United States Patent 11,913,074 (METHODS FOR ASSESSING RISK OF DEVELOPING A VIRAL DISEASE USING A GENETIC TEST) - sequence listing, part 27

SEQ ID NO: 2700 - DNA, 1380245 bp, Homo sapiens
  source 1..1380245: mol_type = genomic DNA
tgtgcaaataatactgtgattcatgttcatgtgtagtggatgatcttgcttttttgtttttgttttttttttttttttgagacagagtctcactctgttgcccaggctggagttcagtggcgtgatctcggctcactgcaacctctgccccccgggttcaagtgattctcctgcctcagcctcccaggaagctgggattacaggtgcctgccaccacgcccagctaatttttgtatttttaatagagacggggtttcatcatcttggccaggctggtcttgaactcctgacctcgtgatccacccacctcggcctcccaaagtgctgggattacaggcatgagccaccgcgcccggcctgctctaacttattttaagaatcactgttctattctggaaagggaaaagaccaccaccaagaagggaaaggagaccatgctggacagcctaatagtctaacaggggatcctagggtgcctgagctcatgggagcaaaccttgttcaggcaccgcaagcccaacgcagcatgcagattgggaaggcgcaataatgcaaacaccatcaggaagaaagctatggatgatggaaaacactgtgtgctccacgtgacagaagggagccacctgatttgtcgcatcgggccagtgtaaggaagtgtaatttagtgggactgccagtgacactaagtcaggccttgatcagggtctggactcagtatggacacgagccactgggtgcagggggctcatgcctgccacctctctttttttcccttactatagagactttgatctgtccaccatttctatgtgagctttgggcttcctgtcacaggtctgttgtcaccgtggggccatgttggagtcggtagattttcagacagtgaagccacatgaagctgtgaatgctgatgtggctgctgcagagcccagtctctccccggtgcagggcctctgagacgacgggactgtcctcagatggttggaagaaatgggttatcttaggcagttaggaaaagagggacaggtgtcccaggatgtggaaaacttgagttcatcccctctcttccctccagcaaggatttcagtgctacatctaaaaagagaagccctgttgccgatttaataatttacagtctctaaatccaaaagggcctccatgtgctagtgagactcatgccctcagttatgttcacgatcttcctgagaagtcagacaatacaggtagaacaaaagatagtggttgtactttctcttctgcgtagtgtgggtaagagcatgcggtttgccgcatgcagtgttgttaatcttttgattgtgttgtgaatggctgaaaaaaaagctgaaagtttgattgaactgaaatccaatccatgtcaacataaggaatattctagtgagtttactgtcctaagagaaggtctctcctggggaacccctggtatgcagagctccctgggacttgcagattggacagagagggtgtgccaaaggggtataaacccttctgatggagagagtcgggcgtgtcttcattttggtagttctggaaaggctcctctttaaagattctgatttaataatgttcacttttgttaagattgaatatcattttgaaatcatttctaaacgtgtttcctttataggcactttatctattaaatttacagtggagccaaatgtattagcaaaatctccaagttgcaaaatgaatactcagaatcaaactatagattttttggtgatactttcagaaaaacaatttctttctaaagttgcaaatcatgaaagggaatgaaagtacattaacttgatttcttccctgtaattcaaacattcaacattcaaattaactttcataatttctcactttgtgacaagttgatttacgcatagttggtatttcattaatgcgatttatatagatggaattcttaaggataaacaaatgtttttgactattgcctggggttctttgggaatagatgctttctgaaaatttaaataagaacattactgttaaagccatgaatctagtttggagaacccactgcagttcattttacagagaaacaccttgtcaatggcatcttcatggtgtttactgaaggtaaaaggcaggatattaaatgtgagaactctctctccagctactgattctgcctgtctcgaattcaggtgagaatgacccatacagatacatggattgcacttgaatctgtgctctggtatttgtgtcatccggaggctgagaacgcctgttggtggtgtcgcagatggctctgctgtcttgtgtggacaaactgaaagggattcaggagcttcttctgtaattttactctgctgtttttcatggacatagtgaaagggatccaggagtttcttctgcaatttggctgtagttggactttgaaaaaaacttgaagagtgtgtgtgcgcgcgcgcgcgtgtgtgtgtgtgtttgaaaagagaattagaaaatgaaggtagacactgggtatgctcccccaggatgtggcgatggggcgcccggccgccctggctacacgtcgaaccagtggtcccccatgcagacgcggttccactcgcagccacagttccagcaccactcgagcctgcactggggctgcggacacttcatgtgcatgcagcctcctgttgggggcagaaaacaaaggtgtggtgggttcgcagcaagtacctggaaaacacgcattcccaaaccagcacgctagcctagacatcactttctgagcgaataatcacaagcaatacaagggcagagagaaacttaactgaggggaaaaacttcataaagcacaatagggcagctctaaagtgatgatattcattaagaaatgaatgaaattgaagcatgtcacttttgtcgggaacaaattttatttgtaaatctgactttattctcctgaaaggggatttagagacaaacacttcatgtttcatagataggggtcaattcctcatttaaatatattcaaatattaatatatttatatttaaaatatataaatatatttttatatatttatatttaaaatatatatatttttatatatttatatttaaaatatatatatttttatatatttatatttaaaatatatatatttttatatatttatatttaaaatatatatatttttatatatttatatttaaaatatatatatttttatatatttatatttaaaatatatatatttttatatatttatatttaaaatatatatatttttatatatttatatttaaaatatatatatttttatatatttatatttaaaatatatatatttttatatatttatatttaaaatatatataaatatattttatatatttatatttaaaatatatataaatatattttatatatttatatttaaaatatatataaatatattttatatatttatatttaaaatatatataaatatattttatatatttatatttaaaatatatataaatatattttatatatttatatttaaaatatatataaatatatttttatatatttatatttaaaatatatataaatatatttttatatatttatatttaaaatatatataaatatatttatatttaaatatattgataaaatttgatgatataacctaatataatgtataataatttaaatatattttgatttatttttgctctttctatagtgccacttacttggcttggccaaattcataaaacaggaactgggatagcatattgtaattattattatttctatttttttttttgagatggagttttgctcttgtcgtccaggctggagtgcagtggcgagatcttggctcactgcaacccccacctcccaggttcaagtgattctctggcctcagcctcccgagtagctgggattacaggcgcccaccaacatgcccagctaatttttgaatttttcgtagagacagggttttgccatgttggccaggctggtctcaaactcctgacctcaagtcatcctcccgcctcggcctcccaaagtgctgggattacaggcgtgagctaccgcacccagccagcatattatttttaatagggaatatgttccttaatgctatccaaaattttaattaagatgagagggatagaaaggaagtaattaataatgctaggtgttctatgtatattatctcatttgcttcccaaagcactttgagataagagcatcactctgctatagaatttccccaaggtgaagcacttttaaatggtgaagacaatgatctcaccaaggtctgtgtgattccaatgtcctgtcattcacagaacaggttattttcagcataagaggaaaagtcccttatcttggaacttattttggaattattcacctccctcacttgttaaacatagactccatgagtttctggagtgcacacagccctgcttcagtcgctgtgggggaactgaagggaggaggaagtgatttgtatgaggatgtacagagaactgtttctgtccaaatttcctggaaaaccccggcaaacgcagtttctttgcttgaatcccacctagcgttgaaggtgctccattactcactcttaccaattatcttgttaattgatttttcctgccaaattttccaagtaattggttcggtgctgtctcacttttattattagaaacctggcatgagaactttcactaatttaaaatatttatgaatatataggaataggcatttgttttaagataacttgccgacatgcaaaatctcctgttttcctaatcctttctggcttgttttaaagatcataaattacagatctgtggaaaataaaggagaaaacttacaacacttttatcttcatactttccacttaggtttgtgccattttcagcacatattgcatggttgtatatttatgatgtaaataatatgttatatggtgtgacattataaaaccacttgtttctctaaaatatcataaatattttatcatatcataaatatatcattattatatcatgtatcgtaaaatatattcaatcaaaattattgagcaatacattaaaacttaatgaactattaaagcaattctaaatgaaagggtaagaaactttcctattgtgatatttaatatatataagcatatataaacacaaatatgtatgaagagtgtgtgtgtgtgtgtgtgtgtgtgtgtgtatatatatatatatattttattttattttattttatttttttgagatggagtctcgctctgtcgcccaggctggagtacagggcgcgatctgggctcactgccacctctgcctcccgggttcaagcaattctcctgcctcagcctctcgagtagttggaattacaggcacctgccaccacgcctggctaaattttgtatttttagtagagacggggtttcaccatgttgaccaggctggtctcaaactcctgacctcgtgatctgcctgccttggcctcccaaagtgctgggattacaggcatgagccaccgcgcctggctgatagatgtgtttttcatacacagtccctggcttataactcccatagctcttgttacagtcttttgtcataatgttggggcaattcaggcctcagaaacaggcgccagaaaagagaatctctccctccgacctttccttgccctccttttaccagcccagggcaggactggaaccatccgcagctgttctgactgtgggttataagacccggatttcagaaagagtcctgtccatcccctggaggaaggaatgctgcacagggaggccaagaagaatctagaccggcaggccttgcagggtctccccactccatcttttagcgtgagatcaaagcctttctgtcccaccgcatttcaacacggctgtccatgcttccatcgtgcctatcccaggaagtctccatagagggccccagaggacagggtttggggagcttccaggttgctgaacacatggaggtttctgatgggcggagcacccagggaaggcttggaagctccgcgacccttcccccatacctcgccctctgcatctcttcatctgtatcttttgtaatatcctttataataaactggtaaatgtgtttccctgagttctgtgagccactgtagcaaataacagaacccaaagagggagtcatgggaatctcaacttgaagccagtcgatcagaacttccggaagcccagacttgagaccggtgagtggcagtcctgtgggactgagcccccagcctgagggatcagacactatttcctggtagacagcgccagggttgaagagcaggacactcagccggtgtccactgcagaactgattgcttgcttggtgcgtggggaaaaacccccgcacattccgtcacagaagtcttctgtgctgactgttgttattgaatgagagaatagaagaagcatgttgtttgttctacacttagaccgaatgccaaaaattaataccaagcatttaatgaatctgggatactagcattgtaaatgatatcttggtacagaagctagaattacaatggcctggtacagtaagaatggaaatgggaagagaagatattcacgtcattagctttcttttctccctagggcttaatatacacaaggccatagagctagacccaggccatggaggagcatggaggaccgcaattctaaaagctttgccagcttaaaagtaagtgcatccaggaagcagctgaaacttcacgcagatttgtggatatagacatgaagggaatatggcttcctttgtagtgagttctgtctgcagatggacactcaaaccatgaaaagctcagcctacgccgggcagtcgacatcgtggctccggccagcaattcttccactagatttaatgagagcgtggaagtccctgaacaacctgaaggcacatttgaggagaagcacacactcagtcagggaatggagccagaatttcatctgcttgagatggaagtgaagaaatttctggagactggagtggattataggagaaagtaccagggtttagcctgtgcttaaaatggaaattcctcgcattctcatttcagcttctctgagggaggaagggcattcctgaaacacagctgagtatgtaacaggccacgaaccttggtgacaaccaggtaacatccttggtcatagaggctatgtcggtttcggttacagtgatgcacttttaaacagtttaggccatcgctaataagcttcaagtctcagcttttctgtttgtaagttaaaaatttggaggtaaaaaattagtgctttcatttatagtacatcacaatatttccaagaaatagcccgacagggagaaactttcctacagtcacgaaccatttgactcctacaactccatctttggaggctgccagcatgttctgagtccagggcagatccgatgaataattttcctgcttctcatcctagaatatctgcctgcctcacaggatcaagtccaagccccaaacctgccattcagggacctcaattctgcatcctacctactgcttcagctgaggctcctgcgtgcggtgcctggaacacgagcagcaggggctgcctccgcacaccggcgcgcgcacacccggtgtctttgctcatgcagtcctggggcctaggacgcctcctcctgctcttccttgccttgctcatatctgctcattcttcaattcttggctggtatcatctcttccaggaagcctcctcctccgggtctgtgtgccctgatagcttgcttcctctatgttattttattaaaaagatcggtttatgtgtatatctctaaactttacaagctaagtttttgtgtgtttgtgttttatttattctttttgagacggagtctcactgtgtcacccaggccgaagtgcaatggtgcaatcttggctcactgcaacctccacctcctgggttcaaccaattcttgtgtctcggcctcccgagtagctgggatcacaggtgcctgccaccacacctagctattttttttttgtatttttactagagacagggtttcaccatgttagtcaggctggtcctgaattcttgaactcaagcgatctgccagcctcggcctcccaaagtgctgggattacaggcgtgagtcaccacgcccggcctacaagctaagttttaattcagcaaatattttttgtccgggctctcttctgggattggagcctagacggtcaaggtccctgatctcaccggcttatgttctaaagagcgacagatggggaacatgtaaatgaacaaattaagcaatgatctgggaaggaagtggtgctatgaaattattattaaactggtgggtgggactcgttgggtaaagggggaagcagacactgagatggaaagggaggagggcagactgggcagaggagaagcccagctcgggcacagcctaagaggcctgagctgacgtccaggagctctggggatggggcagctctcagggtggtcctgaatttcgttagtgggttgggtattatgaccaaccagtagtcatgggacatgagctctccggggaaggggagggagccagaactaattgtcttggcagaggtgatttcccagagggctcaaggccatccacaggcaggccccctgcagagggaatggcagtgcctccccctcgagagatgggatggtgttgacagtgccccccaacaggagggcaggggtctttggcagggtggtaaggggcggtctgactgagaagaggtcagctggggtaagatctgaaggacaggaaggagccagccatgggcagtgacgacacagaagcgtcctggggagaggagcgggactgtgtggttgcaatgtcagtggggacccccggggggaagggcaggactgacatggcctttgagaagtctacacgtctatgtagaggacggatcataaatatgcgagagtggaggcgagagcccttttgggaagctgtgcttggaagaggaggcgggcaagcagggcactggctggggacgtggagtcagaggtgggcagacgctggatcagagcacggggaaggccgtggtgaccggggattgaatgcagggtgaggaagagcatggaatgaaggatgagctttagcttagcggcttgaggaactgggcggtgctgttgactgaggtggggtgcaccctagaggaaaaggttttctaggagcagctagcactctgctttgtgaaatttgagctgtccattgaacaatcagtggagacactaaggaagcagctggctattggagtcggaccgaggggcgagatgagggtggggtgtagatttgggagccatcagtatgtggatagtatttaaggccacaagactgggctgtatgttatgtgtcacaaaggtgaagtgtctcaggtgtccccacaagccgacagtaagtgctgaaccaaacaaccacggaggagagaaacagaaagcaacaggtccaggttcgctgaccacttcctttttttttttttttttttttgagacagagtcttgctctgtcactcaggctggagtgcaatggcatgatctcagctcactgcaaattccgcctcccaggttcaagtaattctcctgcctcaggttcccaagcagttgggactacaggcatgtaccaccatgcccagctaacttttctatttttagtggagacggggtttcgccatgttggccaggctggtctcgaactcctgacctcaggtgatccgcctgccttggcctcccaaagtgctgggattaccggtgtgagccaccactcccagcctcgctgaccacttcttatcttgcaaactgccaccaccagagtctgggctaccgaggaggccactaaggcatggaccccagacctgctgggtaaattctccacctgccgtgcctgtgacgcctgccagaagtgggaacatgggtgggtgtttaaggatcccctttccctccccactgcagacagagacctggctgatttttactaattttctaaggttatacgtcacacatgtttattacagaaaagcataaaaagaaataaagtcctctttggtcctgttatgcctagagctactcactatgacatggtaacatcttgtttccagtctttttcttctgattctattttttcccacacacacatttgtttcaaaacagacatatgtgccacttgctttgaaattctgatttctcactgaggatggatgtaaacctttccgccatgccttcataaccttcatccacacgaatcagagcacgtctcacggagcgtgtttgatgcaccgtctctgttactcctcctgcccatgctgtgaggaagtcccattgaaacccatcttatgaacgagcaaactggtgctcacacagccacagtccatggcagagtcctaactcctgcaacactgcagtgccgggctgtgtgaagctttaccaccgatttatcacaaaataaaccaatctttctcatactgaggcctttagacacttcgatgattttcagtttacgctaatataaataatgctgcagttggcaccttttttcctaaaatgtgtgtgggggtgtgggtgtgtttgcctattatatatttcaggttagtcctttaggatagattttcaaaggtagaattattgggtcaaataatataaagtctttatataggtattgccaaagtggtttccagaaaagttacgctaacttatgatgtcctcaccaaccttgagaattattattaaaaaacaaaacaaacaaaaattaaggccgggcacagtggctcacacccgtaatcccagcttggctttgggaggccaaggcgggtagatcacctgaggtcaggagttcgagaccagcctggccgacatatagtgaaatcccgtctctactaaaaaatataaaaattagctgggtgtgttgcgtacacctgtagtcccagctacttgggaagctgaggcaggagaatctcttgaactcgggaggtggaggttgcagtgaaccgagattacgccattgcaccccagcctgggctacagatcaagactgtctaatctctgtgctttacacccttgtcagcgaaataccaggcctgtttatcccaaaccatcacatatcttctcctgggaagggcccttccgtgttctttccctcccacttcccagtgcacccagtggtggtggagactagagaagctctttccttccatcccatcagtgccttctgctcttttttttttttttttttttttttgagatggagtctcactctgtcgcccaggctggagtgcagtggtgcaatctcggctcactgcaagctctgcctcccgggttcacaccattctcctgcctcagcctccagagtagctgggactacaggcgcccgccaccacacccggctaattttttgtatttttagtagagacggggtttcactgtgttagccaggatggtctcgacctcctgaccttgtgatccacccgcctccgcctcccaaagtgctgggattacaggcgtgagccaccgcgcccggccgccttctgctctttataggtgcatgccaatcccttcattttctaggagcactgctgcatgcaatggagtaataaggacacgctgggtaaattatttattttctctgcaggaagccactgatacagcactaaggacttgtactgagctaagccagcacctgcggctctgggatgtgttcaagcaccgtcttgtttgtattaatgaaaacttcctgaaggacataactgaaaagagagaggcttgagtgcccatcctgggatggccgggcttccctcccgcaagtcagctctgggcaacctgccagccagggcgtagctgatgctcattaaggagaagctgggagaggctgcgcctggcttcgtgtcattgctcatctgtgatggtgccgctgactctgccttgcacacgtacaagtgcatcacattgagaaagggctctcggaccactggttgtgatggctttgccctgagtggcatgtccaggatagacagcaggaagtcccccactggtactgtgagtcatcaggggcaggccacagggatctttaaatatagacgagggtttaattttgaataatgttgcaaagctggggaaggctacagactgacggccggcagacaacagggtcatacggtgcagccatcagcgctggggaaggtcaccagggaggacagaaaaaccacagctgcctcctgactgccacttatcctcaaccactttccatatcttggttctagtttctatatttattccctttccaaccacataaatgctaactgtgtgcctcacatagccatggaactactcactcattaaatatttctgtgtaacaaaaacaataataatagtgataatgggtaacattaatcgaggggttacccaacacaccaggcaccttcagacagcatctcctttaatcctggaatccctgatgggtatgattctcccccaaagagcacacgacatcctcattctctgctcagcacagactcaccatttttttccactggtacatggcagcggggacagggcttggtggttttcttgatggtttctttggaggctgcttcccaacgagcctgctcggcggctctttcatcgactctgtaggcctggggaaacaaagaggaaaggcgtttaatctcagctttctattactgggatcagagtttatgttccctgtacgtcggtacaggaaattcttgaagacaggagtgccttcgggcaagaagcctaaatatcaatgcacttgacaaatgctagacagctactaggcggatggggacactctccctggcatgtggcgtatgcgtaggagcggggaagagattgtttggttttgtagtgtgagctcctctattctgttgttttgcataattgtaataaataacacctatcaggtgcttaaaatgcaggcaaggtgatcaatgctcaaatacacttctcattagacacttcatcagatgtgaagtgaggatctagtttttattccacattgaggattcgatgggtgaaaacatggcccaaagctggtaagtgggagtatcagtgtgactctggaatctttgcttttaaactttgctctacatcttgttatccttccttgcacctggcaaatggggaactccaaatgttgtcacagaagggacaggagcaagaacaggaaatgaagtcgatgtgccagagagggcagtgggagctgtgagtgaagactgtggccctggaaccagctgtctggttcaaatcccagctctacccagacgggtgactctggaaacattccctaagctctctgacagtctttatctctcagatgaaacaccttgtgcattgggggtatggaggattctatgagttaatttcttcaaagactcagaatgactccagtgtggcaagcttttaatacatttgctgacattattcatgtcaccgagagctgggtgctgcctgcaccatcatgtataaggaggttttctggtgggggtggaagcaagaggtcctgggctagctgtgcttgacatctgtgaccttaaggaccagccattcgctgattatccccagataagatgcagcatcaccaaaaacatgaatccaaactttgtcatttcactttcgaattccaagcctttttgaaatgttaaagtttttgagtctttatagatgaagtattatgaggaaaataactgtactgcatttaatagtttctttaggaattagtgttcatgtttctgttatttctgtggaaagtcaattcttccagagccaagatcacatttgagacatcctcatatccccagtttctggcatagaatctggtacacagcaggcgatcagtacatttcaggcaagtgaatgaatgaatgacgcagcccaggaaggcactaaactttcaggggttaccaaatttcaggggttaccaaactttcaggggttaccactaaactttcaggggttaccaaacatccaaaataggaccccgtgaaatgggcagggcacatgggtggtatccctgacagtggtgggggcaccacagacaagctttgcctagggctggtcactgggtgaagccaatttcgtttctgttaatgagccatcatgggcacaaaggaaacacccttgagaactgccagggtgtcacgtgatttgtgaatactttgctagaataacgtggagtcagctgctcggaggcaacggtaggtcaatgagtgcttcctttgctaagatccactcacggcagaggcccagtgagggcgctgtggttagtgagggccatttcacaacttggtaactaggtatgcatcttcatggcacgccttccagtcaccacagagtcttgggtggtcctaaccgtcagtgacacgtggcaaacacccatccccccaccgacctgcaccccaacgccaccccggcctcatgttccacgctgttctttttcaggtctagggctctgtagctctgcagcaatggtttagattgcttgttggtggcaagttggtaagtcatacaaattggagaaaaatacaattttacttatcagaaaataatttcaaaatgccattttttagcaacatggcatactgcatgtgaagggcaatttctcccaggtccacacacctaaaaatgctggatcaaatatggaaaaaaatcttttttaaacgtacggctgatagggtgggaaggcaaaggaaacccttaaagacagcaaatcctcctggttcgggaggaaggaacctggcatttgctgtggggctatcttcttagtcccgcgctgcccatcatctgggtcttcccaggccctaagggcacaggcaggagacaaagcctccagccagagccaggtgggaggtggaatccagttttactacacacagaggacctggactcctgagggtgacgttctcagtggaggaagccagggcaaaagcccgccctgaagagataattgacagatatgtgctggtctcaggctgggttctgtgaggcagcaggtttggaaaacatttttctgaacattcctaaccatcaggcctcggacacgagggttggtgaaaagaattcatcctatctgattagctttaaaaaacctcaagtcaaaaattaatttgaaatattaccagattggcatataccctggaaccaggcggaagcaaaaatatcttttgtggagcacagcactttaaaaagccaaacctcaaggaaattacacaaataaaattctaagaaatctgggatcataataaaaaagttaaaaagtcacctaatacaggagaaaactagctacatgagtgaaagtcacagaattacagaaactacagaatctaaccagcaaaggttgtagatattggaatggccagagacagagtactggccaggcatggtggctcacacctgtaatcccagcactttgggaggctgaggcaggtggatcacttgaggccgggtgttcaagaccagcctggccaacatggtgaaacctcgtctctgctaaaaacacaacgattagccaagcgtggtggtgtgcacctgtagtcccaggtacttgggaggctgaggcaggagaagtacctgaacctggggggcagaggttgcagtgagccgagattttgccactgcattccagtcccggtgatggagtgggactctgtctcaaaaaaacttaactgagtataaactaaatatgtttgttatatttaaataaataaataaaggtgatgataatggaataagagactgtcacaattaaccagggagatgtaaaaaagaaacaaatttctttgttttgtccatttttctggacatgaaacactaataattaaaattagaaactcagttgatgagttacataacaaattagatacaaatgaagagagaatttgtgaactgaaagatggagctgaagaaattacataaaatgccaagaagtaaaaaatatgaaaaggagattaagagatggggggataaggtgagaaggtccagtgtttttctaagtagagttctggaaggagataacaaagagcatgagagagaaacagtgtttggagagagtggcaaaaaaacacacaaattatctacaaagaagttacaattattccccccagctgatttcttaatgcatgggtgctggcagacagtgatggtatcttcaaagcactgacagaaaataccagcccacttagaattctatccaagcaaaattaatttttaagaatgagcataaataaaaacacagtaataaaaaacagcatttcccatcaacagaagttcattaaagaaacatgatttggggccggatgtggtggttcacgcctgtaatccaagcactttgggaggccaaggcaggcggatcatgaggtcaggagattgagaccatcctggctaacatgctgaaaccccatctctactaaaaatacaaaaaattacaaaaaattagctgggcatggtggtgggcgcctgtagtcccagctactcaggaggctgaggcagaagaatggcgtgaacccgggaggctgagcttgcagtgagccgagatcacgccactgcactccagcctgggcagcagagggagactccgtctcaaaaaaaaaaaaaaaaaaagaaaagaaaacaaacaaacaaacatggatgtgggaggccaaggcaggcagatcaccaagtcaggagtttgagaccgtcctgaccaacatggtgaaaccccgtctctactaaaaatacaaaaattagctgggcgcggtggtgggtgcctgtagtcccagctactcaggaggctgaggcaggagaatcatttgaaccgggaggcggaggttgcagtgagccgagatcataccactacactccagcctgggcaacagaacgagactccatctgccaccacccgccccgcaaaaaaaaaaaaaaaaaaaaaaaaaagaaacatggaaataggaaaagtccagaaggagccaggagctgcaagaagaaactgtgagaaaagaaaaagaaaatgggtaacgtatggtaaatcacaggaaatactgattgtctaaaactgtaaacgatgcttaatttgctggttaaaaaaaaaaaatccaagtaggctgtgtgtggtggctcacgcctgtaatcctagcactttgcgaggccaaggcgggtggatcatctgaggtcaggagttcaagatcagcctggccaacacagcgaaaccgtctctactaaaaatacaaaaagtagctgggtgtggtgcccacactactcgaaaggctgaggcaggagaattgcttgaacctgggaggtggaggttgcagtgagccgagatggtgccagtacactccagcctgggcaacggagtgagactttgtctcaaaaaaaaaaaaaaaatcagagtagaactagatgccggacaagaatagcacagaagtgtgagaattggatgattctaatgcgctggcatgattcaggcagagggtccttagatttttttacattaatatatgtttacattctagggtaatcaatacaagagaaagcaatttgcttctaaacaaggaaaaatacagtggaaatggcaaacaaaagagtcaaaagaaaggcaagaagtaaaagtaaaactatagaaatgtagaatgtaatagaaagtataaaataaaatggcagaaatgactgcaaatatcccagcactcccaacccgtgtggacagattatcattgagggcaggtcttgctaaactctagagtcttagcacttatctgggaggccttgtctgcaagaggagcactcaggggctgaagtttctggctcaggtgtgtgcacacctaaagcctttgttacatgttgccaagttaagagcattttcaactgggcgaatacaatgtttattctaacaaaggatgttatactcagcccaagagaaagattcagagctcaacttgaagaaacctcctgcctgtcaatagcacattactggagaggaattacaaactggaaaattgcaaatttatattaatatgctttgttctgtccaggaagaaagattaaagttacagcaaaagaagagaaataattacttttcaaaataccaattttctctgacttccgatcccccgagcacacaaggcagagtgggtataacttgcaggcccaccagaaagccactaggatttccccaaacggctctggatgtaacacctccagcagcaagcgtccttcaaatcaggacactgcaagtttaatacctaggagtgattacaaaagactacccgtgtaaacatttccacactagtgtgcactgagctactggatgggccagttcactcaggggagagggaggtagctaggagggtttgatccttagactggaagagggaaaattgagagcagcaatttctgttttcacctgcaaggatatgtacccttatcatttccttcacagactctgcaactgggccaatgttacttcttccccggatcgatatgttgaaatcctacccaccaaggtgatgctactggaaggtggggcctttgggaggtgattaggtcatgagggtggagctcttatgaagggattcgtgcccttattaaagcaaccccagagagctctcttgcctcttccactgtgagaagatgcagtgagatgccagcagtttgcaggaagagagacctccccagatctagagcctgaggttgaggcttcctgggctgagctttggttcctgtaagccatgggcagcagcgtgggttaagaggcaccctcatgtccacaggacaccagagctgctgaggggccgaggcacacgtgagccaaggagtcaaggaccccctcatggagatgcccacactgaaggtcagagacagagaagaaagcctagggaagagaaaataccccaaaccctaggaaaagaccaaaatgctgatgtcgcaaaatggtttttaatactgttaaagcaaactaagtatggcctaagaaggactccgtacttctgtatttgagtccttgtggtcgaacttagccaagattgaaaacccaacttaggagtgtgtctgacttaatatgtagacaagattgaaagtctaactctagagtatgcaactgtaacaacagctgggtcttggccaatcccagcagccatgcttcagccactcatacactgctgagtgttcaaactgtgttcaaatgaggccgacaccaacttgtaaccagcccgggtgtttctgtacctgacttccgatttctgtccatcacttccctttttgtctataaatttgttctgaccccgaggcacccttggagtctctctgaatctgctgtaattgtgaaggctacccaatttacgaatcgcttttttgttttttttcttgctcaattaaactctgctagatttaatgtgtctgaagttttttggggtttttttgtttccttttttttttttttttttttttttttgagacagagtgtggctctgtcgcccaggctggactgcagtggcgtgatctcggctcactgcaagctccgcctcccgggttcacgccattctcctgcctcagcctcccgagtagctgggactacaggcgcccgccaccacgcccggctaatttttagtagagacggggtttcaccatgttagccgggatggtctcgatctcctgaccttgtgatccacccgcctcggcctcccaaagtgctgggattacaggcgtgagccaccgcgcccggccgtgtctgaagttttaacagtaccaagctaggggagggtgttttagccggcaggacagctacccactttcttttgcagtgggggtggggttcacgctgacctcctgggactgtcaagggcccaggcagatcttggccttgattggagagttaggggttacggtgtagaaaactaataagatgtgtcttttcttttttttttttttctggtagacagtatgtgctcaaaggttatggttttattcctccatagggcatgaagcagttctgttatctaacttagaagtcaaagttcagcattcctttcccaatgaacgacatggcattctgttcctcaaacgctacttgtgctgattttcccattaatctgatgactcagacctcggcacgggctaacacagagctgtgtaggcatggcgctgggacagctgcagggtgttagagggaggggcggccggcgggtccgagaccctgctgcccaggaggggaaggctttgaagaagtaaggacgcttctgttacatgaggaagggcactgtgcggcaggggctctgcccacatcacagaatgtagtaactgcgcatccctgaaggacggagcttgtcattaactatttcagctggagagatcagtctcagaaaactaaataacttcagacccaggccgcctggcctgcgagcagtcggttcagaatcggagccccgagctgcctgggttcatactccaggcccctgcagccttgatttcttcctgtcattatcaagtcacatgctacaaagagggctaagggactaaggctaagatgctgtcatggagatctggaagtccccggggacttttgagagcacagttttcaaacagcttgtggccaggcgcagtggctcacacctgtaatcccagcactctgggaggccagtgcgacggtcaggagttcaagaccagcctgcgaaacatggtgaaaccctgtctctactaaaaatacatataatatttatatatatgtatatatttatatatatttatatatatttgtatatatatttatatatatttgtatatatatttgtatatatatttgtgtatatatatagcaacctcagtcttgatatatatatatatatatatatatatgctgggcctggtggcgcacacatatagtcccagctactcaggaggttgaggcatgagaatcacttgaatccagaaggtggagattgcaccgagccgagctggtgccactgcaatccagactaggcgacagggcaagaatctgtctcaaaacaacaacaacgaaagcaactaccaccaccaccagcacccagcttgtggtaaagacagtgggagaagccacccagcccccctcccctcactgcagtggctcacctgccctccacttgcctgcttcccctggcaccagcactgcaactccactcccagctgcccacccgcccttctgccctgggccatcgctgctgcctggccggttctcccttccccaacctgccgaaagtgctttcaagaaggacaccaggaggccacggctgccaaagctcatgccctttctttgtcattgtctccaactgtcccactgcacctaacatgtgggaaagggtcaccaagaaggcccttggagttcctgcccttctcagcatcacagctcttcctgtgcttcctatcctcacccagcggatccacggggagggaggggagtcccagacccagtgactgctgccactgctgccagccccagggacctggggggcaggagaagcagctctatgacaccccgggagtgggcggtgcccaggccactggtttagacctttgactgccacttccgagaggggatttctaccaggaggagcacatctttgctttgcatccttcatgagtgtcttaatgctgatgtttaaatccttctggagtgatctcaagcagtggctgggtgcccacaggttcaagatcaccaaagcgattctaaaaatgatcccaaggcttgtgtccagactctggagattgggattcagtaggtctgtggcggggtacagaaattagaatccctaaaaatgccctaaggggttgcgaggggcgggaggtttgggaaccattcatcctctggagggcgattctccctttgcgcctgaagaggaacatggtgagctgggtaacttaccctctgttcccgccttagtcatcaagctctaaagcaatgcctgcttattgtgttgccaggaggggaaggttttgttgtgattcagcatcaccgcccgattgtgcaataaagtgtggctctcacggggcagtgtaactgttaggtaattgcatagaattctgtgcctgtctactgctcacccgtggcaggaggaattgcatgcatgcatgtgtgtacgcacgcgtggtggaggtgggggtggaacaggacaagtctctctcctaatatacttcatggctgaaaatagcgatttcataaatatatatatgaaacatctataatatacttatatatagatgtttcatatatatatttcatatgattataggaaatatatttcatatacatatagagagagacagagagaatcaaaattccctcagaaaggtaaaggcatgatcgtccatctgtggctcaagaggaataacctcacaagggtcatcgtgagtaagatcaacacacaaacggcttagcacagagccaggtgcaccctgaatgctaaccgtgtgttttctatgatcaccaccattattactttgttattgtaatcatcacgatcatctctaaagagatgggaatatgaccctgtgggagtttgtacacatggaaaagaccactgaaggcctggattggccttaaatctcctttaaaaacacaagtatgggaggccgaggcaggaggaacacttgagtctaggagttcaaggccagactggtcaatataatgagaccctgtctctataaacacacacacacacacaaaactccactggtaaatcaaaatgtacttatataggttttaaaagctgaattaggctgggcacggtggctcacacctgtaatcccagcactttgggaggccgaggcgggtggatcacgaggtcagatcaaaccatcctggctaacacgatgaaaccccatctctactcaaaatacaaaaaaaaaaaaaaaaaattagccgggcgtggtggcaggcacctgtagtcccacctacttgggaggctgagatgggagaatgacgtgaacctgggaggcagagcttgcagtgagccgagatcgcgccactgcactccagcctgggcgacagagcaagactctgtgtcaaaaaaaaaaaaaaaaaaaagccgaattagcgcctaggagacacattgatatacattgaagctagaataacttaaggaactgcatatgtgttatctttcctgctttaagagaaactcatttgtgacacctgtgtagccaataattagacaagtctattctaatcctaaaaatccatttaagcctgttttccaaaaaagagcagttgtcattaatcatgaaaacagagttggcttaattcagctatgaatgctttcaggtgaatgacagcttttaaatgtcagctttctcatcaacgctcgcctctcttctcacaaacactgaaaccttccacctttgcagacagcagccttcctggctcagtcaagcaggtgggccagttgagcactgctgcgtgtgagcagcccgcctcctgctggtgagtaagaaaatggcatcacttttcaggggccttgagctagtcaacgttactgcttggcaacgggtgtcaccaaaacatgttttgttgttctcacattgtcttatgactatctctttttggagaatatgtatatatgtatatatttaaatgtattttgttatttttttttttgagacgttgtttcgctcctgttgcccaggctggagtgcaatggtgaaatctccgctcactgcaacctccacctcctgggttcaaatgattctgctgcctcggcctctcaagtagctggggttacaggtgcctgctaccacacccggctacttgggaggctgagggaggagacggagtttcaccatgttggccaggctagttttgaactcctgacctcaggtgatctgcccgcctccgtctcccaaagtgcttggattacaggtgtgagccactgcgcccggcctattttgttattttttttaagagaaatcatcagagtgttgggatttaatggggtgtctagccaagggctccggggaatacaaggctacactgtaagcaatacaaggctactccactaagctccaaactccccaagccatgctttagaatgcaattcagaagggcatttgtttttatttatttatctatttttgagacggagttttgctctgtcacctaggctggagtgcaatgacacaatctcggctcactacaacctccacctcctgggttcaagcgattctcatgcctcagcctcctgagtagctgggattacaggcatgcaccaccccacctcgctaatttttgtatttttagtagagatgggatttcatcactttggccaggctgatctcgaattcttgacctcaggtgatctgcctgcctcggcctcccaaagtgctgggattacaggcatgagccaccatgcctggcccagaagggcatttttgacaatgattctaacagtggtgatttctgctaggagtggaatgtgtgccaagtgccacagacgagatcttacagagtcttgccccatggggccctaaatgcttcctaaaggggaagtgaattaaaataatatctatcaacctattttgagattaatgggggaaatggaacaacataaatattaagtagcagaattattaataggtaccatttattggttattttaaaagtgctttgtgttcaactattgttacaagttgacatatgggaaaaatctacacttgagctagaaaatatgctgatttgtatttttgataatgacattctctagtttttggttggcttaggtcagcagtgaccaaaattatccacatagatgggattctgaatgcggaatcatcactaataggatgtgagaggggtcaaagccgaccacagagcctaccttttgtgcaaagtatagttattctggcacaaagtagactattatttttgctagagtgaatgcagaaatattttcattcaagaaacatgtgttgggtgtctaagatgtgccaggcactgtcctggaccctggggatacatcccagtaaacaagagagatgacaaatagcaagccaacaatccctgccttgtggagcttccccattagcagaacggcggctctcagaccagcggcaccggaagcgcttgtgctgtggctcccccactacccctctgggtctgaatccataggtctgggattgcgctcaaggactggcagttcaacaaattcctaggtgatgccgatgtcgctagcctgcagagcttcggagaactactgctcgcagaaggtctacatacactgtggtcaacaaagacagagagaccctattttttttttttttttttttttgagacagggtctcactctgttgcccaggctggagtgctgtggcaagatcatagctcactctagcctggaaatcctgggctctcgagtagctgggactacaggcacatgcttctgtcctctgctgatctttaaaaaatattttttgtagagatggggtctcactttgttgcccaggctggtttcgaattcttagcttcaagtgatcctcccaccctggcctcccaaagtgtggggctgccggtgtgaaccaccacactcggtagggcagaatttttctcttctctgggaaaccgaggtctttgctcgtcaggccttccatggactgggtgaggcccacccacattatagagggtcatctccttgacctcaaagttaactgagtatagatgttaaccacgtctacaaaaataccttcacagcgacaccttgactactgctggttccaacaactgggctgtgtggcccagctacattgacacagaaaattacccatcacagctaggctgaaactcatgtttaagactagatctgtttgacttcaagccccctctgcttgtcttggattcctcagacacgggtgggaacacctagtccttgctgaaagaaggtaaatgcaaccctggagaacagcagtgctgagcctaaatgggctatgcctctgtgcttacaggggtgctgagtttaaacgagctatgcctctgtgtttgcaggggtgctgagtttaaatgtgctatacctctgtgctttgcaggggtgatgagttaaatggccatgcctctgtgcttgcaggggtgatgagttaaatgggctacacctctgtgcttgcggggtgctgagtttaaacgggctatgcctctgtgcttgcaaggaacaagtgtagagcaggtgaaccgttttcctcacacatggtcaacatgcttttctgtggagtgacaatattttgtcccccctgccagccccgtttttaatgaaggaattatgggggccaggatccagctgttagcttttcaaatctgcacacctctcagaaatgctcctcctggggacacagtccttcgattccctcttgcctgttgtcggctgggccactatgcaggcgtggctggggtgcctttcaaagtggcgttcactcccttttcccccaggtcattttatttttgtttctggacaaatccagcattttccttaagggtttagcgccatctggtgcatcagaggcgcactgcagctgcttccctcctgatactgagtggggtgtgcagagaattgccaggggcgctttcctttgaggagctccaaatgcccgtggggtatgcggtgtgtatgtgagtggcgagtgtgtgcagtgttatgtatctgtgtgtggtgtgtgttctgtgtgtatgtgtgttgtgtatatgcgtatgctgtatgtgcagtgtgtgtggtgtgtatgtatgtgtgtgtggtatatgtggtgcgcgtgtgttgtgtgtgtaacgcatggtgtgcatgttatgtatatgtgtgcgccgtgtgtgttgtgtatgtgtggtgtatgtggatgtggtgtgtatgtttatgtgtgtgtggtgcatatgtgtggtgtgtgtgatgggtgtgtggtgcatatgggtggtgtgtgtgatgggtgtgtggtgtgtgtggtgtgtgtgatgtatgtgtggtgtgtgtaatgggtgtgtggtgcatgtgtgtggtgtgtgatgtgtgtgtggtgtgtgtaatgggtgtgtggtgcatgtgtgtggtgtgtgtatgtgtgtatgtgtgtggcatgtgtgatgtatgtgtggtgtgtgtgtatgtgtgatgtgtgttatatatgtgtggtgtgtatgtgtgatgtgtgcgttatgtttatgtgtgtggcatgtgtgacatatgtgtggtgtgtgtgtgtgtgtggtgtgtagctgtgacaataagtttctataaaaatattttccacattgcgaacttgttctagctgcttgtttatggagtctagtacacagggtatacagggtatagacttgcaaagtcggttcagaatttacattcagaccttttttaccaactctgctgggatcctgaaacccctctggaatccaaaagccttcaggacagcatcattttcagaggagggtcccatgtgtcaggccaggcaggcatctggtggaggctgcactgtggccgtgcagaggaagactcaggggacccgcaggctgtgacccctacaggtgagtgagctcaggggacccgcaggccgtgacccccacaggtgagcgagctcaggggacccgcaggccatgcccctcaaggcagaactcctgggggtggagggaaccccccgggggtgctgaggctcctgcagagggaggacgcccctggccggaagctgcaccccagggaagtgcgttgcagagccttggtgctctgccgtgctggagtgacagtccagaagagaagaagggtttctgcagtgcaggagagcgcttggagagccccagccccaggtctgcatggtcaggatcggcctccaggggcaggcgtgtggtgtcactgtgtgtgtacccacgcaagcatgccttcacttgtctttcaatcccagtcaatcttatctttcctttcctctctccacagtgcctgacagttttagcattcagccttaaaaacccaaacccccaagtttcaccattttgtaatactttgcaacttacaaacggcgaaacacacactcatttcattatttatagcttggtagatcttactggctctgtgtggcaggcgacgaaaaggctgtgagcctttgagcaacttgcctggaagaggaggaaatgaaaccgggcctttgacgacctgccaagggccatttctgctgccccagagcaaaccttcgcacacaagctgagtgccttggaaacgcactgcagaggggcgggtgctgtcctggcactgactcagcttttcacagcgcaaggccgagcccgaacgacgcgctggctttaatggagatctgtcgcagccgttccatcccatctgcacatccacttaggcggcgggtccagggtcatggattcaagagaagtggcatcaaacctgctttacttaaaccaacaagcagttcagaaaatacactcccaaataaccggggatctagatctccgggaataataaattacacccatctcccaatactgggactgcatttgtgtgtgaaggcagtcaatggctgagagacggctctgcggtgagatgctggggcaaaatagatcaaaaaagatctcagctccctggagccactgctgcttcagtgtcctccactgagggaggtgcacctcctagcctctcctggactgtaactctgaaggggtgggtgtgggtgtggggagcatggataaggggcagttcgttggagattgtcagtcttgcatcttgatcgctggctccagcctggattctcctctgaggtggtctaggcatccactcctttccccactgaacccctagctgagatgtccacaatgaatgtgtgtctccccgaacaacctgcttttgtttctgtctcctcttccagccaatggcaccaccatcgttctaagctagacattcatgcatcaacattaacccgtctcctctcatcctgtcttctaatccactgccaagttctgcagatccgacctcaagcccatcccctcctctgtattccctggccggattcctggtgcctggtgtgtctctggtttggcccttttagggggtgctctgctctgctcccagtcccaccaccttgggactgaggtcacaccgtcacatcacggcgatagggcagctcacgcccagtggtggagggtggatgcgaagggctcacctctagcctcctacctctggctcccctcagtcttctgtggcaaccgcactgcagtgggactccacctctgcccaaccctgcttccttctcttcctgaaggtgctgttgagagcaccccaagacactccctgcctgcaagtctcagagcctgttctcctgggaacctataacctgtggcacttggtgcctggatagtcctaggaagcaaactctaaaatggagttagagctggaatccctcccgccagtggccaaagaggagcctgtcactgttggaagaaagtgctggaagctctgagtggggccccgaggagcaaagggcagggtcaggcggcatgcaagcgccctgtctctgcggctgtgcacgcaggcagaccctgtggattccaggtgtctgtggagggaaaagaggtcacgtggggctacctgcgggccaataagagcatcccagcaaagattttgggggttcagcagctgagaacgatggaccatttgaaagagagcccctggcacgctaccgagccctgtggagttggagcatctgtgcagcaattgtcataagacagaagtggggcatctaggcccaggcccaagcaggcccacggggcgtgagcgagctgcacaagcaggtcctcagacccccgtgccatccacaccgtggcatgactgcctctccttgggctcacaaccatggccccacggtggtagtggccgggctggggagattccttatgacacactgagggatccaagcttggttcacaattgagttagcttaacatacggctgcaagccaaaaatgcactgtcgctatcctgtaatcctctttagggttgaaagagtggtgaggggagaccctgtcaataagcagagccttgggcaacgcaactgctatggtccgagtgtttgtgtctccccagattcctatgtcgaaacctaatcaccaaggcggtgggattaggaggtgaggcctttgcaaggtgattgggtcataagtcagagccctcgggaatgggattagtgcccttataaagagagggcattaaccagtcacctctcatcctgtgaggccccagagagctgtcttgccccttctaccatgtgagggtatagctagaagacgtcatctacaaaccaaaaagtggtccctcatgagaccccaaatctgctagtgcattcatctttgacttctgagcctccagaactggaaggaataaatgtgtgttgtttataagccagccagtctacggtattgagtgacagcagcccaaacagatgaggcagcagctgacagtggactgtgtgtggaaaggaaagagtcctgagttaggaagagatacaagctcctaagcagtggcaaacgtcttggcagcctctttaagggcagggacagagaaaatctggaagactgaggacaggtaagacaaggagctctgcagagcaggcacgtggacagacccatgggaggggcaggacatgtccgcatgtttgcacagcatggcagagctcacaggagagcacttcaacaagcagatggagggatccggccagtggaccactgccagcctccgccactggccacagcagtcctgggccagggcactcccgtgtggaggaagcgtggtggtgaggtgaagccctgccaggccccccagctcgggcatccccccatctgccacaccgccaacattcaacctgccggcaacaaagagcggcacggagtcctgtgtgtcctccactcctcgaggagaccaactaactggccagtgggtgtcaggtggatcacagtgacaccagggaagatgaagacactccatcttgacaggaagtgactccttttctgggtgtgggtttgcctttcttggcaacagagcctcagccagcactagcatctgcaggctgccggcaccctgcatggcactgcattgtgtcccagtgggtgcatacccatgggaacactggtcctgtcacacatcctactgcccagaagctgttgacctgatgagacggatggaccaggcttgcacgatgccgctggagctgcactgtgatgtgggcgctatcctctaaggtgagatttacactctgaatcaacaactaccatggtgcagggtgtgtctccagcaggtagaacgcaatggttcaggaatcaaggggtggaagtagggacggccccacttctcactcccagtggtccacttggagtttatgctctccatctgtgcaacctggccttgcatatataggggccctggcttccagcaagagagtacttttgccagagaacacagcaagagttctggtcactttatgttgcattgccaagggattagcaggctagaaagggagttgccatcctggaaggggtaactgactctcaggagcaggcagggctgcagttatagaatggggtatttaaatgggaagaatgcatttggcacccaggtggttcactgtggcatctcttggtcctcccctgcccaatgttgatagcaaatcattcagtagtcatggctttagaatggcacccaggagcctggacccatcagggatgatgtctgtgtcaccccaccaggtaagccacctagaggtcttctctaagggcgaggggaatctagaatgagtaggagagaaggaagtcaatgggagtcagctgcaacttcaagaccagctgtggcagcatgagctacatatagtttaccctgctaaccttccatttgtacatttctccagtctctctcattccacaagcaaatgtctccaggcagtgcaaggggcagacgacagcagatgctgtgaggctggccagacccctcctccaggactgatatccctgctgctgggtatgtccgcagcagacagctctctgccaagtctctacccgggaagtgcccccagctgaagaaagctgcttcacccaaagcctttcttccttctgcgggaagcccacatcgaaaacctggtctatgcatagggatgtaaggcctgaccactctgtgtccatgcacaacaactcagaaggctcatccagctccagagctccttctaggacctgctgtggcaactgcacggcagttcagccttccttcaaactgcttcatgcgattccccacagcatcctccagtacacagtctgcactcgaatctcaagcagctcagggttttcttcctggaaaacatgtactattacaattccctactaagtgtttttcatattacagccagagatctttcgaaagcacccatctgatgacgtcaatctttaaaaaatctccagatgccttctcactgccctaaatcccaagctcctgcctgtggctgataaggcccttcatttcctggctccgtctccagcctagtctgtggccacagccaccatcactttatggcacagtcaagggagtgtcttccacctccctgaacgtgtcattcatgctcatctccagaactttacacaccctgtccctttgcttaggacacccataagttccttccctgcctgaagagctcatccctgtaggtctcaaatttcacttctttcaatgaacaattcctccaaccccgtggagaactggccaggtcccacttttatgcttccaaagcatcctgaacactctctcgtgcctcttagcatacaacattttaattatttgtcaaactgtttttctacttcactagattacaaaccctatgagaacagtggccaagtccaaagtccaagtctatcttttttttttttttttttttttggagacagagtcttgcactgttgcctgggctggagtgcagtggcaacctccacctcccagctttaagcgattttcctgcctcagcctcccaccaagtctatctttaatgttgtatccaaaatgcctagtactatgcgtggtaataaaaggtgctttataaatgtgtactgagcatccttcttcttccttctttccactaattataagaaattcacagttgaaatgaggttcaaaggcacataatgtaggaagtgtaacacaacgttgcagccaaaattccacttatagatgtgtttaagatttaaaaaaatgttaattctcaacatttaaaaataaagatatttaacaaaaacgcatggattttatgctactgacatcacaaaatcacactggaaggcctggtaccattgggctcacatttctgctgggtaaacatggacctgaactggggagctgtgtagcaggtgtctccccaacaccccacaacaagccatgcccactccagtttgccacagaccacccccacccgccccagcatggggctatgtgtcattatgcttgcaggcttttgtgttgatgtgtttttgttgttctgtttgttttaataggaaaagcagaagaaaatgaaatttatctttgcatccttatcaaaatattgacaggtccatgaagcaggcttcaactctgcctcactcatttaagggttgtgttgctgttggcatttgagttggccatccctggtattgtgtttgacaagccaacaacagcccactcatccccctctttcaaaaggcagagtgaccagtaagaacaatggaagcgcatttctgcttcactgggactggagtggtcatcagtgctggctggtgcagctcccaaagacctgggtaaaataatggtctggggcttgtcaactctatgcccctgggtggccactctccctccctctcccttgcctatggacaaaatctatcacaaaaacttgagataagcctcagaataagatggtgtacgtgaaagtgctttgtaatcaagcacgatacaagtgcatatcccaagcaaattattatatttatcccaagcaaatggtgggtttatttttctaatttaggaggcagatggaaggaactgaggtttactgtggaaatctaattttcttttatgattcaaaagattactgagacataatccagccctgaagctactgtctattcttttcctgtacttacccagcttcatggtagggagggaggtgtgtggatgaaggagggatttgtcattcattcaacaaacacttaatgagcacctactctgtgccaggcactgcaggatacaggatgcgacaggcacaaaccctccactaacaaagcccagactttttaggccgggcgcagtggctcatgcctgtaatcccagcacttcgggaggccaaggcgggtggatcacgaggtcaggagattgagaccatcctggctaacacagtgaaaccccgtctctaccaaaaatacaaaaaattagccgggtgcagtagcaggtgcctgtagtttcagctacttggaaggctggggcaggagaatggcgtgaacccgggaggcagagcttgcagtgagccaagatagcgccattgtagtccggcctgggtgaaagagcgagactccatctcaaaaaaaaaaaaaaaaaaaaaatcaaaacaaaaacaaacaaacaaacaaacaaaacaaagcccagactttttgtgaagatacagagaaacgatatttcaagtgacgaatgtatcagaatgtacagttgtctgaaagcttacaggatgtagtggggagggcagatggcttctgggaggaggtaacatgatctgggcctagaatgttgagcaggaggcatggttggtaggcaggcatgggcacattcccctcagacactgtagatctattagagagagcagttgctgatccccaactacttaggtaaagtatagccactgaaattgatctcttctgcggctttagagagcaccactaaaaatctggaagtctcagtctgcactcctgctgaatagggagaggaacatcaactacctagaaccagtttatgtggcttttgcaagagcaagtgtgtagttattagcaagcctccaggggcaatacgcggaaggaactggaacacggggaggagaacaagcagggaaaaacaaggaaagcaaacgggactggactctcgttagtctgtgatggattgatcttctgtcactgctttcccaaactcccagcagtttcaacgtaaagcttgttcaatattttaaaaccaatttaaagccaatttttgagtttgctttaaagaattattgcattaatcaaaaaatacattaagttttaggtccaacagtctaactgataggaaaagctgattgggactcaagagaaatgggctctcctggctggagcatgtaatgtgcaagaacagaaaccaatcaatgctaaagggaagaacagcagaaacgagtcacaaatggctcaaagcaaagaaccctgcaactgaatggaattgaaagaaagtgtgaagagggctgatgagggtatttagttattattagcaaaattcagatgtgagaacacatctaaagccttcggttccaagggaggctgcaattgggctttcattgtgagatgtgtagagtgtcatcctttcaaagatttcaggtcaatgaaactgcagaggtcatcctcctggagaccatgctgcttgagagaaatgtagggaacagaaaataagccagctctatgaaaataaaagcccttcattctgttatcaaatcgaattgggtcatgaaatttgaagaaatagcttgtttggttcgtgccttcccacatccaaaagcagctatggttgaaataaggaaacttgggaagattggtaaattcgctcatagagaaggtgctggtaattctgtattctttcccctctctgctttgcatctggaaggctggctcccatgggctgtgcccctaggatcccttgtgtctggcttcggtggggtatggcccatgggagacattagcaagagatcggatggcaggaggcaggaggcaagatgtccatgctcactcccttcctgtgtggggctacttccaggcaacgctggatgctccgtgatgacacctcctgtcatgaggccccttctccatggctgcagctcatggggttcatgggactcttcctccccctgcctttacaggcctggggtggtcatggctccccagtgatgctcgctctgaggccctcagccctgtgatggttcctgtgtccccagcccgcctctgcaggtcatccctttcattaacatctcctcctgtgcccatctgggttggcttctctctcccgagggaccctgaccgaatcagagacgtaggaaaacatggcagcaaagaccccaattagttgctttccgttgtctggcaactgttcaccagcagacatctttttagtttggctggttggtttgctttgttttcaaataagaggaattggaggctggccctgtgatcaggaaccagaagcaggaagagcctcatctcctgggggggtctaactgcagggctgcttcatcctgagttctttctgggatgaccctgatgtggattaactatacctcctcagaattcctatcatgtcagttgcttgtgcaacctctgtggcatctattgaagccgtagaaactccatgggagcagggacgttgtcttactctttgtcccgagggcctagaaccatgcctaacatattacgggtgtttaatgcatatttgttgaatgaatgaaataatgtctcatggggcgcagtggctcacgcctgtcatctcagtactttgggaggcttgcttgagctcaggagttcaagaccccagcctgggcaacatgctgaaaccctgtctctacaaaaaatacaaaaagtagcctggtgtggtggcatgtgcctgcagttccagttacttgggaggctgaggtggcagggttgcctgagccaaggataaggagtctgcagtgagccaagatcataccactgcaccccagcctgggcaacacagtgagaccctggttcaaaaaaaatgaaataatgtctctttctttatagatgctgccatcactcaacaaaccatctattaaatgtctgtgcagcagatgtcatcttgggcctggagacacaggggaacagaggacacagtctggttgaagaggttctggcttctgcaactttgcccatgtggcaccctctgctggaatgtcctttaccacaccatcctgctgtcctgaccaactctgacccatcttctgtgacttttccagggaaacctggaagtgttttatataaagctatagagttgctaagctttggtttagcatattactgtaattacgatattcattttccagtaaatctccccccatggctcccctatgagcctctaaagggaaatacacttttcttttctttttttgagggggtggggatggagtctcactctgtcaccaggctggagtgcagtggtgcgatctcagctcactgcaacctccacctcccgggttcaagcgattctcctgcctcagcctcctgaatagctgggattacaggtgcacgccaccacacccagctaatttttgtatttttagtagagacggggtttcaccatgttggccaggctgatctcaatctcttgacctcatgatccgcccacctcggcctcccaaagtgctgggattacaggcataagccacctcgcccggccgggaaatatacttttcaatgcatttttctagagagtctagcagctgcttgacccacccaaatgctcaacttaatgtctgctaattgacactatttgcagacacagttcccccgatgctggacatctatggtttaggtcatctctaactttctttttcctatttttctgaatccaatattaaggttttaacaatttaaaaacatttaatttgggctaccttaatctttaacaccaaggctggatggttcctcttgactgaagaatgaatgggattagagggagggtcaggcgcctggatggctttaggttaagcaatgctcttctttcccttacagctactgtttccaaataaatactgtagatgccagagtatcactttgtggaagcctctgccatgtttgcagtctcagagcatatggatgtaaattgctagactaactccgtttcccagagcctcaggtatacccgcctccattacagcggtcctgaggcaggggtctctgggccattattgcttttgctgtcagtacctggtaagctcgcgtttgaatgtccctgagctaaaataaaattaacagaaagagcatttgctgcctgggctatggaaatggcaactcagtcctaaatccactcatatgctcatggctggcaatttaggagcagacgagaagacccaaattcaccagttctatttatttagttatgctaatattggataaactcatctgcagaattccatatagggatacacttattcatgctctgattttagagcattcagatctttaacattctctattgtaaaatcaaaatattctgggatttctatgtctgtttactaggttcctatcagtacaatgactaaaggatttatttgcaaagatttggtgtttaaacccttgttaacatctacattgggagaaaaataatgagcaaattcatctactgtgatgacgtttttactctttttccctgaaggtttggttgatcctaattaataaataaaataaaatgcatttgcactttcctaagactgagatagcaccttagagagtgaggctcggccaacacattctttacttaatgaggactgaaacaccagttagcatagggcatgatgctgctaaaggacaatgatatccttacataatgtcatctttctgtacatgccactcacagaggtattttcaccagagattctaaactagggcattaaaaacattgaagtagacttagtatggatttctctgatttagacactgttaagttgttttatttcccctctaaggactcctttgaaaatgctcacatgccttgtccctgttccatatctgcccagggaaaagctattttggacatgccccaagtggccactgggaagtctacactgtgccccaaggaggggagtcattctgggagaagccacggccccattcccatggctgtcagctaccagtctgcttcttgcttttttagaatggaactctccatgacctccaggaaacggctccagtcccccactgtatccggagccctgcttggaggaatgagtagggcattctgtacctgagtagttgttcctgaggcttcaaatacggcactgcactccccttcatggtacgcttctttacattcccggcagaaggcaaactgcaaaagaacacacatccattaattagggacattaggttgcatttggcaataacacatttttccttttccaaattcattatattcattcctctggcttgtgcaacagtttctgtataaaaatactttttttgcaaagagaaatcaagttatgttttgatgggattgttcactctttactcaagagtgttccaagcaccatagcagggctacagagatgatgggtcacatttccttccctcaagatgtttccagtctagtggaagacacagtgatatggtttggctgtgtccccacccaaatctcatcttgaattgtagttcccataatccccatgtgtcatgggaaagacctggtgggaggtaattgaatcatggggatgatttctcccatgctattcttgtgatagtgagtgagttctcacgagatctgacggttttacaatgggcttcccccttcgctcagctctcattcttctccttcctgccaccatgtgaagaaggatgtgtttgcttccccttccaccatgattgtgaatttcctgaggcctactcagccctgcacaaatgtgaatcaattgaacctctttcctttataaattatccagtctcgggtatgtccttatagcagtgtgagaacagactaatacacacagtaatgcaaataaatacccacagcaaagtttaattggtattagaatgtaaggaaaaaacttcattcaagacattccctttaatatttgtttacattcaatatttgtttgcattcacagaagatttatatgcccatgtcagtggacttactttcgtattaaaagcctattatggaaaaagaaatgggtggctatgggctgaaccgtgcccccacataatggataggtggaagcaggacctcagaaagtaactgtatttggagacagggcctttaaagtggtaaagggaagatgaggttgttaggggaggccttcttcaatctgactggtgtccttacaagatgaggagattaggacagagacacacggactgagagatgatgagcagcattcaccatgggactgaagacgcccaaggaaccaatgccctctacccgccatcgtacaaagaagaaagctggaagagtgaatgccagagaggctcgtttagggctgtctgtctgggatccatggacctctcctgaaagcacgtcccattctcatcgccaccagccatgctctgaagttactgtcacggttgagttgtggatcagcagtggaacacaccagactggagtcatcatcccatcccctgccacctgaaacaccttgggaaagccaccttggtttctgtgccttggtttccaccttggaaatgctaggataacagcgatagctttctcatatgacccctgggagaggtagtgagatagcacatgctgagtggctacaatcacagcatacaatgtgttctaaactttaaggagataagaacaacagggactattttgcccctactccatttcataggaaggagtttcctcaccagaaaactggtttctttcaatggaactttctttaataagttgtaggcaacatctcccacagcagaaactgtattcagagaaggcatttcagcagaggagagagtgccatccacaagtatggtgtgtggatgatggtggtggtcttagagcatagaggcaaactgacagtatcctctttcccttgagaggtgggctttatgtctcttctgctgacagccagatgtgttgagtacttgactcctagaatatggtagaaatgatggtgtaccactttctaggcccaggcctcaagaaaccagaagcttccatttcctgttgggacacttgctcttgaagcccagctgccatatggtaaggaagctcaacagcccatgggagccccacatggagaagagctgcggcctcagccgcaacaatagccctgtctgagcttttagtagacagccagcaccaacttgccagctatgtgactgggtcatattccaagtagactgttgttatttgaaatcattaaagtttagggtggtttttacacagcaataaataactgatacagtaataaataagaatataatatgctgaaagtagtgtctggaagattcaaaaatttacagagacttacaagttctcaaactaatattttatagtataagttaggaatttagcctaattttgcttaagacaggactgatttgaattgaaaaacaaaaataatagaaaccaggatataaaaccaactctatcccaaaatataccataattcctccttgcctcaaaaaagaatggcttttactcaacactatttttccttcatgttgtcttcaccatgtgaacagagttttctcctttcctacgtccaatttcttgttttaaaagttcatctgaaaagtattttaatctcaggacatcagaaacaaaaaggaaaagcattttataaggaaacaatctcttcagagatatgccacaattgatcttcaagccatcacttttagcatattatattcttatttcttctcacagcagagagactgaactcaaatttagtgaaatgtaaactttatttaaaggttggtgggacagcgtgtgtgcatcagaacgtccttacacaaatcaccaacattacctggtttcagcttctgacatcttattttctctgaactaaaagcgaattcactgaatagtgagttgagttctaggattttctcctatttttaaaaacatttatctgttaatacttgggtctgcctcacactcattcctctgctcttacatgctttgttggaaaaatgtggacgggaggcccaatcatggagaactggcaatggggtctcagcccactgctttctagagaagcaaatcttatctgttggtgtgaaagggaaaaccgttcacatcttattagctcgtggatgagatataaaatcagtttcatggtagaggaacaccctggaggctgatcagtttgtcagaataaataggcttttcctgacacaaagacattaaattccctttcacaccagtactacaaagaatggactattgagaaataagagaaagggaagagcatatcaaatgaaagcctccccactttagcatggcaaaaggcaagcaaatgctgcaggaatattccggtgatgacttcacagggaggcactggctaatttgcttctattcaaagtataatttaaatttagatctatcatgcagtggtccttcccaattaagtaacatgaatctgtctcatgtgcaatgtagaaggtctgatttgatcttgaaaatgtttgggttttcaattacattatccaggactcaagactctcaaccttcagttctcacactacgcaccagagtgccctgcggtactgtaacaaactcacaggggtgcctgggatattctagaattttaagtaaaacacagcatggctattgaacactatgtgatttattaactcaaggtagttcccagtgttaatgtagattgtgctattttccttttggtgacattgtatctttgcaaaggtgggcttttggaagttaccagaatagaaaacaaataccatgtaaacatccatttggaacaaagatgtgatttatttatttatttatttattgagacagagtcttgctctgttgcccaggctggagtgcagtggcaccatctcggctcactgcaacctccgcctcccgggttcaagcaattctcccgtctcagcctcctgagtagctgggactacaggcgcctgccaccacgcccggctaatttttgtatttttagtaaagacgggatttcaccatgttggtcaggctggtcttgaactcctgacctcaggtgatccacccgcctcggcctcccaaagtgctgggattacaggcatgagccaccgtgcctggccaagacgtgattatttttaagaataaaataaagctaatttttccttccatttgtgtgaattatcatttcagataactattaagtcgttatgacattaattcttactatgctacgtggtacaaaacctttcataaccacaactgttaggcatttcttttggcctagaaataccgtgaaaaatgtactgaaccgctaagggcatggggaacagaattctggggaactctgggttaggcagatacaaaactccttcttaagacagtgttcgggccagtttgcaaacacttcccatggcatagctgtttctagagaaaaagcttgccggggaagaaagcagacctagctccaacattttcacatccattctgctgagctgcatgtctcatatctggggcgcctggatccttctttaaccaaccatgtagaaggctgaaatttacccagggatttgctattacttaaaaatggtcttacatttgctgaggctcccttaagctgcataatacctctccaaaccttatgagtcaacattaaccgaatggaagttagtataccaggaaacatggagtcctgtttataccgtatacattttcaggattgtcttctcttgtggtggatctaacaaatgtgatccatttccgtagagttgtttttttttttcgagaaattttaaatgtctttaaacaatcataaaataatacatacttatttcattggctctctaaagtctattcccttatagatttggttagaaggcaatcaaacacatggactgtattatagtccctgtgacgagagtttatgtattaacttggctaggctatggtcctcagttactcaagcagacactaatcttggtgtttctgtgaagctttcttgtagatgtgactaggatctataatcagtttattttaagtaagagagattatcctagataacctgaagggggctgattcaatctgtggaaaggcctaagagcataactgagccttccctgaggaagaagagatttcacctgtggacagcagcgtcaggctgtgctcaagagttccagcctgcccttcctgatggccactctgtggatttaggaggtgcctacccagccctgaaaccgtgtaagccacttccttccagtaaatctctccatatatctgtgtatacacagatatatagatacaatgtgtgcctgcatgtatatatatgtagggatatacacatatatatgcatatatgtgtgtatgtgtatgtatatttgatataagcatcctgctggtctggtctctctggtgaagctctggctgataaagctcctatagaaacaaattatttttaatagagacggggtttcaccgtcttggccaagctggtctcgaaccctgacctcgtgatccgcctgcctcggcctcccaaagtgctgggattacaggtgtgaaccaccaatacaaaaattagctggcatggtggcaggcacctgtaatcccagctacttgggaggctgaggcaggagaaccgtttgaaccctggaggcggaggttgcagtgagccaagattgtgccattgcactccagcctgggtgacagggtgagactctgtctccaaaaaaaaagaaaaagaaaaaatttaacaaggtcactttattcccaatcttttgcaaaagaactgatgtaatgaaaactatttaaactttccctgttatttgcaaaattatagttcaaacctctctctctctctctctctctctctcgctatatatatatacatatataaattccaggtagccatatggcaaattcctctcagaattcaacaccaggagaaagttcaccacttccaacagtgtggtggtttcctttcatttgacaataaacatggtcacctaatacattctccttggtatgttttcaagcttgagagcttggtgccacacttttaacttaattctagtcatcagcttatcctaaatgcctaaaaggaggtatagaataaaaaaaaaaagatttaatagaggctaaattcaataagccaatttttttctattgcataatagctaaactattcttaacattgaagtcatatttttgtcttgcaactaatatgtgttgagtatttacttttaggatgagtaaaatcttggccctaggcaacatataaaagaatagcacattttaatctgtgaaatcgtgtactagatctttacatgtttaaataccagatgtagattagtgtttagaagtgaaccctttgaggtagagagacccggagtctgaggcctcttggatcatttattatctgtgtgatcccaacatctctttgcttgagcttttttgcatctacaaagaagaaataataagataaagaatatttaacacagtttctggtacacagtaaacacaacaacacaacaaatagttttctccatggggctatgatgtttaacaagtggtaagagtctgtagaaaaataagagggtagtaagcgccttgttaattaaagcagttcccagtatactgataataatgactgttatgtgaatctcgggtaaaactgacacctccccagaaatgccacacttgtaaactactcataagacataagactgctgtctagaaagggatgaggcctctctttgctggtatacatgctgaggtaagtcactgtcagcccccttagacgctctgtactaccagagagctatgtgaatggcccatcatgcctctcattcaatatcatgtcagtgcagtagtcatttgattgatgtttgagtttgctttcccatatttccataatgaacacattcaaaaggggctgtatgtgtactttctctgtggaagcatgaaaaggaagcaaatgaacagcttctaatgcaatcggaatattccagtggctgctgatcaatcaggttgagagccagtaggtacctacaagcaatgacccttaaaataaggcttgatgatgatctctctatggaagccaagatttctttgtgcctgttttctatcatggctgcatctattataaaagcattctattatgtgcatttatttttcttccacggctctgaaattctgtgttaaaagaataggagagaatcaaataccatcttaggaccccttactagagtcaaggcaaacatcaaaggcatgaagcacacatttgtacttctttgggaatagatgaaatatttttctttttggtgtgtagctttccagaagatggcagcagagatacgtaagtccagcctctgtaaagggaatctatcaagagaggaagtctccctatgagtcaccagccgctgatatatgcaaaactcgttctgacaagacagtgccacagaacggagatggtgttagattataatgcattaaaacacaattttgaaaagaagaaagtaaggttatttcctttcaagtacacaacatcttaaaatcacagactctcatggtgtgaggcaatcttaaactgtgctaagctccaaatgcaaacagacgaagacagtgttctatgtgtggtctccaaagggctaaaaagaaagaattttcaggaggctggatacagctctgtagagtacccacgttcctttgtctttcacaaattctgtactaatccccagggatattaaacaatgccaattagtttcccacaaaatattgtgacctccaacaccctgcagccctaggcttatttttgttttaggtttgctctttgaacaggtccttactttctttggtttaatttccattcttgcaagctctgaaaagatccccgaaaatccccttttcttacaccaacatctatcatcatgcgcgtgcacgtaaccatcccatctttcagttgtgcagtctgcactgacccactcactatgagtaccgtctagtaggaaactttagtaccacctgtctcagaactagggcccctcagagaagatgagttcatgcaatgaggagaaaagacccactgagcttactttcaacaggctgacctcagcacctcacattaaaagatccatgataaggtggtcctcctgacaatggttctgctgggaattaactatccagtctataattacggacaaagacatttacatttacttcctactccaaaatagttttgatttttaccataacttaaagggaaaataaacttaaaaatgtgtattggccatttatttttttcttttctttaagagcgttactgaaatatcatttgcagagtcatggatttttaaaaagtaggtattctttgaatgcaaaatatgtgcaggtagcacagattcaaaaggtacattgtgaaaaatgtctcctttcctccttggtcagctacatagcttcccagagacaatcactgtcacctgtttgtataggtattgttccagaaatatgttctgcactcaatcatcaatttatgctatttttaaacaaaaataccctataaaacattgtataatgtgctgtactctgcttgttggtttttcgtttaatgcatgctacagatggctgtctattagcacacggagagctgctccattcttcctgaacagccacacaatattccagtggatagatgtgccttcgttcatttcaccagcccctccgatcagcatttaggtccttccaatattttgccatgacaaacaaagctgcagggaatgtcccgctcttcaggtcatttcacacatgtgaaaggaaatctgtagcagaaatttctagacatgaaatagctgggtccaagggcatatggactttccattttgattgctttcgcgagccttgtcagtcacaggcttagcagcaaggtgggtggaagctgcttccccaacacgctgtggtctcaaccaccgcctttgtcaagctgctttaaaagaatatcaaatacatcccagcacttttgctaagaccttctttatacatgttttgtcaccacagagttgtgttcctagccaaagcaattactctgaccacgtttaagtcttgtctacacagccaaagctgggtcaggagtggcctgtggtcaggctcactctgactttcctcagctcaacacacatggagctggtcgtctcattctgatgggcctgaatctggcccgcctgccaggaaaggacttgtaatgaatttaagctcagcggctttaaacacagacagccaacaaattagaggtccaggttagagagaaagaaacagtgaatgggggaacggcagcttccctcacttgtggctgtgtcgtgagcctcagctttgcagacttggctctcagtgacgcttgccaggtgacctgactgcagcagtctgccagaggacaggggaagctggggtgggagtgctgtatgctctcggtccctaatcccccgcctcttttcttactttctctttactgtaaccatttctgaaaacaattcctatggggacagtccttatcttccaaggtccccagctctggcatttgtgtcatggcttaccttgttcccaaaggctaaggtaggacctggttgcaagctggaactcttgttcaatgatatgttcacaccatcctgttcatctaaacaaacttcttggcgggcaaatttcaatatctaactgagaattccctttaccatcctgcaaggcctgcccaattttgctttaaaatgagcatttctcagaccttatggagcagttggctccttctagaactggagcactggtcacagagtatcaaattcaatgccactttcaaacatcgccattcattagtgggcccattcaaatattgccattaattagtgaacatgtttgaatatggccattcattagtaaaacgcacagcatatgtcttctataatttttaactggtccctaatcctcgtgaccttatcatttacaatctgcagcaaggcactagactctgtagaaatgattacgctacgccagtaaaaatgtgaaatccaagccatatggcaatttgagcccaatttgtcccatgtgcctgtgggtatccttatgctctctagcacagcaggggaggcgaaatgctttccctgaatacctgggcccgccctgggcaacttggggcaaggccagctttggaaagaggcctgaacatgtttggggacaccctgccagcacatcttacagacttttgtctttggaggttttgcagctcctcaatgatcaatcaatcaatcagtcaaaatgatacattaaccctttattgtatgttgagcagtctcataggtgccctgcaggtatacctgttctggcccctttcccctgcagcctcagccaaaatgatcaaggtgttttcttcccaagccctgtttcttactcatacctctattaaactgtttcaccctctatatgaaactgtctccacctatctcctcttctaaagggataggatttgtatcttattcatctttgtcttcccaagatccaggtgctagaacatagtaggtgatcagtgtctctttgtggcaatccaggtgctggagtcaagtagcttacagctaaggtggatgtttataaagcataaaagagctgaaggacaattgtgtactccatgatacaatgcacaatcatgggttgaattgagtattcttgtgtaagtcttaagggtcccatagaagagatccaggcgggttgaggtcagtgggtaagagcacgtggagatagcatttgtttttctgcccttcacatttgccccttcagggagcattctaacatcaagcttaattgactgcctctcttctaacaacttctcaaaatctattccacccttcccaactcctcttttaagatgcactttgcctattgcatatttccatttggataggttgcagtcacctcaaattcaagtcacttctaattccacgtgattatcatgaagttgcaaggacctaacagaataatggcaatcatcaaacctttgcagaataaacaagcagtagtagctggaaaagcctcaacttctgagaagcagaagaggatagcacagtgctgaggaaacccagtactgagaatggagaggtcaatcctgagtacaagaggaataactaagactttctgccagggaaagtactttagtgacctcggaggccataattttggtccaatggttcaatggtcagctagattcagaggctaagatcacaggcatgatggggtggaaaaggcttcacaacagagagctctgaatcagtttgaaaacagcaaaagatgatgaaaagagagagaatgaagacgctagccagagagggggcaggatgggagtgaagtcccagagaaagtcgaggctagggagacacactcaaaggtttatggctttcaatggaggaggataaggttttgcagcaaaatcctaggagagtcacattgatgagagagttttctcaaggagatgacacccatgcccttggtcttcctaacagagcaccatagcagctctgaatcttctggagtctagggggagaggagagtcacagatagagaggaggctgaaacagttactgtcagttggagcatccatgagacatgaattgaagggacgcccatccatgttgataactaaattcacatcacagcactggctctagttagttccctagaatgtggttcccagactagcaccatcagcatcacccaggagcatgtcagaaaacccgaatttcaggccccacccaagaagtactagaccagaatctttcattttaccaggatccccgagtgacttgtatgcaccatttagagaccctgttctagctcattcattcaaccaaaagttcctactcaggaactccactcagaatgtatgctgtgcattgctggagcctgcaaagatgcagaacgtatgtaatttccagtttcagaggagtcacaattcacctctcccttgctctacccaatgctccctccattccacaagtactcatcaagcatgtactgtgtgtgaatggtaaggcactggccattcttcatggcctcacagagttcacagtcagctgtgtcctgatcatatgatggatgtgaggttccatgggagcacagtgttgaacctgggaggtgcaggttgtagtgaggagatgaggaggttacagacaggagacagggaaatattgggtagaagagggcagttccccagcaaaggcctgaccctcaagcctggaaacccatggccctaaatgggaacaggcattcctgttttcacacccaaatgttgccttttggcctgtcatgcccccctatcctgtccctatataaactccaaaccccaggctccatgagcagaagagcagcagaggagagaagagaaggaatatctgaatgtcgagaggagttctgctgcagacagttagagaggagattggctgctggacggcccaactccaggggaagatcatctttctactccatcccctttccagctccccatccatccatcccactgagagccacatccaccactcaataaaaccctgcagtcaccatccttcaagtccatgggtgacctgatttttctggatgccagacaagaacttggaatatggaaagctgtcacactggccctctgcccttgcaaaaaggcagagggtccactgagctgtttaacacttaagctgtctgcagacagcaaaattaaaagagcgcactgtaacacacagctaactgggctttgggagtcacaggcacccatccctagacactactgtggggccagagcccagaagtgctcgtcctggctcctgcacctgctcatctgcatgctccccctcccataaggagtttgagcagtggtggtggctgaactgatgagccatatgcctgttgcatgtcctgcaaccggggtgggtcagggaactctcccgtttcagcagtaagaagaggaaggtgaactgggaccaatggagtttgctggaaatgatagcccccagaaagtaccaatcccagtgctagggatgatgccagcattctagtgtaattcactctgctagtgtaattctgcaacacttttgtctttttgattttgaaaccaccgtgaaaggatacagcctagaacagtgctgtccaattgaaacagcaataatttttaatggtctagtagctatatgaaaagaggaaaaagaaacaagtaaaattaatttcaatattttacttaactaaatatattcaaaattgtatcatttcaacatgcaatcgatataaaaattggtaatgagttattttatattcatttttactaagcttttggaatcgggtctgcttttactctttcaatgcatctcagttgggactagccctattctatgggctcaggagcctcacgtgggcaccatgttggacaggagcctcacagggctagtggccaccatgctggccaccacgctggactgcgcaggtctacaaggaccctgctgtctgaggactccttgcacgatgcagagttcagttaagggtccacagaacaaaagcgacagaacacctccaatattttagaagaaagtaggatgaggtgagctggggacatggggaagattagaaaattaaacctaatcttttttttttttttgagatggaatttcactcttgtcacccaggctggagtgcaatggcacgatctccgctcactgcaacctgtacctcccaggttcaagcaattctcctgcctcagcctcccaagtagctggaattacaggtgtgtgccaccacgcccagctaatttttgtatttttagtagagacggggtttcgctttcgccatattggccaggctggtctcaaacccctgacctcaggtaatccgttcccctcagcctcccaaagtgctgggattacaggcatgagccaccacgctcggccgaaaattaaacgtattctaagacaaagaaattcagattttttttttttcgaataaaggatgctgtgtttattttcagcctttggacgacccatatgagtttcacttcacactgtgttgaagaaaagagctgcaggggacagaaaatcagtcaaattaaagaaaatatgaggcgtaactgccctgcagtgagagcatatgaatttttctgccacacactctgagtcatttgttaaagaaagccagagaataagaactgtcctgggttatcgctaactttcactgtgtctgatttacttgtttgcacactttgtcaaatcttggaccagggacagatagcgtccaggccattactcaaggggaagactgttgatcagagtacactgcaaacaaacatctgtttctgatggctgcagcaccatccttcattatagaatgagcttaataaacacgaagtcatagaaatccaccattcacgtaagttttggcctggtgttattgcagtctcttaatttagccaacaaagaaggttggctcaaagacacctgtttttgcatgtaaagtatcaggctggaaggcttggtcgggcatggttttagcaacaggactttcatttgtgatagttcagtcacgtcctggggaattgaggagaagatccaccctaccaaaggccagtcttgctttagcaccaaagaattaattttaaaagttagagttggccgggcatggtggctcacatctgtaatcccagcactttgggaagccaaggtgggcagatcacctgaggttaggagtttgagaccagcctggccaacatggtgaaaccgcatctctactaaaaatacaaaaacgttagctgggcgtggtggtggacgcctgtaatcccagctactcaggaggctgaggcaggagaattgcttgaacccaggaggcggaggctgcagtgagccgagattgtgccactgcactccatcttgggcgacaagagcaagattctgtccccactccccaccaaaaaaaaaaaattagagtactgatctggatttcacccttgaagttaagcacacactaatgacagaagctgaaataaatcccccaaatgtcttgaacactttctaggcttgtgtctctccatgagattctcagacagctgcatttggatttccgggggctggactggatctcagatgtttctggcccagaacctctgccctaaatgattattcatgaatgttctggctcaaaggaggagagagaagatgagagatccagaggtctgagatgtttgttcacacaccaatctctggagcggaagccgttaatgcttctacttatattcttaaggcctcttaaagaaggttcccagcttggggctgggtaataatggtgagagcatttcccacattatcctctcgatatgcatctctgccatgactatcagacaatggtgagagccagaaccacttagagagctgattgtcatcaccgccctgacagtctcagtggcaggccaggctctaaaggctcctctggatgcctgttggccaaagataactcatgcctcgggggtcgtgagcaggaggtgaagccaaatgccttcagtgacctgaaaaatgctatctcccagcaacatgcacaccttgcagtgtcttatgaaattataaaataaaacccagacttataagactcttcccctgcctaagttttctttttctctctcaattttattgctttgctaaggacatagaaagcaaactaattaaatgacagctaaagagcaagtgactgtgtcccagggcggctgagataatgcgcggatctcaggtgagtcgaggaaatgccacagacattgctgcctctctactaataaatagctttttggtcccataacatgagagacattctggaagctgtgggggagcaaaagatggcttccctctaccctcccaggttctttggctgggctattgattaaaatggcatataaacagattaacaggagaaagagcatattcaattctgtacacatgagagtcccacagaatatgagactccaagaagggttagatcatggaagcctacagaactatatcctagatacagaaaagaacaggggcttggggattcttgtgagggggaggaggttagaggagggcaaggagaggaattgtatggtgaataaaggttgtcttattatgtagataaacaatctctcaggtaataaaagttgtctccgagcagccctgagcagaacaggcagtagtctctccaggcatggtgtccacgtactcatcttccccggctgacacaattccctgggaggggattcacgacaactgagatccatcaattgtatttgcagagaagctagttcagagaaaggccctccccgaatttgctgttccccaagtgtcctctgttaaggagtcagcacaccaaagcatcatattttgaggtggcatttcctgaactcctgcaaagctgaataacaatggagagtgaagcatcaactgttctcagtgctgggcgcccttcctccctctcgatttagtggcacagactgttagaactgcagggccctcagagagctgatcatctgtagggtagaatactgcccctttttcttctggctctcttaataatattgggacctaatattctatatttttaaaaattgcctaacgacatagatcatggcaaacactaaaaaagcacaaaaaagccagattgttttgataataacaatgatctaactccttattctttgaaatcccatctctgtgatgagaaccaaattttcaaaaggctaatagctcataaagggccctttactgttgtcctgtggagaaacggaaaaacgctcatggggtcggttattgttccaaatcaaatcattcctttatctcacaagcatttgttgagaggatgcttctctctggcagtgcagggcctcagggcaggagcacgtaatgactctgccccatctctgtgagaatcactctctggagagccacgcttttatcctctgctcctcagcctatcttctccctagccctcctttgcctagatgacttggaatagggattgctatggtttgaatgcttggcctctctggaactcatgctgagattttattcacgtgaagtctttcagaggttattaggtcattagggctccaccctcatgaatgcattaatgctgtgaggtgggagtgggttactgtgggaggagctttgttaaaaacctttctctctctttcacacatgcctttgcccttctgcctatctgctgtgggatgatcctggccagatgccagcatcatgctcttggacttcccagcctccagaatcaagagccaaataaacttttctttataaattacccagtctgtggtattccatgtagcaacagagatcattctagggagtactctgattccccattaggaaatccctttgggcaaacctccctgaccccaggcctgggtttgctgtttctcctgtgtgttctcaccactctgtactgacctgatcctaaatccctccaccctgcactgggtatttccttatccatcatccctactagactcaagttcccagctctctcaccccatgtgttctgagagctgctatctaagtacttggccctgagtaggagcttaataaaggtttattctaggaagaaaagaaagaagaacacaggcacctagacagaaaattgtgtggcaacgcatagacgggatgacagaggttagagcagtcacagaggaggagatgattgctctccctggacagtctgtccaaattccacagccccagtgacactttgtgtcttgaagggtaaacaagattcatcaagacgcaaacaagacaactctataaattgagctaatatcatcagtgtccatgagccactgaacgcagtttcttgtctcagtgaccccaatggcatctgcaaaatttagttaagattcaaaattaagagaacaaaaatgtgtcagggtgtctctaagtttacattatctgtaagaattcatttctatggctctgtgttcagaaagacttttctgcaggaaaatttatcatggtgtatatcactccctgcacaatgacgcaagtcaaaatcaagcattttccatgggaaggctctgtttctaaggattgaaatgcttattcagataagtcactgaaatggcacagatggccacacctgcccctttattgctacagagaacctgacatcctctttcaagtcggtagcaacatacttctaaaaacagaatgcgaagccgtaaatactgcaatggaatggagttccagcagaaaagtatatgtttctgtaaagtcataaaaagggggactaattcttctcttactgggatggtctgatatacgtttaatgttttatattttcattgaaggcaggaagatagactaaatgataacattgcttcccaccttctcctccagctctgactctttaaactgaatgctgatttatctctccaaatatctcacaggcctttactttattatgggccaggaacaaatggcagtgggtgaaataggcttggtcacacagtgacaagatttacaatgggatttgggggaaaagtcattagtcgtcatttgccatcctgtgttcatgcccctctttttcaaaattgctgtttaaaagtgggtctgactgggcatggtggctcatgcctgtaatctcagcactttgggaggctgaggcaggtggatcaattgaggtcaggagttcgagaccagcctggccaacatggtgaaaccccgtctctaccgaaaatgcacaaattagccaggcatggtggcacacatctgtaatcccagctacttgggaggctggggcaggagaattgcttgaacccaagatgtgcaggttgtagtgacccaagatcgtgccattgcaccccactccagcctgggtgacaaagcaagaccctgtctaaaaaataaaataaaataaaaattaaaaataaataaataaataaataaataaataaataaataaataaatttgggtccaccataatcagcattttgggccagcttccaggagaaagggaagggaaactgagggtccatgagtgctcacagccaggcaggctcgtgttccaagtctcgtacccgttgggccatttgagaagtggcaacaggggatcagcagaagggttaactgccaagtctatgcctgttcctaccaatttggcagtccaaatagatttttcttttaaagtagacttttgctcccactaatttggaaaatgatgcttttctttgctgaagaggaatgtcaagttaatttcaaggatctaaaataaacatatatctgacactggctcagcatgggagtaaacccacctccttaagagcactgggaaagaacctgataagggaagctggggattggtctgtggatggaaatgaccctcacaatctcctggctttatgttttgttcctttatacatacgtatatatatacacatatatacacacacatatatatacatatatacacacatatatatacacatatatatacatacatatatacacacatatatacatatacacatatatacatatatatatatacacacacttgatttgaggtgttggtttacagtaaaatcttcccacttagcatctacttttctcaatttttttcaaagtcatgaagtttagtttgatgttatctaaaagggtgctgatccactatgggcacattttagctatttttctcaaatccaccaaaaacgtaaggtggttgctttcaagttcttcttttagggcgagatgtctgctcagtatatagaaactttttaaatgcttcaatcactgtaacttgataggaacttcctattttgtttctttgaatggtaccctaagttctgctttataatatcagtaaccacaggattttgagtgcaatgctctatatagcacaacaaagtggcttcttagtattagcccgaaggaaatatgttttgggttaatggcaatacagtgactttcaacaaaaactcctttggccccagtcatttccattctctgcaggcaaaatggatccttctctctttgtgttcagtgatgagcaagcatttcaaatgtacatacaacttgtttctgtcaatcagtgattcacgccgagtcatgttcaatcatgttaccacaatctggaatttgcaaatctgtaagcatttctcaggcaatgaattatgtcaacacaattgcaccatcattgatggacttggaaatgcagacagaactgaagaggagcgtctcggcactgctgctacgggtaaggacagagcttcttgctgacttggaaacatcatgagcttaggccagccaaggtttaggctcgttggatatttttaacaaaatgggacttcagagaaatttaattaagatttatttcaaattaagatcaccaaattatatttacataaaagcctctataatgagtatgctatatttgtcattaaaatgtctttatatttttataaatatggtttcacaattttttacagagtcataatctacatggaaaacaaaaagtcataccaaaattataactgctaagagagatgttaatggtaattaatcatgagtgagtcataaatatagaaacgcactgacttgataaataagaaacaatattgcttctcatttggcaaagctgaaaagggaggggctggggaagggggcagctgcactcggtgggaggctctgcacactggcacaattgtttgctgggaggtaatttaacaggactgaaatgcctccattctaagatgacattaatggtaaaaagcaccttcaatttaatagtggcttgaccaaagaaagaaaagctccatcatactaccattgtaaacatccacatcaatttacaatatcctgatttcagaaatgttaaaatacacaaaaaggtacttcttagagttgaggataagtgttggatgcaaagctgtcaggcctctgagtcgaagctcagccattataacccctgtgacctgcacatatacgtccagatggcctgcaggagccaagaagtctgaagcagccaaagaaaaaccacaaaagaagtgaaacagccagctcctgccataactgattgaccaaccttatgacattccaccattatgacttgttctggccctgccccaactgatcagttgaccttgtgacattcttctttcggacaatgagtcttatgatctccccaccatgcaccttgtaatcccctcctctgctaacaatagataacctcctttaactgtaactttccactgcctacccaagtcctataaagctgcccctctcctatctcccttcgctgactctctttttggactcagcccacttgcacccaagtgaataaacagctttattgctcacacagagcctgtttggtggtctcttcacatggacaggcttgacaaaagctttaaaaacatgcacatgctttgactctctaacttcctcttctaggaatttttctttttagagaaaagtcaggaacacaggaaaaattcggccgtgggaaaattatcatcattccgcaagatacacatttacataagtcatggcacaccctgacaaatggtcatcattaaacatggcgttagagaaatgcaaagatgtttgtgacacacaattaagggtgaaaaactggtaaaaaaaaaaaaaaaaaaagcccatcagcataaactcgtctctgttaaaattgcggacatgtgggtttgcgtatacatgtaaaacgtatctagaaagctctacagcaatgagtcaaaaatcccatgtccagccacgtgggattatgtttgttttctaggttttccttttttttttttttttggtacaatttactgacattgtctaatgagtatgtattacttttgtaataataaaaactctttcatttttccacttaacaatattgagggctgatgagcctgtgccatgggtcagggggtcggcgaggctgataccgggagtggacatgtgtggaatgcaagtaggatctgcaggaagaaaacagttgtgggaatgctgttggtggcaagatctgctgtgtatgttttgtccccatacaatgtcactagaaaccattcatgggcattaaaaaagaatccacaatgacatctcttttcattatttcattaaaataaaacattaggaaatagccaatgaaatcttatctaaaatgaggtggactttgcccatttatatgctatccccccaagtaattcacaagcatgcagcaagacttgcagatgctgtattaaggaggccacattttaattttaatttttattttttgagacagagtctcgctctgttgcccaggctggagtgcagtggtgcaatctcagctcactgcaacctctgcctcctgggttcaagcgattctcctgcctcagcctcccaagtaactaggactacaggctcccatcaccatgcccagctaatttttgtacttttagtagagatggggtttcaccatattggccaggctggtctcgaactcctgaccttgtgatccacccgcactggactcccaaactgctgggattacaggtgtgagccaccacccccggccaggagaacacatttttaaactctgtggtaatggttgagaatactcttcattactacaagcattttggacagaaaatctctgagacgatgacagcattgtgtgttctctaaagcgccaggttataacggccatatgtctccctgagtaggattttccagaagaaattaccaaatggcacacaaaaacgcagtgtgctgacactaatacataaaatgcggaaggacccagtctttccagagtgcccctttctcaggacatagacaagtagctttcctactgacagcacctctcagttcaaaggaaagtggtgtgcttgctggatatttttagattgccagaatgttcagtggaatcacataaggccgtcactataaaaatgaaagcaagcccaaccttggtgtgatgttttgcaataaacagcaatccatggaataagaatttaagacccaatttgaggtcacgtgctgcaaacccagtgttctttcagagtcaggtcgctgttagatgacaaccccttcagcaccggcctgaagaaagcgcaggcccagtggcagtctgccttctgttaattcccaaggttctcagcattcctcagatcaatagaactgtgatgtatctatataaatctgagtagcagatccattctcataaagtttaccctgtcttgcttttcaggtgagaagcagaattggaaaatatttcagggagtatttgaaacaggaagattaaattctgtctcatgtgtatcatgaataaaagtgctaagccaggcacagtgacctttcctgtacctgtgctaggatgcaaaagatcataggtgtaggctctgggcagcccgtgcatctgctgggtcagcggtctggcactttttttgagtgtctgctgcccttgaagaaggggatggggaaggattgcataagttgtggcagggggcctggggcaggtgggtggccaggaatctgaaggagagtgaacatgagtgagagtacgagcatgtctcagctggtagcccttgtcccagagctggtggcctgctgtgtcctcctccagtgtatctgggagtggtggttgatgtgagcgccatgctgagccccgctcatacccactgggcccagctctttttcagtcctttcctggcctgggggaagcacgtacaatccctgagctatgaacagtggcaccagcttttaagtaaggatgagggcttcccaaccaactgtaagggggctgctggtttgagcttttcaggtttcacagcaagctcttggtcccctaaggccctgctcctggcagatactctaaggagcccgggtctgagctggacacacacagcagcgagaggggaagggcgagctatttcctccattctggtgctcatcgtgggccatgcgttggttacaaggaagcagatggagttggggaaacatggaatggaggatggggaggatgcagggaagagaatcggggtcactgtgagggaggggcaacagtgccatgggaaatgcatcattggtgctcatgacaacggcacgccaaggggcttgatggcagcagcctcaggtatgggcagaacgttgaatcctcagaatgatatgggattccttaaaaccaagcaaagcaactcatcacctacccataagaataacagaaagggccactcgatggtttgatcatgtttacaaaatctggctaaacaggaagtttcatcctgaaaccggtttcctcaggtggaaggaaggcagttgactcatcctgcttccctgtagtagattttatttttcagataaaaaacctaatattatcagcggtgatataaaccagtgcagggcctctgggatgctggcaaactctagtttcactgtgaggcaggatttagggcctctgtttttactcatgagaccctggaggctctaggtcagtgacatggcttggctgtgtccccacccaaatctcacattgaattatagtaatccccacacgtcaagagtggggccaagtggagataatcgaatcatgggggtggctttccccatactgtccttgtggtagtgaataagtctcacaagatctgatggttttataaaggggaggtcccctgcatatgctctcttgcctgccgccatgtaagacatgcctttgctccctcattggccttccgccatgattgtgaggcctccccagccatgtggaattgtgagtcagttaaacctctctccttgataagttactcagtctcaggtatgtatttattagcagtgtgagaacagactaatacagtcagagagtctgggggccatggcgacagggatgcctaagagaccaacacagtgtctgtctgcgaactcactcattcccttctcactcactcctccactcattcattccttccttactcattcctccattcactcattgcttccttgctcattcccccacttatgcattcttccactcattccttcctcactcattccttcctcactcattcctccactcagtcattcctccattcactcattccttcactcactcattccttcactcactcattcctccctcactcattcctccactcattcattcctccactcactcattcctccctcattccttcctcacccattccttcttcattcattccttcctcattcattcctccactcactcattcctccactcactcactcctccctcactcattcctccactcattcattccttcctcacccattccttcctcattcattccttcctcactcattcctccactcattcattcactcattcattcctccactcactcattccttcctcattcattcctccattcactcattccttcctcactcattcctccactcactcattcctccactcactcattccttcactcactcattccttcctcactattcttccactcactcattccttcctcactcattcctccactcactctttccttcctcactcattccttccttcctcactcattcctccactcactcattcctcctctcacttattccttcactcactcattcctccactcattcctctgctcactcattcgtccactcactcattccttcactcactcattcctttgtcacttattcctccactcactcattcctccactcactcactcctttctcacgcattcctccactcactcattccttcctcactcattcctccactcactcactcctttctcacgcattcctccactcactcattccttcctcactcattcctccactcactcattccttcctcactcgttcctccactcactcattccttcctcactcattcctccgctcattcattcctccgctcactcagtcctttctaacttattcctccactcactcattcctcggctcactcattcctccactcactcattccttcctcactcattcctccgctcactcattcctttactaactcattccttcctcactcattcctccattctataattccttcactcactcattccttcctcactcattccttcactcactcattccttcctcactcattccttcactcactcattccttcactcactccttcctcactcattcctccactcactcattctttcctcactcattcctccactcactcattccttcactcactcattccttcctcactcattcagtcagcaagagcttattaagcagcagctatgcacgtgtccctgtggcctgtgctggagaaggaacagtaatcagagacaggctctgtctgctcttgcctgccttcctgactgctggactagaatctcgcagggattgagctttattctggcagcaaattcagctcctttggaaattatattaccttttctgaacacctaaataacaccaggaggtcaagtacgtggaagtctgaggggcggaggaatgtgcatttagggtcgtgggaccccttcccatttatttgtggaaacccactgtctcccggacactggcctccagggcacggtctggagggtctgtaagactccccgtgacattcctgttccttgttccactgccagggtcctgtcctccctccgctttcccttcacttcctgagtctctttccattagaagaagaattcatatacacatactgcagcaaagggaatgacagctgcagcaggtcgccagtgcatcaacacagagtaaccgaatacatcagagaggacatagggatctggccagctgggaatggaagccaagtgggcatgctgcagtgagaactgggggagaaggccggaacctggcgggctcatgtgggcacgctggccatggtgggatggcagcgtgggccaggaaagcctgggaactgggggtgttggcatgagatgaagctcacagaggcatgggctgcaccgggtcccagggacacctgagcacgtctcagggcgccttctgttcacagcttcccacaggagtccagctgagaaggaagccacatggccattcctgagaacaaggataatgccacacaaatgagatgttccagctccctagctctgaggaagctcattcaaaaatgcaatttttaattaaaagggaaacttcctgagaggacagggagcatttacagcatgaagtcaggcagggtgagcctcacccagctgctgttcctttctctttcctgccttctgaagaggagactgtggaaagggaagcgaggcagaggtggcagaaagagatgataactccaggaaggaaggggtgcctgagagaagcagccaggcagagcggtgggacgtgaaactcctcgacagcactgtgtcctgggccgaggtggggagggtcagtgagggcagggtactggtgtcattttaattcagacttctctctttctttgctgcaaatggctctctggagcacaaactctcaacaaggtggaaactcgacactatgctctcaatctccatgcacaattttgcagaagaggctctttccagcattttctccccagatgtcagagccgtgcacccttctccggaaggctggagggtgttcagcgttgtttgtcacaggcagcggccagtctctgtgttctcgggcgctctgtgtcaggtcctggtatttattcccagattctgtttagatgcacccgaggccccaggcaaaggtttctgcctgagacagtccttggcctccagccacggcttccgtgccatgtcccaaatgcaaagtgccactctcaaatgttctctgatctcctgttcgaagcaaataacagagtgctaaaatcttatttagaggagtcgtggtagaattatttattcacttctagccttttggctgagactgttttgaaaaatagaaaatggcaggtaattcaggtgtcacccttcaatggcatgtgttcttcttgatgtttcacagctactgcacatctgatgaagaggattttttttaactgagtaaggtcatcttttcctgatgaagccccaaagtgcaaaaggcatgaaaggcacattatgcttctccaccagaggagggtctccgcaggcagggcagccgctgaacagcaccgggagggtctgtagttgccagactctattattgtgggctataaattaagaggcttccgtttcaaatacaaactctctcatcagtcacaggaaattaaatgccttttgaaagggagctaggcataggaggaattcactttcttccacctacacactgttggcagctcctcagagggaaggacggagcctgccattctgcggagcgtcacctggttcttacccacgacttcaccgtgagtgtggagtccacaggactccagagctctgtggcctgactgcagggcagtctgctcccaaagagacttggggagaacatggctaactcaacagaatacagaataacaccggagaggggcaccaagagagtggtgatcacataattgagacctagtcagacccagtaacaacttaccgtgtccgcgaggaaccattcatgcagagaggcctccccattttctgccttaaactcattttatatacgtggggaattgagactccaagattacgaacattttcaagatcctctggctagtaggtgatttagcttagagtcaaatctagatttgaacaactccataatcatcataataaacaataacgacactacctacatgaactgagcaatggctaagtagtaagcatgtgccgaaccctttacgtgagtcaacttagttgatcctcagataatcctgcggcagagtgattgttccagccacagatgaggaaacgcagagccttccaggtgttataactcttttctcacgcctctcttacaatcctcaggaaatgtcgcccccccccccccccgaccccccgccagcccccgaccgcccggaactaagccacagccacctcctgccctggttgctgcaatagtctaatctctcctggagtctgcccggcccctcctgagcttcgtcccagacagcagtcagagcaggacttcagatgttgtcagttctgctctcactccccgccactgcccatttcactgggaatgagagccaggggtcctcaccaggcctccccactgcgtccctctctccccacagtgtctcctggagctgcattgctctctggatgtgccagaacatgccgtgggctttcatcctgcgtcactcgactgggaatgccctgggatcctgcaggtgcccacccagctggctccctccgggtcccgtctttactcaaatcgcaccttctcgatgaagtttactctgaagttcaacctgctcttcccatcctcccaccccaggcgcagcagatccgccttaactggactcccccgctttgcttccacggcgcctatggaaatgctctgacacagaggtcagcgaaccactttacaatcacattttactgggacacagccacaccttttggttcgtgtattgtctgtggccactttcacagaatgaccagtggccctcagagctaacagacgcactgcctggccctttactgaaaagtgcggccacctctgctctaacataactggagagcttgatgacggattgggcttgtttttctcggtctgttttcccccgaggagagcgcacacactggggggcaggaactttgtttcttttgagcactgacgcctcccagtgcctagaacaggacctggctcgtagatgatgccagttcatatttgttgaataaatgtgtgaatgaggcatatatttgctaaacaactcacccaaagtcactccagtgataggcccatcagctctcggcatccaaattcaaacccaggcagaccaacagagagtaatagcaacagagacccgttcttaccagtgacccccgaccagcctcatccgctgctgcctcgcaggagacagtgtcctatatttgctcataaaaaccaggcagggaaaaaggcaagctaccagcttttaatcttattaatatgggccagaaaggatggttcatggttctgaccataagacaaagtgcttcaaggcaaggcttgtatcaaccgtgctacggagttgatacacaccgaactgtcacccgtcctcctgcccaggggccttggcgttttgaagactcccccatctagacgtccagcagatgctgagcacccaggagagaggtcagaatgcaggatttgcattgaaagccacgtctattggggaagcagctaaagctctggaatgaggtaccagaaagaagaaaggaagatggaggaaagaactctggagggagatggggccgaggaaggagtaggaggtgtggctatgctagctcatgctcacccctcattcaagctccagacctgggccaagagcaagaagagagcttgcttgtgggtccagagtttctgatggcagcgggtttttgatggcctgtaaagtcatctaacgggcttggcgcagtggctcacgcctgtaatcccagcactttgggaggccgaggctgccaaatcacgaggtcaagagatcaagaccattctggtcaacatggtgaaaccctgtctctactaaaaatacaaaaattagccgggtgtggtggcgcctgcctgtagtcgcagctactcgggaggctaaggcagcagaatcacttgaacctgggaggcggaggttgcagtgagcagagatggcgtcactgcactccagcctggcaacagagccagacgccgtttcaaaaaaaaaaaaaaaaagtcatctaatgcctccaagaccacacgctattgatttaatctctgaattaaaggtctctgaattaaagtgtataaatgtaccttctcccataactctgagaatggggtttgtgtcttagaaaagaaaaaactcacggggctgggggttacatctattgtttcctgtaattgtcacagcagtactcaatacacacattttcacaggcaaggaaactcaggttaaataactttcacaacacattggaaatttaggctgccaattagtcatccctccggcccccctgggttttaacctctagacctagagaaccaaattagatgaaaataccagcttttgtaaatcaacagtgtctaataatcccccaaggacagggccctaggcaaagctgagctgggggaatgtagacagacctcctactttccactccaaacctagacgcagactcagtggcccacccaggggcatgagtaatgctgggagctgcaggctggcttcccacgctccctcctgggcctggcccccaggcctggctgactccatggggggcctggcagtatcacagcgcagggctctcaggctgccagcagagcagctgttgtgttttcagctgcttattctcactaaaacttctgataaggccatctggaaaagtattactgtatattaataaaaatatttaaataaagttacagaatggagagatttactttggaagtattaatatgtaatgagttagacagataacgtgtttgaagcagcctctgccaatctgtttactccacggagagaagaagaacaggtgtgtcaagccaaacatctttccttggcacttgaactgccttacttggagcagctctgacaagcttatttttgtggtggtggttgggggaacccagcatttttagagaagaaaagagcaatcttcactccagaaagtgaatctgtctatattcatgtatcggccttgacgtggtttgatttttctttttaactccagtgttggttctttgctctttgaaatcaaaacattctgtattatttctgggattatacccagcaaagtgagaacaggagcttcttttagtaaataaacgtgatcatcttccgccagtaggtgtcactgttcatttagcacaaaccatacccgaaaggcaaggcaattacctcggctaaaataacaagcatgttttctggaaataaaataaccagtaagtactgggaaaaagattattttctttcacaggtgtctccaaatcaaagctgaagtgtgaacaacaattcactctttctatggcctcccacatagtatttgcttctagagctttagcaccattgtaagaattccttctaaaccatgtttgtacctcagatctaactgcctgaccctataaacattttgcggttgactttgcttataaaatgcattggcattttcacatacaggcggtggagttttctagcgttccagcctaaatcagaaaacaatgtctggtgttgcctacacagaaacaatcgtatatcatagaaaattagaagtgaggcagtaaagcgagtctctgaaaatacgttggatgtaaacacatcgtttacatgaaggacatggaattataagttcacacagtgacacacaaatatgtaaggtcattagtgttcactaaatgcgtagctatgcaatgaaaatggtgagaatcctttacgagctaacgtgctacacagagtttgatgcttcttgtgcgtgatctcacctgttcccccacttatgtgaccattttacaatgaagaaatggatgtttaaagaggacagtgaggtccctgcgccacagtggtagaaagtgaccaactagcagtcaaccaggagatttttggccctagaacctgaggtcctaaccacaacacagagggcctttccttttttcttttttcttcttctttttttttttaaatggagtctcgctctgttgcccaggctggagtgcagtggtgccatcttggctcactgcaacctccacctcctgggttcaagcaattcccctgcctcagcctcctgagtagctgggattacaggtacacgccactgcgcctggctaatttttgtatttttttaaaaaacggggtttcaccatgttgaccaggctggtctcaaactcctgacctcaagtgatctgcccacctctgcctcccaaagtgctgggattacaggcatgaaccaccacgcccagcctcctctgacttttgtaagggaaataattagattctgcttgtgttgaataattctagccaggccggagttcagttctagtcctcctacttccgactgatagtggctctgagtagttcacttaccatctctgaatttccatttatttcactgtgaaagggggaaattggtacctacttgtgggattgctgtagagattcaaataccgtgtttaagaaagttcctagcactgcgcctggcacgtaaaaggcacttgtttaagaacttgataaggctgggcgtggtggctcacgcctgtaatcccagcactttgggaggctgaggagggcggatcacgaggtcaagagatcaagaccatcctggctaacacggtgaaaccccgtctctactaaaaatacaaaaaattagctgggtgtggtagcacgtgcctgtagtcccagctacttgagaggctgagacaggagaattgcttgaacccaggagacagaggttgcagtgagccgagatcatgcgccgctgcactccagccagagcgacagagcgagactatgtctcaaaaaaaaaaaaaaaaagaacttgataaagtaaaaaaccctgatttttgaaataaattaagagtaatgaatatgcaataaagcattcttttctgaaatgcgttatgagaggtcaggagttagtcttaagcagttttcaaaggtgcaagggctggagtggcctcagtttatctggataaaatgactatatatgaacagagatgccaactgttggtgccaggcatggctcatgggcttttggcatgatgaacagtttcctttattttcttttttttctttctttatttatttttgagacaggattctgctctgtcacccaggcgggagtgcaatggtacaataacatctcactgcagcctccactttctgggctcggtgatcctcccacctcagcgtcctgagctgggaccacaggcacgcgccaccatgcctggctaatttttgtattatttgtagagagagggtctccctatgttgcccagtctggtttcaaacttctgggctccagtgatttcccccccacatcagcctcagttttctttactttttaaaaattaagatcctgattttacaaatgaagaaagctcaaagatgaagttacatgtccaaggtcacatagctgaagagagaatttgccgggctgctggatcttgttttttccatttgccgtactaaatcatgtgctacaatatttgtggttttcctcaactccacagagcttgcttctctgaaattcctattccttgctaacccctaattttgtatgtgaaccattggagacagggagcacaaaaggacagcaagagagaaagcaataaactaagtagagaaaggaaggatcctcctggtccttatgcctttgagtgatgatgtaagaaaatcatgtgaagttcacctgggtgagcctttaccctccaggcactcgagggcccataccccacaccaggagagttgaggcattcctcatcttgattttgaattgatgcttgagtgggggtacttaagtattaattgaaacgtgctgaattcccaacataaatggaaattctcaggtgactttgaatggcaaaaatcagtcctttctagacaattaatgagtagatatagaatttccatccaaaagttgtagaaaagtggttagaagggagttgggtatttggcagttaggcctggagtttactttctgggtcagaaccaatgtcctgagttcatgcagaaatcacatttgatcttcactaaaaattaagcaggaccagcatgagggtggatagagagtatgttgtatcttctgtagttacagcataacttcctttccccatgtagcattaacgggggaatggaggggactccggagatcacaggaagagtttgttcagatagagacgtttaccccttgaactgtttccaaccctggctgttgtatattattctaaagagactacattagatatttagggaaaaattaaggatagtataaagttagcataagaagaacttttgtgcagggtctacacagaagaaatcacatgaagagtttaaaaagtattttttaaaaagttaaaattttgaaatacgttcttgaaattctggattcagtatagtcagagatttactatcagtggtgttgaagaaattcttggtatattcttcagcaacagagtggctatgataatggaaaaaggttagaatttagtgaatttcagaagtaaagaattttgatagaaaagaacaactgaagttctttggatttctatgtagcatttctgtttaacgagttatcattatagaaacataatctagtaaaggaaaatatttttcaagttttactccaagaaatcatttgagataactgtggcaggatccacataaaacttattagccaaggattctacttagttccagttgaaagtaaaacagtaataacccaaaataaccgactaaggaaacacaaataaaatctttttttttttttttttttgagatggagtctcactctgttgcccacgctggagtgcagtggcatgatctcggctcactgcaacctctgccttctgagttcaagtggttctcctgcttcagcctcccaagcagctgggactacaggcacccaccaccacacccagctacttttcgtatttttagcagagatggggtttcaccatgttagtcaggctggtcttgaactcctgacctcaagtgatccacctgcctcggcctcccaaagtgctgggattacaggcatgagccactgtgcctggccagacaacacaaataaaatcttgagaaaattaactttacacctatctcctctctttctttgactaacgcctatattctcatagatgctctgtttatgcttcattttcttgtttcttttttattccccctttctctgctgaaagaattatgaagaaggaagaaaatttgaaaggaatagaggaaaataggaaggaaaaatagaggaaaaaaggaagaaggaaggaagaaaggaaggcaggcaggcagggagcaaggaaggaagagagaaaaaggaaaaaatgccccagaggcaaatgacatattttcaaagctacttcttctaggctggtaatttcccagtgccctgaccttgcattccagacttcaataaataaacggggatgatgccaatgatcgagacgccaacagcagcccttttctagggctgacatcgactgccacatcactcacagcatgtggaccaaaatatgagacaagctgggcatgcattcagacattttatttgtgtcttttagaaagcatttatatttcctataaatccatttacatgtcagtatcgtagtgagaaatgcacgcactatgagaaggccttgaaacatcaggagctgcagcactcttagagcagacttgacagctgcactgggtgtgagatatcagcatctttaatgtatgccagccttgcatgggtttggttgggacgtcctcatctgagaagacgtggcccccaaatgaatagggaggcactcacgttaatttttctcaactagtatctgaagggttgtcatgctctctctgctttctaatgtacatagaggtgtctacatgcaaacggatagcagctgagacacgctgtgtaacttgcagcttacatgtaaataattcggaggtgagtactgcgatgcagttacacgtcgtaaccacctgaattttatgggggaaccttctgcacgtattcatgcatgaagaacacacatttgaacaggggcataggcagtgtttgtcaagctctggaatgtggatgacaaaggacatcttaaaattccttgatttggggccaatgacaagcaagacatttacagatttagatgacttgtcaatcccaagctggaattcataaaattggctggtctgtttaaagctgcctctttctggaagcttcctctgcacactctagctacagcagggccttaccatggctcattgtcccaccagtcccttccactgctcttgttcctggtctcataggctacacacaaccactatcatctttctccaccatttgtctagaagagggaggggactctgcctaggtctcatcattgtgtatgaattgacagaacagtgcccagtttacaggcagtgctgaacacagatcagttaaatgaatgaatatgatctttactattaggtttctggtgattttctaaagtctacagacaagaaaagcactggccaatgaaggtcaatgtcaaagcacaaggctggtattgagactggagtacggcatgtagtgttgaagataaattgaggcatattaatattaaagagttgatttgaggccagccatggtggctcatgtctgtaatcccagcactttcggaggccaaggtgggtggatcatttgagtccaggagttcaaggccagcctggccaacatggcaaaaccgtgtctctactaaaaatacaaaaattagctaggcatgatggtgggtgcctgtaatcccagctacttgggaggccatggcaggagaatcacttgaacccaggagacagtggttgcagtgagccgagatcataccactgcactctggtctgggagacagagggagattctgtctcaaaaaaaaaaaaaaaaaaaagaattgattttgatttgagcaaacagcaatcatgggtgggccagctctggatcacaagtggttcatggctccacagaaggggcaaagaggaaggcttttatggagtgaactcagaagcaaggcaaagaattcatcccagtggaaagtcccaagttagggcttagctggctgtttcagattgtcctagaacatgaccactgagttgggtttcagattgcagacacaggaactcagggcattggggccaccttggtctagcaggcttccatttaattactttaacagcaggaaccacaggacacctctaactgtccttaagagtgtaattatagctctttggccactccctgtactaaaaggaggagtggagaatttggagaggatgtaggcaaaaccactgtgagcaatcaaagtatcaaaggaattaactcatctaggaatgcatgttccttattctgcagtacctggaagggcttttggtgtgtgacagcaatgtgaagcgtctttacatcttaattctaagagacagcagccacgatgtgggaagaacttcctagttaaatgtgctctgaaaagttggactgtactgtcgagggagactatgggagtttctttgttcagaaacacttaagaaagtactcataggcccacattaagtaagtgatgcctacaggtgtcttctgtttctgtgaattggtgtggagaacccaatgtttattgagtgcctatgtgctgagttaggcatgactctctttctctgtctcctctctctcacacacacttactttaacataggaggaaactgcatcctgagaggctcatataactactttgaccccactagtcttggaagagctgaaactccctcctagattgaactgtacagcccaccagctttctactgactcgtgttagagagcagtgggcaaagagtacaaactgcattgaggttctctactcacagcgttgccttacaacacatcaaaaatgcacctcctgaaaggttatcgctgcacccattgcaatcctgatctgaaagttcacagtacttgtttgtcctgtctaccagcaacccttcagaaagagtctccattgacttatttcagaggcaacaaaatgagcttcagggagagatggtgtaggtccgtggtccgattggtgtccaacgctggtctcaaatgtctcagttgtccttgtcttttgagatcagaatccacagattttcatttctgatgcaccagatcaaggactagtcccccttggctactccccagtcagacatgataaaggtgcctcatcacccactggagaggtgtcttcagggggaagtcaagattacaactaagtatcttttgggtcaaaatgtttgtaaagtattatgaggagatgaatttgtccaaatactcaaattttgtgctttgtaaaacacagtaggttgtataatatagacgagacgccttgccacatcagtaattccccccatattcacacggtgcccctgttccttggaagacatggtatttttttaatagctcatgttgggcccacaggattcctgaaaagtgcagtggtctgtcctgtcctccttttagagactaatacccagcctcagttccaacaccgagcaggagtgacagtggagtgttcccacactggatgttcaggggaattaacaaagatgagtgatggcctcccaagtggttaagggggtgcctgtgtacagcgttgtaggagcaaaaaatgtgatggggtgacaaatttaaaggaaaacaaaaagaggaagagagaaaaacggagatttgtaaaaagcaagagagaaaatgagatgtcccactgcccctgaatacccaaaggggcgtgctgaagtacctcagggatatgattctatgctattgtgatggttaatactgagtgtcaacttgattggactgaaggatgcaaagtattgatcatgggtatgtctgtgagggtgttgtcaaaggagattaacatttgagtcagtgggctggggaaggcagacccacccttaatctgagtggacaccatctaatcagctgccagtgtagctaaaatataaagcaggcagaaaaacatgaaaagactagactggcctagcctcccagcctacatctttctcctgtgctggatgcttccggcccttgaacatcgaactccaagttcttcagtcttgggactcagactggctctcctagctcctcagcttgcagatggcctattgtgggaccttgtgatcatgtgagttaatactacttaataaactcccctttacacacacacacacacacacacacacacacacctcctattagttctgtccctctggagaaccctaatatagttatttatttatttatttgttgagacagagtctcgctctgtcacccaggctggagtgcagtggcgcaatctcggctcactgcaagctctgcctcccaggttcatgccattctcctgcctcagccttccgagtagctgggactacaggcacctgccaccacgcctggctaattttttcgtatttttagtagagatggggtttcatcatgttagccaggatggtctcgatctcctgaccttgtgatctgcccacctcagcctcccaaagtgctgggattacaggcgtgagccactactcctggcctacttacttatatttttgagacagggttttactctggtccaccatgtgggagtgcagtggcgtgatcatagctcactgcagcctccacctctccagttcaagcaatcctcccacctcagcctccctggtagctgggactactgatatgcaccacaacactcagctaattgtttgtatttttagacgagacaggattttgccatgttgctcaggctggtcttgaactcttggactcaagccttggcctcccaaaatgctgggatattacatgttactattgggccctaaactagtgctttatgcgaatcatcttttttaattctcacagccaccctaactggtaggtactattatcatccacatttttcagaggaggaaactgaggcacacaaaagttgaataacttactcaagcccaccagctcgtaaaagacacagctgggattagaactcaggtagaactgacccaaggattttctatttccttccagttgctgaaaaatcactaaactcatgaggcaatttcataagtctatatcttgtctgggttgctagtaattagcaatcattacatgaaatctgacatgtgaaagtgaaacacaattggaagacgttttgtgacatggatgtaaagtatatatttcttgagggtagagttgtttcactgccactgtgttctacatttaggcctttgctgaggttggaagtattcaaatagatagataaagtcacatcataatcccatgtatcaagtgtcatggaagagtacgcaatcaggcttttgatgaatcccacgtttcacttgcaatctgcagatttccatatgctgtggctcagcgatttgcactggcttctcaagcaaatcagtcatgactccaggcgtgactccagactgaaatcactcttgtcgatatacctgaaaacagaggtttccagcactggagagaagctttggtgcggggatgggctcagagggtcccgacagagggtgacacttgcatggttgcagaaggaagctcgctgcagtctgagtgtgtctccgtggagctcggcatttggacacagctcacacgcatgagtgatgctcttccacctgcatcttctggcacttgcactgtgggggccttcctcaaagccgtgcgcctccatctcagggcaacatagggcaacttctttcttctactcacattctgaatgaaatacattaataactggcttaaaagaatccaatcctttatcaaaagactccagcatttttccttccattgactgctacctgatattgaggaaggtataaggtgtcagattcctgctgggactggcagagaggggcagagggaggcaggacgggctgctggggtggagagtgcagacagaagcctgccatccgccggagtctgtgagcttcagggtccacacgagcctcatggagagacaggcggctgctccgtccatcttcgaacctggctggcatcgcagatgcccgtgcccagggcagcagccataaaggccgtggcaccttcttgcatctctaagtgtgtggcattgtggctgcctttgattgtttggcggtttgctgtgttctctgagtgtttttccacacatctgaagggcgattctttgtcaactgctactgtcttgctaaagaatcagcaattcacacatataataaagctcacaaccaaaaaaagcacattcacattttttttctttcatttttctgcctgagtacctctaccttggaaaacctccatcttgtcatatatgggcaagcattcatgtatttcaagtcatgtttttgcaggcagatgactgtgtaagtcctacatggccaccctgccagtgtttcaagcaggcctctatcatgtgctgacctatggctaggggtccctggtttctcccaccttcttcctgatggccaggcatacattcctgccctaagactggaaggctggcagaccagctcaggtcagctggttcaagaagggggaaagttttgctcatgtccaagagataacgtaagatgttcctgaagctaaacttctcttagacaggacacctgcagatggcacctttgctaaccttgattgtgccttgagatattcacctttccttcagagtgaatgctcctatcacctatatcacacttcatatgatgtaagatacaatttatatattcttgctcatttactcatttattcatttatagatttacccagcaaatactgatcaagtgctgagacatgctaggtgctgggctaggtgtggaatacaatggtaaacaagattgagaaagttcctgccctcagggagcttatagtcagtcatgggcaagtaaacaggtcattataacacagcagtgccctaagtgctattgctctatgtgtgggaaaacaggcaacctggggagccatggttaagagggacggagaaataacacgaatgtggtgaggcagggtggtatccccagagctgagaccttgcaatggctaggatgttgctagaagaaggaaatggaagcaagttccagagctcagaaaacattctgagatggaactagaagaacctggatgtgaagcgggagggccagggaggccacggagatggctgctggtttcaggtttgggccacaagtagatcaatgaagaaagaggaatccagaagttccagtccgagggtgtgtgggaggagggtgagtttcagagtcattaatgggccttttcttcagtaattcagaatactcctaagtgagtatggccacttggatacctggaaatattcatggctccaggtagctaccaagagaagacttcattttaattcttgtcaggaactgtgaaggatccaagattttgctttctttgcaagctaacaagttagtctgctcagttttacggaggccaggagaagaccagaggttcctgggtcagagacaaaggaccatgcattatttacagcaatatcttttttcctgtgctggtttctcaaatcccagttctcacagggtggtttgaaatggaccagatggcagctgcacatggcatgggttgcattacaggtgtgaggaccctgactttagggaatctgagtcttttataatgggccgtgagcaggactgccattgtcaacagagggagacattgtctttgttataagcaaacttcccctctgctgcggaaagagacagtatctctatcttccaaggctgttcactgtacgattattattgtaactatgttatgaaacacagggcattaatccatccatgagggtagagtccttaggacctaatcactgcctaaaggtcccacctcttaacactattacactgacaattgaagttcaacatgagttttggagagaacagtgaaaccacagcagaatgatagcaattttcaccaacttctgtttaattgcttaacctgttctctcttgggattgtcagtaaatgcactgctcttggggaaaaatgtggtgagagcaaacacagagagaatggataagaaatactgaatgggccgggcgtggtggctcacgcctgtaatccaagcactttggggggccgaggcgggtggatcacgaggtcaggagatcaagaccatcctggctaacacagtgaaaccctgtctctactaaaaatacaaaaaattagcccggcatagtggcgggcgcctgtagtcccagctactcgggaggctgaggcaggagaatggcgtgaacctgggaggcggagcttgcagtgagccaagattgcgccactgcactccagcctgggcaacacagccagactccgtctcaaaaaaaaaaaaaaaaaaaaaaaagaaatactgaatgctggccaggtgcggtggctcatgcctgtaatcccagcactttgggaggtcaaggcaggcggatcacctgaggtcagaagttcgagaccagcctggccaacgtggtgaaaccctgtctctactaaaactacaaaaaaaattagcacggcacagtggtgcatgcctgtaagcccagctactcaggaggttgagacaggagaattgcttgaacctggggggcggaggttgaaacgagtcgagatcactccactgcacttcagcctgggcaacagagcgagactctgtctcaaaaaaaaaaaaaagaaatattgactgctaaaatctacgttttcccatgtatttaatgtgagcaattatgattagctaatctcaatgcttatttgtagagtatatcattaactggaaagaaataaaccttgagccactgaagaaatggctttttctataaattaaatagtctttcaaacataacaaatgtttttaggaactacgaaatttttaaatttaatactagatcaaatcagcagataaacattttatgtggttccttttagatgtggtacacattatttaacaaggtagttaaaacctgttttattaaatcatatcataaaatgtttattcccagtgcaatcaatactcatattttatattataaagtgtttaatattttccacctcttattaacaacaaattaaaattgtttgctagctgctgagtcagaatattttcttttctttctttctttcttttcttttctttttctttttctttttttttgagatggagtcttgctccattgcccaggctggagtgcaatggcgcgatcttggctcactgcaacctccgcctcccgggttcaagagattctcctggctcagcctcccgagtagctgggattacaggcgcctgccaccacaccccgctaatttttgtatttttagtagagacagggtttcaccatattggccaggctggtctcaaactcctgacctcaggcaatccacacccgccttagcctcccaaagtgatgggattacaggcgtgagccactgcatccggcaataatattttctatctatagctatatctacgtttaagcttttcactttcttgacaatgtttgatcatgaataaagttatttctctttattacatgactcttacttaattattcacagatgccaaacactggggtgcattttaatgcatgcacacatgtgtacccaccaaaggactccaggctatccttgcttcataaataactgtaatttcagcaacacataatattcctttattacaaatcaagtacaagaacagatagatttattttagtttgttaaactttgtgaaatggttaaatgaatattctatgtcattctgatcctgactgtttttcataactcatcttgcaagatagatatctactttttagtgacccccaacaatattccttggaacacatgttagcatatttttacattaacaatattcacttcctctgattttttttttttttttttttttttgagacgaagtctcactcttgtcatccaggctggagtttaatggcgccatcttggctcactgcaacctctgcctcccgggttcaagcgattctcctgcctcagcctcccaagtagctgggattacaggcgcccgccatcaccatgcccagctaatttttttttttttttttttttgtatttttagtagagatggggtttcaccatgttggccaggctggtctctaactcctgacctccagcaatctgcccacctcggcctcccaaagtgctgggattacagacatgagccactgcacctagcctctgattttagctattggtgtgaagactgagtttgttaaatattttaccttttctataaattaaatgactcagcaacttccatttgggtaagaatatatttaaagcacatgacaaaaatattttatcaagagatgctttactggcaaaggcgtattgaaaataacaatatttaatattttttcaactctttctgaatgtattaaatgaagggtttctaaatgcacaaaataaaaggtacaattaatagttattcgtaagatcctcataaaacctttatggcatacttctaaaaaactgaaaaggtaaatcagcgtgccaataatttcatggcaaagggcaaaaaatacttttgcttctaattctttgttcctgaagattttgaaaaataaaaatatgttttgatgatagactatcatgtgattttggcatataactgcaaatgacttttaaaaaatagaatgatactgctaaaagacttcttccattgcaatgtacctatttatatgaacaaagttatttagtgcttacattaattaaaatgaaaaatggaagaaattcatattgagggctgtctgattccagctgtaagcagtatgcgtccgcggcatctcagtaagttggatgttcccattaccatttcactttttgtttaacaagtagtcaacaaaacttataatgtatttttgttgtttggattaactgtttactactaataattaattttaataactcaagtaggaaaaaatgttaacctcagaacctcgtttttaattctagaaattaaaaattaaaggctttgtacatattttcattacagaaatatatactggatgaccaataaaatattttcaaatataaacacatgttagagaataagagaagtgaaatggactactaggagtatgaggcccgatataaactccctttgataaagaagagcccattcatgtgtttacaaaatgaatgatgtggaccctctggtgtacagattctatttctgtcatttaaaagattgctgtctctcttcttttataaaatatttgtcagtattaggctgagcactgtggctgtcacctgtaatcccagcactttgggaggccgaggcaagcagatcacctgaggtcaggagttcaagacccgcctggccaacatgatgaaaccccatctctgctaaaaatacaaaaattagccaggcgtggtggcacacgtctgtaatcccagctactcgggaggctgagagaggagaattatctgaacccgggaggcagaggttgcagtgagttgagatcacgccattgcattccagcctgggtgacaagagcgaaactccattaaaaaaaaattgtcagtttttataacactccaggagtttcactttttgctactacttaagcctgggtaaaattttatgatggacttaaacacttgtgaggaggtacattgttttcaaaattttgtatgtggggaatatattattaggaaaacagtttgaagaccaccactccataccattccaatagtaagcattctattcacttgctattttactcaagagattttgccagtatgctcttggaagagttcaacattgccatagatcatagggaaaatgattacttatttctgtgtctgcttaaagttttctgtgtgcttttttcctctgccattatcccaggctaacgtctacggtgcagggtgagggagggtggcatctgcctgccggctgttggggaatttccctaagtttctgctttgcacccagactccgtcttcatgaagccagagccgcccaagcttcaggaactggactccgattcctcagaacaacatcctctccaaggctggggtgtgcgctgacttgtgtagacacaagactataatgcagaccgtttgagaatcaacacacaatggggtctttattttcctacttgtgtaatcgctgagcaagtcatatcatctcctggagccttaattttctcatttgtaaaatgaggatttacaaagcatctttcacctgtctcttcaggattatagctgaagcagggaaagaaagctctttgaaaagtttaacgcaatttgaaacatgaaaatcttcaaggtcctaaaattggggggcatgctgaaggaaattcagtatcatttctttctgtaatatattcatctttaaaaataaaacaaaaaaagaccacaagtttggcgcggaaaaacaccaagggtaacgtagcatgtgtgtttctgggaggaaggagaggggagggttaaagagttcctgggaagaagcccaacttcttggctgaaatttactgaaagcctttgcccggcatgatcttgctctcttgtgctcatgacaaagaaatgtaacctttggccaattgcatttttgttccactggtaactaggttaatgtgaacagacagatctggtgagacagcatgggaagaaataacacatgggcttttgtgcagctggatataatgaaggtaaattgggtggaattcaaagatttgccagaaaaaagagagatgatttcactctaaaatcattttgcaagataatattttacaaggaaccttttggacatgcattataagcggttacattcccattgtcctaaaaaactccctgcatagttgtactctatttttatcaagccatgctctgacgcctcctgcctggttggcgataatccctaatgcaaagggatcgtgtgaaggtaagtgaagtcgttttgttaatgttgtttataaagaagcactgagcttctactttgtgcagagagctttacaaatattcatatgagctttatgaatatttacaaatattggcgcattaaaaaaataaaatgtgttcattttaaatataataatgtaggtgtcattgctatccccgttttaccattgcagaaatggaatttcagaggtgtcaggggccagctcaaggtcactgatgaatcaggacccgcttatccagctctctctgccttcagagctctcttgacttttctgcatcacttcctttaccaggaatgatatttaaattattccaaaatgtaaaatatagttagttttccaggcagttgtatttatttctggatttttttttccctaaataaaacctgtatctacatgaaaactcctccaggatttcctttcctcatgaagtgtgtggtttcctcaaggactgcctgggaggccctgaggccgacccactcctcccagcaatgacttggggaggagggagtgggggaagacagagagcaggggggtgggatgggagggcagagaggagggggagggatgggagggcagagaggagggggagggatgggagggcagagaggagggggagggatgggaggacagagaggagggggtgggatgggagggcagagatgaagaggcagaatgggagagcagagagcaggggaggaggatgggagagacagagagcagaggctgggatgggagggcagagaggagggggcgagatgggagggcagagagcagggggcaggatgggagggcagagagcagagggtgggatgggagggcagagaagagggggcaagatgtgagggcagagagcaggggagtggaatgggagggacagagagcaggggccgggatgggagggcagagaggaggaggcgggatgggagggcctgctgtgtgccctcatcaggtggatttcattcgctgggatggaagaggaggcatggcatagagacatgaagttctagaatgtttttggccactctctgcaaactcaagacttttttgggggggggtgggcggagagtgcaaataatgcctttttggagttgtaattgctccctgggagggttaaatttttaatgatttgtaatgtcctggtaggttcctgcattcatgaactgcttgggtgaatggctgtgatttggaagtgaggatgggagagaaagagagaaaggcatgatgggaacgtgggtcaaattgaaactcctgctctgacctcatcccttccgggggatgactcttattatcctggttggctacttgcaggcatgtctatacacaggccacctggattaagagccattcctcagggtctcctggctattgaaatgtctgtatctgtaagagtagctttcagtgtctgaaattggcctttcctctctctctatgtgttaggttccacctggtattcacttagggagaccggtcaccctctgcagctctgtctcactactgggtacagtgaagaggtttacaagcttggtagcagtgcctatgaaaataacaactaggatgcttctgttaccatcacagtcacccccattatccaagggggatacgttcccagaccctcagtgtatgctgaaatcacgggtagtaccgaccctatatatgctgttttttcctacacatacatgcctattacgaagcttaacttataaattaagcaaagtaagacattcacaacagtgctacagcagagcaggtataatggtgcgaggaccacgacacaagctacgtgaatgtggactcccgctctctctaaatatctcattgtcctgcgctcatccttcttcttgtgatctatagctctgctatcccagatggctactaagtgacttctgggcgcgtggtgtctacagcgtggagatgccagacaaagggaggatccacatccaggtgggagggtgtgagatttcatcgcacaactcagaacagtgagcaatttaaaacttaggaagtgttgagctggtattttccatttaatatcttcgggcctcggttgactgtgagtaccagagactgcaggaatcgaaaccatggataagcggggactcctgtatgcgctttggcagtgactggtggcgtggatgccacaaggcaggggagcctgggctaggctggttgctgtctggaaaaggggccccctttggctttttacacaggtatggccaagggatgtgacctcacctgagctgggacaggctgtgtataaaaaccaagcatcataattctgacatcgtatattaatgtgttcctgaaaggaatattaaataatgcctttctcaaagtagtaacattagtgtatctactaagctcacctaagcagggctagtctgtgacatgcagaaaataagcataacgtagtcaaaggcatattttgaaagtgaccattatgcaactattaaaataaataatacctttccccaaataggaacactagtatatctaccaaaggcaggttgctggtgactacttgattggtaaacatttgtttattcttcccttgtaattgacacagtaattatatgagcccacatctatcctcatccgtttaaatacagagctggtgtgagtcgtactaagtcaggatgatggtatgtgggtccgtgatgctatattccatgggttaatataatctgcacatcatttaactaatccactgagggagctggtctgtcccagaagttttgttattaaatggaatagtcaatgttcttgttttcttacaaattcacttacagggagaattctgttaatttttttttttttttttttttgagacagagtcttgctctgtctccaggctggattgcaatggcgtgatctcgactcactgcaacctccgcctcctgggttcaagtgattctcctgcctcagcctcctgaggagctagaactacaggcacacaccaccacgcccagctattttttgtatttttagtagagatggggtttcaccatgttggccaagatggtctctgtctcttgacctcgtaatccgcccaccttagcctcccaaggtgctgggattacaggcatcagccactgcgcccggctgaattctgttaaattttacatacagcatgtagggcagaagacatactttaaactcataggttttcttactttcactcagaagggaagggaaaacagtacaattcggcgaaataggaaatctaaatctttcaatgcatgggtcatgtggaaaccgagagagagaagaaaatcgaaaaatagatgatggatgttgttaaggaattagtaaaccgttaagtgctctatcattattagatattcgggtgatcatcccgcatgtagctatttgaccaatgctgcttgtaaattggcttaggaaaattaacatacattttattaaactgacgagtatgccttttactgaaagcaaggaatagacatagccattttgtttaagaaatataagcacatgagaggcttaaaaaggtaggggttgtatgttctcagcactgcagctaaattcttaaatggaaactgttcttttagcagtttcagagtaggctatctcaagctgattgctacagactcaaattttaagtcgcatttctttcagaaacagaaggaaagtcaatctcactttcgaaaagagaaagtaaggtgacccttgtcatagtaacataatgcagcaggtcccaggtgtaacccggaggaaaaggcagacaaggtcctgcgatgccgcagctgaaaggaagctgacgccaacgggcttctcagaagaacaatgactcattagtcccgggctcacggcagatgcggtctcccaacaactggcctccctccaaaaacatggaggaaatcaagagggcagagccgggaaggaggctgcatccctcgcctgatggggagcactcctagcaggcacagggtaatcagaaaagtgctttggaatcacaaaatgaaaaaacaagtgtcagctgtgggagatgtagaaatgcaaataagtacgaatgcaaataggccggataaatggcagtgtgcaatcacccaaagctctgtttacaacccgaaggcagctccgtctgtaattatctgggcgccattaactgcgtgggagcagctctcaacgggtacaagagagataccaccagaagtgaaatgtcctctctcccgtgatgaagccagatctccgagcgattccatctacactgaactaaaccggtttgtgccaaagagctagaagtgtacctttggtgaaacaaggaagctagatttttttttattgcttactgcgcatctgaacgtaattcttgccattaattaagaaaacagatgataagagatttggcttcaataaacatgtactgaaagctaccacatcattgagtttaattatgcaagcaatctcgtggggcaggtactatgagctcagatagacttggtcaaggtcgtcccagtagagctgagattcgagcatcagtattttgggcctaggtttttttgttttttgttttgttttgttttttgttttttttttttgacggagtctcactctgccgcccaggctggagtgcagtggcgcgatctcggctcactgcaagctccacctcccgggttcatgctactctcctgcctcagcctcctgagtagctgggactacaggcgcccaccaccacgcccggctaattttttttggtatttttagtagagacggggtttcaccgtgttagccaggatgctctccatctcctgacctcgtgatccgcccgtctcggcctcccaaagtgctgggattacaggtgtgagacactgcgcctggcctggccctaagtttttacccttcccattatgtcagaagttctcagttgacaatgtctggagacatttttcactgtcacactacagagtgccactggtgtctagcagacagaggccagagactctgctaaacatcctacaatgcaaagaacagtccccctgacaaaggattatcccaccccaaatatcaagaatgctgacacggaggttgagaagcctggcatttccccattgctgcctctgggaggctgcctctcgggatagattgaattgttctgcaaagacatggtcggcagacacagagggttccctcaccaggggtctgggagttgctggaaatggataagaaaatcctagttctacctcgcagacagggaggaagtgaagaggtgaggcagtaaaaattcataacatatctatcacaaatgcattctgagattgcttggatctaaattgccctttccaaacccaagagatatttccaatgccacctgaaggtcctgagagctccctgacatcattcaggactgaaggtagaaagtagaatggccctgggttttctgagggttctttatttgtcttcgagaatattaaagaccagcatctctccagaatacaaataagagtctaatgtgataagaggctgaactgaaggtgtccctagaaaatttaagactaaaatgtcagctgaaagacaaagagaaagatgggattgttcttgcaaaatctcattggtaaagagagagaggattttcctaacaaaaatgttctgaactacaagcatctcagagggatttttgaattttggccagctaaacaccatcaggggttctggggggttagtcaaataaagtcagaaagggcctatctgcggcacaaaacacagcacagccaaagctgtggccaccgcaggaggagcaggagagaacctggtgaggagcaagaaagagcagctcagctctgcggagaagcatggtgctcagccatcactgctcgagcgtgaagagaagcgcagtccatggcagtttgggatgtggttggaagctctgcatcacagttcacatacttactaattttgttgatttgtgagctacagaaagagtctggggtcctgtccaggtgcggtggttcatgcctacaatcccagcactttgggaggccaaggcgggcggatcacttgaggtcaggagtttgaaaccagcctggccaacgtggtgaaaccccgtatctactaaaaatacaaaaatttgctgggcgtggtggcacgtgcctgtgatcccagctactcgggaggccaaggcaggagaatcacttgaacctgggaggtggaggttgcagtgagctgagatcatgccactgcactccagcctgggcaacagagcaagactctgtctcttaaaaaaaaaaaaaaaaaaaaaaaaaggatctgaggatctggggtcctgagagctccagttcttccccgcagttcccagagctgctcctgctgatacaggttctgctgccaaggcatcccaggggcctcagggtcccaggaagggccaaggctgcagctgccacctgcctgggggctcctcggccatccggcatcttccctccctccatccctggcctgctgttctgagtctctgagaagagcgtctggcggctggcaaaggggctaccatggaggaatggtcttcaggaagtggataaagctggccctgcctcatgccaatcagcccagcaagcagggaggacatcgccaatgagtttctggttttcacttcagaagttatagagacgatgtaagatgaaatactgttcagtgggctaatgcagccacacgagtgagttttattttcatccctactttaataaacatacatgtgccaagctggctctgaattatttaaaattacagcagtcagaagagagaccttctcaaagtctgtcagaaagatttttaatcatctttaagtaaacttcaatttctctgaaattgaaggagaattatttctccacttcaaaagtcagtacagagccattgaaggggctttccacctcctacgataagtaaaaacataaaatgattagcacaaaaaatacaccatgaaatgagtttaaagtccttaatcttgaaggctagatttaagacactattcttactgtccacaaacaggtttactttagtgatcataacaaatggcttttattcagaaccattactcagtatgattttaaaatctcgggcttcatcttttggataattcacatgaccttctccttagtgggcgagtacaagaaggcactgaatagcgtgccgttccgcaccaccaagcggaagggcagcactgcttgtatctaaggtggcgacctggaccaagggtggccttcgctgtcttggactggacgggctggactcccagctgaaggtggcttggaatttagctgttccttcggggccccgcttacacaccaacacccatgaatgcttttcaacgaagttgctagaatgcagccgtggagacgaacagcttaccgagagcctctgccaggaagcaaaagagaggttctcttccctttcattttggacatcgtaacaactaaacataacatttatatcactatctgtcagcagtttaacataaaccctctcacttactgccaatgtgtccacgctgctcctcaggcaagccattctccccagtgcacagatgaggaaatcggggctctgagaggttaactgacctgctcgaggtgaagaaaatgagtagggattagaatcagggagcgaggccgggcgcggtggctcatgcttgtaataccagcactttgggaggccaaggcgggtggatcacctgaggtcgggagttcgaggccagcctgaccaacatggaaaaaccccatctctactaaaaatacaaaattagctgggtgtggtggtggtgcatgcctgtaatcccagctacttgggaggctgaggcaggagaattgcttgaacctgggaggcagaggttgcagtgagccaagattataccactgcactccagcctgggtgacagagcaagactccgtctcaaaaaaaaaaaaaaaaaatcagggagtgaagttcctccaacacgcgtggtcttatactatgtcactgtgacttaccacatgccctgcatggggcgggggaactggcgtgcattgcctaaatcaagcgcaggagtttgatggtaccacgaagcgccacagggtgtgggagcctgagaggtactcacgcaatgcccgctggaagataagttcattgtcgcacagactttgtaacattgtaaggaaagaagcctgacagtagttttacaaatcacaccatataaattattaatggtaaatagataacccagagtggacagtacatactgcaatttataagaacaatcagtttttttaaatggtcataaccatttaaaaaaaaagaaaaaaagagaaagaaatcctccgcagtcattagttcagtcagttttacctttggtagaaacaagtgtgcttcagctgctaatattactcctgcctaaactgatgccccggtaggcagagccaaggggttaatggaaagagtggagcacgctgagcattttgccatcacagatgcctctctaaacgtctctagctcaagtaataacggagctgcctaattgcagtcattaaggagcctgtgactttaaatgacaaaggtagagatgctggcatcagcagcctgttagcatttaatttacatgaaattcgattcagtgtgcacgaactaactaggaggcgccaggcttaggccttaggcagacaaagagcaaaagtgtgggaggctgggtggggccggtgagctctggagcttctggctcctggactgggggactgggaatcggccaggccaggcccagcgggtgggagctgcagataccacttctccaggacccatcccagggcagcttcatgggatgggcctggctgagtgagcttcctaaggaaatcctcttgcctggaagaggctcccaatcatctgtcaacttgtctttcctatttagcaaacgattgagattctcttccttaaagacacattctctgatgaacagaatgtgctctgtaatgggtttagccaaagcatccccaccaccttcctccaggaatgtgtatgtctgtgtgaagtcctcaaggtcattagatctcatgaatttactccggcatttccatttccatgcatgctttttccatttagactaaactagcgcttggggtgcttgccatgctccaagaagtccctgcagcccctggttagtgggagacgcagagcaggcattcagtcagcaaatattaattgacgtggtgaggttgtgctctgaaaagctgagttcctcctgagaggctaattcactgtgctcagcctgtctgcgggtagcgagggctcctgagtaacagcgagctttgcacgagcgctaccgcgtggcggtggaaacatttgttccccttgatgaatgaaacggcactcttgacatgctgtacggacagaatctttacatgtcgtttattttgcatttcaaatgctttgaaaaaagccttcccgtggttttggccagaggtatttgttatcagtttaatagatttattcctgttttgctaaggtatgtaatagttatttatttttaaaaaaagccagtacctctccagtcttcattttcatttatccttagcatggtcttttctaaaaagggcatttggcacaatatctttttttgtttttttaatctctaggtaaccaacccctgcctacattttactctggattccaagagtagactgggcttcagggaccagatgccagggctggcacatctgcctaaaacccataattcttgaacttgacgtgctcagcctctccaaagccgcggcgctgacacagctccccctgcacgagtgtacagcagtcagacaggaacggggagagggggctcaactttctgacggccacttagaggctgcctgaccacaaagacaggactgtaaaacatagaccgcatgtgacctgctggtgctcggcactgacccaggggaggagggccacttgggctggaatgcagttgctgggggctcatgaggggctcagtggtgcccctggccaccgagtcaagcagcgtagattgatcagaggagctgagagctgaggcccaccctcccctttctcctacacatggacacctctgagtggaataagggaagactgtcctttctccaagcttgaaggaagatgactgtgactcttttcctggacttcaaggcatcgaagtgtcagctggctgccatcccagcgtctgacagggcagcaggagaaagaggccacctgtatcatccacccgtgctgcagctgaatgggatcggtgcagcatgatagaggccagctgccccgcaccaggtctgcgtgtcacagggcagagtgcatggtctcccttcacgtgcggggccaggtgactgcacagagtgatgagctgggcccactttcctgctattggccgccagcaaagaatacaaggggtttcccttcccttcccttcccttcccttcccttcccttccctatcgacagccttgcagggtggtggtttcctttgcccggagagttcagaggccttagttctggaaagcctcctgtggggagatggagtggcggggatagggaccagagcagagagggcagcagcataaacaaagaggagaggcaaactgtttgagcccaggagtttgagaccagcctgggcaacatggtgaaaccctgtctctataaaaaatataaaacttagctgggtgtggtggcacatgcctatggtcccaggtatctggagcatggggtggtggtggggtggtgggaggatcatctgagcctggggaggtcgaggccacagtaagctaggattgtatcactgcactccagccttggcaacagagagagatcttatctcagaacaaaacaaaaaaattggagaagggatttctctgatttctccctttgggaagggaggcttggaggctgcctggggctgagcagggagcaccatgcttgtaggcctttggggaggtttcgaggtccaagtgtgacttagaggaactgggagatgccagcagacactgagacccaaaggggcctggcttgggacctatgcagctgtgggaggggaaaggccctccccgctaccagatgcagactctggtgccctgaagcctggcgtctgagccagatctgactttgtgtagaagcataaaaggagtaggatgtttgtgatggctgagcgtcatggaggaattcatacctgttcctggagcaatctatttttaaccttgttaacctgaactgtactttaagattgaaactaaatgcagcctcttttctacccatgatttattagacctcccctttctatcaaattaaagctctgcacaaacgaaacaattcatcctcatctaatttataaccatcctcccacactaggaatatggagccaggaatgagggaggttcacgtgggaggtggcaactgcagaacagacagctctttggatttctttaaattgccatttaattccatccatcaacccatttttctgctgtatacatagaaaaggacaacagccactccctcaaccaaatatccctacattcagttaaaagctactctgtaccccaggacatgggagcagctcctatccttcccaggtgaaaaagtgggctttttttcccccttaaggctaaataggatttcttttctgttagctatgggtaggtgacttcttaatgatctttaaggaaagaagtcaatacaaggaaaatatccttttttaatcccattttccttctcaccccacactgagcgttactatagcaacatctttcctgctactaggacagttaagtccccctgtgaagttaaccgaaagctgctttttcactcagagaatgggctgctgttcattgaccagcttttcctgcgtgtctaaattcttcggttctctctgacatgctcaatctagggtttcccgcggctaaaccctaaaattcacttcgaaactcctaacagcagaattccccaaaccttttcagaactgaactcattagaaatgaatttacattttgatttagttataaataacttttcttctgtgtattggtttaagtttagaaaaggccccctgtaaagaagacaagttggagaataatctcccatattcctctgccatcctttctttccttcctttccttgagatggagtctctctctgtcgcccaggctggagtgcagtggagtgatctcagctcactgcaacctccgcctcccgggttcaagcgatgctcctgcctcagcctcccgagtagctgggactacaggcatgcaccaccatgcctggctaattttttgtatttttagtagacacagcgtttcaccgtgtaagctaggatggtctcgatctcctgacctcatgatcagcccgcctcggcctcccaatgtgctgggattacaggtatgagccaccgtggctggcctcctttttcttttaaacacatacatacatatatgtaaaaacaaaagaaaatttcaggaccttccaaatttcacaggcctagaggaaagttaagccctggaaatggagttgtgagagcaggctgttttttctctctggtgcgtgaccactgcttcctgatttttgtgttgagatcttagaccttaaccagacttatagccttcattcaaaccagactgaatgatgtgggaggtagggaccttggtcattgttatctctttataataaaatgctaagcaacccccttagagtgaagtcaacagtagccaatcaaatcttacatctgtgtgttagccgttgtatggaaaacaccgtgattctgttcagcgcctcccttttgcctccataaaagatcttcacttttccccacaccgtaatatttcactggattcttggaatatcagaaattcatcattctttggtgtctgcgtatctctgaatggccactcccatgcagcccttgaatgaattacttaactggatcctaagcattttgattattttagatggacatatacacatgcatatacacgtatgtgtacatacacatatgtaatgaaattgttccaaaacacagaaaatacaaagactaatgtaatcaggactcacatatccacatcttagatttaatgctgatttcggggggcatttttgcttcaaatttgtaaaaagcaaaggttacagacataaagatcttgcgattctcttatcccagtttcttccgtctttcttctcttctttctctttctctgtcccccgaggtagcatctatgctgacgttcccgtatatcttttccatccaaatatttgcatttttgctacacattacgtgcaaggcttttatctgcttcctcctaatttgtgggggcaagaggctagacatctctggctggaaaggcactccctgcagatctgggaagccatgagccacaggagcattagctgttcctctaccctttcgtttctttgctggacaatccttataagctggagtccaagttaaccttcccaaatgagtggcactattattttaaaataaaagcgttcaaggtagaggatgactttgggactctggcaacacaggaagcccagtgtgttctccccaaggtcacattaaaaaggtggtgcatctgagatggtgactgctcagaataaagtgataaggggacaaaaggtggatggcttacttacaggtgttatgaatgagaccatcagggctcgggtaagaacattgtctgggataaatggtttgtggttattgatctggaccaacctgatagaaaagaagctgtgtgtattattattacaatttcttggtttatgcttgcaatttataatttgtatgctcagtcaattctgccaatataaaatagtaatgccccggtttcaaaatctgatattggattttgtcccacgatttagcatgtcctctaagcaaaataactgtccaaccagatcacttgccttcaacaacttaaaacacaagtaactagggagaaaaacaaacaaagaaacataaactcaaagaaggtttcaagattgacatagagaaaaatcttttctcatctatccgtatgtactctcccactgctcatcgtgggccccagggaaaggcgattttattcaaagaaggtaactctgaacgtactcagggccgtaatatgtgaaatgtctcccagtgtttgacaaaaagactctcttttcatgttcatattccatggaaatcttaagtcaaagcaacaataaaataagctgacccataagtgcacgtgttgaagaggctcagccaagaaaaactgtttggtagttgctgaaaactggcatctagacctcaaagaggaaatcagaaccaaagtgcagacttgtcccaccagagatggtgggtgttggactgagtcagcgacagtgaggcactgactagacttccgtaaccagccatactttctagtttataatgacattcatggttattgttctacacagacaggtgtagggaagcaatgggaaagtgcaggaaaacagaagcattgggaatggaacatctttggtttctccatttcaatgcactgccatgacccccacacccacccacgagactttagctgttccagagccaacggtgcctgcctctttgctgatccattactcattctccctacagctgcctcatagctttggctcccaagaggtaaggtacaggtagtctggctgcctgcattatcctccagcctcaaaatacatggggaactgaaaataaacaaactgttgattccttgagcttaagaaggcctcttggtgttcctttataccttttcgagtctctcctaagatcagagagaggagtgaagagggggaaggtgtatggccaaaggaggacttgccctgattgccactggcaaagacgctgagccttagggaccatccagaggcatgcaggacccctgctgcagcattcttgaaaaatgatgtcttcctacgcctccctgactcaaccagaagctcacaggtaagaacacatcccatgttgcgaagctccatctattgtgagaacttctgccctgccggctgcctctgacatgccacatgcaagtgataccatttaccctactttgcaatacataacaatctgcactggtgtttccaatgcccaattgttttcttgacttctccataagtttcagcatatctataaaccactcataccatgatttacttaatgttttctttttcttccttttttttttgagacggagtctcgctctgtcacccaggctggagtgcagtggtgtgatctcagctcactgcaacctctgcctcccaggttcaagtgattctcctgcctcagcctcccgagcagctgggactacaggtgcccgccaccacacccagctaatttttgtatttttagtagagacagggtttcactgtgttagccaggatggtctcgacctcctgacctcgtgatctgcccaccctggcctcccaaagtgctgggattacaggcgtgagccaccatgcccggcttgttttcttaatttaattaaaattattccaaaataaatatcataccattaatgtaaatagaaaacactgaattgtgttacttgccacacatagaagacaactgcaaaaaatcaacaatatgaatgatatgaaagtcaaacacttttgcctgtggaagagcccagggcctgcattcttgtttttaaagaggcaggtaagcaggtaatagagaagccttgaggactagaacagaaccgatggaaagagaactggcaaggggctaacttctgcatgacgtgtttccatgttatttctcttaggtcccagcaccgcagaaaatcatcttgaacacctcccaaggccaatctcccattgcaacaaatgaactattaaaaacaggggtctcttttatcctaccgtcatctcatttccagataaaacacctccagtttcttcaatgacttccacgagaagacctctctggagaggtctgaacattgtcttctgtcagctccctcttgattttgggaccaagcattgaatataaagttaggatgtggcctgattagcataggcagagtactgagaagccttccttgtgcctgtcactacacttccatcaacagactccatcaacaggaggcaacgcagcctcaggataccacctgcccacggcccacctgagggaacctgctgcccacagcctctgctcccagagggacctacccagtcccaaagctgaggcaccacccatccttgaatggccagagtaacctgtctcaagaatatgagcaagatgattccaagagaaagtggcagtcaacagtggttttgtacaatgcggataaatattagaaaggccatccaggatgcgtcatttgcaagcttgggtggacaggcagctgccaacagtgacagcaggtggcccatgagtgaaacttagagaattaggggactgctttggtcttggcagatttcctggccagtccatggaaccctcaaaataggtcccttaattttgtagaaaaatggtgtcacctttaaacgttgtaaactacatttataaatttaagacattcttttttttcttttttcttttcttttcttttacttttttcttttcttttcttttctttttttgggatggagtctcactctgttgcccagactggagtgcagtggcatgatcttggctcactgcaccctccccctcccgggttcaagcgattctccttcctcagcctcctgagtagctgggattacaggcgcaccaccacacccagctaatttttgtatttttagtagagatggtctttcaccgtattggctaggctggtgtcgaagtcctgatctcaagtgatcccacctcggcctcccaaaatgctgagattacaggcatgagccactgcgcccggccttaacacactcttaagtacttccaaagtctgatttaaaaaatagttttgtttttcctgaggacttaaataacttataaataaatcaaagcaatagatatagtgcgccttaagttctctgaaaggctttgatactgtttacaaactttgtcagagttcaatttaatatccctagcctcagtcaattactcaattgtgtttcaagctaagtcacaaggctgagctgtttcactaattaaccacattcctttagaagttcaagtatgtataaattccttaatacaaaatattggttctgtgttttttaattctttaaaacatttctctacttaattctaaatcttttagggtgaaagatgattagctactaaggaaactattgcaccatcccacacaactattttaggtgatgttcctgtattatttttgggattgtcctctcaatttgcttgtagttgcgttataatcaaaacgtttagctggggtgctgactagattcttcatggtgaccaagtgggttccatggagccctatttatagttgccatagtgatgattccataacccacaggcgaggggcagggagcccttgactttaaatccaaattctctctctctctctctctaatatcatatatattttatatatatataaaatacctccattcaagtcacttggcagaattttgcactattgtgctcttaagatataaatatatttccatctcaaggtcacgtcaggcttaataaaattctgtattgtcaaagtctatacaggaccacacacattcttcgtgtattcaatcgcatttttgatatctctcatagccatttttgatagttgcaaattctaaggccattcattcccacaatctatttgatgaaagtttttaaaaaatggaatattcaatcctttatagccaatgagggcctgagccttgaaccagtgaacagtactgagtagcagttaggagggcggggagtcagactgcctgggcttaacgtcgtggctctgtcactcatttcgtactcttaatcatcatgctatagaaactcccacaatgtgtgtgtgtgcatgtgttattaaatccttcagatacttctcagactcttgcctgtgtagataaacaacgtgtgttttctatcaccttggcttgtctctagtacctggttttttaaccaaacattactctgggtgttgtggtgaaggtatgttgtagatggggttaaaatctacaatcagtgggattgcccttgataatcttaacgggcctcatccatttagttgaaaggccttaacaggtttctcagaggaagaaattctgtttcaagattacaacatcagctcctgctccgttcccaaccttctggcccgccctgtaggattcagacttgggggcctccatggctatgtaagtcaattctttgaaataaagagaactccaactaatgcacaacggtcggtccatccctccctccctccctccctcccttccttcctcccttccttcctttcctcctcccctcccctcccctccccttcccctctccccaaattcaaaaaaagttaactttatgattaccctttctgggaatactagttgttactatacacattattcacatagaaaaatcagtaatgtaccagttggtagttgaattcttcagagggaaagattagtatcttattttttatttaatgagatgaggaactaaaagagcattactattctttactacaatatataacagaagtgttttcttggtgtctgcaatgcaaattctgatgtcagtaaatacattgagagactaatttgtcaagcaagcacagaccacacatggtttctttttatttctttctttctgagatggaaggaaacctaaaagtaacaatgtacacaactcgctagggttgccagcagcattttggcgatgtccccttgggtcacagaacggcagcatgggttctataggtcggggtggcattagcactgacggcacatagcctgtgtcttttgagctcactttccatgttatcctaggtcctgtgaaagaaagacctcaggctcacgttattagatccttgggtaattctccatactctgaagttcttgaagaaggcactggctggggttagggtggctttgggaaacccttgactgcttgaggaatcctttccaattccttccttaaccaggcaggaggaacagcagttcattcgtggtcttgagtccaggttccaggttctaagcttggtctatgcttttggtgtgctctctaactcaatgataatgatagtcatggaagtttcttaatatctggggttttgaaactgttagttcttggagcaagcccaagtttattttgggggaactttgcgccagcattgtagttatactgaaatttagaatatgtgggttgaaaagcaccaaagccagtgtgagaaatccagcccaccattagggctactgaagtcccattaggttgactactttctggaggccaattgcacttaacttggattcctgagtgactttctctggtccataacttcatctaggtcactgctgagacatcacctctccagtaaaaccatctagcctgtctaaagtcatccttccactcccccagttgtctcagtttctctgtcttttcttccccagctatatttttcttcataacactggtttctctagacattatattacatctagatttgtcatatcctgtctctcctattagaacatagacttcttgagacgatggactgtcagtttggtttaatttgacacgtgttttttttttttttgagatggagtctcactctgtcgcccaggctggagtgcagtggtatgatctcggctcactgcaacctctgccccccgggttcaagcaatgctcctgcctcagcctcctgagtagctggaattacaggcgcctgccaccatgcccgactaatttttgtatttttagtagagacggagtttcacaatcttggccaggctggtcttgaactcctgaccttgtgatccacctgcctcggcctcctaaagtgctgggattacagatgtgagccaccacgcccggcctgacacgctgtgttctaaacacccagcacaatggccagcatgcagaaaacactgcagaaatatttgctgcatgaatgacttgctatttacatcagcctactaaatgctacccagtgagtagaaaaatttcaaatgaaagcatcctaatcattcctttttttatagaggcctatcagtgtaggctattctagtggaggaaatcacatccggtccctggtgccatgaagttacagaaatattaggtgcaggccaggtgcaggggctcacgcctgtaatcccagcactttgggaggctgacgcgggcagatcacaaggtcaggagaccgagaccatcttggccaacatggtgaaaccccatctctactaaatacaaaaaattagccaggtatggtggcacatgtctgtaatcccagctacttgggaggctgaggcaagggaatctctcgaacccgggaggcggaggttgtggtgagctgagatcgcgccactgcactccagcctggcgacacagcaagactccgtctcaaaaaaaaaaaaaaaaaaattaggtgcatacaaataaatacatatacacatactttaactcatatcaacatattatagagaaacaaatattgaaaagaatttcaaggctggccatgtgtgtttatagtttcttccagttcaaaatcactatgaaaaaatgttttcctaaggagaacgttggcctctaggggaagcaaagggctcctgtgttgtgatggttaatattgagtgtcaacttgattggattgaaggacgcaaagtattgttcctgggtgtgtctgtgagggtgttgccaaaggagattaacatttgagtcagtgggactgggagaggcagacccaccctcagtcaggatgggcgaaattgaatcggctgccagtgcagctaagataaaagcaggcagaagggtgtggaaggcctagactggctgagtcttccggctttcaaatttctctcgcattgaaagcttcctgccctggaacatcagactccaagttcttcagcttttggactcttggacctacaccagtggtttgccaggggctctcaggcctttggccacagactgaaggctgcactgtcggcttccctacttttgaggttttgggagtcagaccggcttccttgctcctcagcttgcagacagtctattgtgggacttctccttgtgatcgtgtgagtcaattctccttaataaatgccccttcatatattcatctatccaattagttctgtccctctagagaaccctgactaataatctcccacatcaccagcttgaatcctgcccaagaataaagaggatcaaggacagggcactgaactgtaccaaaagaaagctgctctttgggtttgcgaatgctgacctgggtctgctttgtatgggtggtcagagggtgaaagggtctggggtacatgcacatgacccttcctcttcctcttccacccacatgcccagagagctcagggcttcctcaggagaagagatggtctcattgctcagggaaccttttctcctaggcaaacagaggtagtgtggcagctggaagaggcctggagtggtacttggactttgaagccaaacacttgccctctcagagcctttgcctccactgtggtcctaccagagagctgagttcaggacctgggtttgggcgtggaagggcggtgtgagagcaaggctgaatagtccaacttcctcctttaacaaatatccactgagcgtcttcgctacgcaaggctctcttccagaccgcttggttctttggagtccaggagttctccactcggtacacccagttttaccaaagttaaacccatgagattttgtaataaagccaaggctaataataatgcattccattacttttcctacacatgtgtctctgttaagcactttgcaaggaggatgggcagctgggccaatgcaggatccaactattcaagattcctccacttacacaatatattgacactaactctgaatgcatccctactgaatagagaactctagtaatttctactgaaaacatcaaataaaaaagctactactttaatagaaattacctcttctaattgccctacaatgatacaactgtattctgaaaggatacatggatgtcatataaataactcaaaattcatgtttatatttatgtacagtgcctagaacaatgataagacatgactgctgaatgtgtggatagatggatgggaggatgaatggatgcatgaatgaattaatgaatgctctgtgatctgagggctgaagatacattactgaaaactccaagaaggtcagaaagcaaaatcaaggaatatgaaaatctactgttaggtacaaacgtgtctctagagaagagactggttctgaaaatagggagaatgggaaccaccaacttcctgtgtgtgtgttaccacactcttaatatgaaaacatgtgtgataagaagtccaacattttgtagatgaccgcacatgtaagttaaagaaatagtggccttcttttgtctttcctttgtagttttttgggaaaaggacgccaataatcaaaagacctgcagaaaaggtgatttggtgtttcaagggttgtgggcttttatgggacacaagctgaactgtcatgcagacaatgaccgccttctgatttacttgggctgctcaaaactctggaaagaaaaatagaatatcctagctgttatgggaatacttataagaagaaaaagagaaatacagctctttgtacattcagattcctttagcttgaaagaaaaagggtagcctcctttaagaaaacctttgggtttgacagaacataaataaatcttagtgcagctgcttatcgagctaaagaaggcctggtgtctctgctgccacttacagatttcagaaacgtgttgtcattctttaatcatgatcattattggagaatatgattgaaattttaattattaagtagggggaattgtgaagcactttcatccagcatctcgggtgcctggtgtgatcgaccataagtgcagctgatgcaaacctggaagccgttatcacagctccctggccctcgccgcggtggaggcagccgtctgtctacctcctgccggctgcctgtctcctaaaatgtctgcatgctgtttactgcagagccagtgtttgaaccaaatgctcagtaatgtgaaaacatcaattatttccttcctacatttaaatgaactatgattacccttgatttaatagcaaaggagcatttccaaggtacaaaaacatttcagccattaagctcaaagtttgtgtttaaaatatatgtttgttttcttctacagagcaatgggcactaaatttattagcttcgtgctcaccatgacagtaactccatgtctgtggaattctgtagtctgcatgtgttaggctgtgggtaggcaagcttgtcaatggagaaatactgactttgccagaaattcgtaaatttttaggaaagtgaagagcatatggtcactatgacttgctagtatccttggtctaaaccttataattaccagaagccattttcatgtttttttttttctttttaaagtgcatatctttatttggacagcctcaaatcccttcatcttatctggagggaagacaggaatgaaaaccatgatagtatccaggagggattttaaggcaaggctgagctttctaaagctacaagcacttccttcctcagagagtgtctgctgacagccagggccttgttagtggcccagtagccaaaagaagctactttcagaagtggtacttagcacctgccctcagtgatcaccatttttcaggtaagacttgttctccaggttaattacagtggaaacctgatcgaacttgacagtcagtgtgtttgtgggcttctcttcctgccagtctgcaacctaaaggaaatgctgtggtctctctcttaagaatgagaacattctcagaaatgcccttgaagtgactattaattccagaatatggtgtgaattaagtaattcatttggttttagtttacttttgagaaagtccaagctgtgcacatgttgaaataaatcagaggcctgtttacaaatggagccaccatttcttagtgtggagtgcagggacctggttctgagcaaagtagtgggaaggatggaattccctgaatccctggatctgttcacaggaatgcctagagcttctggcacacagggtagcaggccttcctgatgccccagcttctctgagatccatcctgctgtcagccctagaactccctcacaagcaagctattttcccgtttttctcatcgctgtttagaggtttccacttatatgtagatttgtccagggtcctaggaaactagctaactggtgccaccataacatttgctataattataacagttcagttatttggttttctctttgtctccttcttcataatttagaggctttcaatgacttacccctaatgggagatttctggcccagaaatgggtcagcagaaactattatattgaaagttggtttcttggtgctgcttacattattttatttagataagaaaatggctgttgatattttgtaaaaaaaaaaatctatttatccatcaaatcacatatgcttctttcctttaattcaactatccatccatcagtccatccatccatccattcatccaaccattcaacttttaatgtgtccccacagggtgaagcaggcatggtgcaggaatagtacgaacaaatataaacagcaattgatcctaccctcaataagtcatctgcttagaggacagattttggtggtaatacaaccaaagtttataataggaatataatccgtgttattttaggatgtcacagaggttgcaacaaaagattattttatttaattcttgttgatgggcaccgtgtgtttacagaggagagtgcctttgaccaagatcttgaaaagtgggttagatattgcttgggaataatgggcaaaggaggtgccatactccctctggatagtctcaggcccaaatatccatttaggatctctggaatataatgggctatacttggcattggagtcatttagaaggacacaggacaagaagcagcatatcagcaggaagggccaggggacacttctctgaacccccgtgatcacttgggtttggggaaggagacatgctggtaggtaaggagcaatgctggggtagaagccccaggtgccacatgtgctggcaggagttccgggggcacaaggccaagctgaagaagacacaacttcatcgccgtgagcatgacttccagggatgtccacagctgtggcttctcccaggtatttatagttcatttacagtcctgcctgtcaagatcccacacaccaaccaagagttatcttttttttttttttcttcagatggagtctcgttctgtcgccaggctggagtgcagtgtcacaatctcggcccactgcaatctcagactccctggttcaagcaattctcctgcctcggcctcccaagtagctgggactacaggtacgcaccaccacgcccagctaatttttctttcttttttttttttagcagagacggggtttcaccatgttggccaggatggtcttgatcacctgacctcatgatctgcctgccttggcttcccaaagtactgggactacaggtgtgagccaccatgcccggtccaagagtcatctttatcataagtacttactgtctattaaccccataaacattccacctgcatcagtttttcagaaaacagaactgaacgtcaagtttgtcctcagggacagagaaagagttttgctagccagtggctcagaggaagcagcggcctgtgcaaaggtctggaggtctgaaaagtactcagtgagttccggacccggaaatggttcaacatgagttaagtataaggtgtcgctggagatgagggggatggtggagagggagggtaggtggaagatgaggccagagggtccagaaaacaaagtagatggtcttaaggagctgaggtttttaagctctagggaatcactttatggggggtgttatgagcatattttatggtatggggataaaggatggattactagggggaatacactcaaggcaggaagagtgtaggttgttccagtagttgaggtaaagagtggggaccctgagttaataggaaagaggaggtggatgcaggaatcactggccttctggaatcaatcagttatcagtcagccactggagataaaagggtctggaatacatgcacggaggattctaagtgccactcattgcaaggaccgaggtaagaagagacaggacagggttgcatgtgggtgagggaagaggtggaaaaatgagctcaaatattgacattttacatttgaaatgcttatgaaaattccaaatggaggtatccagtaggcaatgtgaagtataatccaggagctctagagaatggtctagttagagacacagacttggggcctatcaactataggcagtcagaactgcagaaatacacgagaaggtctgagggagggcttggcttgaagagaggaccaaggatggtcaccttgaaaataacagcggttaaagggcaggtggaagactagcttgcaatgtgggctgtgaaggatggcaatggtgggggaagatggctggaaaggtgggtgagaagggcacccacaagctagcaggggagggaacagtcaacagtgccaaatgccgccacctgcaatgagcggggactcactacggtagggacctacacatgctttgtctcatccttttcatctttgcacaatattagcctctactgtcttccaatatgaccaaagtctagtccatctagagagatcagatcaaaagtgagcctgaatcatttacatctaacaatgttatctagacagcatgcttttattctgaatcacctgaacttccagctatctgtggtttataagctggcataagctggcatttttcagtcgaaataccacagggagaggtattttaggagctgatttggtattcagttaatactgtagaacgtgctcttccattaccttgaagctaatgactagctaaattagttatatggcccaaagcaaagataagatggttagtatgtttgaccagtcattaaaatgtgtgtctttctggaaaaatattctctgaagtgaaatgacaccatgatgtctgatcagcaatatagctcacccttattttaaaaggtctactttgaatgtctccccagggtgatcatattaaaaaaatcaaaatttaatatgtcattaacagaggttaacttgctgaaaaataagctgaattcgttgggaattgctgctaaaacattctgtagctggaaaatatcaccctgtttctctggagaacggtagcaataaaaacacacagaatacactttcatcccaaaattggcatactttaaataatccatgatttttttgttctaaactggcttaataggtctgaggccaataatattttctatttcctcaggatttcttcactcagtttttttgtttggtagagcacttagtattaacaaggcactacagtaggctataggggcatgaagatgtcagaagttctatgtatagtagactgcaatgtactggaagcaacaggaaagtcagagagataaatacttacataaatactaaatagagaaaaaactacctaatgagaattatgggtgactgagcaccaaggggttccaaggtcagtgtgagcccttctggctggagtggtcagtgatatattattgaagaaggtggcatggggcaccagtagaattcctgaggcatccagattcagcacggcctctggaaggtgactgccaggtcagcttcactgtcagctggtgcctctcctgacccctcctcccttgttaccaaggatgccaaaactttcccagctttcagaatgacgactgtttggttctacctggcttatccttactgatcctgcctaactggctcttgaatcatgttttccagaggtcaactgagtctaagaagacattaaaaatcctgaaattggccatatcatcctgcccctccttgattttggacaggatgcatttgggatctggcagcacttttctgagggcatcaactaccaaggttggagggatctttacatcaacctacactatacctaccagatgctttctttgaccatcttgatatccagatatggagtattcccatttcttggttcccatggactgaaactttacaggtaaaggccaaagttttgattcagcatgaatgagaaattcaatgtactataagctggaaagacttggctgaaactcagccccagctaaagcaacatcagaactgcatacacagtggtaaagatcaagtgtccactttggaagtataatctttatctagtgatcacttttccaacatttccatccaaattttggaagcacctaaatccaagccctgcaactatcccacaatattatagtattattcacttatatttaagatactgtactccatagagctaggatggtagacatcaacatacagagacctttagggttttttttgtttttgtttttgtttttgtttttttgagaaggagtttcgctcttgttgcccaggctgaagtgcaatggtgtgatcttggctcagagttttgctcttgttgcccaggctggagtgcaatggtgcaatcttggcttaccacaacatccgcctcctgggttcaagagattctcctgtctcagcctccttagtagctgggattacaggcatgtaccaccacgtccagctaattttgtatttttagtagagacagggtttctccatgttggtcaggctggtcttatactcccgacctcaggtaatctgcctacctcagcctcccaaagtgctggaattacaggcgtgggccaccatgcccagctggtactttctcaagccagggattggattgggaaaactgatggagttggccaattcctatggaagtcacatttcattcctggaaactttgaatctcagattttcttttttaaagaaacttcatctatatatcatttatataatatgaaatatgtcagttttaattgtatactttgatgagttttggcaatatatgcaccactacaatcaggatgtattttataacctttccatgttctgaaaaaggttttctcacgcccatctgcagtcaacaccatcctatgcccacctagcctaaggaaatcattgaacttctttgtgtaactacagtcttggtattggtaatttctcagaaagtgtaaactcatgttcattagcagacaaatagaaaaatgaattaccaaataattaaataatgccttgaagggctccaaagtaagtcacacctcaaattctgacatacaggcccctaaggtctcttatgaatccccagtgaaacgaattagtcaaatgtcaggtaaaaccatcaggcaatacacaagttcctccaccttggcttccccacctgttgcttgctgggtcacttgctcccctttgcttagccagttcgacccacaaaatatctccttggaagccttagctcttcaaggaggtgacaactgcttctgcagagctcaggtccttgtggtcaacaaaagcgataggctgcgatcctctccaggtgagctgcagaggttagaaagcccttcaatcactgactcttgcagcttggagtatgcaaaaagtcgcagcgacagagacagcagtctagacggtgagtcttctttcataccgtcgagactggcccatgcaggacctgctttaggcctttctgcctcagtgtttgcttactgctctagttctttttgaaaggcgacatgctttctggcttgcttcttttggtaataatgatgacttcttaacattgggattttaaaaaatcatcttggagctgacctacatttttatacgttctgatgttcctcattccttcgtacagatctgggcttcacttcatatcctttcaacctgcagacgtgattttagtatttcatgcagtacaagtctgatggattctgtcagcttttgtcatctgaaaatgttatttttgggggcctttcttttggggatttttttttttttactagacatggaattttagtatacttttttctttccatatcattccattgttttctggcttccattgtttttgatggagaagtcagccctcactcttatcaccgtgctctccatacaatgaggttccctctggcagctcttaacattatctccttatcttgtgttttcagcattttgactgcaatttgttttaacacattgttttctttgtaccgctactgcttaagattcactgtgctttttgggtatttaatttgatgttttccatcagttttggaaaagttttcaccattatcttttcaaatatttcttctggcccattctctttctttttcttcttggattccaattacacagtgtttgatattcaccagatcttggatactctggtctatgtttattactttttttcactttgtgtttcctttctctccagctttattaggtataattgataaataataatcatatattcaacacatacaaaataatgacttgatatctgtatacactatgtaataattacaatcaaattaatcaacacttctatcaccacacatagttatctttgtgtgtgtgtgtgtgtgtgtctgtgtggggaggacacttaagacctagtcttagcacatttcaagtacacaatacaacattattaactctagtcaccatgctgtacattagatccccctgtgtttctatttgaacagtttatattgaccgctcttcaagatcattgatacttacctcttctgctcagtcttctgttaacctgttgaatgatttagtcaattctgataacattctcttccaggaaagtcttattacttttagtaattttcttcacttaggttttttttgatctcagctctctgatgggttaaaaaatctctgaaactatgtaagctgtttggcttgttctttttgttacggtagaaatctagaaaatagttttatcatttctcctccagtcaactagtttctatttttgcactcatctgctctgatctgtttaggcagaagcttaaacaattctgcttgctcaactaactcagacactgtggatgttaggatgaaggtacagtttgcatattaaaagataagccagtacatctctgagatttgccatcctctctggtaaggactgcactcaaagtaacaggagggcctaaccttaaataaatatgcagccatactgctagggcaaacatccacacacagacacacagacatacaaacaacccaaggacaggctttctgacaagtgattgatagatttatttcaaagctgtcaagtagagcccaaaaagagtggaatctcagggttctcttggcaagactatggttctcagatgggcatacaagctttttcctttctgggacagtcacacgaagttagttaatgagggatttttattcttttgtttctggtggcagaaataaaatattcttttcagggcaaaggaatgaaatctcatcaagaggttcctgtctagattcgcgtccttatatacaagccaacttctctctgcagaatgttctacatcccagaaaccaggattgtttgccactgatttcattttcttctcactgttgcctctggattaaaaagcctctctcattactgctcatcagtgtcctgctgctgggggagccatttgtgctgacgaatagttgtttttttcaatgtactgggaaagtggcattttgagagagacttcttccatctacacccttctgtcttaagtataattcactcattcattcattcattcacccattcatcagtaaatattattgagagtggactgtgtgcctggcactgtgcggtgaatttgatatagacacatataatacgaacacgattctagccctatggagtatatacgttattaactgataagttcagtccagcacacacttaccaagttcttgtatgtgctgggcatttaagagtgtaatgacgagtaagatgggcatttctctgtaagcatatggtccaatggggaagacctagatacaattttaatacaatgctttactgttgtataacagagaaacatgcagattgctatgggaatgcaggttgagaggtgctgagcctaaaaggaggatacagggaaggcttcctggagatgatgacgcttgagaggagtctcaaaggatgtgcaggagcgacagaggctgcaaatgcctgcccaatattcatgttcctcttcttcctcagtaacagaacaccaactatgtgcccagcaaaattctacttttccagccttgcttgcattagggctgatcagtgagctgtgagtagagggtttcctggggattccagggagctacattctcaggaggaatggccatggctcccttgtgaccatggaggtcccacactgtccgtcagttgcatacttccagcttttttttttcatgtgagaaagagtaaaattctattccttctcactcccttagcctacactttatttttatttttagttttattgagacagagtttcactctttcaaccaggctggagtgaagtggtgtgatctcagctcactgcaacctctgccttccgggttcaagcaattttcctgcctcagcctcctgagtagctgggattataggcacgcaccaccacacctagctaatttttgtatttttagtagagacggggtttcgccatgttggccaggctggtcttgaactcctgacctcaggtgatccgcccgcctcaacctcccaacgtgctaggattacaggcatgagccgccatgcccagcctcttaccctatactttaaaacaaaaacaaaaaaaaaacagccaaacctaatcttcaatctgaaatagtgtactacgccaggtgtagacaggaagagagaagaggcagtgggtctgggaaaatactcagccttgaaaagtcaaccataataaatgtcaaatcctacagagtatcctttaaatggcaagggggtacttcagcctgactccatttttgcctcactccccatttattgacatgtgcttattaacatgtttagaaacttaaaaatgcattcatcctttactgaaatctgcccaatgtcgtctgctattatttcaaatactcatatttcaggaaggctcagatttaagtgaaggtgtcaccacagtctaagttaccatctcctgtccttgcatccatggccggggaattactctgctatttaccactaatgcagctgccgggaggatccagcctcagaggacttgggtatgttcttctcaaggacaggaaagtcatgcacagtgtatgttcattcatttgtgaagttgtccttgtggccacagttgaaggccctcatgctcactgtcagcctatacacctgtcagtccttcccataagacatactcaacaccaacctggttaactgataatgctgactacaaccaaggcaacttcctcctactttaaaacccagcagtacacaaatgggcgctccctacaggccaagtaaaattccttcatgcatctcctaatgactccccaccaaaatgctgccaaagagtcaatactgccacctcccccatgtctgtgtactcatccctggaacttatgaatatggtagcattcatggtttggttctgtgtccccatccaaatgtcaccttgaattgtaataatccaccatgtcaaggatgggaccaggtggagataaatgaatcatgggggtggtatcccccaggctgttcttgtgatagtgagtgagttctcagaagatctgactttttttataagaggcttcccccttcactgggcacccattctctctcctgccaccctgtgaagaggtgccttccgccatgatgtaagtttcctgaggcctccctagccatacagaactgtgagtcaattaaacctcttttctttataaattactcagtttcaggtatttcttcatagcagtgtgagaacagactaatacatcgcaacgggagtttgcagaaatgagtaggttaagggtcttgaggtggggagataattctggactatccaggtgggtccagtgaacaagagaaagagagagagagagagagagagagaaagagagagagaaagagaaagagagagagattgaaacctgaaggttactttgctggttttgaagatggaggaagggacctcaagccaaggaatccaggcagcctcaagaagccagaaaagggagaaaagaggattctcccccacagcctccagaaggaatgcagccctgcgacaccttaactttaggacttccgacctacagagctgtaagaaaataaatctgtgttgttttcagccatgacatttgtgataattttttacagcaaccactggaaactaatacacatattactgaactgtgagaggtagaggaccactagcctgcattttctcatagaagctatagcatagcattaataatagtggtaataataattgttccgcttaaaaattagctaatgcttgcaaagtgcttactatgaaccgggcattgctaggctgaacatccaacatacatagtttccttcaattcaccaaggtaggcactcttaaaaaacacccatttaatagaagaggaaagtgagccacagagaagttaatttgctcaaaattgcatagctaggaagtgaactctggctagggtctaaacctagacagtctgagccttgtaacctacactaaaataatggtgtacagtctatgccacataatttttgtgtttgattatatgctttagttatattactacctttgctgtcataggcccattagggtattatttaatgtagtcactcatctaaatcttcattcccctcttcaacggctctacccagtgctcatcactcttctgctggagctgggagtggtggaagacctgaggttttcctctaggtagaaggaactcccattatgaacactcaagagtaattctcaacggatcagaacttcctgagagcaggacactctggattacctgagaagcactcccagtctaaccctttgacccactcaagagatgtcctatgtcttagagggttctgccctggccctcctctggccacacccctcttcctggagcaaagagtctgtggagctaaaaagctgcacccacaacagcacatgcttgcccttcagactatgccccaggcacctgagccccagaattccctgcccaaatggcctgggcttgattcagggcttgtgtaggcagcttcctcccatctgtccttctgagagtggactgttccagtgatgtgcctaccctgagcccgaaggctgcctgaagggctgccacatgtaggggatgtggatgaatctgagatttgtgggctgggtgtctgcctatgtgtgtgcagagaaccttctaggcagggcagagctagacaagagaaggggtctgggctgactctcccagttccactaagttctggtaaagaattctgaggggtcagagaattctaagttagaatctggcctctaaggtccttatgaaggtgtactccttaaggtaagaggatagcatgtattttatttaacagcttgctagtgtgatttagaatttttaaacattgagatgagggccatgtgaacccacacttgtcttcttatcccaggtcctgcaaatgttaggactggactaaccactccctctcaatagagggagagacagagaaaggccaggtaatgaatagagtgaaaaatgtacattagaaaaatgctctttcaaaaagcctagaaagaaatatagccaaacattagcagagtctgcaatgtctgagttttggggttatggggatgttgttttatttcacttacagatatacacctacgtaagcagctttataataagaaaatatttgtttatgaattcaaacttatgaatattcaataagttcccagtataatgtcagcattagactaggatgaaaaaccaaactaaaccaaaccaaatcaaaacaacaaatcttcaagacatgaaaaagaaagaaatggagaaatatggattgggtaatgaagaatgtatcctcttaggcactttcattaacaacttgaaaatagaccttgacagaatgatgacctaatttctatatgctcttgaattggatggtctatcggaaacagaatcaggattcaaaaacatccccccaccgtctgacatcactgggtaatctaacaagattacagaaccgacttttagagaagagtttaaatcccagtactagaatatatgtaacagctatattggctgtgggagttatagcttaacagaacatgtgtcataaagataattaacatacaataaatgcatctatgaaagattaaattaatctaaggtaacactaatagaaaaatacagcataaactgaaggtgtggatagttttcttttgctatgtggtggcaagacctcacctggaatctgtttaatttcaataccaactttgggagacattaaaaaaaaatactgaagcctatgaagaagaagttctctctcatttgaaaaatttttgaaaaacctaatctagtattttgaccatgttaagaaggaaggacacatgcatgtttggaccagggtgttttgtagagttggtaatcttcttcatggcctgctttaatgactgaaggataagcccttcacagaaggactaaggcttccaagtaccccaggacaacagagggaggttgattttagctagatataaagaaaaacgttgtaaaaatcagaactgtttgaaaatagaatggatgcctttagaagagagcaagtcttacttgcagaacgtgttgggagtttaaggaaacccaatccatgacacctactatccctgtctcagcttgaaaagaaaaatgggtcaactaatttttgacaaaggcaccaagaagacacaatggtatctggataggataatatcttcaataaatggtattgggaaaactggatatccacatgtaaaataatgaattgaacccttagcttgtatcatacacaaaaatcaactcaacatagatgaaagaacttaacataggacctgaaatcataacattcctagtagaaaacacagggaaaccccatcgccttggcaataactttttggataccacaccaaagctcaggcaacaaaagtgaaaataaacaactggactacaccaaactaaaaagcttctgcacagcaaaggaagcaacgaacagaatcaaaaggcagcttacagattggaagaaaatatttgaaaaccatgtatttgataagtggttaatatccaaaatgtaaaataaatgcctacaactcaatagcaaaaaaccccaaataacctgattaaaaaacggacaaagagcctgaatagacatttctccaaaaaagatataaaaatggccaacaggcatacgaaaaggtaatcaacatctctgaccatcagggacaggcaaatgaaaaccatgagatagcaacttatacctgttaggatggccattatcaaaaagacataacaagcggtagcacgggttggagaaaagggaaccctgacatgctgttggtgggaatgtaaattgttgcagcctttatggaaaacagtacgaaggttccttaaaaaataaaaaaatagaactatagcaccatatgatccagcaatctctctgctgagtatatactcaaaagaagtaaaattagcacctcacagagctgccttcttatgttcactgtggcattatttacaatagcaagatatgcaaacaacctaagtaagcatcaaaggatgaatggataaagaaattgtggaatatattatatacatatatattagggagaggggagcattatatatatagatacctatatatccataaatttatttatatacatatatatatataaaatggaatattatcaagccttaaaaaggagattctactatttttggcaacatgtattaacctggaggacattatgctaagtgaactgagccagacacaggaaaaagtactgcatgatcttacttacatgtggaatcttaaaaaaaaaatgtcaaatatatagagacagaataaaatggtggttaccggaagtggtggggggaattgtggcagaaaatggggagatatgggtcaaagcatacaaagttacaggtaggacaaatattctagaaatgtactagaggactataattataatattgtataatgaaaatttgcaaaaaagtagattttaggtgctattactgtatacgtatgaaaaaagtaaccatgaagatgataagtatgttaatttgcttgagtatagtaaccacttcactatgtataaatatatcaaaatatgttgtacaccttaactatatataatagaaaaataagtaaataagaaaggagagcaggtggagtggcatttttatatacaagatcgctaggatggagggcatgacttgtgtatgtagactagcgggttttctaatatcaaattttatgcttgtggaaatctatccacccaagcttaggcagagccagacttcctcgaaaaacagagcagaatataagttctctgcagagcatctgctaccaagaaaaaaatgggcgtggagcatgatcagtttactctttccaaacttaccagtaagtcactccacctctcctgtggtggcatggatttgtattatggcgccactgtttactagtaccatgtacaagtaaatggtgcagtcatgtgaggaatgaattggctactccacggaagtgcccagcacagggcctggtgtgtaatggctcttcataactcttaccttgttggctaccccatagttattctccttcatcttgtctttcctgctccaaccatagaccaagcctcttgtttcctataagattgagactggtaacaggagtccgtggagcttgtgaacttggatgggaattaattatatatttaatatcactaatccctacctgaagtttggtgtttccttcagttataaacataggtatgaatatcagtagtgttagtggtatctgtgacttagtcatagatgagaatcacagatatcttcgtatgattttagagcagctgtagacaccttgaaataccaactatgttcaccattactttttttttttttcggcaatggagtctcgctctgttgcccaggctggagtgcagtggtgtgatctcggctcactgcaagctccgcctcgtgggttcacgccattctcctgcctcagcctcccgagtagctgggactacaggcactcgccatcatgcctggctaacttttttttggttttaatttttagtagatactgggtttcaccatgttggccaggatggtctcgatctcctgacctcgtaatccacctgcctcagactcccaaagtgctgagattacaggtgtgagccaccacgcccggcccactattacttatttttattttttgagatgaagtctctctgtcaccagactggagtgcagtggcgcaatctcggctcactgcaacctccgcctcctgggttcaagtgattctcctgcctcagcctcccaagtagctgggactacaggcatgcaccaccatgcccagctaatttttagtagagacagggtttcaccatgttggccaggatggtctcgatctcttgacctcatgatctgcctgcctctcaaagcgctgggattgcaggcataagccaccatgcctgacccactattacctatacttatagtagattgcatgtgatcgctgctgtcctatcaactggtgtgatggagctgccaacttgggggaatgcagtcacctcttcccacactggtgacccagacattcacgttgctttccagtattcccatttgcgatttgtttttggtcatcacgaggaaggagggtactcattctcatgcatggtttattgttcccaggtaaactcagcaaaaatgttctttgcactggtatttctttaaacaataaagttttactttaacttgctatattttaaatgcacggtattgacttgttatttttatttacatatatttttgagacgaggtctcgctctgtggcccaggctggagtgccgcggtgcaatacaacttgccgcagtcttgacctcctgggctcaagtgatcctcccacctcagccttttgggtagctgaggcatttttgtattttttgtagagacagggttttgccatgttgccgaggctggtcttgaactcctgagctcaaggaatctgctcgcctcggtctcccaaagtgctgggattacaggcaagggccactgttcctggcctgacttgttatttaattcattcataaagaaacacatattaaaaaccatgaatttctttttattactctgataactgcattttcctttcaatcttatatattttatatatttaaaaatattattcaagataggctggtcgcggtggctcacgcctgtaatcccagcattttgggaggccaaggtgggcggatcacgaggtcaggagatggagaccatcctggttaacacggtgaaagcctgtctctactaaaaatacaaaaaaattagccgggcgtggtggcgggcgcctgtagtcccagctactcaggaggctgaggccggagaatggtgtggacccgggaggcggagcttgcagtgagccgagatcgcgccactgtactccaacctgggcgacagagtgagactctgtctcaggaaaaaaaaaaaaattattcaagatagtgtccaaactgttcatcaaactgccaaatggatctctagtacaaaatggctaaaactctttcccaggagtgtgagaatgtatatcaggaaaataattacatcctaaaaaaagctgctgcttctgatgtgtggggaaatcaacatttagggaattcaactgtttttagtaacttccccccgaagcttttgtttgtgggattactatttacaactgtaattgggatacattttcaaagaaaacttggctcaaatttagaactcagacacttaagacacttttccttgagaaaatctaaatatttatgcgtctccaactcactttcaaaaacattttaaagcttaagatgttattgagagttccccactgttgatgatggtgattaaaaaggccattaaaaatggctcccaggaaaagaacagttgtcaggaagtcagggcagccgggaggcagaagacccaccgatttgtttctttgacactggcggtttagtcacacagtgatcgatttctgagaacactggagatgtgctggaattagtgtggaatttctacactctttggctctgactgggacattccgtcattacaacgaaatgagactgtgctttgctgtctcgcatcctctgtgaagacgttatccagcatgaaaaggaaggcaatggaaaccgagagccagcatacaggagctgctaacagaaaaactggtgggcgagctgaggtgaaatggcttggacacaaaccagtgcatgcagttctaatgaggcagtaaggcaggcacggaagtgcgcatgatgtcagctaattaacttggatgatgttggagagtgaggtatcctgaggaaaagccaacagcacttaactcaccagtgtggttaattatcagagaatgctgttcctgtgtagtttcctacccagcattttgaaaagatatttggctttaaaagtattaaaaacatgaagtgactcttcttgcaggcgatcagcagcttgtattggtgatggaaaaaaataatgggacttggccaggcgcggtggctcacgcctgtaatcccagcactttgggaggcccaggcgggcggatcacctgaggtcgggagttcgagaccagcctgaccaacacggagaaaccccgtctctactaaaaatacaaaattatccaggcgtggtggcacatgcctataatcccagctactcggaggctgaggcaggagaatcgcttgaactcaggaggcagaggttgtggtgagccgagatcacaccattgcactccagcaacaagaatgaaactccatctcaaaaaaaaaaaaaaaaaatactggtacttttccttaggataaggttaatgaatcaaggtgatgaagatggcctttcttaattcagttgcagcatagaagaaaattaactttgtttggtggataatcattggaagtgtgaaaggataagttgttttcagaatactttttagaaataatttttagttttctgtatcacaaatgggaaattaggaaaattaaatagatacatcatgttattagaatgcataagcattacaaatgtaactatcctgataatggtagcaaatatattgaagacggctcatgcaggccttccttgcttcccagtattatctggaggggaagataatcagcctggcaggatggaatagagagggacaagatggcgaccagtctccgaagcaggaaagagcggcatgaaaagtggctttaaatcaacagatttgtgtaaagtgcaaatgaacggttgtacctgagctgtatcacagtgaactaatttaacaaggagcagttgcaatgtgttccattttagctattctgaggacaataaaatgacaatatacacaggcagattaaggatgtctctttcaagatttggggcctggttgatttactcataaatcaaatgacaatatgatttattgttcatctgaacaaatttgagagtgaaagggaacatagtagcagctactcctgaacaacgggcataaagcagcttgcctcgggcaaactgagtagtgtggctcccaccacttctcatgctatagttccacaattatgtgtctctttttcacatgtattatgcctctctttacagtatgatttccacgggaatgtgagatttacacattgtagatgcagaattatattattgcacttattaataaaataacacaagtagataggacatacagtaaaataattactgtttaccatcagtatagttacacatgtgataattgatctacaaaatactttccaaaggattatttcatttaactctcaaaatagctgttatgtggcttcttcaaaaaattctgaatgatgtggccagccaggtgcagtggctcacacctgtaatcccaccactttgggaggctgaggtgggtggatcatgtgagtccaggggtttgaggccagcctgggcaacatggcaaagccttgtctttagaaaaaaatacaataaattagcctagcctgctggcgggtgctgtagtcccagctactcaggaggctgaggtgggacgatcacgtgagcctcggaggttgaggcttcagtgagctctgattgtgccactgtactcccagcctgagtgacagagtgagactttgtggcaaaaacaaaacaaaaatgatgtatcaaataaacaagtaaataagttttatgtggatatactaatgcaatgatgcagctatagtcatcatataaatatgtaattcattaaacaaataatgatatttcataaaatgaaatactatagaacaatgaaaacaatttatacatagagtgtaacaatttggatgaaagaaaaaagatatatttgcttatagatgtgcagaaaatttctggaataacaacgctaagtggctgcctctagaacctgtaactgaggcctgaggacagggaactaaatcgttctgtatgccgtatgattgttgtgtggtaggtgattacttcgcacaatgatgacatttgaaaaatagcatcattatcactatatttagtacgtacatgcccataatagagcagttcataaaacactatctacgcattcacatgtataataatactaatagtttaaaaagtttcaagtgtgggtatgtatcctaaaatgcctagaaagataagtaataataagtagtgagattcctgatcttactggtttttgctttttatgttaactttctactttttcattttgcttgaatgtgttataataatacatttatattttataatcagaacgcaagcagcaatgccacttccatcttgaggaagtgtaatgagggaaccagcaatgctggtttcagtgtctcagtttggctggaaaggatttaatcctgacgctgcaacattaactttctgagcatatgctctgtccccggggaagacgacagtcaagggaatcttgaacttcttggaaaataagaaaattaagggcttcttttaaaaggtaagtgattttacttttgagcaatttggcttggctttgttttaggagaaaactggaatcttacaatgtagccctctgaagggtggcttgcacaaagccggggtcactggggcaccccctccctgtattgtgacagtgtggggctggtctccaacttccctagcctctgctttccaggtgcaaggtggaaatgcacttcccatctcctttgaagttagaccaggccacacgatttgctctagacaaagagttgtgagcaccagtgacaagtgtcatccaggtgagagctttaagggccagcacacaattccttgctcccttccctctggtgcgggatcatggaagcccaggtgaaggtgagcctctgtcagcctcggccttgatgaggagggcagccttcagccgtgtgcaggccatagcatgagcgagaaatgaacttttgttgggtgaagccactgagattttggagtatttattatcactgcagcgtttcctatctgatcatgactatataatttgtgaagcccagtgcaaaacaaagacacagagccccttcttcaaaaatgatttagcatttcaagatattagcagtagagcctcaaactctggggggccctgtgagtatggggccctgtgagtatggggccctgtgagtatggggccctgtgtgactgtacaggtcgcacactccaagctggccctattttcctattccaccatcacaacaatcctggaaaagaatcttaattctcttatttcacatatgagaaaattgagagcttaaacagcttgcttaaaatagcagactcacaaaatgccagaagcgagagtttgattccattggtattaataacactgcgatgatgggtcttttgtgcattcctggttctgggctttggggcacaaggagccaagtacactattacaggaagcagacaagactcaggaaatatcgtctcctttgtaggaaatcacctaactggaaccttcaatggaaggtaagaaagagttaacgtctaacccattacatgctaagtgaatgttttctcttgccagaaagtataattagtaatttcaggccttatctgaaatacctgcctcagcacatgctgaaagtatcaataaagaaaagcaggcaccgcttttaatttcattgctataactaattagcattagagaaaccattttcataagcagtgtgctaacaacccattggtaactggaaaggaaagctgatggtgcagctttctccatggtaaccgggcaaggagaaaagcgcttcacagccacgaagagggggttcctgagggaagcacgagacgcgggctccaggcagcagcacgtggaagtgggcaggcactgcccctgacttcagatgccacaaagaacattggcatattccagtcaagggcagtgttttgaactgaaaatattacatgccaccatagaactgttttctacatattccttaaaagctattcaaaccgtatcaagatttttttagaaagggctctaccaattaaaatcacattggtttttcctaaagaattcctatcaactctcccacccaacatatcctacctctgtacccagtacagggggcagaaggcatcaggaaaagtaataaaaagaacctttggctgggcgcgttggctcactcctgtaatcccagaactttgggaggcagaggcaggcggatgatgaggtcaagagattgagaccatcctggccaacatggtgaaaccccatctctactaaaaatacaaaaaattagctgggcatggtggcgtgtgcctgtagtcccagctactccggaggctgaggcaggaggattgtttgaacctgggaggtggaggttgcagtgagctgaggtcgcaccactgcactagaacctggcgacagagcaagactccatctcaaaaaacaaaaaaacaaaacaaacaaacaaaaaaacaaaaacaaacaaggaaaaaaagaacctttgccgcacaaagagggtaggtagtgaatctggtaattttaaaaggcagctgtcattaaatcctgagtttcaagatgaaatcctatcactctgtttgagcactttattattgttcttactgattgtgccctagaacacattagtgaattggcacaattcctctgtcattttcttctcttcatataaacttagtttgggcaatttttcaaagaaggaaggaagaaaggaagtaaagaaggaaggaagggagggaggggggaagccaaaagaaacaaggattgagtttgttggagtcactttagaacattagtgccacactggtccataaatatgttcattttgcggggggtgggggagactgcaacaacatcatactgtatcaatgatgaattcagcagtcacttaaaatgaaaaatgtaggtggctttcaaagaaacaatctcaagtaaaattgttaacaaaatttatcaatttttgaaaactgtatattcaaatagataacataaaaacaagaataatttaaagcatgttactcaagtagatttcacaacaaatgatacatttaaagttttatggctccaatattaatgctttaggaactgtgtggcaaacatttactaaccaggttctcatgacctattgactgtgtgaagaatatttgtcagcatgccagcgtgcagtgttaggttctgttaggatcaaaacaatctccctcaggaagcttatataaaaagttgtccttgtccctactcttaggtcaagaaaacattgtcatcaatatgaatatgaagagatgcatgaaataatatgactaagttctttaagggagaaagccgccatagattagctagttagtttgagaactggcttttaaatacatactttctctacataatttggaatgttttagaaaacaaaatgggaacaaagtacaatgcacattagctgggcagggaagcatgaagaatgctttctatgttacggctaattccctgcaagctagcctgactttcagagcattcaactgagtacgtggctgttctccaccatgaggccagcacgtggttaatgaccccaattctggcattgtttctgggtcttgtttttttctgcacaaaggttaattgaatttttacaagggtttcctagaggacttgcacaactttttggtattaaaacaaaaggccatcttataatagacttacaatatgactttcataagcactttaagtattttagcttagactttagtaactgtggcatatttaatgtttcatagctttttgagaatttccacagacattctcagcatcttcactaaatttaatcacgaagtctggcagtacagaattcttccttctccctcggcttctttttaagtttgagagtgaatttggttttgtaaaagtatgctagggagaagatgcaagggacttctcagcaatttctctctatgtgttctgcagataaatgttctttccggctcgtgacaactaacaattgtgtttcaaaaaaaaaaaaaaaaacatgcattgttaatgagacttcgccagagatgcttagagttaggtgaaatagagataactattttcatagctatgcattaattgactgaattggctttgtatttcaggccaactccaaagcactggttaatagttataaaaatgtttcacagtgctccatgtcggcttccccctgaaaatccatgataaagattgagcgtggttgaaaggcttgtcatgcgtaagtgctaattagccccaggatgcttgccttcatgaactttcaggcctcatctataaggtcaggaaaggggtcatagctcatagaatatggacttgcattaattcccagcgtataaactcatggatcctccacagaattcactaaacttcaataagctacaattctatccttacctcacatgtcacatccctaaaggtgacatctacattaatgcccctcatccccaatagagagcacattggtagctcaaataggctattactcactgtgacctcttctacttatttcttaaggcatgggagtggcatagtgagatcctggcaggagcactgttcacaatagcaaagacttggaatcaacccagatgcccatcattgatagactggataaagaaaatgtggtccatatatatcatggaatactatgcaaccataaaaaggaacaagaccatatcctttgcagggacatggatgaagctggaaaccgttatcctcagcaaactaatgcaggaacagaaaaccaaacactgcctgttctcacttataagtgggagctgaatgatgagcacacatggacacatgggggaacaacacacactggggcctgctggggggttgtggggagggagagcatcaggaagaatacctaatggatgctgggcttaatacctaggtgatgggttgatctgtgcagcaaaacaccatggcacacgtttacctatataacaaacctgcacatcctgcacatgtacccctgaacttaaaatgaaaagttgaagaaaattttaaaaaaagaccctgcctggcagggtttcagcttaaagaaaatttctgggttttgcacatggccattttctgaactcctataactggcttttgaaccaaagtcctcttggaatgctgagacgcactggaaacctctagatgggccatccagcctgaagaaagcctttcttgttgctgctatttgtatcattatttcctttactaacaataactaagatgcactgggtacgttacgtgttagggagcgtcccaagtgcttagtaagcatcgattagtttcatttttacaaccatctttgccctgtgaaataggacatgggattcactctttttaaagatgagacagttgacacttgggaagcttaggaaggtttcccaaagcaagctgtgggtacggacggcatcagaactaaacgcagggagtctgactcagggtgttcaatctcagcactactgaagtttgagaccaggccattctcacgggcccgttgtgggcactgcatggtgtttggcaccatccctgcctctacccgctagatgctagaagcatccccctgttgtgatgaccaaaactatctccagacatgaccaaatatcccctggggacaaaatcgctggcaactgagcaccactgctctgactcaaaggtgtctgctcctaaccacctgcctctcaaaggtgtctgctcctaaccacctgcccctcaaaggtgtctgctcctaaccacctgcctttgctgccgccggcttccccctgcttctttgaggcaaaaatcaggtcggactagcatcagtggcaaaggaaccagtcagatcagctcatgtgacagctttgacagaccaagcattttggtcacatattagcttttgagaatcaatatgcataggctggaatgacactttcagtaaatcaacattcaggctataacaaacctattaatattctggggaattcattgtgtaccgagccagtcattcagatgactatatgccttaggtctttttatgaaataaattagatttaatttggtaggctaggcagagtaggcagagagtgccttgcatttcctggttatactagtgtgtggtgtgataaaaaactgaataggcatctccatcaaatgattcctgtaatgtccccattggctcttttgaaataaaacctgtgtcctgtttccctcttcctaattcaccttgctcttgcctgtgttctataatggacaatgtgaacactcagacagggctgattttctaatcaatggtaacaactggagttagaaatgaaaatattatcatagtaaactatatttattttaaagtccataggctagttttcatcccctcccaaaccactctaatttatataggagggggtcaaagtttagaggaatacgaagatgtttctaaaatttagatgcaatatgtataagagagaagcttctacttgtgatgaattagttagaaatcaaaatttttttggacagattcacttgagagaatgaagaaaattcaagtagagagaggtatcctgagaaaaacagaatattttagactgaactgggataatctggagacttagaacaataatatataaggctttatatattatatatatattgctttatattgaaatttcatggaattattttagctcttaaagtataggaaaatcagttaaagatggaaacactgatgaatctaatgagaattttaaacatataagtttatttatcttaaactgtaagattctattaggctttaagactataattttatggactgtgaaagttctaaggtcccttaagattatgtagaagagatgtttactttttagcaaagaaaatattgtccagaaacccattttttagaaacagataaactatttatttttaataaattaagcttatttttggtgaacacaaacttttgaaatttagttttgtgaaagacacatgtaatcatgtattatttcgttctttctatatttcattacgttgcctagatcaagcaaacactgatatacccagataagtgtggcaaacagttatgtgttttttttaaacacctcattttacaattttgtaatgcactttattaaacagaaactttagctcaaggctgcacaaaataatgaattttcagtttctgctaagagtatgtatatgttgtttttgtttctaaatagtctatgatatatttaaaaatgaaatttgaagtcagatttcatgcatagaaccataaggattttaggaacgtgttctgacaagcagtggtgtgaatacagcttctcacataagaggtgagttaacagaggctcggagcagataagtcactggtgctgagtcacaggctggcagagcaaggatcagaatgcaggtcctctgccttttaagcctgcgttctttttggttcacactgcctctattattaaattacttaatttatcagagcaaaaagcaaaaccttagggatgctattagcaatttactatttccagttcttttgggaatctgttaattgccctttcataaatgctgctcattatgattaagactttgattaaatgtgaaagtctaggatttatatgttacagacatatttaatattaatttaaagcaccagagcagaatgaattgtgcattccaattttttagctctatcatacactctttaatcaaggatttttcaagaacttgctttgtgctagcaggacctgatttttcccctcaggaagctcacagtttaattaaggagagctcatattagtaacaatgcacatcagtgtctgagtaagagtttaggggaggtgtagctcgtcttcatggaggttaggggcaagtgagtttagtgaataggtgccacggagtgagacggggaaagatgggtgtcctggttgaggggcgatgaggtaagaatgactaatgcttatgaaccattgcctgataaacactgtgcccaggactgtatatggatcatgtttaatccaaaagcaattctgagtgaagtcctatccctcaaccctttttacaggagaagacattgaggcatagacccatgaagtgggcttgctcagtaacaactgctcagtgaaggggctgggactcccagcacttgcctggttcagatcacactactgtctccttcctatactgccccttcgcccatctgtgtgagccaaggcaaggaagacagtctggggcctgtgggatggcaaaggaattttctagaactaagagtgtgtgttgggaaggtaatgagatgggtttggaaaggttagtttgggtaaagcttgaaaagccagaaaaaggattttagcccatgttctaagccttcaccattttgtagaccatcttattcacattttgatggtcgcttaggtaaactaagatctattttagacttgcaaacaactacaaggagaaattagttgaataatattaaatattgactactgatatgataatatgtgtattcatgtaggaggtaggggttgtgccttcttttccattcattcagaaaaagcgcctatggaggctcgcgaatagagaggcaccatgctcattgctttgggcataccctgcctccagcatgaagtctggcactaggaatttcccattaatgttcagtgaatgaatgaatggaatttcctgccctgctccttgcctccctcccttcccacctccccctaccttccttcctctttttcttccctcccgtcattaaacacatatttactgaatacctacaaaacttctatgactaaaaccaatgagattctcccatgaaatggggtggagagaggggaaaggcagaaaataagcaaggcaattgaataatgtaattccagttagtggtaagtgatgaagaaagcagggctggcttacagggtgagatcgtgcagtggttggggaaggcatggtctaagcaggcctctcctgggaggggacacctgtttagagggctaaatgaatggaggcagccatgcaaaaagctgaaggaaggtcctccaggaagggagagtcatggccctaggaagaggacaagtctgcttcatttagagaacaccatgaagggccagggtactggagcattgtcaacaaggggaaagtgatcgggccgaggacagaaggccaggtcacataggtctttgtagtgtgagaagaactccaaattttattctccggagtggagctgcttaaactgttagtataaattataatggaatttaagtaatgttcacagaggagcagagaagataacagagaccgagaaggacatctgaatttattatattttaattaatttttttagagatagggtcttcctctgccacgtaggctgaagtgtggtggtgccatcatagctcactgcatgaattcctgggctcaagtgatcttcctgcctcagcctcctgagtaggtgggactaaaggcatgcaccaccacacctggctaatttttaaaattttttgtagaggtggggtctcactatgttgcccaggctggtcttgaactcggcctcaagtgatcctcccaccttggcctcctgaagtgttgggattacaggcgtaagccaccacacctggcataacaaggaatttttgacagtgaatcttgactactaagagactaggggaccatgaaagaaaacagtacattaaccaggaaaaggatggctgatacattgaatgatgaagaggaattaaggcaatggaaaatagaacacagacccttggagatgaagaggtcacgatttaccattggctgataacctactgtgatgacatttctcaggaacgaggcgactagaagaaaaacatgaaagaaaagggggctaagagttttcagaattctcacaatactttttaaaaagagtctcaaaaatcaaaaccagttttggcatactgatttctaagacataattcactctccttcttcctatccctcccttccttccttttcttaatagaaattgttttatttatacattttgtattttagttgccttgtcagttaagtgattacattcatactggaaaaaaaaaaacatgggcaatataatcataaaaatacaaatttctggccgggcacagtggctcatgcctgcaaccccagcactttgggaggccgaggtaggtggatcacctgagttcaggagttcaagaccagtctggccaacatggtgaaaccctgtctctactaaaaatacaaaaattagccaggcatggtagcacacacctgcagtcccagctactcaggaggcgaggcaggagaatcacttgaactccggagggcagaggttgcagtgagccaagatggcgccacttcactccagcctgggcgaaagagcaaaactccatctcaaaaacaacaacaacaaacccaaaacaaaaacaaatttctatatttaaaaatgatgtatgtaataatttttttttgctatacttggaacttttttttttaacctactagggatctaatacatgaattatttatgcaggaattcctagattgtcattactacaacacttatggtatatttcttccttgaattgttgagacctgatttattaggtgaaggatgacattgttttcaagggaaaggaatgctgttaaaaaccaagctgttatacaaaggctttcctccaggctctgcaggaactccccagttcttggcttgttgctgattatgctaacaccaacttctggattcatttgagttccgatggctcctgccatactgctcccaattactttaagctgggcatccaatttccacagtaactcctgggttctccttgcccatctgttcctgcagtggcatcaagccccataaagaaggtagctgttaggatattccaacttaatgtcttaccaggaggacctagaccagcaattacaatacaatgacgtaagcattttcctcctctagtcaagttgaagaagaaaagaggagctgacaaacataaggccaaggagtatccctggtcacaaaggctttgaactcttacccaggtgtggagagccatctttggcatgctcgctcccagcacaaaagtgccatggcggtggtctgtccctctaatctacgtaaatctctctacttttctttcttgcttgcttgcttgcttgcttgcttgctttctctctctctctctctctccctctctctctctctttctttctttccttttttttttttttttgagacagagtctcactctgttgcccaggctggagtgcagtggcatgatctcaatctcagctcactgcaacatctgcctcctgggttcaagcgattctcctgtctcagcctcccaagtagctgagcttacaggcaggcaccaccacgctcagctaatttttgtatttttagtagagatggggtttcttcatgttggccaggctggtctcaaactcctgacctcaggtgatcctcccaccttggcatcccaaagtgctgggattacaggtgtgagccactgtgcacggccagatctctctacttttcatagatacagagagggtttggctgtgtgtccccaccaaatctcatgtcaaattgtaatccccagtgttgactggattgtgggggtggggttctcatgcttgtgtgagcaccatcccatcggtgctgttctcgtgatcatgagtgagttatcgtgagatctggttgtttaaaagtgtggtatctctcctccctctctctcttccccctgctcccgccatatgagatgcctgctccccttttgccttctgctgtgattgaaagtttcctgtggcctctccagaagccaagcaggtgccagcatcatgcttcctatccagcctgtgaaaccatgagccaattaaacatcttttctttataaatcacccagtctccggtatttctttatagcagtgcgaggatgaactattacagataccattgcctgtgttcagatttctttagagtcgagcactttcagttatatatcagatgacttcaagatcttttgaaatgatttggttctcttagaaaacttcgtatggacagttgggtaggtggctgggctgatgggcagggtgatgcctgaaggaagaaggatcgtactcattcatttccccaaggctttctcgattgctctgtgaaccacacagggagcgtgagagggcgttgatggggtttgtttcaggatgctctactgcacctggctgaacatcgtttgttgggttgttcttgttagtccaaagggagagggagtctaagagtataatgtgagttggaatcttggagaaacaacttacaaagcttgtgatttgggcaaatccactctctgcacctttcagtgctggcatattaggtaaagacacacatttcagagtggcatgtagagaagttcaaatcccagccatttcatttgctcctggaactttgtacgggaaagtgacttaacttccttttttttttttgagatgaagtctttctctgtcacccgggctggagtgcaatggcgcgatcttggctcactggaacctctgcctcccaggttcaagcaattctcctgcctgagcctcctgagtagctgggattacaggtgcctgccaccatgcccgactaatttttgtattttttagtagagatggggtttcaccatgttggccaggctggtctcgaactcctgacctcaggtgatccacccatctcggcctcccaaaatgctgggattacaggcgtgagccaccgtgcccggcctatgacttaacttctttaaccttgttttttatcctttctaaacaagggtcaaaacattaccttcctcataggattgttgggagaattaagtaaggtaaaactcataagacatataagaactgccatcaagtaaatgctcagtacatgttagctgtcatccatctcgttgttgagaaccaaattaaatatcactctataagtgaaagcactttgttaagacctaaatcaatgttaattattataatgatgaggttgagtattgcttcatccttgatgctactctcctcagtaactttgccaatgatttaaagatgtagaagctattcttgtcagatggatggcacaggcccggggtgggtctcctggtaggacaagaccaagattatggcctatggtcttggacaagaccaagattatggtgacagttgaaattgataaggggtaaaagtaaaagtttcttttatgttcaaaaatgaggtgcattaagaactcctgggaggagacccagcttggaagcagtcaacgtgaaaagttcctgggggttttagttgatggtcagctaatgctgttttgggctgaagaccagaactgctaaattccatctctaatcataagatagttgaaattttgtactttgttctagacaccacatattaggagggccttattatattaggtagaaagaaccttggcaagtcagtgttttgaaaatacggtgggtgaaggacctttaaatgtttgaagttgccatctaaaacaaggattatacatgcttcttgctagcatggaaagtgaaactgtgacagagaagtgggtactggtgagagaaagaatataatttcacaaaagaaaaaactcagtagtaatctctgcagccaaaatggcatgcattgatgaacgtggtgttcccagtggatctgagtagaggctggtgattgtgggaagattctcacactgggtgtcatgttagaccagctgacctctaagggccctatcatgttttatgattttataatatagcaggctgtacagaccatttttaatatagtcttaatttttataaaaatgtattcatgcatatatacatagttataaaacataaccgttaaattctagttaaatgccaccaaagataaaaataataaagtagcttcaaattgtacttattgcaaggtgacctatctgaaatgtcttcttggtcatattataagaggacttaagatgccaaaggggaggatcatagcctattcatatttccatctcccacaaagtgtctggcacacatgtaataattaaagtagacaatctttattgaatgttctcttgtttaaagaagtattttaagcccattatatttaataattcacttaaccatcaaaactgctcaataattttgacactatcattattccatttgacccatgaggacactggcactcactggggtttaaatgacttggccaacatcacacatctaataagtgccagggctgagatttgaactcagaaagtctggttccagagcttgtgttctttaccatcacactctactgcctctgctaatggaaggtactcggtcagtgtttatccagttgatgaactgatggatagatggacgaacggaaggactaacgggggttgcagcacagagtcgcctgaatatgtggcaatgaacaaagaagggcacagattacacgaagagcagatgcagaaagggccgatgagggagggacgctggcaacacctcagtcactgctcttctttgagttgattccgcatagagcatcttagggtgaaacagaacgacgtgcattagcacagagaagcaaaagcttcttctcttgggttcctcctcttcctttgcagaggagatgttttctgtcagaatgattagttagaagtgaacagtgaagtccttcaattagcattccttcaaaatgccatctgtaagtgactaaagaagtgacagccagaaggcagaacacagggctatctccgcacagacaagacaagagccgggaaggcagggacgctcgatcagccgtttccagcaatgttaacgggtccacccactaaactaaacaaatgctttcttcctaccatggagacagaaactgaaaaataatttttgacagcactgtatgatttagtgggtgcttgcagacacagcctatacttagttttataccatatttaatagaacatttcaaactttcataattatttggcagcttttaaaaaataaaaaataaataaataaatagcaaatgcccactgggttactcagtgcaatgaaaataccgtatcatcaggactttgtgatgtcttggcaactcttaccccaactctatccaacacctgctctccaggtaggtcaaggtcaatatacttgactacttcaaagcctcaacaaaaatgttctccatcaccatgttatcaggtgtccacgtcagctgagaagcctgactggtccttttcatgcctgtggaacaagggactgaatcttaaggagagtggagaccttgtgttacttacattctgcattcaagaaactatttctatgaagtttaatgatcaatgatgctttttccttcaaaactatccaaagatttcaaatctgtttgtgcaaggaggcactggattgaactgaatttctagtttcttcatcgactggttccttcattcagtaacaaaactgaacattttaatgtgctgatactgtgtgagagctttacacacattaactgatttaatcagtatgaaaacggtctgcaataagcacatgtattcccatcttacgggcaaagaaatgggctggagaggtttcaggaacatgctccagctggctgaggtgcatctgatgaactctgtgcttccagtgaacttgtaagatccaagtctccaggcgaacatcaagttcttctaggattcatccccagcctttccccagtcttctaggactcctctcccttgctccgccttgaactctgttgttgacatctttcttgccctctacaccgttaaacgattctagagtggtgctatacattggaaataaaatgcgagccacacatataaattgtattttaatatccactttaggaaagcaaaaagaagcaggtgaaagtgattttgataatatattttatttaccacaatatatcaaaaaatttatttcatcctgtaatcagcataaaaattactaataagatatcttatattcttctatggtattaagtctttgaaatctggtttgtattttacatttgcaacacacctcccttcggactacccacattttgagtgctccaaggacgctggctagtggccactgcattgcccggcatatcctaggggagggaaggaatccttagttgttaacgtgtcagacaacatgctatggctcatagttgtcctcctgatgtgtatcttctcctcccgatgtgtatcttctcctcccgtctgcagtataagaagccttcactgggcacgtgtctgccaggtacagactacattccctggcctctcctgcactcagggtcccatgtgactggatctggcacctgagatgtaaacgaaagtgaagcgtgccatttctgggttacgcccttaaagaaggcatgttcccagcccttctccttctctctttgtgcaagctggaaggcaggtatggtgccagtcaccttcaaccacctgagcacgctcaagggacagcagagccacagacgggagcttctgtttccttaccacagagccagccatggggaccatgtcctgagagaaagaggttcctgttttgttcacacaactattgttcatctatgacaagcacggtcatcttcatttactttcatcatttctagaatctaattccgtgctctcttggtggggttagacccaactcttccttcaggtctcagtgaagctttatttcagcagggaggcctttctaatgttctgaagactaggttacagccctcactccatactaccatggcaccctgagcttcccctttctcagcatccgtgcacagggttatttaatgttggtgttcgttctagacctctgtgtcatgggggcatgctgtgaccatcttctgggcacttggcacagtgcttagcacatagaagtgccaaacatttgttcaaagaataaatgtaattaagaggcttaacatgtaagtgatgtgctcttgcccttcccggtttgatgggaatacagaatctctttagattttcctggttcctgttagagagcatcagaatgacagtgcacacaggcaaggctagctgggaggatcgagtggcctgagtgtcatgggttgagttgtatcccttacaaagatatgctgatgtcctaacacccagtaccttggaatgagatcttctttggaaatagtgtcattgtggatgtaattagtcaaggtaaggtgtattagtctggtctcatgctgctaataaagacatactcgacactgggtaatttataaaggaaagagatttaactgactcacagttccacatggctggggaggcctcacaatcatggcggaaggccaatgaggagcaaaggcacgtcttacgtggtggcaggcaagagagcatgtgcaggggacctcccctttataaaaccatcagatcttgtgagacttattcactaccacaaggacagtatggggaaagccacccccatgattcaattatctccacctggcccagcccttgatctgtggggattattacaatttaagggatatttgggtggggacacagccaaaccatatcataaggtcataccaaagtaggttggctctaactgaaacatggctggcatcctcagaagaagaggagggagacacagcaagaaggtggccatgagatgatgggagcagagactggagtgacacagccacaagccaaggattgctggcaaacaccagaagccagaagatgcaaggagggattcttccccatgggtttcagaggaacatgaccttggaggcaccttgatttcagacttctggcctccagaaccgtgagacaacacatttctgctgttctacgccacccggcttgtggcactttataatggcagccctaggagcaaatacatcaaggcagaaaacccgtcacaaacctgctggcatgcccgttcctcctggctacgactccacagcctgttcccaggggtcagcccacaggccagggccaggcggcattgctggctagtggcctgcaggaggggcacttatcagtacttcctcactcccaacatgaaaagtcaggtaaagaagtacaggaagctctgccaaggagtggaagggatttgtacctccttaggacaacttcccaggtaagggcgagtggaggacagggtgtccccactacaggaagaaagagagacatcatcattcagctctcacagacattcctccttcaaaacagaccctctggcaaaggttatcctttaaagaaaaaaaagttcttgctcctctgtcttgaactgggaataaattaggagagataagagacagatattactcctttttaaaactctgtattcccattgaaaagagtcaagggtacaattctcaagtctgtgtgtgtgcacagtgcttacatgtctctctctctctctctctctctcacacacacacacacacacaccatatcccacttacagactgaatactttgcaccacaaagtattttcagctgctcttctcgctcctttccctttcaattcagaaggctaactctagctcaattatctcttccttttgacagaattcacatcaaatgcaaacaagatgagaccaggattctgcctggttctgttgccaaggtgggtgggaagtcggcagcagggatcagtagctgtagctgcttcagcctttgttgaggctaactctcctcccaaggtgtctcaaatagaaaggcttgttcctgatgctttccaattattttcacttcaaagaaatactttaatatatttagttcaaattgcatgatggtaattatgcttctaaatctgatcaaatgacgggagagaggaaacctttgcttccatgaggggatatttgttcttcaatagatgggtctaattttccacagtgggaggactcacaagcactgagactggcttttttcattagttatttataaagctcttattagattggttaaattcacatgtgggaaaaaagacaaattattgttaatcaatttctaacctatactattcataatttagctgatagaaacctctgctcaccaaggggatttttattcaggctgcaaatcagtatcatgttatagagtgtattaattaataaatggaatatttagctttttataattagtgtttgtatttattacatttgttatgttactcctctcctcaacgatcccattataattcctattcctcagtaaataaaagctcactctctggtttggaattcaagcctcctcccaacacaccacatgaccccgccgtgccagccattcacactgctcacagggtcttcagctcccttctccctgagagcttgtgggaagggtgtgctgtcctaacccagttagatgtcgtcaaatgccttgtttggccaatgaaatgtgggtggcaatgacatgtgtaacttgaggccagagcctttaatttctggcactcaactctccatccctcccaccatcctgcttcctgaaggaagggctccacctgccgaccctgatggagaacgaggtcacatcagtctccctgccaaccctattggacaggccttacgcgtgagaaacaaacctttgttgtttcaaaccactgaaatgttgaagttgtttgttactgcaacagactttagtctgtgctgactaatacatccaggatattctttgggaattctagcggctacattctatttttcaagtgaaatatgctttggaacacctatacataataaaagcagagatggtcatgttgaagagtgagatggggtgagtgtgtgtgtatggggatgggggaggattgagattcttctttatcttctactgaagcccccgatgctttgcaacctccgcacatttctcagaactcaggctgaaaccctgtgatctagtccaaaccaaccttcccagctagggtttcgttcaaaggtcacaactggtggcttgtgagcagggtctggacacacacacacacacattttttttttttttttggctcacagagtgcttgaaaagaatctaagacaacatttacagattgggagatcaacgtaaaagatgcatcctaaacttcccttgctaaagtgaagaatgaggacaccctgggcctccactccttcccttcagttgctatttgtcattacacataaatgtctgttgcatatagggaaatatttctgtcccatgtctctatcaaaagtgggaaagggctgtgtttttctaaaagtaagagaaagagtgtatttctttgtggagtgcataattctcctaagtatgaaagtgaaaagctaagatcagtgtttcccacccctcatttctctcgttcatgtcacctgttgcttcttattggctttggaatgtgggacctctcttctagcctcttgcatctacctctatggtttgacttctgaaaatgtggtccctggtccacctggatccaagttagctgagttgctcgtgaaaaatgcagattgcaggtttcatttcagacctactggattcgaggtggtggtggtttctgcattttccataagtaaccctttcccttgacaattcttaggcacaattaatcttgagaattactgctctgtggctgaggtcatcatatattcagaaccaagttctacgaatgggtaaagaatttttattctcttctagctttgaaagacccttcagaaggtagaatttggatgccaaaatgctatgatttctgaaatggtgtccaggaataatacaatgaattatttgaaaccgcagctgttcccaagattacagataaactgaacaccaagttgtcttctgaatgctgccctcactctcctccttccccacttttgttcatgcagtgtctttgccaaaagtccttcggccatgtttccttacaaaatctcacgcatctttaaggtgcagttgaaatgttaatgaaaatcaatgcatccttactattatctaaagtcagttgtgtcaaaacttttagaatttttcatttttcaatagagattatttttaaagacagtttaatttcacggcaaaattgagcagagtacagagagctcccctctcccctctcccctatacatgcacagcctcccccactatcagtgttccccacaagagtggtacatttgttataaatgcaaaatgtacattgacacatcatcacccaaagtcctcagtttacatgaggttcactcctggtgctgtacttcctatgggtttggacaaatgtataacatttatccacctctgcagtattatacaaaagagtttcatggtcctgaaaaccctcagtgctccacatactcatcctttcctccccaaacccctgacaatcatggatctttttactgtgtccagagttttgccttttctagaatatcatatagctgaaaccacacagtatgtagtcttttcagattggcatctttcactggtaatatgcacttaaggttcctctatgtcttcccatggcttgacagtacgtttctttttagcatggaataatatctcactgtctggaagtaccagtttatttatccattcatcgactgaaggacaccttggttgcttcccagatttgtcaattatgaataaatctgctgtcaatatctgtatgaaggtttagttgtatacataagttttcaactaattcaagtaaataccaagaagcatgtttgctagatcatatggtaagcgtatgtttagtttagtttttttttttctttttttttttttttttgagaccaagtctccctctgtcgcccgggctggagtgcaatggcgcaatcttggctcactgcaacctccgcctcctgggttcaagcgattctcctgcctcagactcccaagtagctgggactactggtactcgccaccatgcctggctaatttttgtatttttagtagagacggggtttcaccatattgccaggctagtctcgaactcctgacctcgtgatctgcctgcctcaacctcccaagcgctgggattacaggcaagagccattgtgcccggctgtgtttagttttctaagaaactgccagactgtcttccaaagagactgtaccattttgcattcccaccaacagtgaatgagagttcctggagctccacatcctccccagcatctggtggcatccatgttttgggttttggccattttagtaggtgtgtagaggtatctcattgttttaatttgcaaatgccaaatgacatatgatgttgaacatcttttcatatgcttttttgcatctgtatatcttttttcggtgaggtttctgttcagctcttttgcccatttttaatcttgttgatagttttcttactgtcaattttgaaaagttctttgtatattttggtaatagtccctttatccgataggtcttttgcaatattttctcccagactgttgaatgctttttttttaatggttggtctgtttccaggaatcagaaatcaggcttcacacccagcccagatgttcaagtggttgtttgacttgtctgccatctgcaactgtctctcttctgctttgtactccacgcctctcagatgctggagaaactggtcatttgttctctatagcatctcacattgtgaatttgtacaaggctcagtggcttcttgagccatgggttgtgtgggtctataaaccaaacagacaggccttggacagacaggggtttccttcaggcagcacagcctcagccacagcagcatcctgaggctgaggatgtaacaccaagatatgaagatataaccctacgtttctaagatgcggctgttctgggggaagatataacactacgtttctaagatgcgctgtcagtgagtgacatgagagagaaagtctgcatgtcttagttatcagccatgtgagaaggaatacctggatcactgaatcatctgggcataaaagcttttttatgagttgtgttaaaaactgctttttgtggatcacatgaagcaactctgaaatgcattatcctgatcatcattgttgctaatcatgtccattttgggccatgcactgcacatgcttatcattagtcaattgattaagtttgcactctttgggagaggcactactcctatccctatgttatagctgaggacgctgagacataaagagattaagacgctgtcaaccaagccaataacaatattttctctaagctcatgaacaatgtttggctgtgcagaaaaccaatgacatcaaaaggagagcttctagaagtaaacatgactgatggtaaaggaccccttctaaccaaccctgggaaattagcaaggtttcccagcaccccaagctacttgccttcccaccccttctcttctgaagcaacatcccgactctggaatccattcccacatttaaaaaatgggataatgtgagctgtcatttatgtgcattgactggtagggatgaggatagtaagagtatcctgaaggaggggaccagtaacaagcagggaagagagaaatgggggatttgggagtagcaacctctggagtaccagtgcatttatggaaagataatagttagaacacagtgttatcggctaggactaatgatggtggagcagtgtcggtgagggtatgaggtggctctgatccatgctctacggtgaatgtgtgggaaggacaggtgtggaatggttataagtacatgctctggagtagaaggctctggattaaaaacctgactccacagcttagtaggtgcgtaaccctggggatgtcgcttaattgctttaaccttcactttcttcattttaattgtaggaggagaacagcacttacttcatgcatttgtggcaaggattgagttagatgatacatatccaatgttaagcaccatgtctgatagaaacttcttaatatgttggaaatcttactattttatggttgatgaacgaatggttctagtgactttcagggtatgtcttctggcccaaggctaacagcaggtgtgtattataaaggcaaactgatctcccatgtagagggaggagatgggatctggaaggcctgggtgctacttgtaatactagattgactaaaaggagggtagaacgggagggggctgctgctgtaccgtagagtcttgatgaatttatggctgtcattctgaagattttaatcttgtctgaacaagtcataaaaaagtcttttatacaatagccaagactcatgaacttctgtttgctgcacactgtgctctttctgtgggttattcaggtcattctcaccacaaatatatgggataagtaccattttcatcctaaataacctctgccactaaataacctttgcccccactgcactaagacttttacatgttttaactcacttaatggctgcaacggccccaggaggtagatacttattaattaccctcatttaacagaggtttatggaggtgagggactggactgagggggctatgggggcgacctagtctagctgggttctaaggcagttgctctgcccccagagccctgcttcgagagcctctatgcttctatgaaggtcacaaccagaagcagtccggcctgcagttgctgttttaaaaaagaggttgtaaacatcactcactgcaccacagggtggccgtgacacaaagtcagatgtgagcattcttttagaatccactgtgaggaaaagcctgcttcccccaggaatccacaggcttctattctgataatgatgattatatcaccaccagagtccccttcagccttgatcattgagacaccctagacagggggaaagcattgaagaacctctgtggtcaacctaattctttgctatatccatgatctggattttcagccttgacttctagtttattatgatagtgttaggtctgtccttgttacatgaggaaaggtattaatatatttaaaaagctataccgatgacatgggtatagagacagaagatgtgacttcttatagttagaggtcaaaaagccataagatattcaataacttagaggcttgaagaaagatcccaaagggtctccaaggctggaaggatgggctgaaccgaaccacaagaaatctaatgagggtgacttaaaggcatgaacacagcgttatctgcacctcagagctgggcaaggtctgactccctgaggaagagccggcagggattgccatggggaccactccctgccaggcatagccttttcccaaccctgagcgtccgagcagggtttcaggcagggcgggtcggaaacctcaggtgtgcggggatgggaaaagggggtgaaccctgtgttccccagacctgtactgactgagtcatgttacaagtcaggagttgttgcagggataaatgggaacagaccaaacactgtgaaactttcttttttattattatactttaagttttagggtacatgtgcacaatgtgcaggttagttacatatgtatacatgtgacatgctggtgcgctgcacccaccaacttgtcatctagcattaggtatatctcccaatgctatccctcccccctccccccaccccacaacagtccccagagtgtgatgttccccctcctgtgtccatgtgttcccattgttcaattcccacctatgagtgagaatatgcggtgtttggttttttgttcttgcgatagtttactgagaatgatgatttccaatttcatccatgtccctacaaaggaaatgaactcatcattttttatggctgcatagtattccatggtgtatatgtgccacattttcttaatccagtctatcattgttggacatttgggttggttccaagtctttgctattgtgaatagtgctgcaataaacatacgtgtgcatgtgtctttatagcagcatgatttatagtcctttgggtgtatatccagtaatgggatggctgggtcaaatggtatttctagttctagatccctgaggaatcgccacactgacttccacaatggtcgaactagtttacagtcccaccaacagtgtaaaagtgttcctatttctccacatcctctcaagcatctgttgtttcctgactttttaatgatcgccattctaactggtgtgagatgatatctcattgtggttttgatttgcatttctctgatggccagtgatggtgagcattttttcatgtgttttttggctgcataaatgtcttcttttgagaagtgtctgttcatgtcctttgcccactctttgatggggttgtttgtttttttcttgtaaatttgtttgagttcattgtagattctggatattagccctttgtcagatgagtaggttgcaaaaatattctcccattttgtgggctgcctgttcactctgatggtagtttcttttgctgtgcagaagctgtttagtttaatgagatcccatttgtcaattttggcttttgttgccattgctattggtgttttagacatgaagtccttgcccgtgcctatgtcctgaatggtaatgcttaggttttcttctagggtttttatggttttaggtctaacgtttaagtctttaatccatcttgaattgatttttgtataaggtgtaaggaagggatccagtttcagctttctacatatggctagactgttttcccagcaccatttattaaatagggaatcctttccccattgcttgtttttctcaggtttgtcaaagatcagatagttgtagatatgtggcattatttctgagggctctgttctgttccattgatctatatctctgttttggtaccagtaccatgctgttttggttactgtagccttgtagtatagtttgaagtcaggcagcgtgatgcctccagctttgttcttttggcttaggattgacttggcgatgcgggttcttttttggttccatatgaactttaaagtagttttttccaattctgtgaagaaagtcattggtagcttgatggggatggcattgaatctataaattaccttgggcagtatggccattttcacgatattgattcttcctacccacgagcatggaatgttcttccatttgtttgtatcctctttaatttcattgagcagtggtttgtagttctccttgaagaggtccttcacatcccttgtaaggtggattcctaggtattttattctctttgaagcaattgtgaatgggagttcactcatgatttggctctctgtttgtctgctattggtgtataagaatgcttgtgatttttgtacattgattttgtatcctgagactttgctgaagttgcttatcagcttaaggagattttgggctgagacaatggggttttctagatatacaatcatgtcatctgcaaacagtgacaatttgacttcccaactttcatttacgttacctgcaaactcaatagaggctgaaaaatttgttgcctatttaatgaattcatcaacaaatgctgattgaatgactgctctgggctggtcaaaaagggtcacaggcgagtgagacaagtgcagaaaggaggatgatgcaggtgggtggggcccaggagtggcaggtggctgtggggacctaactgggcttattgagaggcacacagccagtgctcaataatgctaacggtaaaagagtaatattgatttattatacatttaattctttacagataagtgtgatatggctgtcccaaaaagcttgctcagttgtaaactaggccattggtctgcagtaccaaaaagtcaatttggggaaccaccttctgtgagacattaacaaactgtaacccatttgggcaaggctgccacggagccaggagcagcctcacaggaggctgaggaggggcattaagcctccagagaagagacccacaagaggatgtcacaggccgcctgttcagctacactaagcagctcccaggagtgggtctcaagccatgagtgcatgtttcagggaggcagttttaagcctcacgtaaggaagaactttttaaaaattcctctcttcctaaacaaccttcctgaaagatctgaactttttgccacttaagttggacacctgccaaggaaggaaggtgtgcggaacccattccagtagtgggaaagaggtttggtgactaggctttaagttccttttcagcctaagattctgtggggctaagaagacgagtgactttttgtctaagtatcttttcagtgtggcatttgtaacattgctcatctctatgaaatggaatgatccatttcctatcaagtgaatttggggcatcagttctcagttttgacacaatgacttgggcagattattaaatcacattatgtactggtctgcctgtacatggcccaatttaaccctcgaaggtggctatggggtggggaaccgccaattataatctacaatctcttttgctaactagcattccactggtcagggaagttccagacagctgctggggacagccaagctttcctctcggcccagcacgcagctgttcaggaagggatgctctcttcctttgagcccttccccctaccctccattctctgcctcctctatatcttgactcttctctctgctcctgatggtaccatgcacagttgatattttctgtcaatttaatcccattttaggtggtatttcatattttcctaccctcactaaaacctccttaaacattcagtaaactatattttcataacgggttttcacgtccagcctgaatcactccctgaccacccaagtaagctcgttgacttacttttccatctttgtatgctcagtgcaaaacataggtccaggtttataataggtgctcaatacataatagtagatgaaataaatgacctaccttttctgacacatgggaatgcctttctatattcttatttttggtagtgaagtttctgataaaacgtatccagggaaacacgttgctaatagaagtatcgcacacgttaggcataaaagctgtacccttttttaagtgccacagaggactaataactgttagtttgcaatcacagactacaaaagaaatgattgcatgaatagctgagattccaggtgttaattcaatagcaaaaaaatgtgtgtgtccttgtactttagtttctgatggttaggagctgatgtgtacttgcttttgaattcactaaaatcagattcaagaccttctataaatctgtagactcaaaggaatggaaaatgcccccaaaggtcacctggcacaaaccctgcctttaggcagaacaagatataaaactccttgtcgactgtctatcctttaaaaacctgtctcaaggagaatatttttaagtattttctttttctttaacctcggaaacgcttttcctgagggtcagtccttatggctccattacacatgatgaaaaattctcccctgccatattgtaagatcatttccatttgctctgtcctcagcagagcaggaaaacattggtcagcttcctccgtatcatgtcccttaatacacttaataaatccgccctgagctcccttttcctcagacttcataaatccaattcctcaagccgatcctcacagatcagttttgcaaccctttaatcattttaataatttttgtcactctcagttgaatcatttccaatttatctgtagcctactttttttccccctcaattaaacaccatggtaatgcaaaacggaccagagctaagaataggaaagtttcacagttcttgagtgttataattcctttttttttttttggagatggagtttcactcttgttgccgagactggagtgcaatggtgcgctcttggctcaccacaacctctgcctcccaggttcaagtgattctcccgcctcagcctcccaagtagctgggattacaggcatgcgccaccatgcccagctaattttgtatttttagtagagacagggtttctccatgttggtcaggctagtctcgaactcctgacctcaggtgatccgccagtcttggcctcccaaagtgctgggattacaggcgtgagccaccatgtctggccgggtgttatgattctatgacaacatcacagaaacattttggtatctaaagacttttcttttttttttttttaaattagaagagcaccagaaaactttttcacctcctgttcttgggcaacactaccttccagatctttctcagcagtgcttgagaaaaagcacttagtcctagtgttagctgtttattcatcctcgcagagagaaaatgatccattctgagatcaaaaagaatggcaaagcctcgaaaaagagaggtaagaaactcaaggcttttagagccagggaggagcctggagaatagggggcagccaggtgggcatggtggcagattggaagcacctgtgctgtttaaaggaggggatggcctttcatgttaagctgatttttttcttcacatgagaatgcccatctagtgcaccaggagcttcctttggggggaaaaaaagaaaaaaaggctgggcacggtggcttacacctgtaatctcaacacttggtgagaggccgaggagggtggatcacaagtttaggagttcgagaccagcctgaccaacatggtgaaaccccgtctttactaaaaatacaaaaattagctgtgtgtggtggtgcgcgcctgtaatcccagctactcaggaggctgaagcaggagaattgcttgaacccaggaggcagaggttgcagtgagccgagattgtgccactgtactccagcctgggtgacagagtgagactccatctcaaaaaaaaaaaaaaaaaaaaaaaagttaagccacaaatcgatattttaaatttaaatataaaatggcttaattaatccattgtgcagctcaaccctgtgtgggctcaaaaaggtgcaagcaaggttttgcccatgggctcctgcattcatgcccttgccaggaggctaatcctctaccgtccttatgatttctataagaaatttctgaagacatatgcatcgttgagaggcatgttctttacacatgaacacttttataaaattgtgttttaagaggagattttaaagggcaggaacctaggctctttactctctaatgatgaaattccagatgcagtggctactaaaaatgacacaaatttgtggagatgaaccttcttgatgctttgtaataactcaaccatcacaggatgtgcggtatcatgaagcgtgattgtccctgagatcgccagtgaggcatcgtgaagtgtgactgtccctgaggtcgccagtgaggcatcgtgaagtgtgactgtccctgaggtcgccagtgaggcatcgtgaagtgtgactgtccctgagatccccacatcaagttgttgtttccagttaatctgagaccaacgcgaagcccattgaagaaatgcacccacttgtgcttagtattctaattttcaaacccagcaggttcaattcccttacaaaggttggtctaggatagagttctgggtatagaaaggcaatttaaccaaaatgctttaccctaattacacagcaaagctatttgcataagtaaccagtctgggtattaagagacccaagagagtcaatgttactccagcagaagttatgtttttgctaaccttcaagaaaataatagcaagtcaagacttccaatgttctatttgtaaaagcaaatgatagaggatataatcctttatcatttgaatgaaatatgttggaaagagattggtctccattggaagtgggctgaaaatggccctcctttcccctgtggccatttttgcaggagagggtgttgaccgtattgagcgtggataagggaaatagtttttgttatatcaaaagaagccagtccagacatgattttcttcttccaatatggaagatgctatttttaaagaggccactgatcttttgtttgctatagaaaatgaagtaatctcttagggtaatggactcaaactataacaaaggacaggttatcttaaaatttgataagacatttctaacaggtaaacaatgacatcgtttactaggaagaaaaataaatgttctttgtggagatttttaaaaatagacaaaacaatcacctgaagagattggcctatgaggcttaaatcacggcactgcaggagcagttcaatttgtcagattggaaatatgatgtaagtttaaaaaatagaggaaaataaacacaatctagattgctgctacatatatagttcagatgatttaaacttttgcaacaaaatgatgcttggtatttatcagttttcccttccaatagaatataaaccgcacgaggcctaagactgtgatgtcaactggaaacaaatcccttcatttctagactcctggggaattggcaataaggataaagaaaataagtattatgaaggatgagcaaaataataatgcatctttcatggactccacagccatatctgacaccgttatttctgtgaaaggttttagcccatgacaattgactggacacgttaggaattatggtcatactgtcaccatctattcaagaacacccagccctcatgacatgagcaaataacagcactgacctgcctaagtgaccagacaatcctttaaaggagtatcactaaattgcagcattccaaggccaggggtcaagatgaaaaagaacgatccagactgcaagttgccaggttactgcagaatgaaagtggcagatgggttgatcttaggaaaaaaaaaaaaatctgctaactggtgcagaaaacattagtctgggagaagaatatctcactttagcggagacagctcccgcagttccattcattacgatccgcgggaaggctagacttgctgtgagggttcagccaaggctcaggcccacgtttccccctaacacagacacacatgtgcacacacacctacattgttgtcactgtatgcagaatctcctgccaagagccaaagtgacaaaaattatacagtagcttgatgggaataagaacacaagtgtacctaatctattcaatgtaagtctgaaaatggaaagaggtctacaaagaacagtattactaaaacagtaacagaggtggtttcatttttattagtaaaaaatgctctaaagcctctgactgctgcaaatatgataaaacagcacatcccaagctcagaaaaatggtttaaaacaactctaaggaaatgacccccccctgaaaatcaaatggaagtggaaacacacttggccaaaaagggaggctctggtgcataagacaatataataaaattatagggaaacaatatgatagaaatgaatctgatgaagtgtattgctattgtaagtaaattcatgcggagaagtattgaacaaaccacaagaagggacacctcgttggtagggatgacacctttgacgtgctaacaactgctcatttctcacggtcaacagagcgggcttcctttcaggtcaccatattgaacacacctggcttggactgaaattcctggtgaattggtatacaaggtttgtcattaactctgcacccaaaataaccacacaaccaagaggaagctctttctaccttttaatgttgtgagatgattgttctacacgaggagaaaacaatcacgtgtgactatgtagagcaaacgcggagaggcaagtgcccctgactcttacttgccgtcctcctggcctccctggtgcacacagctatgggggctggaagttagcataattacttccaattaaattaaggtggcacagctttttcccctttctctttgaatagctgtaggcttaagaaacaatatccgtgctgatgatattccataacaatatggtttcatcaatactgctaggtgtaagaactttgggagtcatacattaacctgccttcctcttgcctctcagagaaatgcccatctggcctccacagaaccactcttgccacggtttcgatttctcaggtcaggaccaggacaagttccactcacttaggaaagcagatgtttaggagtttcctatttggcgactcatgaaaatgatagactggtttctagaaataaaaatttggctgcctcttaagctattacattctcaaactgtgacgggatattcccatttgagcttaaagatacatgttttgtttgtttgcttgctttgttttttgagatggggtctcgctctgtcacccaggctggagtgcagtggtgcgatctcagcacactgcaacctccgccccccgggttcaagtgattctcctgcctcagcctcccgggtagctgggactacaggtgcatgccaccacgcttggctaattttttttatttttagtagagacgggatttcaccatgttagccaggatggtctcgatctcctgacctcgttcgtgatctgcccgcctcagtctcccagagtgctgggattacagcacatttttttttttttttgaaagagccctttctgctttttttcatttgtttacaagataaatttttgaaggtaaatgtgggcaaggaggtaaacaaactgagccactacatgaaggaacccgaagttggactccttctaggaggtgattttctacctgagcatgctgtacgggccttgctgctgctgttgtttttaacttaagaatgactttcccctgtaagacatctcatgagaaggcggggaaagcactactttacaacgagcatgggaggtgggcttatctcccagatccatcactgaaagctgggctatcttggggaaattatttaactttcctgaccttttgttccctcctctataaaatggtgacaaatagaataccttcctgacagggttgtagagaggactaattgagacaaccaacgtgccagcattttgggaatcattaaggtctatgaaaagttggtggttgtgtaactgtaacagctgtattttaggaccccaggaattacgatcttctcaaagcagaaatgtatttctttgtaaccttattatctagtatatttcctggtgcaactaggatctcaggaactgtaaataaacaatagatttaaagaacaaatgactgaatgaatgagagaaccaaagaaaaaggagtagagagagtggaaaaaaacaaaacaaaaccccagagtccttgctttctcaagatttctgcaaatgaaagatatttatttatccaactgggcaaggactctttaggcaggttgcacagacaggagttggatggtgaatgtggtcatgatcttgagaaacaaaccgggtctgagctgcaggacagggtcagaccatataaggctgggactgggactctgaacagttttttgggggtaaagttttattttgaggagtgataggggttatggggaaaaagggtgaagaaggcaaggttttaaaacagaataaaaccaaggccagctattttgaggatgagcttgaacagatctgaacgcgagggacaaggtgacaaaaagcaagagagggttaaggatctgcgtctgtgactcacgctggcttaggagggaggtgatgggtggggaggaaactggagttgggggatagccgtttgtcctgatgattagaggctggtatctgggacctcattgtaaagagactaggtccagggaaaggggacccagtgactaggggctgaaagaaaactttgttgctgtgggaaccaggagaccagaagggctctggttccaggaggactgcggggaggccaggaacccaccccttgaaaactgcactaggaagtccagagcggcaagctccttagtgctgccgtcatggtgcctactacggagtcctctgggttcctctcccctgaagccaagggtgtcccctggtctcaagcagcactgaactttgaggtggcagttgagaggcccaattgttagttaaagatgggccagggggaatatcttcatcacaagatgcataaaagcgactctatacatgtcttatttcctttaaaaagcatgaggccaacgtgcagtgtcttccaggctgttttctaaattgtgccatgaaagggcacattcacactactgacatgtcctgcttttattgttacaccttcctccaactgcatctactgaacatctattatatgcatagtaccaacgagaaatcagcatccaactgttttcccccttcctgttatctgaaaacacagaacagcgttagataatttaaaatgaaaacagcaaaagtgaccaataataacaccgtattaacctggttaagttttctggattctggatttcttgtgagtttttatccatgtacatatatttttgtaatattgtactcatagtaaatgtaattttgtggagcttattcttatatgactacactgcctttagagatgaatcttaattttcaggcatttggttgtgggatgcttaggctatgagaagctggatctcaacatttaaagcaggatcatttaaaatgaggagtcaattgtgttacttcacatgtgtttcatttgaaacagtatatcgttatgctactatgataactacagcaaatcctccttaggactgatttaagcattgaataaataaagttaaaattgagtacactgccattttcagtgcttcttgacttctacacacttatcaactactacaaatctgatggcatccactttccagtgggttagctttcacctcgacaggtctcaaggttcttcttatgggattttagtccatggcaatcaccaccatttgagcacagtcacctagtatagctggatatttaaagaaaagaaaaaaaagagaagctaatggcttttcacacatgcactgaaaaaaattaataacctgataatttctggcaaaggagaaaattttttttccttataagactgcaaagttcaacattatgtgatttatctcagtgacctgtaagtagtgcctataattattaaaaataaccatcaagctggcttttaagaagcttcattatggtactgctaatacaatgcccaactccattacttttttctatataaccttaaaacagagccagttcattcctagtgtttccaaagtgttactttaagaagaaaagtgggccaggcgcagtggctcacgcctgtaatcccagcactttgggaggctgaggtgggtgggtcacctgaggccaggagtttgagaccagcctgtccgacatggtgaaaccccatctctacttaaaaaacaaaaacaaaaacaatccgcaaaaattagctgggtgtgatggcgggtgcctgtaattccagctactcgggaggctaaggtaggagaattgattgaacccaggagacagaggttgcagtgagccaagattgcaccactgtgcactccagcctgggtggcagagtgaggctccttctaaaaaaaaaaaaaaaaaaaaaaaaaagaagaagaagaaagaagaaagaagaagaagaagaagaaaaagaagaaaagtgggctaggtatggtggctcacgcctgcaatctcaacactttgggaggccgagactggtggatcacctgagattaggagttcgagaccagcctggccaacgtggtaaaactccatctccactaaaaaacaaaaactagccaggcatggtgtcgcatgcttataatcctagctattcaggaggctgaggcaggagaattgctgaaacctgggcagtgcgggttgcagtgagccaagatcgcaccactgcactccagcctgggtgacagagcaagactcaatctcaaaaaaaaaaaaaaaaaaaaagaaagaaaaaagaaaagtacaggaacatgactcttaaataagccaccatttcagtggatgcatttattgaattgatgctttcagtaagttgtttctcattgtatgcatcatgttaaaagttgtatttaatccacaggtttaatgattaatttcttccagttagggtaaaaatatagtattatagagtttatagtaatagtgttgatttcaacttacgatggagtaaacaggttttgtaattgccttgggaaagccagaacagaaaaagtaattctatcagcaacatggaagcaaaatgagtagatgacttcttttatctgggaagcacattttcaatcacgagttcatgattgacaagtgtgagtttgtttggctggggcagggttccgtgtgactgacctatctttttaggttcattcgtgttgaccaatctttatggatctgggagcagtaagtcaacctagaatcaccaaatttggctacttatatggtgacatcacagcgcaccaaaacgtacatcaaaaccactgaatctgttggtttcatggggttctgcttgggtaaggacccagccacacagttataagatgaaatcaagagttgaggtgctaggccgggcgtggtggctcacacctgtaatcccagcactttgggaggccaaagcaggcagatcacaaggtcaggagatcaagaccatcctggctaacacggtgaaaccctgtctctactaaaaatacaaaaaattagccgggcatggtggcggtcgcctgtagtcccagctactcaggaggctgaggcaggagaatggtgtgaacctggaaggcggagcttgcagtgagccgagatcgcgtcactgcactccagcctgggtgacagagtgagactctatctcaaaaaaaaaaaaaaaaaaaaaaaaaagagttgaggtggtagttgcacaaacctacctgtgataagtagagctatacgcatacactgtagcaaagtcaatttcctggttttggtactgtactctagctatgcaagaggtagccatttggaaaaagctggtgaagggtacctgggacctttctgtgctatgtttacaacttcctgtgtatccataactatttcaaaataaaaagtaaagcacacatgaaatcaagaggactattatttcctcggggagactggcagaagttggctgcacagtggcttcaagctggagggagatttggcttctatgagggcatgtgcgagtctagctctccagataccttagatgaaggccactggcctggggatggggccgggggcactcactgcctccctcactggcagctggacagtgactccacaccatggggccggggaggtggcaacataggtgcatgagagggggactgcccccaccctgcatatctgctggcgctgaaattctctcaggacagctcagccctgctttccagaagatgagaggacttcacaaagctgcccactgccactgagcaaacagaatgtcctgtgcagggaaagcagcagaagggcccagaaacagccagtagccaggcgtggtggtgggcgcctgtagtcccagctacttgggaggctgggcagcagcctgggcagcaaggtcaagtgcaggctgctgtggcactgggcgctgcccctggctgtgcaatcccagggctctgggtgagagctgaaccgaggctcacatctgcccttgctgggttccaccaccttctggcaaagagcattattggttcaatgttaatgccacggcctccccctagcagcacaagcccagcctccgctcacccagccccctagtgaggtgaaccacggctcctgtccaggggcccattgcaagtttccacacatcctcctgcctgctgcagagggccggcggtgtgccttgatacttggctatgcatcccatccacctctagcagcccctggcagctgccttgcacagaagagtcacctggtgaacactgactgaattgagtcaaatagaaagcagctctcactcagagagcagccctccacaccaatgtcagggagaggaaggctgagcacaagagaatctccctctgtccacagaaatgcctgagcatggaactctgggaaaactgcactcgtgtccagatgcaagtaaatgataaactcctcgagacttcagacagagagcatagacatttatagcgcaatgtacttgtaacacccagagacaataagccctcttgccaagtctttgctttgggagtataggctaattgagggagattgcactgttagtgaaaaaagtggaatgtttaataccaagtagggagggggtctgcctttccaagctggggaagtagggaggagagaggaggtttgtgtggatggtgctgttcaaggttcccctctgaatcctgctcacctttaaatacctctggcaggcctgcataaagggcccatttcccttcctcatctagtcgaaaataccagcaggattgctctgaatgaggagacaggagcctccattaaaatgcagacgccaattactctgcaggatgggcactaagcttatcctccagacttttactggtctagcaatttgattagtatcagggtagtaacatatctccctccaaagcgtggagagctcagaggggagggatatagtgaaagacaggtggattcagcatgatcagatctggatgggctgagcccaaggagaatgtgggctggagatcaggaataggcaggtgtgatggagaacttacaagggtaccatgaaagggaagagatataaacaagcaaaaagatatgagcttatctgttacgtatttctttacaattttacataaggttagtccttatggtgtactagaataatttccatttatgtgcaaggtaagatcatttttacatttagccatcatcttcattgacgatgcaattcttagagtaccttagagaatctagaggaaatagagtggtggccttcagcgcattcctccatcttattctcctgcccacacccaggaccagaagaagaacacattgtcattcagtctgaaaccacctcaaagaagcagggtttggtaacaattagaaggtgaaagagaaaaatcacctaagctgatctaatttctttctaaagggaggaagtgtattaattgagggtggggaggaggaatagcttgaggaaacttgtgtttccaagaaacagcctcaccagtagagattgtctgtggtttgcctgttcttgctgtaggcaggtgcacagttgatggaaggccatgcttatgagtcttcgatgacaaatgatgggtacatgatgggttgaaactctcctgagctttcttcactttcttggcttctctctatgctcaaatctctctatgcattttttttttttttttgagaaagagtcttgctctgtcgtccaggctggagtacaatggcgtgatctcagctcactgcaacctctgcctcctgagttcaagtaattctcctgcctcagtctcctaagtagctgggattacaggtggccatcaccaggcccggctaattttttttgtatttttagtagagatggggtttcaccatgttggccaggctcatctcaaactcttgacctcaggtgatccacccacctcggcctttcaaagtgctgggattacaggagtgaacccctgtgctcagccaatagttaattctttattttgaaatattctaggaggaggaaaaaaaaatctgaccatatccaaaggttagtagttaatagctaaatatcaacaaagaggatacagctaaagattccctaaagtttgagtcctgggtcttatttaattggtgacttgaataacatatttgaaagtaggctcatgaatctacagatgaatcttcaaaatacctttattatgataaaagagaaatccaatgctgatgagtaggcttgacttatgatgagaaagctgttcttccaaatcaaaatgtagtgaagacattttacataaagacacaagaaactccgcatagtcatctttgtatcacagatgcttacctagtatctgacatagggtcaatacccataaatgcttcttgaaatcagggttcagttagacacaaagctacagagcttaattaaacatataacaagatcattggtcattattacgaataaactcatgtttactggcctcttctcccgtatgtgaagagggatttcttattaatcccgggtcttaaatgagtttgtcctcagcaggatctcaaagtcataagagagctacaaagattgacaattattagacagtgtcagagttggaggtgagtcttaggttgggttgatgaagcaggagacttctagttctcaagaaaatgaagaataagagagtgacaaacagtgaccatatatgagcaacgtattacccatttgcctacatatattcattttgcactatatggaattacatatttttcatttccaagaatttgttgctcatccattgttgcaggtctgacaaattaccgaaagcaaagcataaaattaggatagaaatcccattgtgttaaagttccatggaaattatgcagaaactcaactgcacagaagagtgcattaaagatacagtggttgccctggggaagcttgctttcttcttaagtattaaacatgtcattttcatatttgagcaaaaacctgaataaactctgccctcaaagaaatgaaagataaccactgactgtgcacttcatataagcttcactgctacattttaaagtatcctgaatagtcccatgatgttaagatagcaacactttattatacacattactaacgtggcaagctctgaaggtcagggagtggctggctggtcttcagcttgacccatttgggaggtccattttcatctttggattatctggcctctcagtttgattactggggccataaacagctttcccgtgagagctgaggtgaacatttcttgctcattaggcctcttccagacaagcctcccttgcatgcaatgaatatgcacttgatgcccagtgaacatgcacttgatactcaatcattgttcttgacttgacattctggttgattatcagacatgtaatccatcagaacagagatgcaaactgaggatcttgaattttgttagtttcattccagagaaagctctgttggggctgggaggggtggcagaacggatgtggacggcgaatattgatgcggtgtgtgtgtatataatgttctcctgggagaggtgtttcttaaaaagccgagttggttttcaacgtgatatttaaccgaatgctgccaaattgtgctacctccccagcacgttaaaaaaatccattaataaagtgtttgttgttgtcagaatgcctattccaaagcttgggctgtgtgaagggctgactccccacaagagaccgatgacaggcgagggaggtagaggagagggctgaagatggatatgtgctgccttgctgacaagtggtgaggacaagcgaggcgatggatcagtagaattttccattaaatcaagaaaaacacaacttgccccccaacatcacctctgatggtttcttagaccagctgcttctctgactccctactgaggaacaaattgctttcctggcgggacatttggacactcctgcattaatagatatggatcccagcatgccaagccaagcaagaaggcaatttaatatgagcaacactgtcatctcaatttaggacaacagctagaatgccctacagggcactgcaacagcttcgagaagtacatgacagaagacattctcactgtcttgaggctagagaaagctggtgtttctagtaaacagtcagaccaaggataatagaaaatgtaatgcaaagatgacagcagcattgtcctatctgtgaacatcagtttcaattcatgtgtctttcccttccgtagtgaacggaggtcctgtgtagggtacttcccttctatctcaatcccatcacaaagacacaaacaaaaagcccagtgacatcgtatcaataaagaaataggtaacattagatgacagatgttgtatacctatgtttgaggaaggtcaaagtaagaggtaacttcacgtttgcatgttcaaacttacttatctatctttgatgctatgcaagacaaaataaatggaagccctttaaatttccacctcctaacactagcctgtatgcaagaaaaatatattcttgctttttaaaaaaaaactctaaatgcattatgttttggtacatactttaatattagtttctattttatttttccataataaagacatggttgaatccagtgtatctattatgctaagataatttatgctaggataatatttttgataggaattctcataacaaatcagcttcatgtaccaattacaaaattgggagataactaaatttttataaaacgttttggcaatatctactgatacatcagtttattttaagtcagtgtggtttcttatcaatcatattgccagggattcatacataaattgagaataaaatatgttcacatgtaacaaaaatacaaatgtatctcctgttagagtctctctagatagagacagaaaaagtgacacagtagattcacacttgagtttgctcacagacaatggcgattcatatcaattgcaatgcttttcatggtgtcattttgcattagacacaaaatcgcaaaataactcaattggtcattaccatgaacacttcaccatggaactagctatgtgacagctcataaggctatcattattatgttgtcaaaagtccctattgctaacatttactgtatgatgaaaaaggtctttcccctatctcatgtgtgtttgatgaggtgacattgttttataaatcaatttcatggaaagtaagtatttatcttaaaatggtatccttttatctttctctgttcctcctcttctccctcctgttactgtttttcttcttcttttgcaaaacatttgaacacagaagcaaaccatttttcaaaataccatctgagaaacccatcaagcatggatagcacctgtgaccagaggagagcctctcagcaagagagagactgggaataacatttcccgtatcacttgggaagtaagaggaaaaaaatgaacacaattcaatccatgaattaaaaaaattttttttcctatccagatagttctcattattttttcattaaatattttttaacataaaaatcccttgtttccactattttctatttgtgaaaaggcaagaaaataataccagctttctgtgcatagatctatcacagcacttccaaaaggatgttggaattattttagatcgtggactccctgagcagcaagggtggtccagtcttgtatttccagcacccatgaaaaatgactccatataatattgggcagaagtgctctgaatgaaatgctcccaaatagaaaaaaattgttttgtgtatctataggaagatatttcagaattatattttatttttttatttttccagagacagggtctcactctgttgcccaggctggagtgcaatggcatgaacatagctcactgtagtctcgaactcctgggctcaagtgatcctcttgcctcagtctcccaagtagctagaactacggctgcatgcccctgtgctcagctaattttttttagtatatttggtagaaacggggcctcactatgctgcccaggctcaaaactatctttagactcaacaatagttaaaaccaaaaatagtttaaattgaaggttttgaattccagagggattatgcttttcggagctgaatttcctcaaacaaccgtaacctcatctgcttgcatagcatataatatttatcaaatactaaacaaaaaatggtgaatctggaggtgaagagatatttctgcaaaggagtcttgatgattaaaagttttcaaaattataccttcacctcttatcagtgcacaacatcgtaagagtttggagggagacactcatctgctttccttcccaatgagtaggtgtacgcaggacggagcctgtcagaagagcagggctggctgctgtccttgcatccgtttgatgtaggagatcacaggaaacaatgtgaaattctgcagcctggttttaaaatttcttacatcttttacacatttcaaaacatcaaatatgtttgttgtagcttgttcttacctctattctgcctaagcaaatgatatttcatctcttaatgtgaaaataagatttttgagttgacacattcattcattttctaaaaggtgtgtgtgtgtgtgtgtgtgtatgtgtgtgtgagtagggttctgtgtgagatggacgggtgaagccataaggatatatagtataaagccatcctttataaaacaggacaacaaatcttacactaaaaatttgctctgtagagttgcaagcctcagaaagtttaggagtgtcacctgtcctgttcctgggcctggagatgagggtccacctctcccaggtcctgaggactttcctcctggagcctagcctgccagtgagtaggctgctctgatctcttctccctgcactccaacatcttgctttcagctttgccctctaaatactggaataaaagggccaacaggtcagggatattgggagcaggagaactgtggtgctgcatgaatttaagggatgtttttattataagatcagagaaggaaaaatgatcagaaagcaaagagaggaaaagtttagtttatgagaaggctgtaggaggcagttcccggagcctaagtattaaaatatgaacagagacaagagaacctacctgcacttagtatccctgtacttgggatctttgaaggctatactattttaaaaaattattctattcagcgcattgcatcagaaatgcttctatgttaatctggaaataggtgttctaattatagatgctaaaaatgttctgtatactacttggctatagaatagcctacagatataataaaaaataattatttaaagtaatttttggaaaacaacccaataacttagataatgttattaatatgggtatcaaatattttaaatctaattataccaatgtctcaaatatataacaaatataacagaaaagattaactgaaagataggtttaagttgcctgtaacccaaatctgtgtatataagcaatttagtattgtgtatcttctaaagaccactgcttgaatacaattaaatgatcactcacatataatagtgggctgataaaccagctcttttccaaccttcctaaaaaaaaaggtcagtcccataaatactctcatcacagtcagtttcaagctgccaacatgaagttgctgaacatggagctggaaaaagatgtgcataactggctcctgtgaacctggtacagctggctccagcctccagtagacactcatgtgttcagacacatgcatgtgcgtgcacacaaacacacctgttcaacagattacagttgcttattgtattgtacttgagtattgaataattgcttcttgcttactttgaaaagtacctaagctacaacaatgggcaaaaagtttctcgaatgcacacaaactaaaatattaagtgatattttcctattgtcttcttttttgttgtcctgtcttgctaattctttcttgtttacatgctataaccattagaagctctgctaacatcttaaataaaatagaaatattaaaatatatatataaatataagtaatataaataaatataatgaaataaaatctcaaagcatcagtaattgctacatgaggagcaaaccctctgatataattttacatttactcatccattcatttgcaaatgtttgctaagcactgtaggggacagaaaagactttctttatcctctgaaggttcgataatgtagtctatgaaataaactgacagtagacagatcaacacgataaaatacatacaaatttattacatacatatgcatgagagtccctcaaaatataaggctcaaagaaggggtaggtaattggagtttatatagaatccctgggctacagaaaggaatagaggtttggggtctctggctgggaggtggtgacaggttatggaaaggtgaggggaggaaatgtatgatgaacaaaggctatcttgttataccgatagaaagcctcaggagtagtaaaagttgtttcagtgcatctctcagaagaatctgtgatcacctgtgacagagtctgtctgggtaaggtatcacctccaatcttacctcctgtgataagatcttctctgtttcatgagattcctatgacaattattttcctttatagatatagatttcttttacaaaagaacagctattcagaggcacttctgtgtctgcaacttctcagaataaccagctcaaaatatgccaaagaagtacattctggggtggcatgttctggtctcctaccatcatattttggggtgaagtgtcttgagccccaacggcatcaagtatgaacttggagccagggctttggtgtacatttctgtaatttgtgcttcacacaaacaattccacctataaggccagaagggctgggaaacagggcatttccctccctgaaccttacaacctgctggatgctatgcccacatgagggaggggtgccttctaattcacagcaagatgccttctgctaccaagtgctgtggcctctctctgcctgaggggtggagtgaggaacatctgcccatgggtagtagcaccttgtaaaatctaaaaggtggggaggcaaagaggacacgcactgcatcttcttcccttgcacttccttttactactagaatgagagtttcctctttccgtgatgctctaatattcctagtcaggccaagctattgctaatcagaacattctccggctctccagtcttctttattagactggcctctacagggctggagtctcttttctgacagtgccactgaatcagctgtctgaagaacccttgcgggagactgatggaccttcacagacaccgtttctctaggtcagctcagtttaccccaaggccacaggcattactgcctcctttaacacagcactgcttttaaacatttctttccccccacttagtccccagagacttagagttaacttgaataaattcccctaatctgagattgaaaagacagaaaagatagaaatcttttcttccttcaaaatacttaacatatatttgtgggacagaagaatttccatagatataatatatgcataaaatgtcactgttaaagtaatcctcaggggaaagatttttcatttgtgactttacttagccatgtcatattgagacaggattttattctgattggtagtttttggttttctctttctgtttagtaatgaatactggtaaacctcccagctacaaatatctcctgatatgttaaagaaacagagtcttccatagctgtagtgggtgcacagctgtgggaacgcaatgtggcctctcatacactccaggagctgttcctccaccccttccatgaaggaaaggtgatgccttaacccttttggagaggtgagcagtcttgaagccctcaataatatccaccagcaccccagtgaaaatgggaaataagacaggaacttggagaactcccattgagaaaagatcctagaaatcacagcagagtggcagggtctttctcaactgtgtccaagtggaaatggggttgtgtacaaatagggccccctcatataacacgcaactgactccagggcacacccatacttttaacgtctgattgctttcaagaatgctgtgaaaagttgttgcgagatacatgggattgagacttctgcagtaaagggttgaggttagacactgagtaacttcttgtcagtaaaaggaattaaacactgcctcaggagatggtataattatctcctggggaggtgactttttgtcttgaatgattaggtgaagtccaatgagaatctaagaggctggatgaaaattcttggaaattaagccacaactgaaaaaaggagccaaataaataaggccttctctggggcctcataccgtgtaccaagggtcgaagaagtaaagtttgcctgactcatgattctagcttagaaggcaggaatcctgctttgttttatttgaattattgcattgatattcacaacaacagtcttgtttgaatatcttaatttaggagtctgctacttaaaacagctgtcttatgtctatgagatatacgagccacaaccacagactctacgctgcgttcctctccctagtcaccgcatgccttcctgttccagtgaaatttagggtattgaaaggcaagagtctcatcttcgaatatctgatttgatgagtgattgctggaagtggatgccttagggaaggtgagaagacaatgatggggatgatgttgacacctggttgtggctgacggctgtgtccctccagctgcctcacctggggccgcagtaagcaccaagttcacaggcttagtgaggcgagtcacacattagcccatctgctctggtaatgtcaataccagcatgcaagaaagctccgagtcttagagatggaagaggcctccttttgtagaggaacgggaaacagtggcacaggaaaggtgaaatggcttacttatgatctcacagcaatgggacagagaaatggctggtttctcttcaaactcacacagtttcagttccagtaataaaacatctaaacctccatatttggacgaagtatagtctactcataggattacggcaactcagtttaagtgaggctgttttggaagaagctgtcctacatataagttgtcttctgcaaaataagacacaaaaatagttttgaaatcaaaaaagatttataaacattattggtacaactgatttttgtctctggctggaaaatttttcatgggttacacattctttcatatatttctcacatttgagaagtggagatttaattgcttacattttgatgatgaagaaaaataccacttgacacaaattaatgtcaatccttgagggaccagttccttttccacggcatatataataaaataacacaggaacattaatctactttgtagagtagtgaaacttattgagcatgttataaaaacaacagagcagcaaaagcattttacttaagaagcatttaaaaaaaaaaccctcattcatttcacaccactctgatgttttagccaacagttttttcactgggccgtggctgtgcacacgggcttcttgccatcacttaaatggacacttctcaaactctccctcacaggtgttcctggacagcacaggaaagagaacaaagagaacaaaaactacttggattgtctggaggtcatagtccaaaggaagggttgtaaatttagacattttttgaagattcacgtgtttggttcaatataaaagtatcattccccacccagacctgtcccagtgtctagggaaatgcaccttctcctgtgacattgcatatcatcttccatatcaggtaccctggtttgaaaaatcatacttttagaagaaattgccctttccattttcttaactgctctggagaccagcaggaattggagcagcctcattccgtgtcgaagaagacctatacggcttgcttctttttttctttttttcttttttttttttgagatggagtttcactcttgttgcccaggctggagtgcaatggcatgatctcggctcaccgcaacctccacctcccaggttcaagcgcttctcctgcctagcctcccaagtagctgggattacaggcatttaccaccacgcctggctaatttttttctatttttagtggagacggggtttctctatgttggtcaggccagtctcgaactcctgacctcaggtgatccgcccgtattggcctcccaaagtgctgggattacaggcgtgagccaccacacctggcccaaggcttgcttcttttaagagaaaaaggctgtcatgctgctctacttcagagaacagaccaatttttagagagcttcaacaatttctttctaatgataattcaaatctttaccaaaatcctaacacatcaaatttcagtttcatattttcaactacctacgggatattttattgcttcaaacagaacatagcactccaccatctgataataatgtttattttacctgaatgcaagttccgtaagttccatcatttgcccagccttaataataattgtgcaaggccgggcgcggtggctcacgcctgtaatcccagcattttgggaggctgaggcgggcagatcacgaggtcaggagatcgagaccatcctggctaacatggtgaaaccccgtctctactaaaaatacaaaaaattagccgggtatggtggcgggcgcctgtagtcccagctactcgggaggctgagggaggagaatggcgtgaacccgggaggcagagcttgcagtgagccgagatcatgccactgcactccagcctggatgacagagcgagactccgtctcaaaaaaaaaaaaaaaaattaattgtgcgaacgccaccccctaccctcgcccagcaacacagcaacattgctgaggaaactgatgcactcccacattttaatgacccagtgttggaagaagtcaactaaatgagttaaaagtgtcccaaggtaggtggcccagtaagaccatcccaaagaaaggaacctgggcagaatccaaaataggctcaaaggagaagattttctctttagggggcttgtacgtgtgagtggacatagatatatacgctgcaaacgtgtaggggatatttaggagcactgtccctgctgctctagggcacctattccttggaaagagtcagggtgctctgaaaaaaatcatgtcagtcttaccagcaagggaattgtaaacctgaatatcagacatgcgggtggattacctgcgtctattatccaggcttgggaaatggaggtgctcagggatgagaaggattagattataaaagaacagctttgaggaatgttttggaactgttacaatggatcccacttttagggatacatagaaaaagtctttgcaaataccagagatacaggcactacaaggaaattagatagatgccaaaagcatttaataaagaaggagtttggggtaaaaatttgcaaatcttcaccatcctactcttccctgaaacaaaaaactaatttcaatttaaaattttcactatgattagttctattaaaaatcaatcaatctatccatcctatctctgtcttgcactctctctctctctctctctctctctatatatatatatatatatatatataatctatctatgtgtctataagtacaagatgcttcttgcagaaaaatttgcctagagactgtgatttgtgtaaaactaactggattaaaattaaaattcgcaagttttagggttcacttaagcaaaaaaataactttttcattggtaaaatggtaaatttatttctggatctagtttgtgaagcaggagtgtgtatatggctgtgtgtgtatgagtgtgggtgtatgtatgtagtgtgtgtgtgtgagtgtgtgtgtctgagtctggacccagctccctactcaggagtttactccatactctatctcttccagagtaggctgtgattcccagtgtactaatgttaaatgttccagagacattgaaaatatctagggttgttataaattagctttgtggggtttttttacttgcttttgtttgtatttttgaataaatgagttgaggaaaaaacatccttgctaaatagaaatcatgggttacgagacgggagagacgcccacgtggtaatatggctggaatgtcatggtcagaaggtctttcctgtctttcactttttcatgttcactggtgcatgcacgtggatgctgggatatctgagtcaagaagggtggctgtcactgtccaccctttatacctgccaccacttctcaaatactggtagaaagcctcttataaatctacaaatcttgtcacttgcgggacttttcaatatgaaaccctcttatacaattatatgtatgttggataccatggtggatgctgaggaaacagtaaggaaaatttgctatttcagacttgtaaatattaaactcatatttttagatttaaaaaaggcagcaaattatgcagcataataaagatgggtgagtataaatattctatagtgtaccatattagctattaaacattatacagagagtggttatgaattcaatttctaaataatctctaaaataaaagaatgatctaaatcttccacatccctgaggtattagtcttaaatgcatatgatattacaaaactaaaattcttaaaataatttctgaaaaactagtgatacaggagttgtaaagaaattacttgggcagtgagggtatggaagtcctcagtaaggttttcttcttaatgaaaagcagcccccaaatcattttcttttccaacaaagagcagcctgtaaaatcgacctgcagacacaaacaagcatgctggaagcttgcacaggtacatgctggcagttgtgcccgtaggaatatactacctgggactagccatgttcaaaatggcggctccatcttctctttttgccagccacgtgtccagtaaggagcagacaagatagccccaccaagtggaaagcccatttgcataataagattagggtggggcgaccagccttcttcgcgtgctaagtaaacgtcacacctggtcaaaccaatctgtgagccctacgtaaatcagacactgcctcctcaagcctgcctataaaatctgctgggatctgccaccttaaccctttttttcagacatctctctctcttgcaaggagctgccctcctctctcctttcttccgcctgttaaactttccactccttaacccacccacgtgtctgtgtacttaattttcttggcgtgagataaggaaccctggggatttaccctagactacgatgctgcttcactagtaggaagagaaaagataaacagcgattcctgttttataaggtaggaaggctgtatattcacacgacactcgccgtcacagtggtctctgtgacttcagtgaaccccctttccacctgtcctcctcgccctcacactagattactttttccaaaagatctgatcatgtcacttcccctggaagcccttgcctggcctccattgtctgcaggatgaagtactgaatccttaacccacagggccagactccctttccctgtcctgctcttgatcaggcaccatgagcccacgactcctctccgtcggctaatcattcctccctggccgtgttctctgcagctgcctagctttctgtcccttcactctgttccagaatcttctgcctgaaatatttcagtcaccacttccaggtcaaatttctccatccctcagtgcgcttaatgaagctccccattcttgattccaaaccttttcctttctcactgcatcattcatgattgatacaacgatgagtgtgctgaatgcaggcatcgttgctgaggatacaaaaatgaatagaaggcagctcctgctcaccccaccagcggccccacagcagctccacgtgtgggcaagtggtatgcacacgagcaatgtgatacacgtgactatgagatgtgttcaaggtgatgcggaaactgggtacgaaggcccttaagtatcctggatttctgtgggacattcccctgcacagttacgtgttgccatgcggctatgctgtttcgcatagacatgtcttgtcttcccattagatgacgtgtttcttcagcacagtggctgtgacatcacctctgtgtgcctgtagcatctagcagagagccacatacatgctggataaccaattcatgcatgtagaataaacaattttcccctacaagtattactgatttattttaaatataagaaagaatatactgaattttcccccttggtgcatgtttcttatgagtacagcttagttgctaaaaacagcgtgatttctagtgattgcggtagaagaataaaagctaaaactcctaggacttctgttagaaatgtaaatcagaagctgatattacttcaagtgctacgtgaaataccacattcaatttgtaactccaaaagctttagtctgtggtacatgtggttctacatggtttagtagtgcctttgtatgtgacatgagaacaaaataatcagcaggtgtaaatgtcaatcgaactagagaattttctagaattgtacctctgctttcagtttatggcactactgaatgcaaactctatttatctgcacaacttcagaaggttattgtggcaacaccttttaatagaaggggcgaatacaattttacgggtattattgagagttagaggtctaatttctcatgcctgggaatacggaaagtgaaaaatatatattgttacaaaaaaagataaccaaggaaatactcaattctgttagaaataaaaaagaagtagtttcatgccagaagacttttttcttttcctgcatgaaaatatgaaactctgagactgcacacaagtgaatggtatttgagtaatgataaaaggagacagaaaagacaccagatgaggcagaggctgacatttgtccgctcatcatccatttgcccttttcttcataggaacagtttctagctgggcacatcgcaccccgaatacagatatttcccaactgctttgggggctggccatgtagcctcacaagtaacttttctctgtcggaatacgagtacgatgttgtgtgctacttccagatttgacctttaaagagactgggaatgtcctcttctctttcccctttgtttctggttgaaaagtggacctggggctgagccaccttgcaccatgtagatgagggcaactaaaggcttggtggagtggagcatcccagctccagacattttatgagagagagaaataaactcccatccccttaagccactgcagtcttaggaactggccacacaccacggaactaacgtcagaataatataatggagcctactacaatccatttagccagagaggaacaaaaagattttttttttttattgctgattacagttacagtggacacaaccatattatggaatataataatctggaggtgattttgtttgctactaaaacgctctcatcaaatacttcttttttttccccaatatctgcccaaagtccttagtaaatgaattcctttggtcattattaagagaaataaatgcctgtgtgcccattaagagattttgattggagaaacagaaagccccaatttaactggcttaaatagaaaggaaatgtatcatatcccatgacaggcagtccaaccatggagtggcttcagagctgatgaactcagtagggcaatgaactctagaagggcctggatcttctgaaacctgatcactagtaagggtcaagggattagcaagactggtttagactactcagaactcactactgacccggaaaatgaggtcatttcccaaactggtccacacttgaaaaaaaaaaaaaatctgttctgttagcaagagaaagggggagatggccgtcaggagggaaaccgacattttagtgtacagtctgtctgctgtgcacacagagattctaaccatgacctgatagaaacttacccctgccagctgccagccaggtgctgggggtcatgctctatcagcaagcagttctgtttgtacagggaaggtgcatagcctatagagtcggtttcatgctggctattttattcacattctgaggtagtttgtgtccctgcagatttctgattatacatcagtgacgtttaatgtgatgctcagaatattaaaagcatacccagtaagtgttttatctaaatcatgtttacaagggaagttctgtgcttttctgaggtcttgcaaaaacaatctttggtttctttagaccaagaaactaaaaatagacacagtgacatagcctccaaacagcaattttgagatcgaaaacctctgttacattaacaatgtgaagcagttcccatccatcccattacaggaagttctgggtcaatagatttagtctaacaaagatcttatctctttaatcctatctttctacttcaacttttcttattgattaagcatcttctgaactttacaacaatacaatactgcttatacaaagcccagccatgtcttcacataaaagagtttttgagaagcctactttgatttagatttctttctttccaaatagcagctatcttctgaacacatagcttttctacgtacttcctatttacatgtaaaaccatttaaatgaatggtctaaacaaggttgattaatcactgggaaatttctctttcaggacacatccattccaagctctacattctttaaaaatctagcaaataaaatttcatcttatttctgatgcaaatgactaacataagttgactggactatctcttctatttccttcagataatcagggcaagtcaaaatgcaggcttgtacaaataaagaacaatgcttcaagttcttttttttttcttttcttttttcttttttttttgagatggattcttgctctgtcgcccaggctggagtttagtggcgtgatctcggctcactgcaagctctgcctcccaggttcacaccattctcctgcctcagcctccggagtagctgggactacaggcacccgccaccatgctcggctaattttttgtgtttttagtagagacggggtttcaccatgttagcctggatggtctcgatctcctgacctcgtgatccgcccgccttagcctcccaaagtgctgggattacaggcgtgagccactgcgcccggcctcaaattcttaggacacaatcaaaagcttgcatttgataatgtgtgtaagaattctttaggcatatgtcacattctgcaagtggactgggtttgtctacatggggaggcggccacgggaagagtgaacacagacttcctccaaattacagccctgccagtttagcactaataccttgagaggaattgggaaaaaatcgcttggcatcaaattcccagactgtccctgaactctggtcaataaccaacacggctttgtgaagaaaaatgtgatgtgtgtcaggaacaatattatttctgtctgaaggagagtaacaggcaactttgattggataaagaaacaggcattcttggccttcttctacagaaaggaggaagaaaattgctttttggaagtgcagcaataggcccgcttgacaaattacctcctagagtgcaagagtgaggcttatctgcttctgactgggttccttctcacttgtacacttcttctgatcctggttcaagaatgggcaaacagacaggcaagggttatacatttgacctgggccttacccatggccttgtagttacttgatatttttcttctccttgaaaaaaattcttaaataaattggactttaagaaatctccttcttagtctctatccacaacctcaacttcttaatggacagtggggacaaaggcctgtatggtaggcttggatagctctgccaggtgtacctcctaaggacctccaaatcttaggggaggtgggactaaaggtcaagccaggacagatcagatttgcctaggggacacttcaagtttccacttcttggtgcaaaaagaggccaaagtgagtctttgaggacttcaactggtagaatcctggggcccactgagatgccaagcggagaaggaggaaaaatggctgcatttcttggaatctcaggaaatgtgatttctacatctgttgcagatccttggagaccagtgcccatgggactggctggtctttacccaagaaaagccctattacctcccaggagcttgtagagagatttgattgaataactgatcgacttagcctttcccagtggaatgttggacaagcgagagaaatgcctgtcactctagtcctgagtgctcattctgtgtgggctcccttgaactctgcctaaatgtcatgaacaacaggaataacagcaggtacttagcgctgaccttggtgttcctgtttcgtgtgaagagtgagggcgtgctgcttcttcatcatgccatgaggctaacatgcgatgttcttggcatgtgctagacaatctctgcccttacccccaaggggcactagctgaacaaaaacaacactaaaatcccctgtaggaagttgattgctagaatacagatatgtgcaaagttgcattgggatacgttttcctataacgtaagaactatttaaactatttaaacattttgtgtaatttaattaaaacatcactgatttgcattggctgctcaatacatttggtgacatgtttcagagaccctattttgcgaaggtaaattaaatttcccagtggacttcattctcattaaaaaatgacattcagctacatgggtatgacaggagagttgctcctgacgcattccaggtttaagagtggccagccggaccaccacctgcatgcctggctctttctggaacagcagcgagccttcacggagttggtttctgtgccctcggtctctgccagtgaaaagcatatttccttctccctaagtttaacctcaaagaaacactttgcctaaaaaggtgtaaaattctacctaataataattattggtcacattgcttttatttttaacatgtaacattactaagtttaattaagaaaaaaagtaattcataaactcagtccctaagtaaccatcaactacatgttcagaaacctcaaacattctagaaggttataaactgaaaagtaaaagcttcctccctcacatcatcacttcctctacccaaaggcagccactgttcccggggtgtctttgattctttccagaaaatatcttatatgctcatgtgcatggatccccttttcatgctgtctttacttcattctgtgtattaaaagtgattccgtatcaggacacggattgaccttactcttcataacagagtattgtattccactgtataattatgtcaagaacatacttaactgctataatactatggaaaagtggatcgtttccatatttttatctattacaaaatagtgctggaaaggggaagatcaccattcagaatgctgggggttggggagatgcaagctgcctgtctggtggggggccgccaggtctgccccagctggactggacccaagcactacatccttaggattgttctcactgtttgcagaagcacttcttctgacatggaaaacaaaaacacaatctacatgtcatttttgttgttattatcataatgccccatgcagttaatgtttttgagattgacacatggtgacactcgccctatgaaaatattttatttatcattatataagttattctatgaaattttaaaatctctcatattcatttaattaacccttggaagaagagttactaagcatacacgatcacaaaatttcatcccatcttctctaattgatcttaaacccataaaaatatatatcaatggcagtgttagaaagaaaaagattttactgtaaaaataaattgtagtctcaaaaatacatttgaggcaaataaaccatataatttaaaaagtcatactttcattagttctctacagaaatgaactattgtgggcctaatggctctgatttttgggtatcacttgctcattgtgactagcagtatgcaactcagcactacggattaaaaaaataaagcaagccatctgaatcccaagttgcttcataaaacacctgtcttacaaaatgtaccacacaaaaggtagttcttgctctacagagtttaggaaatgctgagtgtgctgttctgcttgttcaagcaatacatctttgcatagtgaaagttttaagtcctataggaaagaaattggtttaatctggcttacctggtgcctccaactcttggattgcagctctctgctccacctctctgtaccccaactcctgccctgctcctggcagcatctgttggaacctggattgcatgacccgtactctggaaaatgctgctctatatttttgtagtcaagaaattgctttatttctggaaagtttttttctttttttccctcaactacagctgaatagctcaaagtgcttgtgttgaaaacacaggaaacctgagtttgcaaatgttattccttggacagacgtccctgtccttttccagactggaactgtccagtagaactttctgcagtgatgaaaatgggctatatctgcactgttcaatacagtagccacttgccatgtatggccactgagtgcttggaatgtggttactgtgattgaggaactgactttttaattatatttacttttaaatagccatatgtggctaaaggctgccatgtcagacacacagccccagacagaggtcagagcacgaccaaaataaatgcacagaaacaatgctctccacacagaaacaatgcaatcttcacaagaagtctgttttcaggactgttctgagctctctgcagcttataaagctaaagaagtttctccaatcgatttgccataaaactgattttctaacacattattcaaaaagatggatcttacgattttgaaagagtataattattggtcaggtgcggtggctcacgcctataattccagcactttgggaggctgaggagggtggatcgcctgaggtcaggagttcgagaccagcctgaccaacatggtgcaatcccgtctctactaaatttacaaaaattagctgggcgtagtggcacgtgcctgtaatcccagctactcaggaggctgaggcaggagaatcgtttgaaccttgaaggcggaggtgacagtgagccgagatcatgccactgcactccagcctgggtgacagagcgagactccgtctcaaaaagaaaaaaaaaaaacagtataattatttcatatttacctttatttcaacaaaaactggctaaagacaataagaatagctagtggtctgtgttgggttaaaaaatatacttttctatgtgcagctgacccttgaacaacatgtattagaacgtaagtccacttgtatgtagattttcttcctcctctgccacctcggtaacagcaagaccaacccctcctcttcctcctcagcctactcaacatgaagatgatgagggtgaaggcctttatggcgatctacttccatttagtaaacagaaaatacattttctcttccttatgattttcttaataatgttttcttttctctagcttactttatcataagaatatagtatataatacatgtgacatacaaaatacctgctcattagccatttatattattgacaaggcttcccgtcaacagtggatcattgtagttaagtttaagctatctgccgactttcagttgcaggaggggttggcacccctcaactccccgtagctcatcaaagatcagctgtacctcaaaatcacggaacactttctaggaatgtctgccaactgatagatgctttccagatgaatggtatgcagaacttgtttgtacatttgtgaacagtttctttaactaaaataaatactctccaaagctttccatctttgcacttcaagctgtctcacaggcagaaagtctagcgaggcttatttccaatctgcaaatgagctgatcttagagtttaaattagatttttggacacatgtcaaataaacatggactgcatatttttgacatttcataacaccaactttcttttttaaaatgctctttgatgaagaacatcttgtatatcaaagcctaaagtaccaacaagatttgattccagtctctatgtgctggagtgtccaggcggttgaggcaaacttacatggggacagctggagtgaaggctcatgaacccacagttagtcatcctgagaaacacctgttctttctgatgtctccctgaaaacatcatatatttggagactagattttaatctctagtcttaaaaaaactcaatatggtttaaaaaatatctaagcataatttaatgaaattacatatttttacaaaaataaattaaaattggcttgaataagaaaagtaaccattttcttttttccttttattattaaatattgatcatctacatgttttctctttccaaggtccacctattgaaaaaagagcttcacatctatttgttaatttggattttaaactcaataattagttaaatctttgagtaaaagggtaggtatcatcataatttatcttcattgactcctttcctacgttaaaggctgaaaatgaggttcagactctcatttcactaaaacctccaacagtattttaatgctgttgtgataagtcgttcaaaataaccattttcaccaaaaacatatacacgtttctttgcacgaagtaggtcatatcctgtatttgcacaggtctaaaaccacatttgagggaggctttacaacttcatttttataattttcgaaaccctttttaagaaaaccaatgcaagaagatgaacatggttaagaggatttggaaagggtccatgcaagtgaggagcccaaggtgaatgcctcattagttccctgacaaacctgcctccgagcgacacagcatggtgtttgtttaaggacagagtgactgttagatgccttaagaaattctatcgcatttccttaacttatggtcactaatatgatttttgaaattcgattttcatttaaatgtgtatttttctgcagttgccacattttgtttctggatttctaattaaaaacagaaaattccttatccaacttcaaatcattattttaataaattatcacccagacatgtaataccccaagataatatcaaataagataaagatgttttatttatagagaactcagaaggtttgattgccatagctttctgcattcccaggtcagtgagtataatgtattccatattttgttgctgttttccagcactaaacacgtcagcattttgcatcggagtcattaaagtttgtgagatagttctgatgaatagcaataaggccagaaaaaaagaataatgcataacatgaattctttaggaaatcaattaatttttttatgagcagtagtaaaaataggatctagggttagcagagtgaggctagactagtatttggtaccaaaatacattctctgctgcgttctatctatgtaaaaatattctgtgctgagtcaaaactgaaatctcagttctcccaagagtaagacattttacatatcagaatgtactctttacttggccgtgtatgtagcctttgatagagcacaccaattctgtaaattctgcagtactttcaggtttctaatggactttttgtggatccctgaacatagtgttattttggttttctgaattatatactatgtgtgctattaaaacactgtatattgtataagtatataaaggtgcttacgtatttttcaaagagctctttgttggggcaaggtaagcagttctaatactgggataaatgatgattaatattggaaaataaaagtaatagtttgttgatattactcctagattattaagattcactcaaccatttattttattcattcattcattcattcattcattcattcattcatacatttgatgaatgttaaacaccaaatacatgattcaccaagaagaatgaaaaggcttaggacaggaatataaagacaggaaaccactgtaacactgcagcttgaattctgggaggtagtactttcaaataattctttataatggtaataaatttactggatccaccccacatttatcaggcctttcctaggtggactgacatcatcacttaaatggaaatccctgtcttcatttattagttaaggtacattgctcctcggggaacagataagcctgtgacacagtggagcaaagtgtctggaatctgattttccaatggacattcccatatgtttgaacaaaagagtcataaatactaactatagcacctattttacagaagctgaactaaagacacagaagccttcaaatggaaaggatatacaacagaaaccacagctgtgcggaagaccacccaggtacatggtcgtgggtgaaatgactagaagattagaatcctctggagcccagagctcaacacatgggtgtctagctccgaacaattttaaatcccacaaatgacagagaatttggttttcaacttttttatacgcgattttttttgtaacagctaacatttcttgcatacccacatggtaagagttgtactttttctatcttgataattgagggaaaaaaaaattaagcacgggtgaattcacaggcatcttacaataaatctgtgaaccacatcctgataatcactggagttaatgacgtctagggctttttccacatctggaactctgtaattcttctatagctttgctaccaatgacttttccttgaacgatgtattgaatgaggcactcacttctccctgaggcagcttattttgttcttcgttgtccatactgtgagagcaaagagtaaaaagagattcaccttcttctaacttttatgtatttggccatgttctacttctgaaatgacataatctaaccacaatttcttccagacaatggctttccattacactccttaaacccagaaaagatgggcagcttacaaggttatacaaaccacagcaaaacaacatgtatcaggaaaaggggaagagaaagaaggaaacaagtaaagccaggaaaccagtttccaaatccactgtgtttatgacctctatatatgctatagggagcccacagatgtagctttagattttctagcagtcaactgtcagaggaaaaccttatcagctggtttaacatccttaaaggcaactttcctcaggacaagcataaatgtgcctggtactcagatcagacttgaatagtcaccatggttccttgtggaaaagtctgttgggatgtcctgaaccacaggcatcacatttcctgtgtaacgatcacaatataaacaaatggcatggtggcaaagtagtatttaggaaaagcaattatttgaaaggctaaaaatagtaaggtctaggtgcccagtttcctgccgtagatctgactacatcctggattctagactatttggaagagtatatccaatgaatgccatgtaagcaatcttccttgaatgttgggtttttgggtgagctttggataaatattcattaagcttttgattaaatattaaataaatctgcacttaactctgtgccaggaactattctaagtattttacacttattatctcatttagtatgcacaatagttttatacagagttgctcatatataccctattttagagataaggaaaccgagaaagatgaaaaccacaagtagtttgtgaagccagggtttgaacttcacacattcaacgccaccctttttaaatcactgtggaattcctttagcattcaagttaggtgaatatccttctgtgaaagtttgggatttgaagacaaagggcaatgatgaaatcaatttatctctgctgagaagccaaagcaatgggaatggacataagcttgcaaaagtgtatggagactggggcaaaaagacagggagggaaaggaaggcatacagttcagtgcatcctttagaaaatcacttctctgttcttttttcagcttcttcaaattgcaaactgtggtggtttaaaatacgttcataaattctttgacactctttaagatggagcccaactcccttccctttgagagtgagctggatctagtatctcacttctaatgaataaagtgagagtgacaggtgcagctttggggatttggtcctacaaggcactgtagcttctctctgttctctcttttggacaacttgctctggggaaagccagctgccatcatggggacaaacagcctaagacaagggccatgtggtgaggaactgtggccttctgacaacagccagtgaggaactgaggactttttttgccaacagtcatgtgaatgagctaccttggaagtagatcttccagccccagttaagcctccagataactgtgaccctgctaaactgcaaactcaggaggaaccctgagccagaactacccagcaaagccactcacgggtgattcctgactctcagaaactgtgagatgatacatttctatcatgttaaattgttagaatttggagttgctatgcagtcatagataactaatacacaaaccaacaaacacacctccaaaaccaacaaatcgaaacaaattaagataaattaagaatacgctacctacaattgccaaaggacaaagaaaccttgagaacataactatcctcctttaagtaaagttgcctgcagactcttttaatccaaagacattacagcattttgattcacttctaaaataatttgtcatgatttgcagcttaagtatgtatgttatttacttataatttacttgtataaaaaagggaagataaagatattcaagatttcacattacataaacccttcaacattcttaaagcaaggtcaacaaccaaatgcaaaagatgggccagcaaaagtctctacctcctaagaaaagttaaaatcttaaaatccagctttagaggatggaaccacagtaggcaattagcaggcagaagcacataatttagccagtagttaaaaacaattcattaaaagctcattttaaaagacaacatttgctagcattctgatcccagaggttggcaacctgctgaggccacacacaatcattgcagataattcagcacatgataatgactaaggctggagagtgtgtcctgatttccatcgtctccagggagagtaaacacttgagttttcattctaatgcaatcacgattatgaatccagaggtatttctttccacttaggcaccatggtatctcattatttttcaacttccacttcctctactccattgctcaacccaggattttatgagccccactgcatgacatacaggaagctttactaaggggaaccaatgctaatttatttctagatgacttacagtgctcagccccaaatcaagactggctaatacaactctgctatctgtgctccttcttgcacaaaactcctcatgaagttgcaattttaaaagaaatgtttctcatcaaaattcaatagacttttatatgcacatacactttctcacttttccaggctgcatgaaatttaatatcaggattattatccatttgtcattttaacctataatttagtaagcctttttgtgtttgagttatgcttcttccccccttgagccatcagcttgcagccatagattcatttgaaaagccggccaggtcacatggtttgacctcttagaacaaacattttccacatttcttattctgcttccataagagacaccattagttttgttcatctctacttaaaatgatttttatgacataataacatttcaagttttccacattaaccttcattttatttcttgaaatactcaggcaaacaatgtcactaagacgtcactgatggagaattctttctccttcactcctgtctacttaaaggcaactctgaagaaagaataaatttttgctctgcatcagctgagtgctgggagaaaagtttaaaagtctggcctagtggctcacagcatcttaaagtaaatacttccataagcaaccaaagcagaaaatcttcatataactgttttcaccaaaataaatacataaattttcaaatctggagtcctataaaggaatttaaaatctattttcttatatgtaagttcaaagatgtctaagtccaaagggaaaatgaaaataaaataaaaatataatcccagcccatgtgcaaaagcaaacaaggacaggaacacaccgctccaggggtgtgggcagtactcaccccacagcccaggccattgcccccttcgcaggtgactttcctctggtcaggctccggcagcagccccgctccacagccagggcgggggcataacacgccccccatctgcaggacacactcctctgcaccatactgctggtaccggttgtactgcaaaacccaaaaagcagattgagctttcaaactgactgcaaatttcagccaaagggttaggagctacagtgcatgggatttcttgcttaaccagtttcagtaaaataatgcatgtgtgtgtgtgtgtgtgtgtgtagggggagggagagggccacggggttgataggggaggacgaatatggttcaatgcagtaaaagtctaccaaattcaactggcaagacatataagtgtgtttactttttgcttttttgtcttcagaaaatagattttccaaagttttgtattttataagatcgcttctaccaactgtattttaacaatcttatttcatatacattttgaggaacatatttatgtattaaatgatgaacacttttaatacatcgctatcaatcttataaagcaatatattgtcatgcctctatttaaaattcaacaaggttttatatttattttgaaaatcggcccagcattccacctcataatattggcagcccacacaatatcaatgagctagaagaagactaatgttaaacaatcacattttccctttatcattattcttattcttaaagcatgatttcttgtgtccctgatgtcatttcttcctggtaccgttttgctcaatttcctttaatggtttccccagcctgcaaataaattccaaactccatcagaccattttcaaggtcttctttgtggcagccctacacttttgatcttacattatttgtaatataaactcagatcaagtcaaataggtttgctcaattattaattaaataatgcaacatttattgagagcctactacattccagactctatcgaggcgctggggatacagcagtgaatgaacaaacttctccgccttcatccacagcactgtaacagtcaataccgagaggttagaatgtctaggatttccaatggtgctaagtgaggaagaaaataatcaacagggaagagggagagtccaaagaaggtggagatttcaattttaaagaggtgattacagaatgccttacaaagcaggtgtctttaagcaaatgtctgaaggagattagaaatgcaagtcacatggatccctgggggaataagcattccagacaagcagagaatactataaggggccagagccccagtgtgctgatgtggttggctgttcagggtacaacaaggggggcagtggggcggaggcagagagaacaaggagggaaaaaaacagaaggtgaagttggagagtttgtgaggatctagaatatgtagttccctgacagctgctttcagaaccctgggtgttattctggaagataccagaaccactgcagaactctgaggctgaggcatgacataatttgactaatattttaaagacatccacctggctgctatgttcggaataccctctggagggccagggtgtaggcaggaagcagagaagcttatgtcaacatctatgacgtaagctaggagcttatgtcaacatctatgcaaaagatggcactggcttgaaccgggaaggtagtgctggaggtaggatgagtgtttgaattctgggtataaattaaagggagaagttgcagaattttcagtcaggttggatgcctggtgtgagaggaaaagaggagtcaactgtgagtggagtgtagttccccgtttcctgagaagacaggaggcgggtaggggtggggacaactgtggtagaagaaagggtatgtgtgtgtgtgcacgtgtgtgtgtgtgtgtgtgtgtgtagggagttgaggcatgaaataattatttctattgtgctcgtgttcagtttgataagctattacacagcgatgtcaaaatgtccagtatctaattgaataaataagtgtagtttaggagaaaggcatgggtcctgggtacaaattttgaagtcattagcctgagcctctaatccattttctcattcttctgtccccaggaaagaaagaaaaagatgacctggcctccttgtaaacgtgtgaatggcatacacatacagcacctttaccagaaaagaggtctaagagttcggatggcaaacaaactagaatctctgaatttatggggtaaggttctctggacagtgtcataagctgtgcaattaccagaggatacaatgaagatatttcatcaggtaatgaatgatgagacagtttatgtaactgagagattgcctgtgagtgattactgcatagatttcttagaggcttcatacataacccttgcccacagcacagccccaaatgccaaggaaggacctggggaggcgcgctggcgacctgaacgtctccaggtcctgcctgagtctcaggattacctgcatccttgaaattattcgtaaagctcgacactaggttagatctatgacactctgaccatgttatgaggtcagatgtgattatccaacctctgcagggaaggtgagaaaacaccagcaaaggagactaaggagcagcagcctatgaggcaggtgaaaactgaggaggactcaggtgtcccgaaagccaagggaacacatctcaaggaggctgccatgatgagctgtggttggagctgggtgtgtggctgccattgcggtcttgaaaagtcatttcagtggagtcatggagccaaaagcctttggagtggagtccagaaagactcggaggagagaaattcaaagaagtgagaatagacacttttttaaaggagtttgccagtaaaagggagcagagatcggggaggccattggataggactctggggttgtaaaggattttcgaaaatggagaaataacgatatgatactatgctgaaggcaggactgagacgagaagcgcagatggacagtttaagccagagaaagagctctgtccttgagtaggttggaggggaggatctaaaggatgtgtggagggttggccttcagagagcaggcagccatccttaggaagaggaggcccggctgagtgcttaggcccaggtgcagacaggcagaggggtactgggatttgaggaagaagaaacgtatgagtgatgaaggaaggggagggcggaggaagtcggtatcactgctgggcggcacccaggccctcctgaggtcagagatgatgaatttaaaggaaaactcgtgagcagagtcttctgtttctctgcaccaacactgagctgcaaaggcaaagtagaaagaatggtggatttaagtttggttgcagttttgccggaattgtaaaaggaagcgggacatctctcgatcacctctgcctatgactgtgaatgatctcacggtgatcctccaagcccctctccctcagctctgttcacctccgcctatgactgtgaatgatctcacggtgatcctccaagcccctctccctcagctctgttcacctccacctatgactgtgaatgatctcacggtgatcctccaagcctctctccctcagctctgttcacctccgcctatgactgtgaatgatctcacggtgatcctccaagcccctctccctcagctctgcatcaccgaactgctcaacctacttttttgtcttgacctgtccaaatccttccacattgaaaaaaaacaaaaacaaaaaacaaaaaacaaaaaactttttattgtaaatatcacatagaataagcttaatacattataaagtgaccaactttttaaacactacccaggccaagacacagaactttaccaggtccgcctgaagccctccatgtatctattctcatcacaacaccttcaccccttcctaaaagacaccatggttttgttgttgtttttgttttttgttttttttttttagacggagtctcgttgttacgcggctggagtacagtggcgcaatctcggctcactgcaaccttcatctcttgggttcaagcgattctcctgcctcagcctcccgagtagctgggactacaggtgtgtaccaccacacccagctagcttttgtatttttagtagagacggggtttcaccatgttggccaggatgatctcgatctcctgacctcgtgatctgcctgcctcagcctcccaaagttgtaatcactctcttgtttttctttatcactcaaggttcatttctaaacactacagttcattttgtctgttttgaagatgtgttgtttagtccatcaccctccattgtctttttttccttgcaatttatctgttgaagaaagcaggacatgtgacctacagagtttcccagtcttcattttgctgattgtatccaatgttgcagtttataatgcacctggataatttttttcctataaattgataattggtctataggcttcatttaattcagcttctttccttccttctttcctctctccctaccccctctcttttcctccttttttccttcctccttcattctcatcccttcctccttttttggtccctccctctatctctctgtcctcctttctcctcttccttctttctgtctctctgtaatactacttcatagatggtgttttgtacttctatcaggaagatcataatgtctttctctcttcttgaaagcttagcagtcattaatattcagtaactagattaatttattgggattgaaaaatgatattttaattcaaacattccttcatttattagttagaatacttctattttttggttatccagtggtattgtatgaataggaaaggcaggataaaatatttgaatcttttttttcaatgaacatttataaactcataaacttaaacatattatgtgttaagtgtgttttaactcaatgcagtgatttccttcttgatgcacaactatctcatctctggccaatggcaatcctatcaagatgagtttccataacatgatcctgacaccattcaatagcttcctcgctatctgctatggaaaattactcaggttcatcttacacgtttcctgctccaggccaggaattgcctacttttaaaagaagcactgcttcttaaaaatttcaagaccataaattgggtgctaggcatgttcagtgctcctaagttagtcattgtttctaagtcctctcagttctcactttgaaggacaggtatctcagaactacaaggtttttacttaacattttctgttttacctctgttgctcctttcttccacactggttctcaagaacacagaagatgacataattacaatattccataattgctcatttgctttttctcacattacacaatttcagaataacaataccatcactgtgcctatgatttctgaaaacttcaaatatgttttcatatgctctactcattctcccacaaaatttttaaaataattatactgtatccacactgttaacacatgcggccatttcgaactatgctgtctttctcttaaccttcatgttatcttacttctatacacacacacacacacacacacacacacgcatgcaggcacaaccatcagtacttatgttgatggttgatgttttcccagtaattttgattgcttgaatcttgttctctagtaaattcctcaggaagagttcctgggaaatacagtcactgagttcttccatagtaacagtttatttagggcttttattcttgataatgagtttggctgcataaaaaatctttatattatacataaaaagaatatatggaattatagtttcttacagtatacatataaggaatatacaatcctgatatacatacagggattgtgtgtgtgtgtgtgtgtgtgtatatatatatatatatatacatacacacttatatttatacatacttcccccttgagtatctgaaatctcttacttcatgttcttctggtataaaatattatggataagcctgaaaataatgtttttttcctttgtaaattaattgccctcttttgcctagatgcccaaggaattttttccatttctttagaatccaggaattttgttagagtatatcttggtgctggtcatttctggatcaattttcacaagcatactgtgtcaggaaagttgtactgaatttagtttttagggttcactttgttcagttgctttgatgtttttcttatgtcatttctagtatacatatattggatcttctttacctcacttctaattccaacagcttatctcaaatccctttttaattttcttatttgtgttttttagaatttccttcacttttcattttctatttcttttaagacaatatctattatatgtatttgtgtaatttcctaataatttcctaataacttggttcaccttgaaaaggttattttggctttcctttgatttgaggcattcttccattgtccataaggatgctattttgttctacattcgctgcatcattttaatagccctgtacgggactgaaccttgcttcttttctgttagagttttaccttgttcctttgctgttgctcagttttacatgaaattagttctcctgaaattttacaaagaggtaggattcagaaaaactgtagacttttctgttctggtgttttaggcagtgttcaaaaatatgggggcttcctttctgcaatctcacaactctgttaccccatttttaaccggactatctccttcctttttttctcttctattttgagcaaatttctgctcagtgtggggctttgtcctgaggagggcctttgcctgggtaaatctggtgagtgcatgagacctaaagtgctccaagccctttaaaccttattacagacttttgcactcattcctctatccttttgtgcatccacatggcctgagtttggcatagtatcttgtcaatagtttgtggacagtaaataattataaattaataaaatctaactccattaagtgacaattaattaaataattctaataagataatcaatagcaatggaaattaataacagtaactcaggattattttacctacaaaaataattttttaaaataagttgctcttaagtaattgactattttctcatttgacaacacatcacctagtctatttaatttagttaggtaattttattactatgacaatagcttttatctcggaagaagttaatgtatggacaacgtccaataacaatttagaaattcttgttgactgcattcatagtggtctcaaatattgatggaattttaaaaattatgtccccctttccattcattagctagggaatttattaaaaattattgttatttattttgtttatgataaactcaagagcatttgagcatacaattcctttttcaaaggaagacaaatattttaacatatgcgcctgggaatttctgatgattaaaaagtacacacaatacctgaaatatgcctattgaaagtattacttttcaaaattaacattgtgatatttataagaaaaacactgacctggaacaaagaatgtgctagtatttgtagaaagcttaatatactaaggaaataatttagtcatgtaattacatatcattagcaaagatccttactaagttaccttcgagatataatccacagttttcatagatccttttaaccatttactggcacgaagttgaaagcgcattaatggagatttgtgacaaactagcactaatacagaatactgtatttatctcagtataaaatatgtgtgataatggtaaagtaactaataaatctaccccagttggtggaagggaacaaacacttcccttgatattcttgtattggttccaagggcttttttacttatcaatattgaatagcattttataaacagactaacttggaggaatgtgattaatttataatgtgaactgggtttatatagagtccaccctcaactgagctcaaaagtggaaaaatcactcatgcatgttttgtctatggaatgcacagtgagcatctgtgtgtgtgtagatatgctaatatttacatgtcaaactatactgacagttttaagctattaaaaatagtttgcaaatttctagatatgctttcataaagtgaataatccacagacaactaaaataattttgaatttattgtacaatatttgcaaaaatatttgaaaataaatgtaaatattcacaaagaatactactctgaacctaaggaaaacaataactgtttttctcctgtattttatcagattatagcaaaaaatacatttcattagtatgcgttatgcaggtagaatcctgactcactgctatactttctattttatttctttggggagtaaattattcagtctttatgtgaatgctcatggattctcttaagaacaaaaagtattcattttaaagcataaaattcatagaagtttcaataaactcgtattttaagaatttaaataatgggtcatgggagagtataatgaaatagatattgtattctgttagtctgcaggttaggagacctgtatttgggtagaaaagtgttctataatgaaggaacggttgcacgttcaagccccagaagggccagtgaacttcccctttcttgctggctgttgactgcatgttaagtacattaaaggaacatgggtagtcacctgagaagtgtggctatggggaaaccaagcgtaaacatcccccaccactgaaacaccatccaaaaggcctctcctctgtaggagagaacaggctgcttcactctgatgcttaatttgcatgctttcatagaaaaagaagaaaagaatctaattttaaaaactacaagaaatgtgaagtacagggatccgaggtaaaactcaagtctgagaaaaatggcacatgttctgtcaaaatgagtcaatgcttgccagccatccaggagctatgtggccccctttcaggtcctccaagctaaggaggttgattttgtgctgtcatagtgtttcccagagtatccttttgggggcactcaggtacagctcttgggtctcctttgcttccccacaccactccataaattatagcttttgttacatctcagccaaaagcacttcggggactccctccctgggcttctccctcaatccctcctagagcagaggggtcgtgatcaggcttctgttcactgagctactgcagtgaaccaaaccacggcaccgacactttgctgctcggttaattctctgtccactctgtgaagtgatggatgtggcctcggagccacaaagaagtgccatcttttgctgacatccacacaggcagagaacccacagtgctgcattagaactaaggctgaaactttcaagaccacgctttccacaatacccagctgcctctttctcttattcccttctattaaaaaaaattcagtcaggtatagtgactcatgtctgtaatccaagcactttgggaggctgacgtgggaggatcgtttgagaccaggagtttgaggccagcctaggcaacacagcaagaccccatttcgacaaaaaattaaaaaaaaattacctgggcatggtggcatgtacctgtagtcccagctactcaggaggctgaggtgagaggatcatttgagcctagaagttcaaggcttcagtgagctgtgatcacaccactgcactctagcttgggcaacagaatgagactttctcaaaaaaaaaaaaaagaaaattcagctcactattcctctgccatcttttagaaactaatgaaaaatagtttattatagaacttcctctttggattaaaaaaactataataacgtcagagaggaacatcagcttatgatttagccatttctccttgctatgcagataatgtcccattttctatacgcattagaaatttttttcaaaaaagaagcactccttagattgtcagtaatcttcatcttcctttttttttcatttgcaggtagttagcctgagagcatctgtgacagcctaagtggtggcccccatgaccctgctgtttttcttctctattctgttgctaataatgttttcttcatccctgaacatctgtcagctactgatgaagtgaattggctagagaaagggctggaccttgttaattgcatagaaaaaactatcaagatggctgaaatcaaatgcaaagaggcaacatcaaacaagacctaaaaaaaaaaaaaaaaaccagtaaacaaaaaaaacaagcaacagatcatatccggaagcacagtttaagaagtttttggtttttttttttccagatatttcaggtgacccaatgccaaaaagcatctcatcttctagtagttgtggaatcttctggaaaagagatccaaatcaactggcttccttgtcccctctccatgtgtgacacggagcagcacccacttccagtgtagctcccctttcaggggagggctacaaaggctgttttcctcacaagagttcctacagctgatgtgacttcagagactcctgtagactatggaaacagggtggtgaagcgtctcctgatggagcgcactgcagaaagcagggttgtctgtggctgtaaattatttcactctttgctctcatcccagagaaacagtgttagggtagcacctaaatctgcaaatccaagagccttgcccctcagataaatgagcgttgcctctgccttccttgaaaggagctggggcacaggtcactgccaccatcctccttcctggctccctagtctttttctttccctgaattcagtattttcacctctcttctttctgcttattctctagaagctctttgtccagtcctgaagcaactgcgatggtttctaggtgattctgagggaagggtgacatgtcattgtctggaagttttgtgtaaggctacgggtggggcagtgaaatgggttagctccactgagcatttaatgatctaattagaacttggatgaaccaaaatattttttaaaatcatgtggattgtattagatggcttcatatttataactatctgaaatggacaagcctctaacactgaggaagccttttggggtgaaagccgagaagctgccttaatgccaaggcacacctgagcacaggtaacaacagccaggtgctctggatgtccacctacgtccctccaaagatcatcacaatgcatccctcatgccccacatcattgcttcagaggctcaagctgcctgtcattcttatcacccaaactgtcagtcccatatgggtccatacgtttcctaatatcagccaatttccatgcttccctctctcctaagccttttttctgtgtcccctgaaattcctgttcatgataaactaactgccctgtataatcagccttttgaaaggtttccctgtccacactgacttaactgaaactgatccatctcccttgcaaccttttcaagtgaaggctgcttttcatttcatattcacatctttcaaggccagaggtgaagatggttgtcccttggctccttaacgacgcccccaaatgcttgggttcctctcccttgcaaaacccaccactcctttgagacccatgcttcaccctcacctcctcactgctgccccctgatctcctggatgcagcccctcattcttgaagactgtagcttcaggctgttctcaccttttctccgattcttgtcatcattctggggacttgaactcctgtatgaataagccaccatcaatctattctttctgttttaccttctcatcctgctgacctttttctcatccttctattcgcacggtccatccccaggctctgtcatcctgagaaactgtaccacctctgaaatcccaattccaaatatgtctctttctgatgatcacctcttatctttccaaatctcttgctaaagtatgaacattgcttaaattcttcaacttcatcaagacgtctaattaattggccccatatttcctctccagccatgggcctctccaggcccaccttccttcctggtctgacagcttctgtcatctaccaccagaagcattgcctggaaaacacagatttccgtggtcttctttatctgatggcaaaattccacgcctggaaaacatcacctccaccttccctgggcgtgtagccctgcagctggacacaatggcacgatgactttctcttaaataatggaccacaaacttcaaatgggcatttacaacttcctcaagattgtattgtgtttctccagtgacatgttctctcttctttcttcccctcaacccgccgaaaaaaggggtgaaataaaaaagatgaaatgaggatagttacaaaagcataggagatagaagttttcacatagcaagggtaagaaatatttttataaatgttggtaatagttatgataattagtagaattaggataacagtgaagtagttatagaagaaaatgaatttattacttttatctggagttgcaccaattttttggttcctaagaccaatgtaggtaggacctgcctctctccagccatccatactttatatttcactgaggagagaggaatcatggctgatgtcctgatgtgctcaacagatgtttcctaagcacactctaagtgtcaagtactcttctatgtggaagacgcagcagtgaaaaatgacatcttccttcgtggagccatcatactgcatctctcctcttcacatccctgcaactatgaacacacctgcacctgcactcaccctctccagcccctctcacaacacaaaaagtggccttcctcctgttaggggccgattcctccctctctgctggatctgagcccttcttgccttccaaagtacttcccttcttcagttcttggatctctctctcaaattaccggtaattcatctctgtggaatccttcctgtgagtgtaaaacaagttctggcccttcgatctttaaagaactgtcttgtggttgctgcatttctctttctcttcatagcaaaccctctagaaggaattatcctccccttctgttcactcttcatcccataaaactctggctcctgtctttacgcatcccccaaaactgctcattatggtcattcgtgacttttgccacagtgtcacaggcgaaggacgctccctgacctcatcttctgcaaactctcagtagcattcaacacaaatcaccattcctcctctggaaggcccgccttctcagcttccccaacaccataaatcagcattcctcctctggaagccccaccttctcagcttcccaaacaccataaatcagcattcctcctctggaagccccgccttcttggcttccccaacaccataaatcagcatttctcctctggaaggcctgccttctcggcttcctcaacaccataaatcgccattctcctctggaggacccgccttcttggcttcctcaacaccacaaattgccattcctcctccggaaggcccgcctacttgccttctcagcttcctcaacaccatatggccctggattgtcttctactttccttgaggttccttcttggtctcctttgttggttgctgctctttacccaatttccaaacactggtgttccttacggttcatccaatcacggtctctcctttcttggcttcttctgagaatccccatgggtttaaaatttcctctacatgctggtaattccaaagttatctctccatctcggacctcaggtctcactgtcctccaagctctcactcacacatccaagtcccgacttatctccttctccatgcttcaggcatagcaaatgtgttcagaattgaagctcagatcccatgcctctgatctcacctgccccattttgctcatctcagtcaaatagaactttcaaactccttcctttccctgacccacagccagtcagtcaccaagtccttgaattctgcctctcaagattcacttctttttgtctccgctgccaactgtcttaatccagagcctctccatattgcaacaagattgacatactcaaaatgtaatttggataatgctaaccccttgcttaaaccttcaaggatttcccactaaactcagaacaaaacccatatgcttaaccctggtgtccttggtccaggtggccttcatcttttggcactgtccttcctgctcagtattttccagccaccttggtttaatttagtgtcttgaataaagcaagctcttcacctccttgggggcactggatgtgtgctttcctctgcttgggatgctcttctgcccactcccataatgctagctccttcaatagctggtgtcccctcaacgcttagtctcagggctcctcaactacccctcatctaaagtaggtgacatccctatttgttttcatcctagcatcaattatgatcagtaactgtgacttcctcatttactattttatccaacactagcacaataatagtacaagaaagtattcaatacatttttgttgaatggataaaggttatttccataaaatttcagtgattaaacctaaggtggaggaagctggtataaatggaggtacttctgaaatgcaattggttcaaaggccctacaaacctattgactccagacatcatacctgatttctgaagggctcacctggaactgcagagtgactttagtttcctacaatgtgataatgtctttgccaaagaatttggactagggggaaggagtgttgaaaggtgctatatgaatatgaattgtgaacacaaatcagagaaggggctaagaagctaatataaatgtattattttaaggagtttatttttattttgggaaggcagtgatacatagtgtttaatttttaatccaaatctaaaaaatcaagatacctactaaagatcaacgaaaacagaaaggaaccacatacaaagaaattagaggtctgctgtgggtctctgccatacagtaatgaattagtaattaaccagcatttttgtaggttttatcaactcactttctaagtgagtattacgcttactttactgtctattttgttgccactatgtaaagctggaatataaacagcatttaaaatcagaggaattttagtatagcacaatatttgcaacttacttggcaacctatttatttacaaatattctaagagatgattgagcttcactctcccttgtctacaaaaagctaagttagagaaacaaaaatgatttgtccaaggatgcttgtaacagacattaatataaacattttattttatcaagtgataacagttgcctcaagcatccagtgagatcccaagagtttcaccagctcctggagcagttgcccccaccgctggcaggaatgctgggacaagagctctctgcttcctctcgggagcctcattgccaccatctgcctagaggccagtaggtcttgtcatgaataatcaggatataaacgtccctgactgatatgccctgttcacgacagtcaccaaagaatgcctgactcctgttccatctctccaggctgagccccaagctccacatccactctgtgtatcctttttcctaccacatattccagctgccccaaaccctgagacccttcccccatgcttggggaactcatgggcaatcagcagtaactgccctatgactgcaatctgctttctcaatgtttttcttacattcttccctaactgaaacaggcgtgtccctgaggacactacttcgcctgcagcaccctcaaatgtttttgtgtctgcaatcccagtaccacaaagcattgctctacagtgttgtaagtaaaacattttccctttctccttctaaagccctccaactttccatttcaacccatcagcctacaccatgcactatttccccttctgctgtcagctactgacatccatttctctctctctctctcatttctcaaatcttcagtttgcaattctggaagatctcagcgtgcacaggggtggtactcccaactctccgacttcccaattccatgacctcaacttctctcgtcaccttgtcctccatctgaaatcagacacacagcctccctaggcctcctctgacctcgtcggtgctgaccatgcagctcctccacaagctcgatgtgaagtctttcattctttggccaatgcctgtttgtccagttcaacccttctagtactcaaatcccgaaaattctttgagccactggcatctgtaaccaactttccctgtcctctctctcatctgggttctctgcttgcccagctgaaatttcatggtcggtcataatcactcccttagattcaccctcagcttacactgttgttgtaacactgtaagatgagatccaccctcagcttcttagcctccctcttgtttttgttacattttgaccgcaaaacttcaatgccagtgccttttctgcatctgtgcctacacagatgagtgtgtcagaaaaacacccagtggattgacctcactccaaattcaaccatttcccaagtttattccctcctcaccctcctaaatgacaatttcattatcctctcctgacatggtttggctgtgtccccacccaaattctcatcttgaattgtaatccccataatgcccacacgtcaagggcgggaccaagggtggaagtgattggatcatggggatgattccccccatggtgttctcgtgatggtgaatgagtcctcacgagatctgatggttgtataattggctggcatttcccctgcttgcacttttctctcctgctgccttttgaagaaggtaccttgcttccccttcgccttccgtcatgattgtaagtttcctgaggcctccccagtcatgtggaactgtgagtcaattaaacctctttcctttataagttacccagtctcaggcatttacttatagcaatgtgagaccagactaatacatctcctttccctctaaaactcttccccgatctgtactctcagctgatgacctagcttcctgttacaccaagaaaagagaaacaaccagcagagaccctacgcaaggtttaccatcaaatccaatgctcatacgtctgtgcctgcatattctgtctcccccactgttaccaggcggaactggccactctcttgtccaagcccatgcctacatccaaggacactgctcctgaattctcccttcccccttctgcatcatcagtctcccaactcctctactgaatcattaccatcagtacatagacatgctgcaatttttcccattaagaaggtcattttcttatctccatccctcagctacctcatttctttgctttcctcttcagctaagttcccagttgccaaaattaaaatgtatgtatttgcagtctcccactctttggttcacctctcacatgaatccattcgaggcaggctttcccctcactgcccatggtcaaggttaccaaggacctccacattgtggagtccagtgctcatttctcatccttgtccttcttgctgagcataggacacagatcatgattcctcctcctaaagatgccttcttcctttggctcccaggtcatgatacctgcctggattttttcccaccttattatcattattatttttctgagacagagtctcactctgtcacccaggctggagtgcattggcacgatattggctcactgcaacctccgcctcccaggctcaagcaattctcctgcctcagcctcctgagtagctgagattacaggcgcccgccaccacacccagctaacttctgtatttttagtagagacagggtttcgccatgttggtcaggctggtctcagactcctgacctcaggtgatccattcgccttagcctcccaaagatgtgggattacaggtgtgagctgccacgcctggcctcctcccactttattattgcaaccctatctcatgcaatgtggctccttcctctttgttttgctctgtcctcctcccctcccctccaccagtcacacttgtttctggactattatgaatgttaaagccaggcacatgatcacattggagcctctgttgttgcttcatccactctgtggaaatctcctttcccagatgtcaccatgaggcttctctggatacctttcagtctttattcacctgtcacctgctcagtgaaactttccctgaccaccttatataaaatttcacctcttcctccagtattcactgtccttgttttttttttttttttgtgtgtgtgtgtgtgtgtgtgagagagggtcactctgtaacaaagactagactgcagtggcacaatcttggctcactgcaacctccacctcctgggttcaaatgcttcccatgcctcagcctccagagcagctgggattacaggcgtgcaccaccatgcctggctaatattttgtatttttagtagagatgtggtttcactatttcactatgttggccaggctggtctcgaacttctggcctcaaatgatctgcctgccttggcctcccaaagtgttatcattacaggtgtgagccaccacacctgagtgctgtcctttttcatttcctttttctccatagcaatgatagccatctaacataatatacactaaatgtgtttatgtgtatataatatggttttctctaagtagaatatggagatttttcactcctctatccctgtaacctaggatggtatatagcacatagtaggtactcagtaagtatcagctgaaagaaagaaggaagtgtgtgtatgtctgcatgtgtgtgtgtgtgtttgcgcgtgtgtttgcgttttaggaaatagagatcaatattgctctgatgcactatattaccaaaactaatcgtagtgatattaattttgattatggctcaattaaatttctaggagaatgcaaagtgacctgacctttacaaagcagatctgaggagatgattactgttggcttctttccttactaattacccatggactctaaaacaaaaatggaaacactgcaaatattggtacaagtttgaagagaagactccattatctgagcagaattgtcagggtaacaaccagtgattcttgctttaagaagtctttaggctttcactgggaaatggctgtgagatccaggtgtcttcacaaggagttatgtttgggagagtcagttgtcaacttttacctgcaatacgggataactgatttcacttgtatttgaatatacatttatgcctgctattctggaaactcacaatatagaaaaatgaaggggatgtactgtaattctctaactccaggatgtggcagtgattccagtttcttatcctctccttactaatccttttgtttttattctcatattggaaatgggcagttttactttgccacatacatacaccaaacaaaaacacacaaaccaaaaactcattgatgaaagtgagctgccacatctccatttgcatatttcctggtcaaagttggcagagacaatctttaggagtaaaaataaataacactgggctgggcgtgatggctcacgcctgtaatcccagcactttgggaggcagaggcaggcggatcatgacgtcaggaaatcgaaaccatcctggctaacacggtgaaactccgtctctaccaaaaatataaaaaattagctgggtgtggtggcgggcgcctgtagtcccagctgctcaggaggctgagacaggagaatggcgtgaacctgggaggcggagcttgcagtgagctgagatcatgccactgcactccagcctgggcgacagagcaagactccttctcaaaaaataaataaaataaaataaataacactggaagttaggtcaatcagccttttgccaactctttagtgtattttaaggataacttgacacctagatttaacatactaatacagagtttgtagttccatatagggatcaagaaacgtatttttaagcattccatactatatatgtgtgtacatatatataatatttagcaccctgaattatttacttagcatatctatttaaattatgacacgcctcactgagcacaacacagcatttaaataatccacttcaaatggtcaccctttgtatagacgtcacatgttcatacccgtgtacaaaaggctgccatgaaatacagataacaaacacccaatacaaaaacctggtaaaaaaaaaaaaaaaatgctcacacattcacccacagacagcaacttaggaatgtctatgaccatcgatccctcaggcataattcatctctgcatttatttgtttgctcatctgccactatgcagtgcttgcttcctgcttgagtcttgagatgaaatgcactgcactggcagatagcagatgtagcaattaataacctgtcaggtctgatggatagaagaggaaaaaagtgtcctcacacatatctccagcatggttttcttccccatttcagggcacccagggtcaggagacatactcggcctccctggggagcccaaactgtctcattagcgtctatctttcatgacagtctgatgcagcctttgagatgctcactcacctgctcttctcccagaatcctgaagtgatggagctctttaatcaaggagttgggacagccagctgttggaaagaagaattaatcacaaaaacgtcactttcactctgtgtggttatatgttcttacacagagttatgactatcaactgccagtgttgccttttgggaggacacagacgtgtacctgaaaaacacacatctaaccaaccacaaaaaaagccaaaccctcaaaagagctatggccgctgcctggcctccaaccgcacctctttagaaaacagttgcatgtgaccctggccaggctttctctcccctctgattatgatctggccttaggatgtcatgccactctggttcttagaaacatgttcagcatgtcactggttcctcatatatagccaggattccgcagggccagagtaggggagttggtgaccacaggctctgacttattcatcatgtcctgtttgctcaccatcaaggccaggggcctgctcattgagaggtaagagcaaaggtcgggtagctacacatccattctttggggggctcagctggcggttagtaccttgcctggttttgtcaagaggctttgtgaagacctattagatcttgcgtttgagtttggaaagggcatcttacggaaggaccaagagagaaggcccagcagttctggtgcctatcactttctcgttccacccaatcaatccaagctccttcagactttcaccttttccttcttcagttgtaaaacaaagtaagtaaataggtaaaaaaaaaaaaaaaaaaaaaaatatatatatatatatatatatgcacacatacacacacaattaaaatacgtatgtataaaatattatataattatatttaatgtatagatatgagttatatatatttttatataactcacatatataaattatatatgtaaatatataattttatagaattatataattaatataaatattggcctaaatatatatatttatatataataatataacatatataataaatattctatgtaaaataaaatacagttgaccctggaacaacatgggcttgaactttgtgggtccacttatacacagattttttcttctgcctctgctacccctgagacagcaggaccaacccttccccctcctcctcctcctcagccactagctgtgaagagaatgaagatgaaaacctttatgatgatctgctttcacttaatggatagttaatacattttctcttcctgatgattttcttaataacattttcctttctctatcttactttaagaatatagtatataatacatatgacctataaaatatgtgttcatagactattgatgttataggaagggcctctagtcaacagtaggttattagtagttaagttttgggtgagtcaaaagttccacatagttttttgacttcagggatgttggtgttcctaagcctcacattgttcgaggcccaaatgtatagatatgtaaaatttaggccagtatatgcttaatatcatttaaaatgtgttgcatccctgtcttttcaatagaactattcctcgatattaggttgtagtcatttatactattatttttttgagtcagggtctaactccaggctggggtgcagtgtgtaatcatggctcattgcagccttgacctcctggctgaaggtaccctcttgcttcagcttcctgagtagctgggactacaggtgtgtgcaccaccaagcctggctaagttttttattttttcctaattttttgtagagatggggtctcactatgctgtccaggctggtctcaagctcctgggctcaagtgacgctcccgcttcagcctcacaaagtgctgggattataggcgtgagccactgtaactggcttatttatattattctctctggaaacaaaattgatataaaaacctgtttctttgagataagacctatggattatataatctgttgaacttcctagtaaggaaactggattgtatgcaggacatatcaactaaattatggagccatttctcatattcctcagcattgtgatgtgagagtggtcagaagccctgagagtgtttgtctgggggagggcaggctgaggaatgagaaaacctgtattcacacaggtgaaggtgctcattgcgatacagattagatctgtgcattgtttcagagagtaggatttaaaccaacagaagaaaatggaataaactgccttataagacagtaactgcaggtttttcaacacatgctaaatgaatacttatgtaggatattttagagaggaattttactgggtatgatgatgaatttatgtgtctacttgattgggctaaggggtgcccagatagctgataacatgttatttctgggtgggtgtgtgagagtgtttctgggagagactggcatctgagtctgtggaccaagaagatccactctcagcaatgtgggcaggcatcgtcccatccactgagggcactgagggcctgcacagaacaagaaggcagagaacggtgaatgctctttctcttctagagccttaaagatcagatttcctggttctcaggccttctgactgcaagacatacacgactcccaaacctgctgcccctagttgtcaggccttcagacacagactgaattagaccaaaggctttcctggttttccagcttgcagatggcagattgcaggactgcttggccgccataattgtgtgagcccttcccccagtaaacgtcctcttgtctctttctctttatagatcctatagacagaaaggtcctgtttcttgggagaagcctgactaatacactgagttatttccaattccaaaattctatggtcatgtaaaatgctggaacatagctttagcctatattatataacatttcatatgttgagaaagtgcttcacaaatgtttactgagtagtacaaaagattacaaaaatgtgaacaaaatttaaacacacgtgtaaacaggtgatgccaccaagaaaataaataaaaatcctggccgggcatggtggctcacacctgtaatcccaggactttgggaggctgaggcaggaggatcacaaggtcaggagtttgagaccagcctggccaacatgatgaaacgctgtttctactaaaaatacaaaaattagtcagacatggtggcgggcatctgtaatcccagctacttgtgaggctgaggcaggagaatcgcttgaacctgggaggcagaggttgtggtgggctgaaattgtgccaatgcactccagcctgggcaacaacagcaagactctgtctcaataaataaataaataaataaataaataacccaagtgaatattttactggaaaacataatacattagctttcacaggcatgtctggtactgtagagaaggaaaaccagatccttcaagtgagaaacagatgcttgagctgagtgcttctccaactagagaccacggagacttgcaggctgaagattctttttgagaagttgttgattttggggttgctattctgatgattacctaaacaatagtaaaaatatattctggatcatttgactggcttcagttcaaacaaaaactgctgtgaaattcagcctcaagtcagttcctgtgctttggatctctttgggagcaagtcatcatagtttagtttcctgaaatgagtgagaaaagagtggatagaaggcaagggaggcttcccctgccagtgacgtcccatggtctggggccgagtgtccgaagggtagagtcacaggagaagttgtgggggaagggaggcagcctacagctcagggtcccaggcctgctgagatggaacatttgaatctgggccaactcatcagggccctgttcggatcccaagcactgctttagtgtcagtaaaatgacagcctctggcgtattaaattgatagagtccatcagaatattttggtcttgtactttcagttatatttaattgatatgtttttatttgggccttctagttgtataagcataaagtatttatagctcagtttatatctagacacattgaagacatattgtcttaaaaataatttcattcggccaggtgcggtggttcacgcctgtaatcccagcactttgggaggcagaggcaggcagatcacgaggtcaggagattgagaccatcgtggctaatacagtgaaaccccgtctctactaaaaatacaaaaaattagcctggcgtggtggcgggcgcctgtagtcccagctactcgggaggctgaggcaggagaatggtgtgaacccggcaggcggagcttgcagtgagccgagatggcgccactgcgttccagcctgggcgacagagcgagactccgtctcaaaaaaaaaaaaaaaaaaaaaaaaaaaaaaaaaaaaatatatatatatatatatatatatatatatatatatatataaaacttcattcaaccttgggtgttttggagaattttttgtttctttacaagcggtcttttatgtcactcaaacttgagaaaaatggctttattttaatcctgcataaaataagaaacacaattttaaattagcttatcttcagaatgtgtattctggctgtctcctaagatacaagtgaaaggactgatgttgatgatagctcgtatataaacatctttaacagaagactagataattacttgaaacacctggtaggttcaaaaaaacaacaaacaagactagacacagcatagacttagatgagaagagctggaaggcggcaagatatttaagaagaccgtggacggctatctgcaaactgtgctcatcacagggacactagtgtgggaaatggccagatataaactcagtgtgaagatggggcttaaaaataacaaaactggaactgcaagacgggcccacagaatgcattcgcgtagggagacaggaaaacgttagcggagggggcggaggtggcagagaggaaaacatgggcctggcgaataaaaaccacagtactacttctggatttggagcaatagagaccatgtccgatccttccatgccctttaagcatcacctccctcacatatgggttcttctgcattgatttttggtaaatctgcgttgactcttaatgactgcatattactttacgtaatgagtattcctgatgaaattcgtgagtaagcgctcacatgatttttttctttgggtgtttgatgggtgaaactggtatcaaactcactgcttttcaacttttgagattcaacttttcctcattctgaaaagttaaaaaatcatctccggaactctgaactctttattgtatctcaaagattcccggcagcatctctgagactataatagaagtgtttggacatctattggcatttaaaatatttgtatatgccatattatgtcatcatttttcttaagcacaaggttctccttaaattgttattctgtcctttctaacatgggacatattctctttgctcaagaaaacagaacacacaggaatcgagtagtgtttttacctactgacactgtgttagctttcttgacaagagcctattcttctctatcttttccctcttttcttgtcctggactccacttttaaagcccgtcctgctgtccttggaaatttaaaagagaatgtcacctctttccgtgccatcctcatgccgtgctcacaagtttgtgctcttctgtcgtgtttttcctctagttattaaacccatcactcaactgttgcctgtgttttctaaaaatctgagctcattggtgttcaatgaataccagctttttggtgttaaaaatgaataagacaatttgttaaaaagcatataaacacaggattgaatcttattttaaaggacaactgcgaaactgggctctatatttcaattagtatctgtaatcaacatttacttttattctgttgctataccataaaggtcattttatcatctaacggggaagctcctcaatgaaaacgcgtcacaaagttgtgtagcatttccacaaagtcactgacagctactgagaaaaagcaaccccaaacaaaacaaaacaaaacaaatacctttgagagattaactgagccataatgttttcagaaagctttcggtgaatttcctcaacaatcatgctgtaaagtagggaaaactcatttggaaaatatattccattgagaagcattaaaaaccacatgagtcttcgatcactatttttccttttaatttctttgcaagtcatcacaggagcaattgtgatatcctttgggttcaatggaaaatcgtgagcacccaggcttgggatagaaatggaaatggatttcagctctctgatgtgctcctggcactggtcacatgacacaaataatctgcaatttgcagattgctgctgtttggtgcgaaacgctttgaggattaatttctctctcggctatagcttagaatccctaatgtgggcttgacaattacagtgaccttctatttcccccctaagtacaacttagaaaaggaaaccgactaacgacaaaatggcatcaaaaataaatgaagattcaatgtgatcgaagacaatgcagcgagactgaacactgacctctgagcacaagccagagagcatgggccacatgtgcaggctgggctgcagcagtgaaggaatccagtgggcggcttgctactccagctaagccaggttgattagggttgccatacactgtgctgaagtagccatttctgaattagtctgagagccaggcgttaataggatccctggaaaactcactaagctgtctcgacagagtaattgcattcagtcagcagcaggactttacagaatcaagtttaaagcattatcgttttcataaataaagccaagcttattttaatcctttctctctgctgatgggtttttatttataaaggattattcatgcattctttctccgtagccaatacttgctgtctcaagatatcctaagccagttaaggagaatcttgaagatactcaccttccacctaataatgtacttacaggtatacacacgggagagtaacttacatggttacacaaggagatatggaatagaatatttactgcgacatttttgtaataacagcaacaacaaaacgacacatctaaaatgaccatcaacagaagaagagataaaatcattcaacaaatagccattgtgcacccactttgtgccaggcactattacgacacttgggtcgcagccgtgaaaaattaaaacagacaaaaatccctcattggagcttgcattctaaaggggcgagagacaataaaaataaactaataagtaggtaaatgaagtaacattttggatggtcattagcactgtgtggaaaagagaaaatacaacagtataaagggcagggttggctaacgtaaaagtaagtgttcatttcttattgagaccatgacactgaagcacagatttttaggaattgagttaatatgagttagctagagtgaaatgtatcaaaacaggtaaatctcaaaatcataaagttgagaaaaaagttgcaatcgtttatgcacaatgcaatgtcatttacagaaagtttagagaatctattaaacaatgtcgatgcacgcaaatatactaagaatataaaataatgcctgcaaatgataaacgcccctgaagtatgtatcaaattgaagggaagaggaaagaggaacaggaccatagaagggcactgctattcaaatctgtcttaaagtgtattacaataattgttaaaaagaaaagctaatacttctatgatgcttagtaggaacaaaacactcttcacagtgttatgcatgtaattcatttactactcatgacaaccctataaggcaggtactatttttatccccattttaaagatggcgaaatcgaggcagaaaaagaactaaactaatgaagtcatcaaagccgggtagtgtgtacatggacattgattatgctactttaaatatctaactggatgtctggaacttttcataataaaaatctctagatgaaacctttaaagtacatctaaaaataaccttggaaaaggctgaataaaaattcaataacgtatagacctgagtttgtgaacatatatgagcatgaatgtagtctggagaaggaaaaccttccaatacaaccactaattagtagacataacttatctgagtagtatagcatgaaactttgtaaattttgatgctttcagaataagctgaaagaagccatgaaatattatctattcaatttcttacttgtagatgaggcagttaccagtccagaagatgcgaagtatcttttaggagctcagcatagtgtgtatgaagctcagatagctgtgatttcataatttatattaaaattgatgcagattggtattttctggttttttgcagctgctgtattaatccaaacatccttgctgggtcagcttctagtggctatgagactatccatcttccaatgaggtgccagggaagaatcagtctcattgataatgagacacgatcagaaattttcatttcacaaataatattatccttattggccggaggtgaattccaagtaaatattcattgattcttcatcgaacaactcttgagtgtacacttactatgcgtaacgccaggggccatagagaaatcataaatgaatcagacagggattctgccttcctggagcttgcagaagaaataagacgcacaccaacaaaccaagtagatgtagaaagagccaagtgagcagagagcaaccaaagaggtataaaaaaagaaaaagaggaggtggcttggaatcaaagaggccaaagcctggagtgtttgaggaatccaagcagctgcttggctgcagatgagaattgaaagcacctgcatacacacagcctacctactggggctgagaactgagaccactgagacctaattatttgttccagaagaattctgccctggaagataagcttgtaaagcaataaataacttcactgtttgcttcaagaaactcctgcaaataatttaaccagacagtttgctcatctgagtagccatctctcttaacaggaaatcagacggttcacctgggcaataatagctcttgtataagacaacagtttccttatgaaggcttccttaggactttgtctcactgtgtccactgaccccaaactactatgtcattgatctgctcaactccaatcagtttcccacttgaaagatctgcaataagcgcttaagcccagatccccaggctctatgaacaccctcccctgacctctctttcctgtgacacctccatgactgtccacacgatggtgtcacttcctgcactagatctaatcagcgctgctctgcaatagattttctgtggtcatttgggaggtttgagacagaggacaaggtagaacatgcagtaacaaaagatgaaaaacacttctcatttttcttatttgtatgtcattacaatgtcaaaacaacttaaatattttgaattgtgtgtatattcttggcgctttgccttcacctttgaatttcataaagttcttcctttgttattgacctatattttgagtgattgtgatgatacattttacagggcaagtgttttcaacatccagcatccctcagatcacaaatttaatttggctggtcaacacatgagtggccactgggaatgggaggctctcagagtgaaaagggatccttatccattattttctttctcctgctgctctcaaaagtttgtccttggttgacatcagagaaaggaaagggaggaagtgaaggagatggaattttgtgctctctttaatatgtttttccacagattatggtggttggttggttacctgagtgaaaatgtcaatgtctagttaacgttgggggaaagagaatctgtgggactgtcatcccccaagtgggtgtaaccaaaaagggcacttaggttaggcacatccctgtcagataaggcctagttaaatagggtctagagggtcagcggggcacctaattatcatggttaatgaggtttctttaggagaaaagaattctgagttccaaacaatgtatagacatgaacatttatggaacactcccctgtttataaactggaaacttgtgtaatttatatttgtaccctatacttcgccatagagtgtgctctgtaaactggccttccttgtagggcatgttcctgaatagggcatattcaggcactattaagtttgggaaaataaatcatatccaaaaccagtattaaataaatataagtcatcggactttaggaattgatgcaattccttaaatggaggaatttcttaaatggacacaattccttaaaaatgaggtaaagagaggggctgggggtaaagtggaatggggcaggggaacagaaaagagtttatagttttacaagtacttaatggtattttttgtttttgaattttgtattttaaattcatttcagtactttcccttgtcactttagttctgtgcatttggtttcttttattcatcttagcgtaggcataactgcattcattactgaaaggcatctttcaaattcttataaaaaacaaaacccatgtaagcactctaaatattgccacttaaattcatcactgcttttatatagcatccctgcttttatatatttagagtgtatatgctggggtgagatacatttgaaagagattatgaaaataaaacaaaaatccaatttaaaagacaactaatagcttctatgatgcgggaaaacccacacagctttgagtatattgttaattacactatggtttgattgcccagatctttgcattttatcacgagaattagtaattattctttattttaattagccaaaatgatgaatctgagcacgtctcatctgtcagagagttttaccaatgagctcaaatttgctatccatgttttgcagtgcagcatcacaagtgttcaaccaggtgcctctaaaacacgagaccttgagccttggtatgcggctcaggtgactgcaccatggccctggtataagcaattccagacagttaaatccagcccttcatcctgcacacttacataagaaattcatttatagacaatttttttgttgttgtttgtttgttttttgacacggagtctcgctctgtcaccaggctggagtgcagtggtgcaatctcggctcactgcaacctctgcctcccaggttcaagcgattctcctgtctcagcctccccagtagctaggactacaggcgccctccaccatgccaggctaatttttttgtatttttagtaaagatgggatttcaccgtgttaggacaggatggtctaaatttcttgatctcatgatccacccgcctcggccccccaaagtgctgcgattacaggtgtgagccaccgcacccagcccaaaaatttgttttaagcaagcacttatcaactagaaaatgaagctcaatagacacggatatcgttggtgtgtcaaagctgaagattatcctaggaaaaactttcatctatctgtgtttgtgtatttacaacttcctctatcatccagacatggtggctcacacctgtaatcccagcactttgggaggccaaggcagatggatcaccttaggtcaggagtttgagaccagcctggccaacacagtgaaatcctgtctctactaaacacacacacacacacacacacacacacacacacaaaatagccaggcgtggtggcatgcccttgtaatcccagctactggggaggtttgaacctgggaggcagaggttgcagtgagccgagattgtgccactgcaccagcctgggcaacagagtgagactctgtctcaaaaaaaaaaaaaaagtttctctatgtatcaatttttattttaagaactttcataggcatgagtaaagctactgcagtgaaagaacctgtcaaaggtcatttcactacttctgtgctgtccttttggtctaagttcacaaagtgtttgtctccattgtatttgctgtttttgtgtttggttatttagtgactttaaaaatgtcaattaactaccatgcccaataagtacataagcaaaaggagtttttttgagaagtgttgagagagaagaggcctggaatctaaaaacacagataatgtgctgaacggaagaaggtcacggaagaggatatgctgaagtctgaggtttgagtcactggacaatcagaagcaaagacttacttatggacaaggtgaagggcgttgggcctatgtcatcaacagtgagcaagagacaggaaatagaatggaagaaatgaaggaaaaatggaatcgctggcctgagaatgaacatcagcaattggtgttgactcagaaggctgagattctgtttgaggacttaaaggtgagggatgggaaagtggtcctgccgagctgctagtgcagagggtgtggaagccatgctaagctagtgagttctgacaagggctcctttcctgcttcaggttttatcacccactcaatatttactgcgcagagagctgaggacacacattaatgaaacagtccactcttcacagtgcttagggcgtccttcgctcatacttctttgaacatatccactctcttgtctattttacattataacacctccagatcagagaaggagtttttgacttaacttgttactccccagctcaccgtgcccagagctccacgcatgactgaatggtgaatttggaatcattgctttcatctactggtttttaccaaagtgtaaagtgcattttctaaatggctctctggctcacagaaagtaacagttttaaaggagatattttaaaaggtagaatttccaatgacaacccaattctttggataattcgtcttattttataatagcagaaacattcctatatgagaacaccaactcttgttaaaacattgagattaccttgaaacaatttagagtctctaaagttgaaagttcttctttgaagatctatacattacaatgttgggcgcagcagatataatctgaactaggaaagactgcatctgcagactattattattattattattattattatttttgagacagagtctcgctctgtcgcctaggctggagtgcagtggcgcgatctaggctcactgcaagctccgcctcccaggttcacgccattctcctgcctcagcctcccaagcagctgggactacaggcgcctgccacctcgcctggctaattgttttgtagttttagtagagatggggtttcaccatgttagccaggatggtctcgatctgctgacctcgtgatctgcccgcctcggcctcccaaagttctgggattacaggtgtgagacactgcgcctggcctgcagactattattaattttataataaggataaatgaaaccagacgtaagtgtcatacatgcatgaattgagttcagagctgtcgtcttatgactcagatccatgttcacccaggttgggaagctcaatgctgcatccatgtagctgatcccagcataggcctgacataggaaaaagactatgggagcccttgtgccagtgactaaattccaaccagcatctttccagtgagatggcctattccaacacacacacacacacacacacacacacacacacacacacacacacacacatacacattttgtaagatcttgaaaaccataaaccaaaatagatccatgatttactggttaattttttgatgatgaactatagagcattaccaaaaagcctaaaatgtttttctgtttgactttcatgccttactttttttctttctggtgatatgatgtcactctgagcacacagggcataggttatatatagttcctttagattctctttaaaactttcaggaacaatgaaaaataatatatcgactaggtagcagttaggacaaatggtgttaagctgttctaaaaagacaatgtttaagctaaaaaacacatcttgggataagaaataaagaaaattcagttacataatggcactatcagggtatagcatcaaggcatatgtatttttctcttctcttcttagaagcgttggtgtcagattatcatttccaggttttttttttcctatttaggagaagttcaggaaatgcttaatatttacaattccctttttaaaggtgtttttcaaaattaaaatagctttgttttcattgccattataaaatattaaaatagttgagaaaggtagaaattagcaattttaccacccagagacagtcaccagtatttttttatgaatcatctcctagataactcattgcatgcccttacatcaatacacataggatattaaggatgttgcatcatactatgcatgacattctgtaacttgttttttccacctaataataggaatgggcatcatttcatgtcaaatgatacagacatacatcatcgtttttaatggctacgcacctttgcaatatccttgaggcaaaccctaatgatcatattggtgtcagtgagtcacctagacatgcatatttgcaaaccattcagaggcattaaattggacacactccccaaagtgcgactaccaccgggttaaagtatcgttccatttaacatttccatcattcctgccaaaacactcttcagaatttgtctacaaacttaacaccaccaatcacagtgaggccaatgtcccccagtttcccagagtattagagacacaaccctcccctccttggttgtatgtgtattcatctcttcttccttcctgagatgaagcttggcatcactccactctgaaagaaatgagaaccgtttttgcatttcaccttaatcagatcaaattaggacaggtggcaaccctgcaggcaacataattatgaaaaatgtctgtgctcaatacagcctgtccttccagcttcccaatcaaataggacaccagagcccaacctttctatttcagctggtgactcatagagcagtcacccacataattgctctgaatataatggtgctgcaaaatctgaaattaaacataatataaaaagcacaaaaatctattttgtaagattagttaatttaatataataatagttcttctattataatcttcatgtgccaaattgggggaaaaaaccttatggctggcctgttattagaagaaaatcttttaacatatcccccttacacttgccatccaaaggtaaaaagaaatgatgttgaggatttcctggttttattgtaagagagtagctgttgtccctccaataaaaagtgtgcaatgaatatctgtttaaatagatttgagataagctgaagctggatacaaaactccattatacaacagggggatcctacatccagcttcatttaggatattgcttctcagaagacatcccgaacacctcaataacaaatgttatattgaaaatgtgctcagtaacaattgcgggatgagtctctgtgcagcgatttttcagcatgtcaaaattatactatcacaccatggaaacaaattaaacagcacaagcctggctgccgggatggctgtattagcaatgcagtgctatttcataaagaatgcattgcttcagatctgtcaatgaatgtcaacaatggcttctccatttgtatgaagcccaatttgtatttggagaaaaaccaaacagaacacttcagaatctggttccatttcttcccaacatttagattaaaagaaaaaagcccggttatctaatttatctgtagtcagcgttccttttctagggaggcacttgggaggaagcctcagagtgtgagttaagcactaacattctctttctgaagcacacgggcaccattaaatgcttactgacagctcagagaaaacacaatctatgtgctacacattgtacaagaaggttttgttgatatattagattcatatatgtgagctttggttttcttgtatttgtgaaacgtggcttagctgtgtattatggctttttgtgactaatgagtgggtcttgcttcagaaatgattacagttatgtcagaataatgtcaaataatcagtattagtagatgagctcttagaaaacagaagccctcttttgcagatagatatgtcataccaaagagaaattaaaacccaagactattctaaacgccaaatagagtctgctatattcacatctcaaattttgtgtatctaacaattaagttaaatagtgattgtcaattaaatagcgttcaaattgtagctcaaaccgaataagaatttcttgtccctggagtggatgtatgtagacatcaacattttaagacacaaagggatgatgagtttcaggctttgttgcagaagtttggacagccgtttggctcttccctagcagtcctgaaacacatgaagtaggtggtcctcctgcctcttgcctttttattttctacagctggctcgattacagccctgaggacttgacacagcagaagacaacccagccaggcagcaggttcaatacacagctgaaatctcactgacctctacatatttggctccagtaacctcttatgtatgtatttattttttaagatcatgttctcagtctccataagggtaaatttgtaaggaagaatttctttaattgtttttccaaacatgcaattctgtgcctcaatcgcttctttttttaaaaaaaagaacagttagggtgtcactctgtcacccactgttgagatcatagctcactgcagcctcaaactcctcagctcctgggagcaatcctccctccagcttcagcctccagagtagctaggactgcaggtatctgccaccatgcctagctaagttttaaattttttatatagagacaggattttgctacgttgcctaagctgatctagaactcctggcttcaagtgatcctcccacctcagcctcccacagcactgggattacaggtgtgagctactgtgctcaacctgcacctttggttttgtcactatattgccatagcaaaattcaggtcagtgggacttgagttttggttttctccactgagttccacgttcttgctcacgtttactccagctaccctggtgtagaaatgaaattaccccagtcctcatgatgcaagcgcttattctgtgccaacaccttaagctccgtttctaaatgagattttgtgaaacgaatcaatcaatcaatattaaaactcaagactaaaatctgtctttgatttttgttcttcctactgctatttccactgaaaaaaaaattctctttcatgtgtccatgggtagaatatccttgcattctttctgttgaaatagtatggttctagtattcactagctatgagatattaaagaacggaagccatcttcctcattatgttttataacagagaaatataactccccaatttacatctaagttcatcttaatagtgctttatacaaaaagttcctgaagaattacaacagttggccattctgcaaagtgccaagggactgattctgaatccagagcaacaacaaccaattatgaagaaatggtctctgtggctagtatggtctagacactagcaagctacatataatgagactgctctctcctttcaaaggctgtgatttaaatttataggtggggtcaatgggttaattttcactgccttgttttcactacacttaccgctattgaggggccttaaaatagctctgctatcagaactcactaatccaaatcagtttataaaaacactctcagattaacaaatcaatgatacttacacaccacaaaattggttaccacttaaaggctttattctgactagatttatagcctgcataaatcccattctcatgtaatttagatggaagacaagcaagaggtatctctgctgtctactcacagcagtgtaggccaaaaaggagagcgattctttattattgatgtttagcagcttgtgtttaaaagctataaagaagacgcaatgaaaatacaatagatcaattcctaaatttccagtatagtttacaaaattttaagagggattaaggatgctagtaattaacttaaaaataagggcatcattatatgtctgtgtaacagagatcttttcagaaacaaaaaatcaagatttttttcttttccaactataaataaagcaaagcctgtttcagataaaattcatctgccaaatactttaatgctatcctgaggttaagaatgatgaaataagtttgatcattcttatggtaaaatgaaggctatttaaagatgagtttcattcctgctttttttttaaaaaaaaacttttatttctataagtttttgggaaacaggtagtatctggttacacgagtaagttctttagtggtgatatgtgggattttggtgcacccatcacccaagcaatatacaccgaacccaatgtgtaggcttttattcctctcattcttgtttttttaaaggtgttttgaacacataaaactcactgtatctaatatattctgagcattggattctagtaacatcacctcttaagatgtaaaatctcttcattttagtctctgttgagaattaaagactggtaaaaccagtaatgtttttagaagcatatattgctgtctgaacttgggatttctgattcaaaattcagagtaaaattttagctcttgggactgctacagaaatattctataagcattaataagaccatgtcaatagagcgttaattattaggattaaaaatttactctatggggggctgggcgcggtggctcatgcctgtaatcccagcactttgggaggccgagtcgggtggatcacaaggtcaggagttcgagaccagcctggctaacatggcaaaaccccgtctctactaaaaatgcaaaaatcagccaggcgtggtggctcatgcctataatcccagctacctgggaggctgaggcaggagaattgcctcaggaggaggcaggttgtggtgagccgaagaggcgccactgcattccagcctgggcaacaagagcgaaactctgtcccctcgccaaaaaaaaaaaatttactctatgggtatcaataatcaatgtgttattctaactcattctgtgcctcattcagtaaaaggctatgaagcaatttaaggatatttgcaacaaacaagttggtttgctggtgttgctcttgctttttttaatgaagggaagactggaaaagggaaagtgatggcaataaaagtaagggcaaactgggaggtggggctggacctctcggtgcataccgtaaagccccatgatactgatccatgtgagccaccaacttggttctgagtttcccagcaatcagaacaaagagggcaccacaatccctagaaaatacacccaaagtggtttttgagaggacaccatcatctctagaaaataaacccaaagtggctcttgagagaaggacagaacttaattttggcacaagcctaggactgccagatttagcaaataaaaatacaggacacccagttaaatttgagtttcagtaaagtaccaagtcctttttttttagcctaagcctgacccagatatttttgttaacctgaaatgcaaatgtaaccggtatcctctagtttatctggcagccttaccaagccataattcagagagaatatttgtaacagaaggccatttgtagcatgtagttttagttcttggtttcttaaggaatgactagaatgagaaatagtatatttcctagaaacaaaagcttctaatttcaacaacatcaggacatagtatacggcatgccgtcaagaaacctgctgaaatacaccagcagatctgagcaggagcaagtgctgcagaagccagggtaaggaggacgcgcagagacgccccgctgctgagagcgcctgtgcttcagggtccactgcaggtctgcacaccacagggtgggtcacacctgagacgcccgtattttaattcctttctcccgtaaagccctcacctcactccactctaaggatttagtcggtgaaaaataagattatacttcagacaaggttcaaccaaacatcatcaaataaacctattctaagaaatgaggagtatctgtattcgatggtagaagtttgaaaggaaatacagatttttttttttttcctttcaaagagcttgttaaatttgatctccctcttcaggtagataactcgtggtcaaagttttcaaaagtttcgacatgtaagaaagaggaaaatacatgtaaggcacacaaaaaccatctattttgtgtatgtaattccaaaggattttgcttctttcatggaattgcatagagatgtttgtcttattttcagacactgataagccattatcagtatcatctttacctgtgcacatgttttttgttgaatttcctttaaaatacaatgaattgaaaaggattaaattcttttttttttttttttttggagacagggtcttgctctgtcacccaggctggtgtgtagtggtgcaatctcagctcactgcaacctccacctccttggttcaaatgattttcctgcagcagcctcacaagtagctgggactacaggtgcccgacatcatgcgcagctaattttttttttttttgtatttttactagagacagggtttcaccatgttggccaggctcgttttgaactcctgacctcagatgatccacgcaccttggcttcctgaagtgctgagattacaggcgtgagccactgtgcctgggctagagtattaaattctgaaatgcaattataattttatttaggatatattttacatctaattaaataaatatcctaaaattagcttcacagtggagaaacctgacggccaccactttgaccaagtaatccaagttcatcccaccagtaatgggacaagctgacactgtgtgcctactgagaagggtacaacatcctcctccaacactcttgccaaaaatgcataacttggttgggtacggtggatcacgcctgtaatcccagcactttgggaggccgaggtgggtggatcagttgaggtcgggagttcgtgaccagcctagccaacatggtgaaaccccatctctactaaaaatacaaaaattagctgggcgtggtggcgcacgcctgtaatcccagaactttgggaggctgaggcgggccgatcagttgaggtcaggagttcatgaccagtctggccaacatagtgaaaccccatctttactaaaaatacaaaaattagccagatgtggtggcacacgcctgtaatcccagctactcgggaggctgatacaggagaattgcttgaacccaggaggtggaggttgtggtgggccaagatcatgccactgcactccagcctgggtgacgacagagtgagactctgtctcaaaaaaaaaaaaaaaattgcataacttgagtctaaacaggaggaaacattagacaaacacaaattgaaggatagtctacaaaataactgtcctgcgctcataaaaaattccacagtcataatagactagacataatagtctagataagaggggtctaaagagatgtggcaactggatgcaacatgtgagctgggattttcttcttactattaggtatgtactgaggataaattttgaaatttaaataaggtttgtgtaaagtatggcatcaatgctaatttcctgacttcgatcattatactgtggttacataacagattactccggtattgagaaaacatattctgcaatcttcagaagtaaaggaccatcatgttggcaacttactctcaaaggattcagaaaaaaaatatatgcacatatgtacacagatggagacaggaagaaacaaatgtggtcagtgtcagcatgtgggtatctagttgaagaatgtatgaaaaattctttctcttgcaccttttctcatgagtctaaaattacgtcaaaattagaaagttcaaagaaaaagacatttcctttggtaaaaaaaagtcactcagtatcactaggggaggcatccactttgttttaaagcttactgggcctgaaggaaatgacactcgaacagcacagccagctatagctacagcacagaaaaccacctccaccctctcccacaggagggctccccggctagagttttctgaatacttactggatagttcaatgttgtttttttgtttgttttgtttagctttgccttgttttttgttttttacagctgagaaaatttgagtttccacaacatccacagacaatctggaccataatcaagtcagtgcagtctaaagcaatgtttcaaatatccgaaggtaaggccagttctttattttttgattgctactgaaactaattgaatagtgttatgaatggagtcaaatgatgtgcttaatcaactgaatatccaataattctgtacagcctattctatgttagttttctctaactataagatattctaatggagaacaaggaaaggaataatgccatttttacccggccctttagaagacaaggtaaactcatcttttctaacaggatattgaatatgcattttttttttaagaatccaagccttacctgtacggttgtcccttggcgtccaaggagtattgattccactactcctttgggatgccaaagtgacaattgctcaagtctctgatatacaatgatgtagtatttctatataacctatgcacatcctcccatatacttaaaatcatccctagattatgtatatctaatacaaagtcaatgctatgtaaatagttgttatattgcaattttatttgtattatttttatcgttgtgtcattttttatgttcattttttccaaatattttctatctgcagttgggtgactcctcagttgtggaacccatagatacagggggttgacagacactaggttgaggtaatgcttcatgattgttgaatgtaggattttggatatgcagaaacgaatttctaccttaaagactgaggagcaaaatataaggagacaatgcattaagcccatctgttaattttgattagttttaatattctctttaatatactcttctgtttatataatgtggggctagtagacgaaagaatatcaatatcatttgatgatattaatgttctgattatgcctatattccttctacaaatatatatggcacaaaatccaaatgccaggaactggtctagataagaggaatacagacgattagacacagttcctatgctcaggggatttacactccactagatgatacttaagtacacaaactaaagagagaaaaccctaagggctatggagaaagatgaagcagggaaactgttggagggagagggaggatctggaacatcagcaaagtcttcactagggaggtcccttgtgcagaccaagggacagccaggaccagcactaggaggacgagggaacacaagcagagcagacaggtctgcgggccagggtgccgccaggataggagggctggcgggagaggcaggaggtcaccgcaggacctgaaggaaatgactcctggccaggggccagatcgtgatggtctcaagggttgaagtttaattccgagagtagggagaaggcactggaggacttgcacatggtagtgatgtcatagccttcatattttagaaggcattctacattataataatgtgagatttacagaagagttgtaacgactgcacagagcgtcctcagatgcgctgcaccccacgtccgctgctgttaacatcctacataaccaggccatcttcccataatcctctatatttaaaaggtgatctgtccccttactgtatagaaaataattacgaactaataataacgacaatcattatgaactaataacatcgcatgtcaactgcatcccaggagctgttccgagtgcttcgcatggatcacctccttagtccttacgggctgctttgagtgtgagggcagggctattgatattttcattatccccatttaatggatgaggacagtgaggcagggaaaggtgcataaacctgcccagtgtcacaaaactaatatatggtgaggctggtttcaagctaatattggccaatccccaaccctgaactctggaatagtctgggggagcaaaacaagatccagggagcccagttaggaggctctggctgtggcctgtggtcagcagtgcagcggtcaggtgggaggtgatggcacctgggggctggaaggtgaggccagcaggtcttgctggtgggctgccctgtggagcagacaaaggaaaaggaggcaggggttgcgctgccacttttatcctgaggaaccggctggacagtggtgccttctactgagagtaggaagactggggaagagcgagagagggctcgaggagttctgcttcggatgccacattggcaaagcttataaattatccagttgtagccaagagaagaaggtgagtgtttggagagtagagagtgacacaccaagtcatgatgctcaggggtcaaataggtggaggtgatagaattgactgctggaggccgggcgcagtggctcatgcctgtaatcccagcactttgggaggctgaggtgggcagatcacgaggtcaggagtttgagaccagcctggccaacatagtgaaaccccatctctactaaaaaaaaaaaacaaaaaacaaaaacccagcagggtatggtggcgcatgcctgtaatcccagctacttgaggggctgaggcaggagaatcacttgaaccctggaggcagaggttgcagtgagccaagaccattctactgcactccagcctgggtgacagagcaagactccgtctcaaaaaaacaaacaaaaaaagaactgactgctggacttcatgccaaatctatttacaaatcaatttaacactcttcaagatgtagaaatcaacaaaaattggttcatcaattttctgtcctcagcctgtctcctcttcctcccagatccccatcccagctctgtcttatgagagaaacaaggaaagagagaaggaaggaaagaaagaggggaagaggctgtgggcaagatgggagaagacatcaagaaacccaaaggcaaagaaaatgatggctttcaagaagagtggcaggccacacctcttccctttgaacaacaaattcatgtcacttctttccaatatcaagacacccgtaggacacaataatatattttctctcagatttttgttagaattcagtcaaactgtctgctttagaatttattatctcatgacatgagcctctcattacagggtcacatatttgatttatgacatcaccagttaagttgtttctagtataacacttacacagttaaaatatataaatatttttacatagaagttatgaaatttcaagttgactgaataactgaacaactaaaaacactggtttttttatatttgaaaatgtaactacatgtgcaagaaaattataggtaataaaataatagtgaagaaaagaaaaaaataagtgaaacaagaaaataaggaaacaagtggattacaaaattatacattctagagaggaaaaacagtcaaatcagataggcagaagcagggatacctaaacgaacatggatcaatacaagttcttcaactacatgaacactggttgggggggtccccaagaaagcaaaatccaatggaaaatgtgactgtattgggtgggtaccctttgtgctattcaaaaggacaaacaatgccgtgagaaatctaaacctacaatgtaattgttgactccatagtgtgactataaagtagtgacaaaataattatatacttgtttctattgtgtgtcagataaaacagcacaaattcttgcacccatgtattacaagaacatcaaagaacacgttgtcagtgttcaaatacggcaaaaagttgagagggaagtttttctggtaatctctcacattcaacaaaccaccgacaacaagatactccaaaggaacccacagtgtggggcgagatgtaggaatttcatacacacagacaagaggcaggggagctatgttattcaagctcaagaaaagtatgaaagtaaaggcttctgttatgacactgggttttacctgctttcccattgttgtgttacaaaccaccccttactttttattcttttcacaatctctttccacgcagacactccatgtggttagcttggacttcctgacaacatggtggcctcaatgtatctggatttctcatatgaaagcccaggactcttcacgaaggccaagacggaagctgacagtcatgtcaagagctaggcctggcagagtgtctttttccactgaactcagtgcaagcagggtgaggtcagcccaaattcacagggcagggaagtagaacctacctctcattgggagggggatcacattatttgcagtgatctttactatgccacagggttgatcacctttatggcaatttgattgcttatcagccaaaaggaaggaggtggtgctataatttacggcgggaaagtgaaaaaagaaagaacattcctgggtcacttctctaggctgcctctgactaactccactgacaactttaaatccacatcagaggttgcatttgaaacagaaagacaagaaatacctgcaactaatgttgtcctgtggagtggccggtggcaggggacagctgaaagatccacacagaaggacaggggacttgcagacatggggtcggggtgaggagtggggactgcaaggagactgacagcgtggagctgccagctgtacaaagcttgctatacctatcagggttgaggactcatttttgtgtttcgacacattcttggcacgttccccttgagcatgaggcagaacgcaactgcctttgcttattttatctagagaatgatgaccaaggtgctctttccctaaagagaaggcagaacaagaggagagaaacacattactatggttggaggttaaaaaaaaacacttttctggaaataaaagttattcaccactaaaacagtttacacctaaaagtcagagaatcacttatttggaagatttctatctttactagtgcttattgtataggaaaacaactatttaaacaatactcttcacaatatgtatgtttttctttttctgacattgttttccaactttggtttgctattttttccctttattcctcaacttgtctcccacttctcagcctccattcatgtctgccttgcctttcacccaccagtggtcccagcgatatcgacaagaaacccctaggaacatttagcacacacaaaaaaagcctactaaatcccttcctggtggtccctatgctcataattaagtcggtgcatttctgtctggaaggagagttacactagattatttttctgatcatttaagagctagtgcccattagttataacaatggttgtaggagaatgaaagtgctgaccaactcctatctttgcctacacaatagttctctacctctttcttccctgaagatgatttgatgcaagacctggcctgagagccttccatgtctcggcagcagggactctctgactcagagaattgatggctaatctcagtttgcctcaagaatcctattctccgtgtacagtgactgtattaggagtgttcataggacctagtcttggccaatgaaaagtaccgggaagactgctgggggcttctggggagtctatcacttcctgatacctagagagaaattcaaaagaacaagaggctttgggcctcacgcttttcttcctgtttggattccagggtgatgagatgttatcttgagctgcagcacctgtgggcatggggtgatgaacacatgccgaaaggaggagcccagggcttcacagaagtgttagctcctaaacagagccctcacctgccaacctctggacttctcataactaaacagcaaatgttctcaggtttcagacctcagctggtcaggttttctgttattgtagctaaaggaagctgtgctccatgaatattttcatatttcacatttctgcatagctagggcttattgagtaaggattactggcaacccaagttaaagaatgaccgaatggtgaacatgccttggaattcgagatagtgacttgttcctgtgacatgtaaaggctcatctcctctgcagccattcacttacccaggggtgacaaaactggggacctttctctcctttcttcagagaagattcttccacattcccggacaaaacttcctgccttgctgccctccacccccgactctctctctctctctctggagtggagaagggacaagtgtgacagttactctatgtaagctccaagtttcataattccagaggtcctctcctggggagaaagccctgcccatgcaggcacatgtggccctcactgtaccataccatgggagattagtgcatgaggtactggtgctgctatgatgttctgtgagtaaataaaaggtctgtcctctgatccagcgtgcgcacacacacacacacacacacatattctaaacccacatacacacatgtgtgcgtacacacagttagggtagttcatgtacctacttaaatgcatgcacaattctgtgtgtgcatttttcttagtgcagaaggggagaaggtcctatggttttaatcagattctcaaaggtgtcagtaatcaaaacaaaacataacaaaattaagaactagttactagagtataaatctcttgaggaaaataacattgtcttaatatctgtagggcctagcacagtgtttgacatgcagcagatgctcaataaaagcttcctaattgaatgaatagataaattagttgtgtggtcctccaactatgctcgatgcctagtgctctgggtgaaagaaacaagtatgtgacatttaaatacaaactcataagccataaactcatagaaacagatgtatacacgacaaacttgcatttatcagcatgaaagtctgataaagctctatattgagaaacattcaattgtatgatagcatggaacataattttgtacatccaaatgttaattataagagagagaaaagacctgtaaatgaaagagagagatcaccgtgagttatctacttaacatacgggcttggtcacattaagcattcattctgcatttaagcattctgaatcttaagaattttaatttgccttcttagcaatgagaggctggagtaaaaacccaaaacatatacacgcatatgatttctatattatatgaattttgtataaaacatgattatctttctctaattcattagctagtttatcataagcatccactcgatggaatgtgtttttcttccttcaaagcataagatacaggatatttaacaatatatgttacgaaagtatgtacagcagatagattagtaaactcttcttgtaacatacttcttccaactatcctttttctttggatgttgggtggccatggatgttatgggttgaatttactccccaaagagatatgttcaagtcttaaccctaagtaccaatgaatataacctcatttgggaataaaatctttgtagaagtaatcaaattaagataaggtcatgagggtgggccctaatacaatataactcttgtccttgtaagaagaaaagagacacaaagacacacagagacaaagccatgtgataacagatcagctgtctgagtgatgcagccacaagccgaggaatgccgactcctggcaacaccaaagctcagacaaggggtgggagcagatccttcccagagccttcagagggagctcagtcctgccaacaacttgattgcagacttcaggctcccaggacaatgagacagtaagttcctgttgttttaagccatccaagcttgtggcagattgttttttggcagccctaggaaactaatacaatgggtgacaatggatatattcttgtgactcagatcctgctagtgcaatgttgatttccatctgtcactatataaaatcattgacactcagatgggaggagacagatcaaaggagatcaaatcatagaaaatagaaggatctgagaagaccattcttttaacatgcaattgccacttaacctaaccaaaagatgtattttgtaacttatccttaagactattgttctgataaaaataacgtttctttagagttctgaaattcaagagcaaaatgattgcctcattggaattacagttgacttacatttgagacagggcatcttggacatgtcatttgaaaataaggaaggcattggacttccctttataccaggtaaactttcattaaattcaaccaaagcctggcttacagcaatttctgtgctcccatcagcttgaattgttctagctgtgtttggcagtgctgggatagggatggggtaacataatgatctctcgctagctacccagttttctatttctcatttgttcttaaaagcctcaaacactcccaaagtattttcttaaaaattgggctttcgtttatttttggaaagaaaacaatcaaatgttgatgggtgaggaatgtacagagacagcaacacagggattctcaaatgtttctgctactgggtgtctatgatgacaaaggcgagacccaatggtgcaattttcccaaacatcccgcacacgtgaaaacaccatgtttgtttcttcaaccacttctttaaaatctgttatattaacattcaattaatgatataatttctttttattgtacagttcattttcttagaaaagctctgggtattgaatccttagaagttccccaaattgctattttgaatagcctaatttttattccttacttggtattattatttcttctttctctcatccttttctgttatttctctaccccttttctttgtgcattttgatcagctagagttatattcttttccactcccagaggatacttcaaatcccatcaccctctctgaacggtcttccttttctatcctcattcatctgggtggacttcttccaactgcatcctcctgttcaaatccatgcttgcctgggatcacactgagtcagtgattctgatggtaattttttcaacaagcatttgttaatcattctctgtccaagtagtaggtcataataattagatactttaggtaagagataatttgggcccagtttctaccctctaggtatgtctttattgatatacccagacagtactagttagttagttaatatactccgtatacaatatactctagaaaattacggttctgttgaattggcatgcttttgttaatgcagattgatgctacatctccaacactaacctcagttaaactttttacctaagacaaggcatattatggggatatatgtgtgggaaagaagaaaatgttctcacctactagatgggtctttctttcctttcttatttcattctttctttcccttttcccttcctccctgattccccttttctctctttcttctcagaagacactattaaagcagctaagtcataatcttacaggtcagggcaaaaattagaaaactattcaaaaccactattacccaactcctagggaaaaaaataaaccaaactcctattaaaaaattcattacagttacccttgggaatcattctttcatccattcactcataattcatcagtgtatttattattgaaaattcctaagtgtcagcttacaacaaagtcatcctaaactatatgaatcttttctaaataatcaagactgtatctcaaattactcaacattacatttctaagaatttaccatttgacttcatattgaatatatttgtttttctatttatgtcttagtctgttcaggctattacgacaaaataccataaactgggtagcttagacaaaaaaaatttatttctcacagttctggaggctgggaagtccaagatcaaggtgctggcagatttggtgtctgctgaaggcttcttccccattggtagtgctcctagttgtgtcctcacttggtgaaaggggcaaacaagctcctttgggtctattagataagggtactaatccagtcatgtggactctgccctcatgatcttgtaactccccaaaggccctacctcttcatactatatcttggaatactttgaggagaattaacattaattcttctttaagtatttggtagaattcagcaataaggccatcagatcctgggcttttctttgatggaaatgtatagaaatgtctaatatagtggattttttttttttttttggacggagtttcgctctgtagcccaggctggagtgcagtggcgcgatctcggctcactgcaagctccgcctcccaggttcacgccattctcctgcctcagcctcccgagtagctgggattacaggcgcccgccaccacgcctggctaattttttgtatttttagtagagacggggtttcaccgtgttagccaggatggtctggatctcctgacctcgtgatccgcccacctcggcctcccaaagtgctgggattacaggcatgagccaccgcgcccggcatatagtggattttaagtcatcattatttaagacacaatgtatttagcaaaactaaaaactgttatttttttaacagggtgcatgtaatgctgtatttaaatatcaaaagaagctaattcaatgtgatgaagtaaaataattcgtatcacttgccatctttcagtggttgactaaagctgttatctaataaccatatttttatctaagtatatttaggggagattatctatctatctatctatctatctatctaatttgcctatcgatttacctacctatcttatctatgtaatctattttatccaatcaatcaatctaatcaaccaaccattcaatgtatctctctatttatctatcatctgtcttccaaagtaactttccaaacacaattagaatttgtgctatttctacgtatgacactgaatttttacatcaattacttaagctataaaaaaaaccttccacagaaataatcttactaaaacaaaactgggtgcaagtgaaattcaacaccggcttgtctcccagtagccttagcatctctgctataatttactgagagtataaaagtgctcattcatttggacttacttctgtttgttgcatagggcctgttagtcatgctatatttccttacaaaatgttaacattgagttgtccctcaaggaatattttaatgtgagagagaagtgtcaaggttagaactgctgagagatttgctctctgtagactgctggactgtaaataatcagccatctccagcatcaagtgattgctcaaaagataggatttctttctctgaacttaaaaatttagcataacttgtatttacttcatttcaacatttagatctgcatttcagagcactttaagaatgtgttggtaacttattaggccaatactaatgcagctcagcaaatgaatgcttattatgagtaaactaagaactctagggaatataaacaagatctaatccttgccctcaaagagcccacagcttagttgaggggatacataaacaaatatttaagtacagtaagaggcagactgataatggtactaataaagacttctgtttttataaaggtctacacagttttcaaagcccttcacccacattacttcccttgacctgaacaagaaatatttccagtagaccagaaagactgaatcatccttagtttagaaacaaggaaaatgagaatcacaacattaagggttggatccacattcataagcgtagcagcaacagtgctaaattgccgatttttttttggcaccatattgactatcttctgtgaaaataattaaatgggaggccatcagacagaggtggctctaaaaccccgggttcctaaatcagcaaactgaaatataactcagactcatttcctatgatcggctaatttaaaagatgaaacttgaactcagctgatcacaggcagtcaacttggaattagttatattgttctgaacttcccatgggaatcgtccaaataaggtaattgttcaaactttagccaattacataatttatttgcttccaaatttatcctataaaagctttcccttcaatgacctgtggtggagctctgaccacttgtggctagattcataaatcactgtttgcgcacataagctgtttaaaattttaatacgccttagtttatcttttaacacttctattttattcactcttccctctgtgttctgaaattttgttgacctctcttacctgacttttatcttctctctaactctttgtgttcttgtggacttacactattttaactccttccgtatcattttgatggggtttggggaagtagcagatatatggaacttcttcaggaacccatgtgggacaaaattatttccataagctctgggaatgcctcacagaggacagcaaatttgacctgggtctttagaaatgagtaagattagagtgagctgctgagctgaaagggaaatccaagagaaggaggaaaatgggagaagctatggtctgaatgtttatgtctctcatgagtgtccatgcatctcaattagtacccgtataaaacagccccttctactatgtgaggatgcataagagggcaccatctatgaggaagtgggccctcgccagacaccaaatctgccagagactttgtcttggactgccaagcctccagaactgtgagcaataaaattctgttgtttataagccacctggtctatgggatctcattatagcagcccagatggactaagacaggagacttttaagcccacatgataagctacgttaatatagagatcaatgcttttcttttttttccagggttgaaccttaaaaagaggtcaactatttgaaactaaacaagttcttgtaaattaaaaaaagcaccttcaaaacacagagacaatccagaccatttagtttaagacataactttgagcctttcagctagagcgggttttcaaagtaggagtcatgaagctgcctccaggaggatggcattctttacacaacagaaagcctccaccatggtgatatggatgggggtgcagaagacaaacttagcctccaatctactcggctaacaactccctaggcctttagggcagaacgggtggccagaatcgaagtcaaatggagtttattcagctggaggaagaacttgcagcatggttgctcaacttcaggccacggatttgatcctactttatagagatgagaatgagtctctgaatgcacagtgtttaggttagaaatctgacacattggcaagcatgaacggttcatgcctgtaatcccaacactttgggaggccaaggtgggcggatcacttgagaacaggagttcgagaccagccttgctaacatggcgaaaccctgtctctaccaaaaatacaaaaaagagccgggtgagctggcacatacctgtaattccagctacgcaggaggctgaggcaagagaatcacttgagcctgggaggtggaggttgcagcgagctgaaatgataccactgcattccagcctgggcgacaagtgagattctgtccccaaaaaagagagaaatctgacacattcttaagagacaccataaagggatttacttgttactgaaaatcttagattagcttttttctctttgattaaaaaataacataaattagaataaaatacagatttaaatttatattctattttattctatattttagagaaacatatttgagttcctcaacatctaatatttctgcattctcacagtatttctgtgatgtaatttttcaaaggatctgtgtaccatccacccctttcaaagctgagaatttcatattagatcattgcagctttggagaaaaatgcattaaaatataacagttcacattcttttgtgagaaaacatatatacagctatgtacccgtatgtgtatatgtgcatatatattacatgtacatatagaatgtacatgtgcacacagacacatatacatttacacacatatgtattttgatatttcaaatgctcaatgcagcatggccataggtaatagcaatctattctatttttagtggtagccatgtcatacagatgttttgacaccattgtaaatagcagaaaggggctgccctctctctttttttttttttttgagatggagtcttgctctgtcacccaggatggagtgcagtggcgcgatcttggctcactacaagctctgcctcccaggttcaagcgattctcctgcctcagcctcccaagtagctgggattacagacacgtgccaccacgcccaggtaatttttgtacttagtagagatggggtttccccacgttggccaggctggtctcgaacccctggcctcaagtagtctgcctgcctcggcctcccgaagtgctgggattacaggtatgagccactgcacccgtctggactaccctctctaaagaacaatgccaagcagaaattacaaccctctgatgagtggcatatagagaaaagcatcctatggtatcagccagaggagaaaataggggctctacagcaagatgcggacatgtgtgcaaacaccctgagccaagagtttcctcaggaaccaaccataagctctttgggggcctgtggtggtggtagtcctaggaggtggagatgggggttcgaggaaatgcagaaggttttgtatgtaatgaagtgttttcttttcatggacagagactgtttttctatcccaaaggtctgggggagccataaaaacattttagggaaaatgtcatcaattcctgttttagagtcacaatggcagggttggtgtgaagaacaggctgatattggaaggccaatgtggaagctgctcaactctccagttaagtgtgatgtgagcgtacactaaacacacagcaggaggaagggaggctgggagacacatttaagagctaactagtaggtagcattgagaggagttggtgactacctagatgtggtaaaagaaggagtctgggatgacttcagggtttccaattttgaccagtagggatggtggtgacagtaactgaaaaaagaaaaacaagtgttccagttccatgtggcagactgaacaaatgtgtttaaatctcctacttcctaaagcctgactaaaatgatattggtgcagaagggaaataaatctataaggacaaagagtttgagagagaagaaaaaatcagaagagagatgttaatcaaatcatagaacacagatggaatggtagaacctactgtatttagcagagcagagaaagctaaagcctcactgtctgcagaagggaaattcagtcataatcaaggccatttaggtgcagcaccaccggaaggcccaggactggaggatccaggtccctggcaaattcagagaaaagaaagggcccaaatgagaataagtacttgaaaatctcatacagtgagcagtaagatgacagcatcccaccccccagcctatgaagctggcaactttccctgcttccccaggctgaagacaaaatgttcttttcccagagtagccctacagagtggatctgggctcaggccacctggcacagcatgggggggagatgaggggctttattgaaatcagggaattacatggatgactgcatgttgattggtgatagctcaacccctttgttctgcctcccttccagactgacggcatccagatttaataaaaccctacacctccccaccactgggcaggacattattgtagactttctatctgcagttgtggagtcctaccaccctagaaatagtccagtgtttgggtgcaggtgtgccccttcctcacatcctgttcactgctctactacaggtactcaggtgaaatgcagaatttaacaagcctgaccttgcacacggtttccaatcagtttttttaaaatgcttttaaaaaaagtatgaatgaaaagcaaatgaagacaagacatctggagaaagtcttcagtaccaaaggtaagagactccaagaaactgaaaaggaaacagaaaacaatttagggaagagtagaagacttaaaaaaatcaaacacaacaaacactcaactacaatcaatttctttgaatagataagataatggtataaagaaaaaatatttggagaaaaagaagcggtcttaaatattaaaatgatgacggcagaaaattttaaaaatttagtcagtttggaaaacaagtttggagaaatctctttgaaagaagagcaaagaggtagaggaatgggaaacaggagatgggagatttaaagaaagaaaaacaaagaattgacctaacacgtttcatatccaagatgtaggaatcccagaaagagaaaataaagtggagaaaaatatcaaataattaaatacaaagatgtttcccagtatagaaggtcataggtttctggcttcaaggagccactgtataagtaggcccagaacaatgaatgaggaaggcctgagccaaggacagccgtcacagtgagcaaatggatgatgggctgggggagaacaggaacaagaatcagaatggccttggacttcagccaccagccctgaaagcttgaacagaatgccttcaacattctgaaagaaaatagtgccttacctaggtttccctattcccagacaaaccattgatctagtgttggggggacaatagagagaaaaatcagtgcagaataaacctggcattcgggacaatgtggacgacagtgccctccgctgtgctggagggtcctgacagcctcaggaggagtgggacctcagaatgcatgtctccaattggaaaaattggggagaaaatgatatgtgatttttcgtgattatactaagagatttataattctattagaaagtttggggctgaattaatgacgactttacccaaacccaagtgaacaagcaaatgaaaaaaccaagtcaatcactaaatccaagaaaaataaaatagttgtataagaaagggaattataatacctagtctgaacaatgcttttaatagaggaggtgtgtgtgtggatgtgtgtgtgtgtttgcaggcacatgttgtgtacagcattaaaccttcattgatctttcatagctagaatttagcagatagtagttaaaattaaagtaagaaaaaaatagctggatagtcatactatatttaatttttttttttttagacagagtctctctctgtcacccaggctggagtgcagtggcgtgatcttggctcactgcaatctctgcctcccaggttcaagtgattctcctgcctcagcctccagcgtagctgggattacaggtgtgtgccaccacgcccggctaatttttttttttttaatttttagtagagatggggtttcaccatgtgggccaggctggtttcgaattcctgacctcaagtgatccacccgcctcggcctcccaaagtgctaggattacaggcatgagccaccatacccagcctagaattttttatcctaagattcatcttgggctctttcactgatttattttattattattactataattaggctgcagcttaggttgtcatccaggtggcaatgttgtcacagttgtcattgcctgcacatgcccgtcaaacatacagaatagctgtcaggagcttagaagaaaattccaaagacagtagctgctcactccttaactaagggcagcatcttcagcactcttgcttgttgagagcatggtatttggaaaccatagtttctgaattatgggacataggtcccatatgtccaattatgggacaaccataattctgacactgcaagtgagctagctaggagattgcattttgaatgtgttaaaaatatcttaatctattttacttttaattttttatacatgtacaagggggataaataatgaaaaagtgtctcatatatttctactctaagagcacttttgataagtattaaatataagtctgagaaatttgaagtgatacaaagtctttcagagttcattaacagtgtttttttattttttcttgatgatgaagaaaatgatactgttttttagttcaatggcatcttaataactatttggtgaaactacaaaagaatgaaaagtgattctataggaataaggaaagtgagtagtttacagatatttaacactaaatgacaaatgtgaggtttctttgatgaaatattgaaattaaataacagaaaagcttctaggagatggggcttcgggcagatggttggcaaagttgagctgggcctgagatgataatacatgaactttcctttaagaacctgtttttccctattccaccaaaaccaaaacaaaaaaccctaagaaaacactgcaagtgaagatctactaacaggcaggttttgggcatggagattcagggcgaggtctgtgctggactcagcttggggagtcgcagtgcctgggggctggactacggttagagttctccagtcaccaagaacctgctgtttcactgaggaccagaagcacatgaaaggagaatgcttttccaatagcttcaaaggagtcgaattgttttgaataattagctatgagactgttccccatagtttacaaagaaaagtcattgatatatttttaaggtcatcatttgattcacaaaataagcaaaaaaaattttttgaatgaggcaatgactcagagtgcagaattattttatcattattcatgtaaaaagatattaataaattgtattatgtgccaagcactatgctaggaactcaaactgaattatttcatcaactcatcccaaaagcactaaggaatcattactaacactgtccctgtgtcacaaagagggcaacttgcccagcgttgcatgggagctggcctgtggtgggaaagtgggttctgactctgggggcaaagccgggagctgggatgtccgcgagctgcttctgaacgctgcccatagggagttatcttttgtaaggtccttcagcaccaccaaaatacgtacctctaaaaattacgggcaaaacagaaacagggcaggtatttcgttggttgattgacccacttatttattaatttattcaataaatatatattaatatataactaagaaaaatgtatatgtatattaataatacacacacacacacacacacacacacacacacacacaaatttaagaacctctatggaccaggcactgtgaggagtaccagggatatgacagtgaagaagagaaaataaacacctcaaacaacccaggatgttgtgttgcttgatattgggtgccgtaacaagtagaacaggaggagcaaataaaccagggaggcaatggggccagggtggtccagggaggatgtggaggaaggtctgggggaggctatcagctgtgcacagtgcccaggaaagaggatgccaggaggggcctgggcttggccggggtgtccatagcagagccaaggtgcttgtgttggaaagaagggtcgtccacgtggccagaggttgtgataggagaggggtggtcacaaggtgtcaccgaagaggtagagaggaatctggcactcacagatagagttgtttgaattttattctaattataaagggcagttactggagcattttgagggcggggataggatctgatttgcagctgaaaactatcgatgccctgaaacaggagcttgaagccttgttctcacgtctaaagccatccaaatataggggccactgtggtttttgtctggttttacaactcagttaatcccaatgaataattgagtacataaaatctattaattagggctgttaaaaaagatgtgatggaaagatgatcaatggaaccaccaggcgtggaaataatgtgagtctatgtgcgtatatgcagggcgagcttgagcttcacccaaaatctgtgggtctagaacttacttctctcttacagcacaggcacacctcttcttcttgtgtgtcacttcactgcattttacagatgctgcagtttttacgcattgaaggtttatggcaaccctgcatcgagcaagtctgttgatgccattttcccaacagtgtgtgctcactttcagtctctgtccatttttggtaattctcacactatttcaaacttttttgtcatcatcatatttgttatggtgacctgtgatcagtgatcttggatgttaccattgtgattgtttgggagcaccatgaaatgtgcccacataagagggtggactgaactggtaaagtgttgtgtgtgttctgactgctccactaaccagaccttcccctgtcttgccccttctcctcaggcctccttattccctgagtcataacaatttaagttaggccaattaataaacctacaatggcctccaagtgttcaagtgaaaggaagagtcacacaacttctactttaaatcaaaaactagaaatgattaagcttggtgaggaaggcatgtcaagttctagatctcttgcaccaaacagctagccaagctgtgaactgggaatgcaaaccaggagctattgaaggacatttaaaatgctactcctgtgaacacacaaatgataagaaagcaaacagccttattgctgatatggagaaagtttgagtgttctggataggagattaaaccaatcacaatactccattaagccaaagcataatccagagcaaggccctctcttcaattctatgaaggctgagagaggtgaggaagctgcataacaaaagtttgaaactatgagaggttggctcatgaagcttaaggaaagaagccacctccatcacataaagtgcaaggtgaagcagcaagtgctgatatagaaaccgcagcaagtcatccagaagatctagctaagatcattgatgaaggtggctacactaaaccacaggttttcaatgtagatgaaagagccttctattggaagaagatgtcatggagaagtcaatgactggcttcaaagcttcaaatgacaggctgattctccttaggagctaatatagctggtgactttaagtagaaaccaatgctcatttaccattccaaaaatgctagggcccttaagaattatgtgatatcagccaggcgcggtggctcacacccataattccagcactttgggaggccgaagcaggtggatcatttgaagtcaggagttcacgaccagcctggccaacatggtgaaaccccctctctactaaaaatacaaaaattagccaggcgtggtggcgtgagcctgtagtcccagctactcaggaggccgaggcaggagaattgcttgaacctgggaggcagaggttgcagtgagctgagatcatgccgctgcactccagcctgggtgacagtcagactccatctcaaaaaaaaaaaaaaaaaaaaaaagaattatgtgaaatctctgactgtgctctataaatggaatggcaaagacaggatgagagcacatttgtttacagatgcacatggtttaatgaatattttaagcccactgttgagacctactgctcagaaagaaatattcctttcaaaatattactgctcaatgacaatggacctggttacccaagagctctgatggagatgtccaaggaggtgaatgttttcatgcctgctaacacaacagatgaagggataatttcaacttttgagtcttattaagaaatatatttcataaggaaatagctgccataaaaagtcctctgatggatctgggcaaagtacactgaaaaccttctggaaaggattcaccattctagatgccattaagaacattcatgatttgtagaaggtcaaaatatcaacataacaggagtttggaggaagtcaatttcatccctcctggatgactctgagggcttcaagacttcaatgtaggaaataactcagatgtattggaaaccacagaagaactggaaatacaagtggagcctgaagatgtgactcaattgcagcaatctcatgataaaacatgaactgatcaggagttgcttcttatggatgcgcaaagattttttttttttaagttggaatctacttctggtgaagacactgggaacattgttgaaatgacaataaaggattttgaaaattacataaacttagttgatcaagcagtagctttgagaaagtttgagaggatcgactccaattttgaaagttgttctactgtgggtaaaatgctatcaaacagcatcacatgctacagagacatctttcatgaaaaaagagtccagtgatgtggcaaacatcaccgttgtcttagaaattgccacagccacgtcaagcttcagcagccgcaaccctgatcagtcagcagccatcaacatgaaggtaagaccctctcccagcaaaaagataaggatttgctttattgcagtgggctggaactgaatctgcaatatctctgaggtatgtcagtattcattttctactgccattataataaatcaccataaaaccagcttaaaacaatatccatttatctcatagtttctgtggttcagaagtccgggcacagcgtagctcagcttctcctctgcccagaatcccaaaggccaagatcaaagtccagcactgctctgtggggctctggagaagaacctgctttcaagctcattcaagttgtagcaaatttcagttttgtagggatgtaggattgaggtcccttttccttgctgtctacctggaggcacctgtactccctgcctgcttcacagccagcaggggtgtctcaaaagcttctcctgcttcccctccatctctatgcatgcctccacctttctcttcagccacatctctctggttgcttttaaggtctccaggggtgagtttggagagcctccctatttgaggtctgtgacctttatagctgtagctgcattcgtgtttaatggcataactagaggacagaatcttggaggaccctctttacaattctgcctaccacaataaatatttttagtgatggagacattattttaaaccaattcactgaggaccaaagagggctctattaagcaactcaacaacaacaaagagaaacagatttgagacaaacataatttaaacaaagctagaaaaggctttaaaacatcttttagcatgccttgcattagtaagcacatgtgcaaatgtatgccatcagaaggctatggtaatatctatttagaagtgcaccaccggactgaaatctagactatgttgagattgtatttctcaatatttctggtatagtaggtgtctaagacttcttatcagttatttaatacagacatttaaatagttgatattgtttcacatatatgtatagacactacagtgggaatgtctagttttataaaaacaaatctatttggtgccactaatacatgaaattttgacaggtggcagaaatcaaatgacatttacagaaattcaaacaaaatcttcgcttaatattactctcctttcccccacccttaatcaatcttgaaatgtcaggctgcaggcagccactgtgtctatttggaggtggatactgaagctgacctcccagaatttcctccttccatcccccttggcaacaacagcagtttcttatttttagttttctgggagaggaagacagagagagagagagagagagagagagagagagagagaacactgaaactgtatatttctatgagatgctggagtctgataggtcctttgaagaatgaagatgcaaaaatattaggttgatgcaaaagttattgcaattttttccattacttttaatagcaaaaactgtaatttcttttgcaccaacctacacatttttcttttaatgagatgataagcatatagagaggggtcttgaaacagctagatgccttttgtgttattttggggcttctaggctgcctttctgctgccccctaaccctcccttcatctcctcatccacacttttacaataaccccaaagctattattaatattaaggaccaataaaaagttggtagaatttagagagattgaaaatattttttatttcagtgaaagttaaatatctggtctagagaaatactcagggtataaatatgtcaatactttcatggctgttctcataaaactcagctccaaattttagctaggaaaaaacagcagagtgtcgatgaagagaagaatgaaatttcaggattcctgaatgaccactaaactaccaatgcatccaactatgttacaatagccacaagcaccggcaaacagccagccagccaaaggctgtggcagcaacgtgggctgccaggacccttgctccggccccatgccttgctctctttccataaagggggtcatgtgatacaaccgtggcaatgccacagggcagaatctgcagtgagttcctaaggaagcttttgcctccctctcctcctgcatgcaatggggagctgatggctgcagtggctgcaacgtggacctgactatgaagcaaagggggagagaactgcagacgagctgccttcacacaacatcatgaatccatgccaggaccacgtaccccgacctttttgttatgtgaggaaaatcaccctctctcgggtaagcatctgtagttgggttcgtgctgcttatggcctccaatagcctgaatggtaacacacacttctcaccaggactccctcagggtctcccgtctctcttctggccgctctctctccccagccctcctcctagctaccaccccttgctgctgatgcactgactttgatgctctgctgaactctcgtgtggcctgtcaacttgcctgaactccctgtcctgctctgttcatttttactccctcctgacacatagctctgtgtgcttctttatttggtagcctttgcagctcagagtaaaaggtatttcatttgcgaaagcaacacaacacaacaggtttgcctcctgctctccctgcaaggggaggggccggactcatcccatcccttttaaactttaaaccactattaggactgctgaagggaaaattagtgtgtaaaaataaaatgtccccagtgatgtgcacacccatttttccatgtgttcttttttttttttttaattatactttaagtgctgggatacatgtgcagaacatgcaggttcgttacatagatatacacatgccatagtggtttgctgcacccatcaacccgtcacctacattaggtatttctcctaatgctatccctcccctagccccccaccacccaacgggccccagtgtgtgatgttcccctccctgtatccatatgttctcactgttcaactcccacttacgagtgagaacatgtggtgtttggttttctgttcctgtgtcagtttgctgagagtgatggtttccagcttcatccatgtccctgcaaaggacatgaactcacccccttaaggctgcaaagtattccatggtgtatatgtgtcacatttgctttatccagtctatcattgatgggcatttgggttggttccaagtctttgctattgtgaacagtgctgtagtaaacatatgtgtgcatgtgtctttacagtaaaatgatttataatcatttgggtatatacccagtaatgagattgctgggtcaaatggtatttctggttctagatccttgaggaattgccacactgtgttccacaatggttgaactaatttacacttccactatcagtgtaaaagcattcctatttctccacatcctctccagcatctgttgtttcctgactttttaatgatcaccattctaattggtgtgagatggtatctcattgtggttttgatttcatttctccaatgaccagtgatgatgagctttttttcatatgcttgttggccgcgtaaatgtcttcttttgagaagtgtctgttcatatccttcacccactttttgatggggttgattttttcttgtaaatttgtttaagttctttgtagattcttgatagtagccctttgtcagatggatagagtgcaaaaattttctcccattgtgtaggctgcctgttcactctgacgataaatttctttaggtgtgcagaagcttcttttggtacttaaaatatttttagtactgcattggcaaatcaggaaaatgctgatgagaagaaaatgtacttgctccgttattaacaatctacatttcgctatacctttaaaacagactcattgaggttttagactcaattactgtaaagccagcatacagtgtatgggaccaggaacttgcacactgtgtgattaccacagagttttcagggaggaatataatgacaaactttagtgagatgggtttgtggtatttatattttttcttatttctttttagctaggtgtttctcatatccaacataagtggaggtttgaataagctaatagattatacaatagatttgaaggtacaaacatgttttacatatgaaatggcatgggatggggggcaacctattacaatcccaggaagccagtgccagaactgccaatcggaagatatggcctgggccttcctgttaaatcggtagattccttgtctattagaaaatgctttaatgtactcatcaatgaattacaacaaaggaaaaagactgtgagaaagtaaaatccttaaggctcacctaaatctgaccaaaatgtgcaggtagaaccagtgtatgggacaccaaacgggtgctgtacctctccacttccacactgaagcttggaattatgtatgatcataagaactactctgtgttcatgacaatttgcttaatcaatgttactttggatttactacacatgttctagcaaactgcaacatatatttttttcctatcgtacatgaagtgtttggtgtggaactttattttatatcccatgctcgttaattccctaagcacagctcccatttttcaactgctgctttgagaaaaggagttatttggtttgataatcctttccctctcctgaccttgttgccccaggatatgaacaacttcaataagcaatgcacaagggaagtactttgtgttttgcccggaaagccacagaatctttgaatgcaacagacactctctcaaggtaaaagactatgtccaaatttttttttgcttgcccaaatttttccccagcttttccttttctctctcacttttctttttccagaaaaataccaaaaaattaaactaaaggtttattctcagtattatgcccaaacctacctacaaacaatacatcaatataagactaattgtgcataaaattcaaattctattgcactgccgcataaaaatgcaaaatgctacagtggtataatgtctaatgctgagcccagttccataagagctgccccaagacagcttgtacagatgcaattatctctcacacactcaaactgctttctttcacaacattacttttattatgcaaatgtataaatctaattttaatccaaaagaccatctagaagattaaaaccgcactcgtgtcttactttcactaagtgtaattaaagatactaaaaatgtttttcactggaggaaggattttagccaccaggtcaagaaaccacaaagggcgccatggagctgccaagctgacttcgcattcatcttcattcttgagtggttctggtgaagcagaagtgatagaaaaatgagccacagtagcagcagttttcggcagagggcagcagatgctcttcacttggaagagacagaaagtcctggcagagcctgaagtggttctgaatccgccgggtctgaaaggtcattttgttaatcacaaaaaggctgaagatctacaaggtagcaaggacacagattgcctggtttcacagacatatggtcaccggcacaagaatttttggcaagcctgtaaagcaagcctttacaaaaactgtcttcattaaaaaaaaaaaaaaaaaaagagtgacgcaatctcgatgcccagagtagctaaggccaccatagggaaagtcatttgctaagctgctttttttttttttttcttctccttactttcctgttttactgttctatatccaggtaatggtagttacagcagaagttttttatttttttcaataggtctatcaataattgttacactataaacttttcatatgataaaattggtaataatgatatctatataacaataactaacatttacagggttcttacttggtatcagtttaagctctttgtatagatagttttattttaaatctcacagtgaccctgaaatattactattaccatttcctaaatgagagaactgaggctgagagagcaatttatccagtcacacttggtatgaagcagcagtagcccttgacttgaattggggtctctgagacagcagagtctagaactgtaccctccaatatggtagctgcaagccacaagtggttatttcagtgcgtctatgctgaatggagagaggactgtgaaatacatgctggattttgaagactctgtgtgaaatcagaaagtatctcaataatttttacatcgattacatgttaaaattataatattttggatgtattaggttatataaaatatattattaaaattaacttcacctttaatgtggctattagaaagcttacaattctataattgtataattggtacacattattctttttttttttttttttttttttttggagatggagtcttgctctgtctcccaggctggagtgcaatggtgtgatctcagctcactgcaacctccacctcctgaatttgaacgattctcctgcctcagcctcctgaagtacctgggactacaggcatatgccaccatgcccagctaattttttttttttttttgtatttttagtagagatggggtttcaccatgttggccaggctggtcttgaactcctgacctcaggtgatccgcccgcctcggcctcccaaagtgctgggattacaggtgtgagccactgtgcccagctggtacacattatatttccattggtcctgttggctttagatccttgactcccacgctgtacagcccattgtcccaagacaccttcttcctcgccattctcaggaaaatgaatgacgttaaggaattctgtaaaatttctcgacctgaaccttggtagttcctctcactgaattgatttgtttgataggaattatgtcggatgtaggtatcacatggaatggaaggaggacagaattcagggataagagggaagaaaccactactagcatcacctctcactgtgtagacaggaacatcagaggaatccgaatctccactttgcatcgacatttcctggacaggattacctctcaactttaagactccaacttctagagtttacatagattattggtcaggatagtaactaagggatccaatgcgtgaatatttgaacaacctacagtcatggaaggaaaatttttgttttgattcatctatgttaaaaaaccttcaagctcttcttggcaagcactgggccagagacaacgtgtctttggtttacagagaagtttccccatctttttcttttatcagcacatctctttcatttcaacaaagattctcaaccaggaaatggtcaccatggaaggcagtgagatggaggataggctgtataattccgatgactatccagggggattctggcaaggtgcctcctgtccacctttatgttcggtgcttcaagggctcacttgagtttctgcattcttctgttgatgcttaccatcaatgcccctgacagcctgggtgagggtgcaggggagaggctcaaaggggccagggttttgctgtctgtcatgtgccactctattagtcaggcttctccagagagacagaagcaataggatagatctttaggtagataaagatacatatatgaggggagatttcttagaggaattggctcatgtgatgatggaggttgacaagttctaggacaggccatctacaagctgaagaccctgggatgctggtcgtgtggctcagtccaaatcccaaaaccttggaaccagagaagctgatagtgtaattctcagtctgaggctggtgggggttgggtgctgatgaaagtccttgagtcccaaggctgggggtcctggggtcctgatgtccaagggcaggaggaggagagtgtatcccagctccagtaaagagaaactaatttgttttcctttgtttttcctctatataggcccccaggagcctgaatggggcccgtccacattaagggctgatcttccccttccccaatcaatccacttggactcacatcccaacctcctctggaaacaccctcacaaacacaccccaaaataacactataccagctctctagctattccttaatccagtcaagtcgacacctaaaattaaccattacagccgcacattttggttcataggaaagaactttaaagctactgatctagttaaccttgctggtcacccataaatgagaaaggatgtgaatcaaggaggaaggagacgtgctctacaacataggccacccacactcactcctagtatgttaccaagtgacaaattcacacatcacattccattgtagaaaaaaaagtcacttcttaatttcctcaatatctgatctcaccttccgcttaagccaccctctgtttttctccccagagaggatgccttaccacgtgtatgccgcctatctcagtatctgctggtgtaacgagcgcttttggtacctgttaggccccccgtctccaactcctcgcacctcctttccaaggtggtgactgggtcctcatggtgagtgagaggaggggtccccaggctgtttgcagatggggggctgccctctattcctcaccagctgctgcagtagtggtctccctgtcaccacctgctctggctgctaacttctttgaaaagggaaagttctctctttgcttagggctgtgtagcctctgaagatctggccgccattcccattcaattcctgggcacgcaggtctgccccgtaggctctgatggtaggctccgtttgctcagtagccagcaccaggcctgcccctttccagcgacctccctgcccctccccaggcccctaaaggaggttctgggagctgtgcccaggcattctctacctgaagccactgtgctcctgcctggccactgctgcagcccccagcaggaagcagagccacaagccctcacctctcatcctcccccacactctatgcagccttcttgtcatggacacaggtcttccctccaccccacagtccatgtgagcctgaaagagaggttctgttcctcttctgtctcttatctgaccagagctgccactacctcatgccctctcctgggattgtattaactttaggcttctgggaaagttgatttatgaggaagaggaagagtgagaaagaattggagaaacaaaagaaatcagagaacttgacaattttcttgttccttctgaaatgaattttcaaggtgacttattattctgtttaaaacactaaattctcagaatgctatgtacttcttggtgctaacaaactgaaaaagaatcacacctacatcaaacctatgcagtttggaaatcatctgctcttgtggctcatctgcgttgctcacttgtcttggcaaaagcatatctgagttggcaatgtctcttttcttttccgctttttcttaggctgtctatttcatgtgctatagctatttacaatagattgcatgagccccagcctgtttctaagaaaaagataatagaaaaatgtgtataaaattgtaaaaatacaatcatgtacaaagccatagttaacactcgagagcctatgggtgagtccactgagggcacctgccaagacccttaaccacagaagtctgagatatccccaagctgggactcccattactttccctattctggctctctggtgtgcttcctactatgatatcctagtttttctgcctctcttcaaccatgttttcccttaaaaaagatgtatatacagacataagtcttgtaagtgaatgcataaataatagatacaaaaaggattttattgtagtattccctagcaacacaaaaatatgggtatatacacttccagtgtcacattattcaggatgtctttttaaacagtataaatattatcctcaactgtaagcaaatatagaccagtaagggagcgacagacagctttttaaaaactgcttttttgaaaagcttatccaaatcaagcatttgttatctttttgcaatgtcaacagagctcttgaataaaatattagattatgcccctgctttttaatctgaaagtcatgtgggttttggttttgtcataactaccttagtgcctgtgtatactctctaacacccattattttcctaatgattttatgaaactacattggttttgcagatgagccaaaaatgggtaaaaaggaaagaatgaagacataagtaaaacagaaaacatggctttggctaagaaagcaccttttcttgcactgtgctttaatattcagtaaacatttggttacggttaaaagaaataagaaatatgtatgtttatattgaactggctaatttaatggctgctttgacttctactaaagggtcatctaatatttgataataaacacaacacattaatttttcacttttctttgaattacgggaaggaagtcttactatgaaaagcctcattatgaaaggcctcagtctggtctcaaatccgcagaaattatactctttcctcttgacatcttgtaataaataaaactgttaatattttgactttagacaaatttctcttttgctttcagcagctaacagttacaaaaagagacagtgccacattagttacagtaatttactttggggacaccagcagaaacacataaaattcattagtggcgccaaaagctatttccagttctaataaaaaggctaaactacaatttatgaaacgagtcttaaaactttcctgaagacagaagagttgagatgatctttggaataaccaaagcaagaatccctactgtacttaagccaaaatgtttgttttcacaataccgtaacataatgtgttaacattaaaatactttctcattgccaaatgaatataaactggggagatgctctctcagctcatgctcttggtccattaagcccgggttcctgcctctggcagtgtttcatgcttcaaagaaaggcaacaacaacaaaaaaaccttataagcaaaattagaataaatctacagctcttatgatcaatcatgcaaggttagcactgggagaaaaacacattcgcttctgtttcccataggaatcgcatgcctctgactttgagaccttgggaaatacattttcatcccacaggaaactcaaggttgcagatggacacacacattctactaatatcatttttatttaaacagtttggtctgataatttattaaaaagtgttccctaaaggaatgatgctgctactaaaaacattttcctgaattacttttaatctaaaaagtgcttgagaagaaagctggaagatacgatagttgaattcctacagaagccttgccttctattaataatgaacacaaaatatttggaaaataagacaatggaaataaattgaaataaacaagttggtctgcactggtctttcttagaatacattatgccattcaacacttcttatttagaaatgtctttttccaggaaaagtcctatgccctttttaaagtagatgactttcaagctactataaagacacatgcacatgtatgtttattgcagcactattcacaatagcgaagacttggagacaacccaaatgtccatcaatgatagactggattaagaaaatatggcacatatataccatgcaatactatgcagccataaaaaaggatgagttcatgtcctttgctgggacatggatgaagctggaaaccatcattctcagcaaactatcacaaggacagaaaaccaaacaccatgtgttctcactcataggtgggagttgaacaatgagaacatatggacagaggaaggggaacatcacacatcggggctggttgggggatgggggcctgggggagggatggcattaggagaaatacctaacgtaaacgacgagttgatgggggcagcaaaccaacatggcacatgtacacctatgtaacgaacctgcatgttgtgcacatgtaccctagaacttaaagtataattttaaaaaatcaataaaaaataaagtagatgatttctcaattatttcttctgcatataacccatcgttgaggggtaagcgcagaggagcaatgtggcggctacgtagaaccacttcttaaaggggagagtaacatctaacactcgtgctaagatttccatgcaatcatgtgcacaaattgccagctcagggctcagcacacaagtgtaaaatttaaaaatgccagaacatttctgctcaggcctattcataggccaggcctccttaggtttattgatacccttcccttagtcacaaaatttccttacaaagggcctgtggaatagcagttggaggccaaaggtctggccaccacctaataagaccccacccaaagtcatccagtataagaagttggtttcattacagtataaagtaaaattaaaggctgattaaaagcagcagtttacatctgtacatcatctgatctaatttcctcattcctgatgaggaaactgggccgtagacaggctaaacaaattcctcagaagttaagatcctatatgttcctggtgcggttcactgtgtattcctcgccgtgcacacagtgtcaggacagggcaggctccaactccttactgtttggtgaacgaataaggagggaaccagcctgttttggcgtaaccagcttactggctgtgcggctgttaggattcagatttcctgtggctttttactctctactacacttaccaaagaaaggatggttctggaaagcatcacagtgtgacacagatcaagtgcagaccgaactaccacccatgtgtacacgaacaggggccagtgactgatgatgcttcaggtcccgttagtgggcgccagtccttccttcaaccattaaagaaaaataaagggaacacactgatattttttcctttcaactgggtgcttgctgacctcagagtcctagggcacatgtggttgccagactgaaagaacacggagcgtgtctggaggatgccggcaaagctgagaagccaaactctggctgcatccactgatatttacagctttgccagcctaggctctgctcccaccactcttgggtcagacccgcagaccctggccaaatgatggatgaacaaatgcactcagacacagatatctagtgaaagagtgggttagggaaccgggccgcttacagaccccaaggagggtactgtaaagagtcagcagccacggctggctggtgccgcaggcatttattcagcacaaatttaatgacaaaggctttgagtcaacacacttgtggataattaacatggtcaccctccccccaccacccagagcagtcctgctcgcagacgattaaaggccaggttctggggcctaagtaaactcacttatctagatcagtttctttacatccccttgttacctaacctaagctcttaagagaattcagctgccttcagccaaattttctttagaagctttgcaaacccctggccttccaaggtttgcatctttctacaattgttcccaccaccctgaccaatctcctacacaccacaatatgcattttctcaaggcattctgctgaaggaggtacagcatcggagaaaagcctaggaaacagagggccccgactgccttatcagtcatgctaagatgatcttaccaataatgaaataggatctactattatgtgatctaataaagttatacttttttgataaataattcagcaaagtttcagttttctgaatcaaagggcaactaaagtacgtattattttctgaaagaactctacctactttaccagaaagagaacaccatggaatatggtacacacatcactgtgtcatgtgatgtacagccttggactttacatgctacttaaaatggattaaaaacagtgtttactataaagaacaagaggagtgtagcaagtgtcatcaaatgctttcataaagcccatcgccagacagtcagttacaaacactgagaagacctccaaaggtctttatttgtggcggagagttctaggaaagatgggtggaacccacaccaaaagacgtgctgctctttggggagaatgagtggtgtttcatgtctttagctgttgatatgtttgatccccaattcagggagcaaatggccacatcttttgtgtggaccccattggtgcagagatgagcctgttctatgactgcttccaatgcaccagggtgactaggataactctcagtgtatttctgctacatcaccttgcccttcattcagtaatgatacaaagatggaggttttcaattaaaaacttcacttaggaataaattgtgtttcatgggtttatgatgccctaaaatgtctctgagaatttacacttccttttttattttttattttttggcttgtgggtatttgctttgtgggcagctgcaaaatcggtattagccaaaacaaactgataattaaacaaacaaacatgatggtgtcatgtatcatgtcaattagagtaatgttggaaaatggaagtatacaatacttctaaatattgatttattgctctcctttttcttattctatagaaaaactagattaaaaaatcaatgtcatttacatgattttagtccaataaagagtgtaataatttggctgttcaattaatttggtttgaagaaatgagtgtcttagtctgctcatcctgctgtaacaagatactatagactggatggcttataagccacggaaatttatttctccaagtctggaggttgcaaggccaagatcaaggtgatggtggagtctgtgtctgatgagtgctgtcttcttgctgtgtcttcacacggcagaagggatgagagggctctctgagttcccttttataagaacactaatcccattcctgagatctctaccctcatgacctaatcacttcccaaaagtcccatctcctaataccatcaccttgagggttaggagttcaccatatacattttggagggacacaaaccttcagttcatagcagtgggtaaacatttagtgcttgaatatttgctagtgaaaggattaaattccaactagccaagaaggccacaagccagcctttgtagagaagtagagacatagcacttagaagagggggtctgacatctccagagctgcgccagctcttactgcagtaccgttcattgttaattaatgcattcactcattcattcaacagacagaatcgcgcagggctacatttggccctgtggggatgtagaggcgcgtaataggcaggcccttgaggcaggaagccaatgagagtgtaccatgcatgcagataaccagagtgctgagcaggcaatgaagagaaccattcgcaggacacacagctttaattaagtaatttatagttacgggaaatcttcaataattgatatcttgtaagtgggagctgaaacataatgggcaggcaaaggagtgcagaaggcagacacagagctggaagacactaggcactgaggaaaaccagcaccgaggaatggcgtcttcgtggagcatggactggatcaagggatgatggaagaggtggggaaggcaggctagggatgctcatgcatctgggctttgttcaggaagcaggacagactccttgaaggcgtttgctcaaaaatgggacctgatcagactggtgtttcagaaaaatgactcctgtagacatgaacagggtgatgtggatccaggagaagtttagggcaacgctctcagccagcagaatctaactgagaagcaagggaggaggtactgacatcggttagggtgcagtcaggagcgatttcagaagccgcactacaagcctctcccctgcaccccggcagttgctgcccaatcacccctccctttcacctcacctctcccaacccaggctccacattccatcagtcaccgtttaacaggcatccacatttagcccttctgcttaaaacctccactacttgacccgtgaagtcagattatccagtggtcacaaaaggcaccctatacatgactctgccaacctcccacctcctgtcttgcccttcccaggctggccctgaaccacggacgcttttttaatgttttccatcctggtattctcacccaaccatcctccgcactctcgctctgcctgcctccttccccacccacctagcaaatgccaatttgatcttcaggaagatgctgcacataagctcgtgctgaagaatccagttaatgtgagtggagcagacctaaaatcttggggcgatagtggttacctagtgacccacatctttgtgatttgctaatgctgataaaagctttgttgacaagccctttcaaaggcactctgcttccactctgtgacaatagcgccaggtctgagtctctagcttaagggtttgtgaaatgctttcaggtttttcactgaaggagttcacaagctttggtgcaccctgagttgagctgtgtcaatgagctcacatagcgttcattgtgcttacacacccacggtatcataataacagaagccttttcaattttcaatttgattgaatttcaccctgaaaaggcataggtttttactgtgtactagagtaagtcccactcttccttgggaaactcataatataatatgaaagcagagcctttagggtctgaaaaattgagctttgaaggtctgacaacacctaccatctacccaaggaactgccgagcacccaccaataactccctagtttgaaaacgtggccaatcagcgcaactctctgaggctcagcttccctgtagagccgtagatgagatgctttgaagtaactggcacttgggtgacacacacggtatgtccccaataaatggaagttaccattgacatagtttatactgtcatcataatagaatttcagaactgaaattaaataaaccaaatttatttaatttaatgagtttccaaaagcagagagtatcttaaatcttcctgtacttccaagaattacattgttttaagatgtcttttaaagcagtttcagaagtaccagtgtgttgccatttaccagagtcaaattcaaactttcacaaattcatcatctttaagttatggcgctctctggataccctctccgcaggcatccacggttttctcttgtcatcatcatcatcagtgaagatgtttgtcccccaccatgtctagggccctagactaggcactcaggaagagaagcagtgatgaatcaaaaaagacacgtggttctctgccagcaaagggcttgtaaaagaccacacagtgacagtcaaccacttgggaaagaaccacatgacacaggaagttcgagtgtctaaatacaaaaacggttttcttccaaaatgttagtcacagataaaataggatacagacaaaaacaatcctttaagggctgtttgcatccccaggggtgtttgcgggcagcactaccccagaagggtggggccacgctttctaggcaggctgctcctgctaccctcttggaactttgtgctcccagccacagccatggaagaggaagagagggtgggagcccagcaatggttgattgggggtgagtacatcagaataactctgccgtagcagacaggagtgcccaccatgtgccatgcatgagctagtgcttactgaaagccttcaacattgtgggattccatagatagaattttttctgagaaacagttttctgatggttgtaaaggaaacaaattctttaccaagcatttaacatctgcaaagcactagagtaccaataagctctacaagacccgaaatacactagagtaccagtaaatcatgcaagactcacaagtagctcagtcagactggtaagagacaagacaggagaagagtagctttgccacgtgttttatgcaaagtgtcaagtgacaggtgcaacaaatccatggcacaaatatcacaggccctcaaaagcaatgagtgtaaatagaaaataaaataatctggaaaaataattgcctatggcataaggcatcttatttatttaaaaatgtatccatcataatatgaggatgacttcaggctatgaggaatttattggacagttttcattcaatggggagataaaaacgctttttgaaatgtcttgctatctgtagttagaggaatatcctcctcttcttacatttctatttcattttctatatgcagttgctaggggtacgcacacacccagacaaacacacacacacacacacacaccccacacacacacattcctcagggctttttattcattggaaatttgccatagctaaacacagccactgaaataaaaacatatcctgacatgcattcttacccaatttatcccatttaggactgtagaaagtatctgggaagaaaaactaataaaaaaatgtgtaagtcgttaactatttcttgttgagttcttttccccccagcagtacattaaaatggtctgtacaaattgatagcttcagcattcaaagtgcattaaaataagccaaaccaagactgtgcaccaatgtcagagagcagctcctgtttccaattaaaagagactttccagtggaactgatgagtcatggctcaacatggcagagaggtcttatttatttttttcaaattttctttttagttttaatgatagtcacagcgtcacacatttttgttcattagcatagatggggcctaaggttacaaaagctgtggtaagaatcgtccttaattgcaagggttattctaggatttacatgagaaaaaaaaccccataaatggcaacccaggcagacacaggcatctgtgagcatcttataaaatatctgtaactatagtgtaaatggcaaaacgttatctagtcttttacttaatatgacatttgggtgaaattgcatcttgattcatttgatcttgctgtttttctttaatatgaaattagaaaaaagtagtttcacttttgtttttagtcacattttgaaataatagaagtcaaaataaatccagttgtctgaaaaatgtatctgtttctaaatattctataaaccattggaaactgtattagtccattctcacactgctaataaagacatgctcaagactgggtaatttataaaggaaagagatttaatttattcacagttccacagctctggggaggcctcaggaaacttacaatcatggcagaagggaaagcaaacatgtccttcttcacacggaggcagcaaggagaagtacagagcaaaggtgggggataccccttataaaaccaaatctcgtgagaactcactcactatcatgagaatagcatggaagtaaacactcccatgattcaattacctcccactaggtccctcccatgacacatggggataatgggaagtacaattcaagatgagatttgggtggggacacagtcaaaccatatcagaagctttgcagatcattgtctctctctgttagacctatgattatctaattaaatttctattccaggctttgctgtacaaacaatactgtattcatttggcacaataaaaattaaaacagaaatatttgtcccggaaaatgtaaaggtatgaaatacctttcagaaaaaatgcatgtgtatttgtgtgcatgtctgactgcacacacatacacatacactcccaaaggagataatttagttggttttctttgttttctgattgccaaataaatttctctgctgaatacattgcaagtctaccctcatgattccagtttgtcatactgtgtttttatattccttccaattgaggatgttatgcctaaacatacaatgttccaaagagtctacttcacttcatactatattccccttagcaacattgaatccttaagacatccgttaaaagtcaggagcattcagttaacagcttaatagggttgggatctgtagaaatttatcaaacaaattaacattattgacttttaaacagacactgtagacagtttcaaagaatatcacgaggattttgtaaaagccacatcatactgtggatattaaatattcctggtggaataagatagctggcacagttaaaagaaactgagatattgcaaggccaggagcactgctctcctctgttgcccatgaatcttctaaggaaagaaaagtgctttcttgccacttcagagttgtttttggtttcctgaaactgtcataatttaattaaagcactcagtgtcctgcatatgtgacaccatctagttgacagaatcattccactcgatttttctaacaggggacaagatgcaggtgccaggcagctgctcatacagtatgagaatgggaggggcctctgtccaaaatgtctcctgtcagacgaattaaaatgattatgggctaaagctgggtgctaaaaatgtgtctgtgtgtacgtcacatgaggagggggctttaaccaaatggaaaacttaaacacacacacacacacacacacacacacacacacacacacatcccccaccccctaaaacccaagcaactttttgggactcctaagactgtaagtgagttatcgttactgatgggaatgggttctgtcccataggtgagtcagaacggagaaacggatgcctgtggcaaggcagtgttgtcagagacagaaagcacatccccttgtcggcctgtaaccacaaggtctggatgagctgaataaaaagaatagtagacacccctggtgagcgtccccgcagatgggctcagtccccctgaaggcctgtagcagggcagcgggagggccttctcaggctgagtgggacctttccataggcagacggtgctctgagcctcctgtatacagtagaatgggctcagcactgacctgtggcaactcatgtaatccccacaagtatctccatcttacagacaagaaagtgtgttcttaggaaagctaagcaacttgctgcaggtcacacagctagtaagcactagggtgtttccaaagcctaactgttcaatagcactcttactttctactcaactcaccccaagaacaggcacgaggactcaaggagagctggggatcacctggacacgaggatggaagttgaggtgggctcgccatcctttggggttggtcttcccaggagagaagagccgtggaatttacctggagatgctctgtcttgggcctcaccaatttcgaatttgttcatcataggctgccctccacattagtaggcttcaagcaggtcataagaactcaaaaaagtccaactaatcaacaaatgcgagtactttcccttttaaaatactttttcacaattgagagaaaggaagagaagagttaaggatctgctgagtgtggcatttcctcagaacttctgtatgtcttctccctagagcaagctgtgggcttcgcatagcatccctgttctcaccccaaagaacccgaggccaggacagtgatgttgaagcgggcagacggtgaggccgatgctccttcctcagggccgtaattaaaacgggagacttaggagctggcagaatccttgggaatcattttgtctgacctccttattggagataccatggccagtgatagttgataatttaccaaaccccaaattccttagtggtgaagtagaaaaaagagtagatttctggtttctaatccagatctctgttccttatgctgtaaataaggtgcaaacaaacaaaaaacatcaaccagaaaaatttaaaagccaaagagaaatcattttggaatatagtagaatcgcttctctacataactgactataatcaaagaacaggtagactcctgttcaaatgaatactgttagaacatctggtcttataaaatgagcctatttacatgtgctgacagatggcccacagtgaaaatgctttgctagtctgattacaacaaatcctaataaacccgaatcctctctcaggtgccttcctcagcccccattcatgtgagaggcaatctctattacaaggacatcggtgtgcaggcatttttcaataatttgccatacaactctatctgagcatcatcagacgcactacattgaaagaatcccggattttatgcaaagctatcttcattgggttttattttgctgctttttttcctggaggaggggcccggtggaaggaggttgacagctgcagaggcagtgactcagtgaaaagtggagagttccagagtcccaggtaggtgaagagcttgggggccgttgaattggtgggggattaatgatcaaggaaatctcagaactttaagtaactaacgcacttccctagacaatcctgaaagagctctaattaaaaataaagtaaatgtgtccaggcttttttgatatttcatcaaatttttgcaggaggggaagtgcttgtaagagcccaccaagggctgaatgtgaagacaggtgccccttcatccacacatgccccagggctgtgtcctcaaccctgacaccctgcaacctccttcagtcctctccatcctggtgcccccgaaacatgagtctcccatctcgagtctcccaggcactatgagcaggccgttgtgctgagggcagcacagagctagagacaaggccaccctgacaaggcactgtgctgggcatgtgatgtgctgggcacatgacagcactcactatgtcagcacaggacagcctaggggagccgcatgtccactgcccctgctctatccacagctctgtgcaggatgtgcatatttgtctcccagccctgatttgtgggcaggaggctcagagaaagggctggcaggggccagagggcaggagcagcgggcaaggctctccctgccacctctcgcaagggggctgtccattccggagacactgggccggacctctgtggatataatcccctgtctttcaggctgctgctgcagctgctggtgaacagtcatggcatgggggctgctgtgagtgaaagcagggagcgtggtccttaatgcacatgcgggagtgcccctttgatacagagttcccctgacttaactatttgcaacgaaagagccacttgctcctgtttcggaatgcccatgggaaggatggaaatgccaaagagcaaactcacaaagccactgtgggaggctgaggcaggatgatcgcttgaggcaggagttcaagaccagccagggaaacatagccagaccctgtctctatgtatatataaaaaaaatacaaagtcgagattaaacaggaggcccaacagaaatacaggcctgtggtccacacaggatgtttacaggctgtttcagagcttcagtccgacctacagaaaggcaggaggagggatgaccggccgcacgtcaacagctgtaagcacactggagaactgcctgagcgctcaggtctgttcatgttcattttagatgaagttttgcagaaaaagaacacctgttaccaaaagtgccacgccatcacataaaatgcctcatcagaatgtatcagccactgcagctctgagaggctgatggagcacgacctcataaaaggcttgaaatgaagcttaaagtaaatccctgttggtggaagaggtaagatgtttttataaaccgctaaatcatgctgaaattggaagtgtgtctgctgaggatctgaggtttttctaaggtattcatgcatgtaggaaatgcttctgagggtcccttcaccttggtgacaccatgcttctgcaccgccacttaaatgtactaggtgtgacttgggagtccattaacgcctggcaggcaaggaggttacatcatgggaatccatttcattaccataaataaatgtcatatggctgccatacattttattgattaaactgtcaagaacaaaattgtgtaagaacaaaaactttttattcctgtggcaaaaaaaaaaaggagggaaagaaaaagaaatgaaaatatctacataatttaatgtctctggccctctaacttcttacccagaataaaagaacaaagcccagcttactgctcccttggaggctgcagcacgacctgcctttcgtgtttctacagaacaaggtagccttttctcctctgcgttcccaggcctgttgtcaactctaaagaattgcttaaaagcacctcttcaggtagtagagcttatcttgagatgaaactaaaaaatagactcatttgccttttatccttaaaaaaaaaaaaaaaaacttacaggttggtaaaaagttaagttctttggattggccccaattctgtttaggatacagtttttctgcttcccttacttgagagcaaatagctgttgacctagaggcaaaatttgggcgtgctcccagaggggaggtggcccaatccaaggtgactgatcccaagtgtgactggggcaaaggtcttgatcccaggtttcctgtcaaaatagctagaggtagagttggctttccatacagtcttaaacttttttctcttgtgcttgcttttatttttctatccccttattgggccagggtattttttttcagtccaaggacaaacaatgcctcccaccatcacagataataattacaaaactttacctttgcacagagccttgcagtctgcagtgatattcacccctggtttttttttttcgagactgaatctctctcttttgcccaggctggagtgcagtggcacgatctcagctcactgcaacctccacctgctgggttgaagccattctcgtgcctcagcctcctgagtagctgggactacaggcacatgccaccatgccaggctaaatttttttgtgtttcagtagagatggggtttcaccatgttgcccagggtagtctcgaactcctcagctcaggcaatcttcctgcctcggcgtcccaaagtgctaggattacaggtgtgagccatcgtgtccggccacactgctgattttcttaaacaatcttgtccatctatgaaggcattatttatccctgatttacaaatgagacagaggctcagagaatgacttggcagaggtcaaatgccaggaagtcctacagctgggactagaaatccctagtaatatggtttgactatgtccccactcaaatctcatcttgaattgtagttcccataatccccatgtgttgtgggagggacccagtgggaggtaatttaaccatgggggcagttaccctcatgctgtttttgtaatagtgagtgagttctcacgagatctgatttttttttttttttttttttgagacagactctcactctttcagccaggctggagtgcagtggcacgatctcggcttactgcaacctccacctcccgggctcatgcaattctcctgcctcagcctcctgagaagctgggattacaggcgtgtgccaccatacctagctaatttctgtatttttagtacagacggggtttcaccatgttggctgcgctggtctcaaactcctgacctcaggtaatccacctgcctcagtctcccaaagtgctgggattacaggcgtgaaccactgtgcccagccgatctgacggtttttcccccttttgctcggcacttctccttgctgccgccatgtgaagaaggacatgtttgctttcccttccgccataagtgtaagtttcctgaggtctctccagccctgtggaactttgagtcaattaaagctctttcctttataaattagccagtctcaggtacaactttattagcagtgtgagaatggacaaatagacctagtctccaagtgcagagctccttctagactctgctgtggtcaaatgaccattggggatcagtccaatgaccatacaggatcgagtacgttcacatcttgaaaagcaattgttagcgcaacgtcggcacactctcttttctggcttcatctttccccatggagggtcaccaggtagcagaaacactcctggcctcgcctgtactcctcactccctcttccccaggaaaggaaaaaggagtgtttgaaatttgggagctaaacctggtggtaatgctcagccctggtcctcccacctcctcaaccctgtttgcctgcactgtacgctgcctggactgcacctccgggaaatatgtttgctagagacagcccagccccgatccagccccatggagagggaggcctcaggtgtctgccctgcacaggactagagtgagagccagcaccaaccctctgtgtatctttgccacattctccattattagtctttttagtcacagtcaactctgtctcagttggttcagaactcaggcaaggaggaggggctatttattggattccctcatcctgtaacacaaagcagttgatatttttgcacaaggcgcaatgcctaccaccccatcaaattctgctctgtgggggactgctgactgtgctactcagaataccatgaggctgcttctagtaaaattctttcccagatgactaggggctccagagagatttcattcaaaactgttggcaagtccccagggggcttgagtccttcaagaaccagagctcttttaacgtctcctggggactgcagtggtcttgtgcttaggctaaccagcactgtatgtattttattcttctttcacactttttgtttatttccaaccacttaatcctttttccattaaaattatgcaaaagcctcactttcctcattcatatgaaaatactttttcttctcttccacccccagttttctggttgtagttttactcctaaaatcagcaagacttgtttcacataatgaaagaagctattatacgtcttaaaaacttgcttttcattagcttctaaaacatatacagataaagtgaaaattccaaaactttatggagcattttagttttatgtggtctggaaggcactcactggggtagtcttggagcacatatgggcacctgggcagctgcttatgcttagctgtgtcgcacagacagatgtgattattagtgtcaattagtctcaactggtatgaaacaagagacaacgagatatggaatacaaaatattggcctacataataggttacctcttcagcttgagaataaaaagggagtatatcccactgggactctggcagcagtggtcgacatcctattttttgaccaggcttgagttgacagactcagccacggcctttaccaccgaggtttctttcaggaaaggaaagacaccaagtgaagggaaactattcaggctggtggcaccaacagcaacagccacatcctccccagaactaacacagaattgctgtattttacacagttttctcaggttagtgtgatcaactggagaaaaaaagctaacaattatatttctgagggatggaaataaagtttaaagggtgctgtgctgaataaattaactttataggaagggtacgtccagtgatctttcgaagccctgagctcagcaagaaggctggaaagccggctccctgcaggaatgaagccacctttgcgaaagtataactgagaaaattattatagtgaaagagatctgaccaaaccaactccatcttccttctcatctccaagctatcattgttcattcccgggcataggacaaactgactttgggagaaacttagttgataaaataactttgaaacaaagacggtaacagcccttttccaaaacaaacccccttcctgcctagggactagactgcttttgcaggacacaataaattagctacaaggttagaaatgatggtttaggagtcatgcagctggaggctgcaaaattctcaaccttctgaaattgctcctgggtataacatcattattgtaaaacctaaaatctgtgcttgagagattttgctgaccctgcattcaatggatcagttgggaccacccagatggataaagtggctcatctggtcagaaaatgactcagcacaagagggcagctttgatttcatttctccctatgatttcatttctgaccaaaccaatcagctccccacttttcaacttcttacctaccaaattatccttaaaagtcccatccccgagttttctgggagactgacagagtaataataaaactctggtctcccgtacagccagatctgtgtgaatgaaactctttctctattgcaattccccagccttgataaatcggctctgtctaggcaatgggcaaggagaacccattgggcagtataggatgaggaactcaaactcttcatctgatattttgcatcatattcagaatactttcacagccccaggcaaaaaggagtgtaacaaaggcaaagtgccctgtggcgcttaaagcttctgtgccatacaccatcctgatgggctgggtagtaccattcctgtaaattcccttgcagacaacattaaaaggcaggccacctaccaatgaaccaagctcattaccaaacatttcccaacaatgttgaagtttctgctagtgtaaagagtttacatacttcttttcccctccagtgtggggaagcaattctctaagaaagaagtttaatttatgaatgtctggctgccacaaaataataaggattttcccccactactgtagattaaattatcttatgaaatggattagaaagcaaagggtctgtcttatttaaaataataaaaagaaaaaatctttccaagctgatttgaaaatctacctagaagtcatttagctgtctgttccttttgttttagtatttccatctatcagggaattagttttgtccataaatgtaatcaatatggaatataaagtcatcaaattaaaaaatagatttagagttttcatgataaagtgtacctttaacttgagttaatacaaatgtaaattagatatagatatttgatgccttgcttattgcatttctttggtatgtgacagaaaaatgatcacagtgcttattttaattaaaaatttgttctctttctagaattattgtgatatttatggactgtaatagagaatttctgatgtatacaagaacacaatatcctctttcattctggaaatcaaaaggaagatcaaaggagtcttaactgagttactagtcaatcactttttaaaaaaagacaaaaaataaggtgtcaggtgtaacagagaggtctaagaagtcagtggaggtatacacatactaagtacccacaaaaattttaaaaactacaacaacaataacaacaacaaaaagtcagtggaggaattgggagaagttggaaaaaagaaaagccaaaataagaatttctggtgagaagagaggcagagccaaggatagaaggaactccttactatgatgtaaatgtggtgggttaatcagaaaattgatgcatgttttattatttctaaaaacatttaaacatacacttatatagcaatcttttaatggaagatcaaagcctgttttattttttaaagcatagatctacttcttggagtgtccagtcatcattcttttaaatcagtctttctagtttctggtttcaatttctttaaagtaaaactaggacataaggacagtaacaatgcaatctgaagtcagaattggtttcgagttttagattctttcatttttatagtaattctgcatgcaaatagctcaacaatagttttctaataagcctgctttattaaatctttgcaaatcactcaacttagttttttgtagaaacacttcttttttcattgatggtttcctggcttacttgatttttttaattaaattaagaaatccatattaagcacaactagtaaaaacaggtctgcaaaggaacacaactgacttgttaaaacacacaattaaaccggagggaggagaaatgctgaagctctctagtctcaaatatttagcatgctatggacatcactagggatgtatttcagaggaactgaaggatgttggttaacttgtgagcctcttctatatacattgctaggagaacattttttatgctactaaatttagataactcaaattcaatagtgtttactctcggaaaaataatatattctaaatggacatctttaaccaaaaagttaaattcatttaaacataggccagtgaacagatattaagaagtgtatattgcaatctactttatttaggtattccaaagatgtcatataactatctctcaatagctaagatgattcagttcttaaacctggctaacgcattagatagagagggacatcagtgtcatctcaaaaattatctgaatcttgagttttataccatctattctcattaatctctctcgacccactttttactactaaaacaagtaaaattttttttaaaaaaactttcatattaggcataataataacaacaatgacatttacaaaattacttccatggcataaagtactttctccagtattatttatttcattagcattgattgaatgtctgttatatgccagtttgacatgtgaattttttttagcctgtcttaagatatcttggtggggggggccacagttcatcaatgccagaggagcaagtaaaaaactattaacttcagtagctgcttcttgtgacaactggtagggtcccgcaggaaggagaatctttcctccaaggtggctcacctccaatctcagagggaaaaagcatagtctttttgagaggggttctaactcttggctgtgagcaatgagggatgcttggagtcagctaattaggaggcttaaaatttggaaaacccaaattccctgacccaaactaaccagactgttgggtgcaaagttagggattcactcaggttagggcatttatctacagattgatcatccataaaaatggtatctggatcaggctaggaaatgcatgtcagttttgaaagacatgactcatcttgctgttattgtatgtgagagagttgcatattagttaaggatagtctttgaaggtttataaatgggaagaaagtacatttggattctgtctgtcctccctggaagaggtggtagacacgtggatttcgcctgcctggcatgtcttccggcagctacatctttccctgcccttagttcgtttgattcaagtgggcttgtctcatctcccaggtccaagtgtgggcgcctgacctaggcactgccattcagatctctcatgtcttcatggcgtctgttggcttggacatatggttttggctaagccagggaaatatagatagggaactacctgtgctcatctctgctaccacctggggagagagtctatttgagagcagtaaacatggcatgagagccgagtgaagggaagacagacagcttcgagacgtcatttgaggacatgcacccaggcaggccaacagccaaggctgcccgaaatgactcagctgcacaaataattctcttttttgttaaagctaactttagttggattctattacaatggagatcatcctgactaataaaaccagactggaagcagaagtaggggtaagacctagaatctgtccttgccaacctgcatatcatttatccttatagccaacccaggagtgagtagaattggttagattttgtttctgtgacattttatcaataagaaaaaaaaattcaaagatgggaagccaatggtccaatattagatggttaatatttggcagagcagtgactaaaacccaagtattctgactctacttcctactataattgtgcaaaatatatgactgatgatgtttcaaaatcttacggaataatctcaggactaatttcctcaataaatagccaaaaaaaaaaaaaaatgaattacggaaacatactaaccgatatttggggatgtagatgcttaacttaaaccacagataccattcaacttgtcaaccatgatctgaaacgcacttgacaaaggtatgttcaggtaaactcatggaaatcagttggaattattggtctcatttaatcattgggataaatgataacattactgaatttccaaattcctgaaaatcactgtagtcattatagcaatcatttcaaaacattcaacttaaacgtttataaaatgaaaattcttactaaaattttttatagagcataatcctataaagcagtttgattgatttggttttattcccattcaactattttgcagtttcattcaatttatattatgttagatggatgttaatgtcctagctatatgtgcatttggcattgttgcctaattaaaacttcccttaatttatcaatgaaatcacaataaagtgtccatcactttgtattgcatggacacggggtttaagagcagaataatggcactgtgccctcttcaaagtcattatacagatgaaatcatgccaacatgtccagtagaaacagtcttgaaaagggaaataagttagaaaaggccgctgtctcagccatgccagcgcaggtggcggaggaggcggcgtatcagtgacagtggtgactgcgtgtgcatgcgtggcggaggaggtggcgtatcagtgacagtggtcactgcgtgtgcgtgcgtggcggaggaggtggcgtatcagtgacagtggtgactgcgtgtgcatgcgtggtggaggaggcggcgtatcagtgacagtggtgactgcgtgtgcgtgcgtggcggaggaggcggcgtatcagtgacagtggtcactgcgtgtgcgtgcgtggcggaggaggcggcgtatcagtgacagtggtgactgcgtgtgcgtgcgtggtggaggaggcggcgtatcagtgacagtggtgactgcgtgtgcgtgcgtggcggaggaggtggcgtatcagtgacagtggtgactgcgtgtgcgtgcgtggcggaggaggtggcgtatcagtgacagtggtgactgcgtgtgcgtgcgtggcggaggaggtggcgtatgagtgacagtggtgactgcgtgtgcgtgcgtggcggaggaggtggcgtatcagtgacagtggtcactgcgtgtgcgtgcgtggtggaggaggcggcgtattagtgacagtggtgactgcgtgtgcatgcgtggtggaggaggtggcgtatgagtgacagtggtgactgcgtgtgcgtgcgtggcggaggaggtggcgtgtcagtgagagtggtgactgcgtgtgcgtgcgtggcggaggaggtggtgtatcagtgacagtagtcactgcgttcatacgcgtggaggaggcgaaacgtcagtgacagggctcattgtatggatgggtggtgtttgatgcagcctcctaagccatggatgcatttacaaatagcccctattggttaagcacagtgggaccctgggagttgaatgccacaacccaaacaggattgggatcttgagtttaggatcttcagactcctttagttctggtcccctacaatttgtactgatggttccattgctgttctagaatcctgggcacttttaaaaaattcatactaaatttggcccctgtaggaaagaaagtacatttatctgtttcaaatttatttttgataaaacacttaatttcctattggctctgaactacaataagatcagtggcaatcaagtggaaatatgagacattgaatgttgatatttttctctctgaaggaaattgtgctcataatgtaatatggtgcaggggaaattgtattaatagtaacaggttgtggaaggtgtcctacacctgtccccaactagctgtgtaacccagagtgattcaccgaacccttccctgagacgtacatccttacctataaggatttccattcagagccttttcatatattgtttccaactgttatcttctgaacagtatgcagaacatacaaaataagagagggtctgatagggcatgacaggggcagagcaaaaactggttaatagcatctcgtcgacaggcgtggctctctgcccctgctcaccctgcagtggcttcttcagtcagggctaaggtctctgagcagccatcgtgcagagtgtgtgaagtcaataaatatttaaaaacagagcatagtaagcagagatgacaagtgcagccaccaccacagctcagtcaattaaatcctgctgccagcacaaacttcctgtgtttaaaagtgcaactgggtatgggcccatactcagagagtatattccttgtcaacatttttttttttcaatagaaatagtaagagttttcagatttgggctgtgctgatacaaacatgctcaaaatcccattgagaaaaacatattagtcatctaaatgaagaagtttgctaatgttctaaatctttctatcctgggatataattttgttttattgagtttcttcagtgttaagcatattgtgtcacagaagtgcttttagcattaggaaaagaatcatgttttaattttaatcctttcagataatttattaaaacaaaataagagcatgcaaagagcccagttaaagtgagcaataaaggcctagatattttcgtgcttctgagaaatttagtacggtatgagatttgctggaataaaatcaatagaattggttttatggctatagcattgctatttcatctctttgtttacttgggcatttattactggtgcatgatgcacagaatgggtagaaatgctgaaatgtggtcttttggctctcttccagccagggattattcaggtggagacaaaacaagcttgcttctccagtaaaagatctgatagccttgagatgcccaaggacagtggccagaagtaattgtagttttgccttattatttttttaaactcacacagatatggattgtacagaaatgcattttcatattctgaaagtgtaataaaagcctcaaagtcaacagctcagtagtatgtagacaaagctttgatccataagggaggtcttactgagtatatatcccttctgcccattatcccagtatataagccatcaatagatcgggggcaagggtgtgtgtccatcagagtttaatgaaacagtagggaggagaacaaacacctaggctcatgtttataggggccagggatagtctgtggactttcctgcaactgtccatggagccagccctatagttcttaattgccaatgtggattctcataaaattaaacagtattattctgtcttcactattaagagtagccatagtaaatcacctcctctccagttttctgttttaactgtgaggtgtagttcattctctggatagggatggcttctgtttgcctttgtaattcgttgcagaaaacctattatttgcatttcaagcttaggttcaggtgtctgcagtagatcaacagcataattctttgtactaaacttaagcattcaagcccagtctagaacacatttcacagaatgtcacagtgtcctagagccaaaaacacagccatagagtcaaccatgaacttggaaaatcctccagagtatgcagagctatcaagggcaacgtctcttaggaataaagcaattaattcagaaattaaattttctactttactctttctgcaagaccttagtcacatatatgactttcttcagggatccttaaaactatattagccatctgtgagtttgcaagtagctaaatacaccacctgtaattattagtttaattattataacatagtatcctcacaaagcattgctacatttgtcaaatgtgctgaaatcagttctaaccagagaaagtgttgaaaagacagtgagacaattcttctcaaaattggaggaacataaaagaggcccagctgactcacatcagtacatttgcatgactgaccccctctctcatatggtctccttatggtgagcgccgttcacaatgcaccctcctggcctcttgcttgccttagggctgagtgcacctgtgctgagaaccagggccattcaactcattattgtcatgatgcaacagtgaagaagtacttgaaacagtaaggatgcttctctggcttaaagaaaatattgagggattaatggtgttgattgcttctctgtttgcaacatgactgtatataaaataaaagaagtacgtgtttgattttacccaatggctgacaagcatttgggacatacttcttaagctgtttatataaaccaggttcagaatggtttagagacgtagttcatggacctatttcctatgaaaaggacataagagacttttgtgttttatttctcaccttctgaagtaatatatttcaaggcttttaatcagaaagaatgaattaaatgactaaaatgccagacccaaagtatggccaactgtatcttccaaagatggctgtcacatatttatcatttgaatgttcttctcacaatgtcaggttgacactccgccactgagtggtagggacaatgttgtctctccccaagctcaggcagaacactgtgagtgtctcaaccaacagggtacagtgacactatgtgactttgaaggctaaggtcataaacatgtcatgcacttccaccttgtttccttgacaggacccaacttggaagtcagccaccatgttgtgaggaagcccaagccacatggaagggtcgctgcaggtgtgccagcccagagtctcagctgaggcctcagaagacagccaacatctactgtgatgacgcccagatcataccagtccccagaggtcaagttatctcaacctacaggtcgttccagatgataacccagtaattttgcaacaaaggcaagccagctcctatgttctgcttatatgcctgacccacagagtccacgagcataatgcaatatttgtttatgtcagctgtggtatagttttttactaacttttctttatgagtttgtacagggagagagaattaagagactcagatgccagaccctaaagataaggtgctttgttacgataaggaattctctttccagacatttataatttaaggtatgttgatgtatttagtgcctaaatgtcttagcatggtatttccttgtgttttatacagtttgtctttctctactccccagcactacaacgaacatatgtacaaacttgtgtcaccagaaattgtaagtgacatctgcaaagagagagattgagagaaagagaaagagagagagagagaagacaaacagagacagggagagagaggcagagagaaatggagaccgagagagattgatttatcctgtaaacatccacatcactttacttaacctcttttggtactcggcctttcaattttgtaatacggccaatgaggaatttcggcaaatctcatatctaggagacctaggagcttgtgaagtccttgtccatcagtggctgtgcattcactggctcctggcatggtgtctggtcttgagtgtagacagtcagccttggagaatgtttactaaatgcacagtgaagggagcatgtgcatctcaccttcctggctaccttagttctcatgatatcctcagaggagctctttctaataatggttatttgtcatttccaagggtgtgctacattttgcatttatttaacatcctgaaattgttacataatacgtttattatattataatctcctttgtgtctctggtaatatgcacttttgttaaattttcatatgtatcattgctttatctaatagatcacatttaggacaagcaatggattaagactgccttatcagggaaatctaatgcttgtctttaagaagagaggtttagcttcaattaagacatatacatctaagatttatcactgcaagtagatacttaatgtctgtgtttggaatgtactaattaggttccaattagcagggtcaaaatatgtaaatcaaaagcacttcatcccctttggtgtctctttctctcccataactaattatctgtactcttcttggtcccagcaaacaccacggaccatgtctttaagtctctaatatggtttcttcaagtatgggccaggtgctgtcaacctgtatgttcctcctgaataagtccctgagggtgggagcagagggtctgcattttaccaagaagaccaagtaatctcactggaaaatatagcttgagaaatactattctttagccacttaggcattttcactatgatatctttagggtttatctgatggatacttaccaagtgtttctcatctctccaggggctgtgagtagcataagaaagcctaacccaccgccctatcctggaagtgtggtcaggttattaaggtattgcagatgacaatcatcatacagggcagctttttcagtgactcaaagaaaacccttagtattccataagctgatataccttttaaagttcatttctaaactaaacattgcaaaaagtttcttgtcaaaagagatttcagatgtctctatatactgtttcttgtataaatcacacacccttaccaagagccctgagctgggacccacaaatggaaatcaaaggtaatgtgttcctccattatataataggaatttcataaaacccatacaacagtcatctgtgttatacagaaaaacattcatcactgagcatttgaacattttgatgtttctgaagtacagaattcatgacactctgcaagtttttccaaccaatttacaaattattttcatccctcatcttattatcctacctagtgtcaacttgttctttcggcataatcaatctgaatgactggtaaggtttcatagtgcagcactttagtttatgcagacatctgcccaaaagcatctcaatcactcatagcaagaaacaggggcagcattagccatgaggaaatgctgttttgttacacatgtatatctaaagacagggctatttgtataaaagaaagtcagggtagtgatagacagaactaatgtatcaatgtcagcagaaaatgcaagtcaaggtatggcagcaaaaatcagcctcacagggtacctggaacaccattaatttaaatttaaagcccttgtggggaaacggatatgatataatcactaaattatcattcataaatgaaggtctatcaagtagactatagtattatatttatataagaaaatcttttcaccttgcattcacacataggggtttatgttgctttaagtatttttctagttttatcattacattcttaaactacagtccaatgtgtagcgataagggattactgacatttatagtaagttatttgttcttattattctaaaacaatagataattttgatatagaaattaagaaataacttatgtatgtagatataaagaagtaaaacatgatatatgattctaatggagaagataatgtgatactctctagctatttatgtgactttggaaattacttattgcatgctagaatacaaccaaaccagctattaaaagttaagaggaggtggcaaagcagaaaatactttaaaggaaacttccaaagagccccaggtgatgtaaagttataaaagctgaatttgcttttaataccaattcaacatagtttttcaaactgacgaaaagtacctagatggcattaaacccaaacataaaatctgtctgcaattaaccataaatccttcactatcccgtacacatcttgcttcatcggaatcaatgttgacttatcatgagcaatacctctgattctttagaagtatgtgctacataagatacaaattggctgggcgcggtggcttatgcctgtaatcccagcactttgggaggccgaggtgggtggatcacaaggtcaaagatcgagaccatcctggccaacatggtgaaaccccgtctctattaaaaatacaaaaaaaaatagctgggcgtggtggcgcatgcctgtagtcccagctactcagcaggctgaggcaggagaattgcttgaacccaggaggcggaggttgcagtgagccgagatcacgccactgcactccagcctggcaacagagtgagactgaatcttctcaaaaacaacaacaaaacaacaacaaagatgcaaatcaacagtgctgcatgaagaagtactcacccagaccctggctgggtactcatggcatgctccctcattgaaaaccgccatcatcagtattagcctctccacctcacacacatcataaaatgctcccagtaaatatcatccgggtgcgtgccatgaatttcatgtagttccctctaggaactttgttccactaactgcaacattctctctagccatttaggaataactagttcatacttcccactgtctgtcctccaccacagaatagagaagtacatcgtatatatactataaatacttcatttggtgattaaggtctgatgtatctgttgtatattgtgggtctttatagattttcttttgttaggagagcacatttaagggtaagattccaaagattggaaacattactggactgaagattctttgatgtaactgtgaagactcctaagaggaaaattctgcttgtaaactggccggccagccttcagggaaacatgtcacaggagcacgctggggtcacattgcctagcacaaaacagaactctattaaacatttgggatctgatagtctctaatgttatttagataactgaataaaatgcattttttttttaaagatggggatcttgccatgttgttgaggctggtctcgactcttggccacaagtgatcctctggcctcagcctcctgagtagctaggagcgcaggtgtgagccaccgcacttggctctaaaaggcatttttaaaaatgaaggtgaaaacaattaaaaaaaagtcgagtcaataaaaatttagccaattttcacatccagagaatcattttttataaacttaattatgttattttccttttgcatttggattggccctacctgaaaatgtatacatcatttggtttatgcttacccgtgtggctactgtgaaagatatcaaatcatgtaccccggaagcccttcatttattatggctccagggcaaaggggagcaaaggccacttccgggaggacgcactgatgacacagcaaagtctccagcagccatgaagaagcctggcccctgcaatgccgagagggaggaggatagaagacgatcaaggaagggccaggggcttggacccagatccctttcttggtctcctttctggtctgtcagtctggaaggtggcagtttcttagaaaacttctaacatctaaggtttaggaaatcccagggcagtggggcttttaaaaattgcttcggatgcagacaaagaaacctcaggcctactgtgtgcacctcccacgtgtgtatctacgtaggatgtagagaagacaaagggacacagtgagcatggtggtggcgaaaggtcacctgtctcccacggaggcatggcttcccatggagagaaggaggccagcaaaggccacaggggcataaccagcttaccacgccccctgggagggaccctttcagaagagacaagggtggatggcccactctaggagtgcagccttgcccagatcctggaagacagggtggtgtgactatggtgtgccactcagctccaaaggaacaagggtagaagctctggtctgagagctgacagggtgaggacagctgcagtcagagccagacgaggtgtcagcatgggcccagtccctcatcaccaccaaggtgcaccgtcacagaggcattcctgggcccacccaggctctcagcgtcattagcatgggcctggcccctcatcaccagcaaggtgcccagttacagaggcattcctgggcccacccaggctctcagcatcattagcatgggcctggcccctcatcaccagcaaggtgcccagttacagaggcattcctgggcccacccatgctctcagcgtcattagcatgggcctggcccctcatcaccaccaaggtgcactgtcacagaggcattcctgggcccacccaggctctcaccgtcattagcatgggcctggcccctcatcaccagcaaggtacccagttacagaggcgttcctgggcccacccaggctctcaccaccattggcacgggcctggcccctcatcaccaccaaggtgcactgtcacagaggcgttcctgggcccacccagcctctcacctccgtcagcacatggaagaagagaacagggaagagacccctctgcagacagtccactccatctggggctaagctttgccaaaccgagagagaaaggctttaaactgtgaacaatgtccacaataacgacaatactggaatcaactggatactgtcaaaaagagtctaggttttaaaccagaagtagctaaaaaatgattacactgattttactaggttggactaaatttagttctcctgctgctgagagaaattggcagcttgtcaaagaaaagttacagaaaataaaatgagttgacacatgttgattattgatttccagttcaaactcaccacacaggcatatcaacacacatgcacacacacacacacacatacacacacacacacacacacacacacacacacggtcatatgcataaatatttcagtcacattctttgattcacgtgtatggtataaatcagaaagcaactgagcatcttcctggctgcttccagaataaaccacgtttgttacagctttctagtctggggagacagccgaggtagcccgctgcctccaaaagctgactgtggcagctcgggtaactttggagcttgttttctccacttcagaatattaacttgcgggaagatgacattctgaaagaagacctgttctccaaaccattcggtcaaggagcgaaatcctcagcgatgggcgtgcagactgaaagtcagcgctcgggcccctgctgcatctttgagttgcttcaggagcctcccacctgactgctctgccatccatccgcgcctctcacacttctgttcctccccgtcttaggccccagtgttgcatgtccttggactgatgtcctgataggcttcactggctttgattttccacccgcctccagaacacagcattaggggttctgctaccagtcttcctaagctaaccccacaggacaggggcactctctgcagcaccccccactgctctgagctgttggagttgggaggaggcctgcagagaccttccagggactctgagatgccgtggaacatgcctactggttcctaaatccaatgaaacgtttcagtcctttaaccagcatctcaacgaggatgattccaaatctctgtctctagccccaacttttcatttgaattccagatcctgatgaggggcacagaggccttctctgaacttgatcaagtagctcccacccttggccccttggtcactctcaaccacagtgtcctaatttatcttctccaaaatactcaccagcatctaaaattatcttattgatttgttctcatgtttattgtatatccccctacctcttcccaaattcaccagacaggtgacgtgatattctaaggaaatcatataatactgctttagggtcaaataaaacacacgaatgtcaacgaagacggggactcgtaagttgtgtgtttctgaccctagaatggtacttggcgccaacagattctccaaaaaatatttggttactgactcaccaatctgtatcacagaagtcaacttgacacttccacctggacatctctcagacactaaaaattcagtccaaaattgagtgcacaacagttctttattatcattctgtctaatcataagccaagggcactactctctgttcagttccaaatccagacacccgagaatcaccttaactcttcgttctctttgacccccacatctcagcttgtcccagtgacctcacggctctggatcgcccatgccgccacttctcatgtagatttctgggacagtcttctctctggctggcttcctattaggcccttttagacataattagttttttaaaggcgaatatgaataagatgctcttttatttcaaatctcctcagtggcttgccactgctcctaggatcctgctccacatctctggaagagcattcaagaccctgtgtgagtggcctctccacccgcacccacaggctggcctttcctgatgctctagcttttcattagtaattttttaaaaatcctgcaaacacctgtcttattttcctaaggagatggaactcacttccaaaacattcaacgttgcaacaaccaaattgctaacagtccaccagtttaagggctgagaatatgaactctgcttctgtttcttgacacagcctcactcgacattaaaaataaattggttccccatctagatcaacttgaaacatgaattaaaaacgagtatactaggctgggcacggtggctcacacttgtaatcccagcactttgggaggccgtggtgggtgaatcactttaggccaggagttggagacgggcatggccaatatggtgaaaccttgtctctactaaaaatacaaaaaaaattagctggcatggtggcaggtgcccactcgggaggctgaggcaggagaatcgctggaacccgggaggaggaggttgcagtgagtgaagattgccccattgcactccagcctgatcaacagactgagactctgtctcaaaaaaaaaaaaaaaaaaagaaaagaaaagaaaaaaacggtgtgccagttgaaactactcacattttaaaaggatgtcacacaaatttcagccacattgtagagttttcttatttccatttaccttgcatgataagctccaccaacaaaaagcaacagaatttactatggcatgtatatattaaattgtatttttttttcagaaatgcaatttctttctgagattactttaatcaaaagaataattgcattattcatgagccatgctccgttaattggaagtgttggtcaattattacatgagatcgcatcacctttcaataaagagaaaagagttctcttgtgctggtctttcaaccacaattaccccctctcagtccagtgacttataacacagcagcaaagttaatcatttaaaactagaaatcatctttgaaaagtcaaccagtggaaacatgtttctaacaacaataacagcgggagagtgtactttagaggaattcataagtgcctctgcaacaggatctggataaaggtcatatttttaattactatgggtacaaattttacaaatcacatgctgtctttaccggtacaaaaaatttatcagaggtggagcttggggacatgcgaaataatagggctttgagtagttcctccaactttacaaatatttcatccttaagaagcagacatttaaaaaaattcactgaggaagggaatgcgatattctatgatactcacagcatactgtttagggatcaaatagaagaagtaaatattcaacagcaaggagctgttattacaatgggcttgatttttaaccccttatgttgtccaggtcctgcacattaaaagttctatgtgtgacaattcattgttttattcattaattctgtctgtctagaagattctgaacctgcttcagagggcatagaataagaaactgaggacgagaggaggcccagtgctgagtccctggaactcatgttgtgctgagcacagcgactaccatttagtacatgtttaactgccccataactgctggtctctccattgtccttgactgtgactgcctgacaaatctatgttctgtgcttcagctatgctgagcaccacattctcagttaggtatagaagatgtggtttatatagcacttcttacagtgcctctaagtcagtgacacttagtattccagggcattgagatgtaaatgtatcctgggcacatagagcatatacgctgtgtcacaattgttcaaaattaattatatataattcttttcttaatataggagtccagtggctacctctttgaggactcatttgagccttgcacagtgtagatgacactaaaaatgcatgatatgttgaatttcacacacatgtttaagcaggcctggtgatggtacagtggttgagactgtcctatttgtctatgttggcatgagattgaagcacagagctttctggaaggctagttcactgctgaggatacagagcagtgctaagtgtggggcagataaggccaggggctatgggctgggcataaggatggacagggcgggactctcactgggaaggggctatgggaaggtgcttggtgtcactcgagggactgggaggaaggctgacacaaaagcaggtgggcaacggccctggaggacatggtctccaggtcgggttttggagtcagacaggcctgaggtcagatctcggcttgtcgtcactggctgtgtgatcttggcaagttatgaatggtctttctaagcccctgggtatctgcagaaggaggcggtgactcaggactgcttactatccacacttattcaggttctacatgtggataatgagatgcttgatactgagtctggacagagatgtgttatctaaatcccattcattaccgagttcatacagtcagagttcaggtagggaggggtactggttataataactcttcttagagttgctgcaacaattaaatgagatgatgtatccgaatggcagcagctgggacttactaaggtctcaaaaagcattgtgactgctgttgctactactactactactacaactattactataatgattagaactattagtctgctatacaactatcacagataatattacttaattagaagggtagcggatggaggccatggctctgcttgaatgaagtggtttgaccttgattcacgtagtacgcattgctgagctgaagcaggagaatcacagaattatagcagtgctctgaaagcctggtatggctgcaggactcagatgagccagatggtcaaagtggaagagttggtaaatcaaggttattgcaataactcagttagtactaataagggccagggatgaatacggtagttacgaaacttgaaaggacaggcacaattctaaaaaccattcaaaggaaaaaacagggatggaataaaaactaaaaggtcatttctgtgaagatcaaagacacacagctgaagattcacaaggaaaaaatggtgagctggcaagagagatgatgagcatggcccattccttagaaaggagtctgattgtgaacaaaagaaaaaaccagacgtgaacagcggcagtggcctcacctctctgagctgccttcccatgtcctgggccgctctttcccctttgctgtctggtcctcctctcacaagtctggactctgttgctgcaggctcaggtttagaccctgcctttgctctgcgcacatgtccttcccgatctcatccattcttcttgcctttaaagaccacctatttgatgatgatggcacgtcctgactcagtttgaacatcccattggatgctgaatctcaaactattgatttttacccaaaacctgctcctcccactgccctccctatctcagtaagtggacacccagtcttccgtgactcaggccgagtcccacggtgccatctttcactctgctgcctgtctcatgccagtatctaacccacatacctctcgtatgtgcagagactggtggcttctcactgacctcagcacgcccactgctggtggaaacctccatcatctctgatctgggttagcacaagagacttctgtgtcatcatcttcactccagctacagaattctcccagcatggtagcccctaaagtaaggtctgactttctgcttagaactcttcaatcctttctcatcttatcctaaagaaaagtggagaccctcacggagtctgacagggccctctgaacacagggccctgctacttctctgcacccaccttgctcttctccacactcactgggccctggcaggttacatccactgctgtctactcaaccacacaggagccatctcagggcctgtgtgtctgcagctccatctgcctggaactcccctcccagatatctgtgtggctgcccatcccagttcctttggatctatcttcagatatcatgtaccacagaggccttccctgaccacctcctagaccgcaggaactcccttccccaccactacctgccccagcctctgtcacctgcttccattttttttttttctgtagcaagtgctgtctcatttctgtatatttgcttattaatttcttgtccattttcactaccaaagtacaggttctgtgaaggcagaggtgttgtactgtatacagccacatcatcaacatctagaacagtgcctgaaagatacgtattgaataaatgtgtggtacaagtacgctgggcacagtggctcccacgtgtaatcacagcactttgggaggccgacgtgggaggatcacctgaggtcaggagtttaagaccagcctggccaatatggtgaaaccccgtctctactaaaaatacaaaaattagccgggtgtggtggtgggcacctggaatcccagctactcgggaggctgaggcaggtgggtcatttgaactcaggaggcagaggttgcagtgagccaagattgcaccactgcactccagcctgggcaacagagcgagactctgtctcaaacaaacaaacaaaaaaaccatgtagtacaagtaaatacttaaaaaaaataagtatcccattctgtatggaaagatgaggaatgagctgcacagagggaaagttcgtaacgtgaatgttggctcaaaaaaaattcttcagtaagccatcaggggtggaataaaaagctttaaaaagtgcacgtagagggggttctaagaggaatgtgctattttgcgatgagatttagcctgactgcactctgcctgtgctgacctggatgcagacagtcgctgcctccaccgaggagggcgtgcatctcttcacccactcggctgaacttcagcagcttccacagtgacaggaacggatgggagaatggactttgttgtttcgagggatggtggtggtggtggtatttttatttgctcatttatcttggaagtatcgagtggtagacagtggcacatggcagtggcaggtgcagcagcctccagggagttaaatcctagccctgccactggacttctgactttggctaagggttgcctggtgaatggcagacagtggcacgtggcagtggcaagtgcagcagcttctggggagtgaaatcctagctctgccaccagacctccaactttagcaaagtctctgaccactttgtgtctttgtttccttctctgtaatatgagaatatgaatgtgggttcctaacctgtatctgaaacccaaggtttcagagcttttcagattttaggaaggtaatacagagtacaggctgtattttatggagcacccacagcagggtctaatcgaacacatgaggatatctgtggtgaaatacatgaacattcatacctagtgggataaatcgaggatattgatatggtttggatgtgtccccacccaaatttcatcttgaattgtagctcccataatccccacatgtcgtggaagaaatccggtaggaggtaagtgaatcataggggtgggtttttcccgtgctgttgtcatgataatgaataagtctcacaagagctgatggttttataaaggggagttcccctgaacatgctctctctcttgcctgccgccatggaagatgtgactttgctcctcctttgccttctgccaggaatgtgaggcttcccagtcacgtggaactgtgagtccattatgcctctttttctttataaattacccaatctcaggtatgtctttattagcagcatgagaatagactaatacatgtggcggtggcaagtgcagcagcctctggggagtgaaatcctagctctgacaccggaccttcgactttggcgaagtctctgaccactctgtgtctttgtttccttccctgtaatatgagaatatgaatgtgggttcctaactcgtatctgaaatctgaggttccagaacttttcagattttaggaaggtaatacagagtacaggccatattttatgtagacccacagcagggtctaatcgaacacatggatacaactgtggtgaaatatatgaatattcatacttagtgggataaatcaaggatataaacagcctcactgcagttcatgccaggatttgccaccaagagtgcatgtcaggcaagttttgtctccagatgagtcagaaatattagactttatctgtcaggttaatgtatttaacaacttggactttttattaaactgcaaaggatttcactttatgtatgattttaataacaatatttggcctaagttaaactctttccttctccctccattcttcccttgcctccttctttcctatgattctctaagctcccaacagccggccctgtggtgagagggtggctggtggaccacgaggagcagccgccgggagagaggctgggatgctgcacatgggggagtggcttgggttggctttggctccgcccctagctggccccagaatcaacagaaccctgaggtcaaaacagtgctcccgggagctccgctaatgcagcttctctctggggcccgcttccacactgatcttgcccctaaacccctttgatttatcaattctggccccatttctggtaagtcactccctgggaggcaagcttctccaatgcatggaagtcaggagcttatggaggagaagtgacctgggtcccttacatgccaggttatgtaaagcaaccccaaatatccagctgtgaggagtccgccagaaatgccaacagacgagcacttttcagggaaaaatagagacacagctccctctcacggtttaaatgtattgggtagagatgagcacagcaaaagaaatagagggtcttcctgttacgggaaaggggtgtacaaatggcacttaagtcaaggatgttcaatttgttctcactgtcaacatagggtaaagtggttctgttcagctttctaaatggccaggctattggctgagtacagcctatctgttcgagtaactgtcactttatttatagttacggcaacttcttagaaccggtatcctttaaaatacagcctaatactagagccagatgggaaaaaatcctagggtaaaatattaaattgtgactagtcatttaatagaacaaagttattcatgacagcttatatatgtcaaagcctatatgctggcttgtctataaactggcagatggatttttttccaaatactgagaagaatttcagtctggattttaaaacgagtaagttatttcaaaacaaaactgaccaataaaagaactgataaaaatttgtttaagcttattttattaaaaacaacaactgactttttctttttttttttttgagacagagtcttgctctgtcacccaggctggagtgtagtggtgcgatctcagctcactacaaactccagctcccaggttcaagcgattcttctgcctcagcctcccgagtagctgggattacaggtgtgcaccagcacacctggctaattttgtaattgtagtagagatggggtttcaccatattggccaggctggtctcgaactcctgacctcgtgatccacccatcttggcctcccaaagtgttgggattacaggcgtaagccaccacgcctggcccaacaactgactttaaaactcaaaaggctttatttaaattatactagtaaaaaaaccaatgaacattcttatttatcttctaaaccatgggaatatttaaataattttatattttattatttaatatagatttagtattatgttcctaaatctgggatatggctatttttttctgttgaaaaaccaaaaaaggccaactctatatgtggccagtatacaggtaactgaggctgacatagaagagagttacatgtatccaccaaacaaactcaacctatgaagatcttaaacattttttttctgttgattttcttgagttttcatgactattgcataatggtagatttatactatttccatgtggatgacaggagataatgtccaacatcttctacccctacaaatcagatctgaaatttctttatgatttcttaatactatcatcgagcattcaggtaggctccatgccggaaatttagactcttctttactgcttcttccttgctcccatcttctaataggtcacccaaccttgttcattctacatcaaaatctcctttggaagttggttcactcaccctacattagtatcaaacattttaggtcaaggtggcaattctgacttccagtagtgatttttaaactcaataatgacaacaataacaaaacacgtcatcggccttttcttcatattaagtcttatatgaacgcccattgtgtgaaacgctgaactgacagcctcccctttaccctctcagcagccccaaggcatcctcaccactgatgcggaatattagggccctctgtcttgtcttttccaacagcctggatgtctacccactccagcccatgcccagcatggacatcagagtctgctcctgcctcctggctcaggttcctgggggcagcgtgtggagctgagaagactgcatcgcctggattccatcccagctgggcggcttactagcccatcacacctgggcagtcccgtgagcctcttctatcctgtttcttcatcactaagatcgagaataaattacaatatctattttggggcatcctcagacaaacccactacagggcagggggtccccaacctcccgagccatggaccagtacctgtccgtagcctgttaggaaccaggccgcacagccagaggtgagtgggtgagcgagaattatcacccgagctccacctcttgtcagatcagtggtggcattaccttctcataggagcatgaaccttatcgtgaactacacatgcatgggatgtaagttgtgtgctccttatgaggatctaactaatgcctgatgatctgaggtggaacagtttcatctgcaaccactccactcaccctgtttgtggaaaaattttcttccacggaaactggtccctggtgccaaaaaggttagggaccactgccataggacctttggttcttccaacactcacacatagctgcccctcaccactacttattgattttaagtaagaaaaaagccagtgagtcattgcaacaaataaaaactacatgcaaggcaaatttactacaaaatgtctgactttcccagaaattatggttgctttttaaaacatattttattaaagaaaaggaaaaaataaaaacctctgcccctcactgtcctgaatgatataagactatctgattggatactagtataagtctgatgttgctgcctggaagaaagcagtgagaggcgtcagaacactccagcacactttggaatggccagggagttttgctggcagacactcagcagaagatgccttacactccctacctcaccagtccccacagtaggcggtggaccttcatgtaatgggagactcacaccttctgtgcaagagccaggcacatgggtaactccaggctttaccccatgctgcatttatgagaagaaataagacaatgaatgagcctgttaggccagtgtctgtcttctatgattaacacagccaaggaaagtctggcccacacagaaagagcagccctgcagaaacactagtccccctgagctttgtgcttcagcttttccaaacccaactcaatccaccatatagaaaactcagcaggagttttagccgtcatcattattaccctggatctcacaccactacaggataaactccacagttcctagcatgactacaaggccctccaccctgcagcccccaccttctgctagactttcttgctggtccattgctgacaggcagctgtgctctggcctcagggactccatccctggccccttcctagagcatcccctgatgcacatctgtggatcctgcaagcttcgcatggccaggcttatccccactctttccttctccagcccacaggtcaatctcctgcgatgctttctccaccccttcacgcagagtttattttcttctctaaactaccagaatcttttgttaatatccttgttagagggtttattgggtgctctcataattacagccaactataaactcctagaggtcaagagctggttttatcattcttcgtatctctagtatcttccctagtccctgatagatgctacataatcaataactatgtgttgaccaaatagatgattaagtcagcattatgttttaaattttatttaagttcacaaaaagacaacatattatgacacaaaactgttaatagttccttaaatccaggcagtgaaattacaggtaattcttattataatatttaaacttttcttcatttcctaaatttcataacacagcaataatcatagaaaataaaagagtgagaaaaacctgggagggtttatttatttaacatttcagataatcaaacaatgttaagtactaatattagtgttggcctctcctgctaaatattatgggaacttaccattgcttacatgaatgtatggattagtgcaataaaaattacattggaattctctagatcttgatgtatgttttcttaatttattctgacctaattcattagcttaagtggttcatacatttcacagctataagtcttgttcgctcatctgggaataaatctggtagtatatgctgacacttactaaaatgtaacaatatgattctatttttctgttagagacctttagcccagaaaaaactcccattaaaaaaaaaaagaagaaacaggtttttcatataaagaaaaaaaaaaaaaggcttcagtacaattggcatcttgaatgtcatggccaaaaactagagttccatgaaactgggtacagatctcattatgagcataaaaacaacacacgctcttaaatacaatgcaaaatttcctgctgattaaaaatacaaacaacaatgaacaaagcataatatgagtacaggaaaaacccatctatggattctatgctttagttatgtaacattttcacattagggcaggttctaatgttgatcaccatcatgaccagaaagagttgcaccaacatgaacaagaggtccctaagatattaagctccattaattcttctctgtgtaggcagttagggtcggacaagtacaggagggatggacttattataatgaggcctgggatggtttcttttataatagtctatattgtgcagaaaaaaatacattatacttacaaatatttggcacatagtagatggataatcaatattaactaattaacaatcctatggcgcaggaagatttttcataagcatgttgtggtgacagtgacttctcacatgaggccagctgtctatctcacccacatcctgtgacctgcttctaccccactggttctaccccactgaccttcttctaccccactgtgactaaggcactcctctccacatgctatatggtctgcatgtttgtgaccctccaaaattcatgttaaaacctaatttccattatggggatgttaagaagtgggcctttgggagatgattaggccacgagggtggagtgtggagccctcatcaatgggattagtgcccttatagaagaggcctgagagagctcatctgccactttcactatgggaagtcacagcaaaaagacacaatcctttacaaacaaggaagtgggccctcatcctacaccaaatctgccagcgtcttgatcttggacttcccagcaccttcccagcacccagaactgtgagaaatagatgttgttgtttgtaagatactgagtttattaagttttattatagcagcctgaagggaccaagacaccatcttcacagtgaccgcctccagctactttaatcatgggacagcttcctcctccccatccaatttgcacacaggggtcagccccagtcagtgcctcccctgcagccacagcaatgtttggctgggcttggaacaccacctgctaaaaaatgaccatcccttgggtttcactgtgaaatcttattaatgtcagcattgtatgtttccgatgttccaatgtaatggaagcaaaattcactaaggattgttcttcaagggtcagcatgcccaatatgtaacctgtcttaccacacagagagacaggttcatttacgtctctttaaaaatggttcttctgcttcaaccactagggattctcaactcccagaagaaagtgaaggactgatcatgcttttatctgctgcagtgttggtaacaacagctgactgtgggatgatcactgtttctacatgtggtgtgaggagcctccatctattaactcatatcatctggatgcagtgatgtcattagtcccgtttcaccatccaggtaactgaagtcacagagctggaaagcagcagcagtgggggtcacgtgagcccagcctgcagcgcacaggctctcagcccccagcatgctgcccctttgcagaacgggccctgagaaatgggaagcttttggttttcaagagtctctggatctcagtctggcatccagtgacataggaatgtgtgttagagatgactgaagatctgagagacataagcgatgtggcagaagtatttcacaattttgacctcataacttcttttctgttttgaagccctgggtgttggcaggtatagaacaatagagtggcttcaaagaagtgactctccgggtactatcctctgtgcgcttcccagagcccagctgtgttcaagccaggactttaggagaggaggtaggagataatgaagggacgtgattagctttgtgggacagccacaaactgggtggctagaaacaacagaaacgcatcctctcgcagttctggagcgggtgttggtggagctgcttccttctggaggctctgagggcaaatctgttccaccttctcttgtggtttcgggtggctgccaacaacccttggcattccttggtgtgtggactcatcattccgatctctgcctctgtatgcatgtgagtctcctctctgtgtctttgtgtcccttctcttcttataaaatacaccagtcaagctgggcgcagtggctcacgcctgtaatcccagcactttgggaggccgaggcgggtggatcatgaggtcaggagatcgagaccatcctggctaacatagtgaaaccccgtctctactaaaaaatacaaaaaattagccgggcgtggtggcgggtgcctgttgtcccagctactcgggaggctgaggcaggagaatggcatgaacccgggaggcagagcttgcagtgagctgaaataatgccactgcactccagcctagcaacagagcgagactctgtctcaaaaacaaacaaacaaacaaacaaaacccaccagtcacattgaattttgacccaccaaatccagtatgaccttatcttaccctgattacacctgcacagactctatttccaaataaaggcacattcatgggtgttggggattagcacttcaacattatctttttgggggacataattcgacccataacaggaaatgaagtgttttttcgtgtgttttcttcatgtttgtttttttccctcaagcactaaaaaataatgcaatttggctcctgacaacatgaatctaaaatctaattctgtgagcaggactctctgagcccgggcgcagatgggatacctgcatggggaggggcttgtgtcttgctctcagaaacataataaaccaagagattctgctgcattttcaacacatctctaagaataggcagcagtgcacctccttcttagtgttggcagtgaggctgacgtgacagtctgaatggtacatgcgtcccaggaacctcatgtcatggtaacagaggctacagcacctcacactgaaataagacgggctcagaccccccactgcaaccggctgcattgtcaccttctggggtacacatccgcggcatggagcttctttattctgttatcatccaggctatgagtcggagtattcaacattttaatgctccatatatcaataaattaagtgtgatgctggatggatgtgacattttcaatattccacagtatgactgacgggctaccgtagttcctcccctgtttgtaatttgagtaatctggatgggggacatgaactggccggccaataaaagtgaagactagtggaaagagcaaagtcataaagcaagcatggtccttcagagactgtattaaaagattatcgttttgtatatcattgttttttctttccagagcatgtaatcataaactgaaaagagaagagacaaaatgtaatgttgaccagaataaacaacgctgtgttcatcacttaatgttattacccagtcccttggttgtcttgtcctctgtttgttatcattttcgagggttttattctagacacattttttggtctcagtcagatttagtacagactaatataaagttctgctgctccacagtggtagccgacgcttctggaaactgcagtgaaatctcatgaactcgatagagttcactcttgcttggagcggtccacacacttcctttgtttaagcagcaatgatatgtcatgccaagctgagttcaactttcttggtaactcttgaagacaaatcaaccacactaataaattattcgacctgcaggttatatgagtaacaatggaccaccctaaactctaggcagcacagtctgatttccaacaaaagacaggagatgcagataacgtgtagatactaaatgtataaattgtattgtaattctgataggaaaataaaaccccaaaccctgaacaccattaattcaccatatgtcaacttaaaaaaatgtgaatgctagataataaaactttatgcccatgtaaatgtctaaacacaattttaataactataaataatgtagagatttatttcttattcattttaacaagcttttcactgaactatgatatggtattctaatattaatcttaaagatatcccagcatattctcaacttaaaatttaaaatatggctgggtgcagtggctcatgtctgtaatcccaacactttggcaggccaaagccagtggatcacctgaggtcaggagttcgagaccagcctggacaacatggtgaaaacccgtctctatgaaaaatacaaaaattagctgggtgtggtggcagatgtctgtaatcccagctatttgggaaggtgagacaggagaatcacttgaacccgggaggtggaggttgcagtaagccgagatcacaccactgcactccagcctgggtgacagagcaagactccattacacaaaacaaaacaaaacaaaaatttaaaatacgatgaaataaggcctttcctgtactaaactatgagcaatttatttcacaagaactcttgagtctctgacctattctagaatcatccaaaattgaaattattataaagtgttttctatgaatttcctacccaccaggcatcaaatgacagtatcaatggaacatgcacaaccgaaaaggatctcggccagcactgatgagatccttcataactataaagcaacaggactgatgaaccacacagtgaatccagccacataacttcataatcacccgtgcagaacacacttctggaatgctgtccactcggcccggcactcccctgaggactagggatagagagtgaatcgtagggagatggtctccaccctcacacacactcatccaagaaggcaagacagagcccaccatgcacaccgcaggagacaaacatggaaacccaagtcccatggggataagtgtgcggggtgggggctgggaatgcctggagaaggaggcaagtcctcagagaagaccactgatgataaagttgcttttcagcagagacctaaatgaagtcaggtgtgagccttctggaaactgggaaagggttccaggcagaaggaacaagggagcaagaccctgacgggaagcagattgaggtttgagagaaaggcttgaaaggatggcagtgactcagcaggggccagggcacattggccaggcacccattttaactactttggcttattccaagggagctgagaagccattggagtctgagcagagttgggacgttatttgacttcaattttaaaatgactgctctggcatctgtttggagaccaggctggaaggagaagcagcagagaagtggggaggtggaagatcagctgggggctgttgcagtaatccaggaaacagcccatggtggcttgggccacggtccaagccatggtcagattgtggaaggtgttttgaaggaattgtctgcaggatttgctgatgggtaggtagcatgtgtggtgtgagagcaagagaggagtcaagataacttggagatgatgcttgtgtccatttatggaggtgatgatgactgaagcaaaagaaggatcacacattcatatttggcattatgaagcaggagacaccattaggaactatggggaagtcagggtggcagctagaggtttaattttggggatcaagggtaaagttggagctaaagctatacattttggaattatcagcatatggtgagtatttaagtcaatgatgcaaggataagactacctacggagggaatacagactgggaaaaaagaaacaaagggggagaaggggtctaagactaagccccagggaatcacaacgtttagactgagttctgggctgggagttaaagaagaaccacaagatcatataatatcatgaagtatcctaagtatgaactgaaggcttatcagctgtcaacatagtagactggctgtcaaaggatggctttgctgtataattgttttatttttaatctagtatctcaaataaataaatttaaataaattgctctgtaaattttaaattaccacactcatctgcattatcattactgctcctatagtctctattaggttaaccacagttggtggctgttcaaggatttactccaataatgattatgtttcctttattttaaaatgcacatttttcccacattttaacatccctgaaatcacaatgtatcatacaattgacagcatcttagaactataattttttaaaaatttaaattttagattcaggaggtacacgtgcttgtttgtttcatggatattacatgcgtaattgtgggggttgggcttctaatgtacccatcaccctaacactgacatttatgatcagaactgatgctattttttccttcttagaggaatacacaaaaaagatacatcatataatctgtgacatctcagctctgatcaaataaaatatgtatttctaaagtcacagctctgttctattgtctttggttgatgtacaagtagaagagttggtctctgcacagctgccctctggggctagtgtctactgggatgatgaagagtcaagggtaggaaggaggcagcgccaaggagccccttgtgggcaagcctcttgacagtcaccgtattttgcccagggcttgctattgattagctctgggtgtcatacacctccagtgacttttgccttagcaagaagacagatacagttggaaacttacacaagggcttgctctggtttcattctccaggcattcttttcccctggagtcatacatccctgaagaatagaagccgtgtctctattaccttttaatccccagaactgagcacaatgcataaatatagctggtgctcaataaccattttatttaaattgaaacccaactccccagtatttggaaagacttgtggcctacaacctcagaggaaatgtacaacagattccctccctgggctgcggtagttgaagatcaccgactaactacggtcacataaggtatcatgtctgagtgcccagtactagatcctggtgtagtctccatggaaacatagagaggagcgcttgtatccttgcagagaaacaacaaatgcatcctttataatgataataaaatgcagcatttatagagaggataatcacctgtgttatgaaacaggcaatttaataactctgtctgataaaaacgcaaagacaactgtgatgctgtattttacttctgggggtgtcggcatctgagttcacgggcagtggtgtgagcagcaagaatgaatcttcttcatctccttgtcaacctgttatatgctctcttgctgcttactatgccgttttgtctttttctcctcattatattccccagctcatacatcctaacctactattccacttatttcttcctttacatcatgacctgtagtctatattcctcacaagaaggtcctcaaggaattacaaaggacttttagaaataaagacataaaatattttttacagttcctgcggaaggctttttgtgaagattgtgctttacatgtattaaaaacacctctgagagtagccataaaagtaaatttgaaaatgcatttgaaatgtaaatagtgtttgcagcactcaggtgaggctgcttcaggtcacatgtagcaagagctctgcttaagtcttgagttatcttttccttccagtttcctgaattatgtgacctctgagaggcactctgagtcctaaatgggtagtactcggcagtgactacgattcctaaacaattcctgtcctctctttcactccaggatcttccaagcctgcagcccctggctgcactctggtgccactagaaactgtgggccatgaaggagagatgctggcctgggttcgtacttggccacccaagagaagtaggatgtagtgctatctaacaatgtctctccaacaaggagttcttgagtctcttttaatcagggacccactacattaatttgcataatctgatctggagttcaatagatcaatgattcaaggtaaagaaagctcctgcagcagttcctagcccagccatttcctagccagctaaaatgccttggagctcaggtcagcaaactggctctgatctaagaatggtttttactttttcaaatggttgggaaaaaatttcaaagaatactatttcatgatgacagaaaataatataaaattcaaatgtcagtgtctgtaagtaaagtctgattggaactcagcagcctcactcattcgttcatggactgtctagggctccttttgtgctgcgacagcgtggttgagtagctgggacagagaccctatggcctgcaaaatccaaaatacataatattatctggctctctgcaggaaaagcctgcagacccttgccttagattggcaggcctagtcaaaggctggcctgttttggggactttccagcaatctggtttcatgtagggtgctgctgtgagacatgctgattgaattctgaaggacagggtgagacacaagcagggaataacattctgagaaaaaaagttggctctgtcagactacagggatgagaaaaaaacagctccttggtggtgtaattagtagtttaagtagctttgtctgcaatgatgctagagtaatctgcggtctttcatcatgttcaaggagaatgcacaaaaccactcagctcactataattgcaaatagcccttaatgaatatatatttgctttggctcctctgctctattttacatcaattcttgtgattttccaagtcataaaatgccccagatgcctttcactaaggcattttcacctggataaaaagatgtaaacagattagaccatttctaggtgagttatccaggaaacaggggtgatacaagtggattatctattttccgatctggaaaagtaggagtgatatagaagagaatcaatagttctctacaatgaaatcttagccttggagaagtgtttggtgaggggggtgaagatgggggaagtggcattgcgagagatgcagttactcactgatgccttgcatggtatcacatgatgtcacatgacactgtatgatatcacaaatagaaatgcggactctgatgagctagaactgagtgtcggcttctccgttgccatgcagcccaaggtaaaccactgactgctgcaagccttggtttccttgtctgtgaagtggtagcacgaagccagcactgctgtgacctcccaatgaggtagacggagcaagggtgccttctatgctggcagctggtgctcacctcggcagcacacacactgcactggtggatgggaacttctatgactgacgccaaatagcacactgaaatttgaacacagtgtttatgatcctgaggttgaaattttaaaaaatttctcaatggcaagcatcaacctcaggacactaagtggagaaagtgagatgttattaccaaatctcaagcttgactaacattaaggtgcttgacttgaatcagtgtttctaaaagaaaatgaaaacttctccttcactgtgactcacaaataaccagtaaacaagaataatatgttatagaggtgaaaccagctactcatggactcaaattttcagttgtactgaagtgaactgggcaaaaaatcttttaagaactgcctccaggagtgttggctattttgtaaatagtcaaggatgatggttttcagactgtctagataaccttaacctcaccatgaaatgcaaattatttgctttaaatggcaaaaagtagaaaagctctattttgaatggtattttgtttttaaaatactcttactctttaaagtaagagtcaagaaataaaagacatttatttgggcttagaacacaatttatctgagattttatggtaataacaatactgaatcacttttttttttttttttttttttttttttttttggtgaaccacaggcccataagatcctggctctaattctggctttaccattcctagctgtatgagaattggaaaattccttaatttctctgaggctcttcattttcttctatacaatggggacaagtgtaataatggtattaacaaagtggatgtaaacatgaaataagataataagtgtaaagctcttaccacaaattaagagcataaaaagttatcagaaatggtcatgtatccttggttataaatacaggtcatatatcaattctggcatttatttaagcaaaaaacctttaaattccactcttattttggtgcctgatttttttttttttttttttttgagacagagtcttgctctctcacccagactggagtgcagcagcacaatctcagctcactgcacctcccgggttcaagcaattctcctgcctcaacctcccgagtagctggggttacaggtgtgcaccaccatgcctggctaatttttttgtatttttaatagagatggggtttcaccacattgcccaggctagtcttgaactcctgagctcaggcaatccacgcaccttggcctcccaaagtgcggagattacaggcatgagccgctgtgcccagcctaggtgcctgattttatttttaaaaattaattttcaggcatggcaacaaataaagaaaaaacacacccatttcacgatgcttattggtgacccccaggagaagtgaattgagctatttgagggaaggacagacacacacacgcacatgcatgtgtgtgcaggtgcacatgtctctaaacatagtataaatagattatgccaaccagcacagctccagatgagagtgtctgatgccacagcggcacatcatgagcagtcacccttcactcaacttctagcttgaatagaggacagagatttcaggagcatcgccaagtgatgggtttgggcctggcagatgtgattctgagtagctactgcagcttcggtgcctataggactaatactgcagagatacagtgttttatctttcaaagccagtacattccagggaggctgtatcctggggctgctaaagacgcctgcaagactggcctggaagaaatcctgggagggtctgcttcaggccactgagctaggctggaaacacctgggacagcgcgcctctgacccctgagccacactcgggaggaaccccacactctggcaacaaggactgggaatgtcctagttaggcctccctccctccaccacagcctcggaaggtacttcccgcttgggctctttcttggcaagctggagtttcaagtctttttttttttttttttttttttaaacaccaacctagacatctctagacagtacaaaagtactggaaaatggggaagcaagttttaataataggtacctttggtttataatagaaccaccccccccccttttttttttttaagaaacaggatttaaagaaaaaatgttttcagttcagagccagctttttttttttttttttttttttttttttttgagatggagtctcactctgtcacccaggctggagtgcagtggcacgatctcagctcactgcaagctccgcctcctgggttaacaccattctcctgcctcagcccccccaggagctgggactacaggcgcctgccaccagcctggctaccttttttttatttttagtagagacggggtttcaccgtgttagccaggatggtctcgatctcctgacctcatgatctgcccgcctcagcgtcccaaagtgctgggattacaggcatgagccaccgtgccctggccagagccagccatttttaagtgggacaattccagtacaattggccttgttgctgggcaaagacactaggattcattgtgctattctaaataaacttttcgatcaagagatggaaatgcacaacacatcataaaggatgtgaaggaacatttccccctttctccttaattagagcacttggtatttgtgatgaattaggctgactcggtaacctacaggacataaatctgcagaacaattctattttccaattgctagctaggttaacacgccttaataaacaaataaatatctccatatggactattatccaaagcaattgtgaatccttgcagtacggggcagcgtgtggtggtgacatcctgtgaatggccgagttctgaggccgtcctcgagcgtccatttgagtagtggcctaaatgaggggtgcccttcacggatggaataaggtaacattttgattaatgcaatgagcatgctgctgaatgttacagtcagtattaaaatggcatgtgctaatttaaaatcttagttgtcattagattagagtgcaaaggagagccaccttttgagaagacttacttcatctcagggggcagaaacaagcctgtctctgtttgccactgcaggtgtctggccaacaatgcttgggctctgaaaacatcctgaaatacatatatatatatatatatatatatatatatatatatatatatatatatatttttttttttttttcttttcctaaaacaacatggaaaggtactaagcagcttacttgtggaaatgtataaaactaaatcaaagactttaatacaactgcaaaaagtcacaaagtggaaaaagggcagaattgaaaagcaatgtgattcatgtctggtaataggtttttgagtttttaaaattttttaaattttttattttttgagacagagtcttgctctgttgcccaggctagagtgcagtggcacagtctctgctcactgtaacctctaccgcctgggctcaagtgattctcctgcctcagcctccccagtagctggaattacaggcacctgccaccacgcccagtgaatttttgtattttgagtagagacagggtttttgccatgttggccaggctgatcttgaactcctgacctcaactgacctgcccacctgtgcctcccaaagtgctgggattacaggcctaagcgactgcacccagccttgttaataggtttttaaagatgggtatgcttttgtggccaaaatgcaaaagacgtatttttgtcagcaactaaatattatttggaatttcttctcatgatctctagaaaatacttgatcaggaaaaataacttaagttatcatttttacctttttccaattgcaactctttttaaagagtccaagtaaatcttttttttttttctcctgattgtctttggaagtattgatccagaaatacttcatttcaatggttacaagtaacaataaatttaaaatagcatctgatttcctacaatgctcatttctgtatttatttgaaaatgagacttgcagggagccattatccacactgtgctttgacgccaggtggcttcgctcctggttctgatgggcagctcaagtggcgctggagcttttgctggccacacactcactggaggaccctgtgtcagacagtgcatggccgatgacacagctgtggtcaggacctgccgctgccctttggagctcacagtcccaaggggtaggcagatatgtgtggccagataatgtactaagtcacactgtgttcacctgaagttctcgttcttcatgccaaagggcatagagccctttgtacctgtgcagaggacgtctgcaatgccaagagcaaagggctcctgcagatagaccagggaccgcctcctgggttctgtgaaagccgcagttccccaagtctcctggactcctgagaggaaagagagagtcagggacgagtggctgtgaggagaagagagaggacagggtaaagacggcagataccaaaagaggaagaaaggaccagcgctctgcacgcactgggctcagctccctggaagcccccatgggaggtggccaggtgtccacagggagggctgcccaatgggccccacgaggcagctccactgggcatggcagcagtggagcaaccacttgggaacacacaggtgtggaaaagggcaacatccagagatttttcggattccatagaggcctccctgaggcttgggtgatgccggggaggaaaagagagccgggaatgctgagatggaatttgctggtcagccaagagtcagatttaatttgattttaagaaactaaagaagtatggcatttcttgcacatttaagtttgtggtttaaattttgaactcaccaaaacatgtacagaaatggttagggtgcattgtgaggactgaggaacaagactaccctgggcagaggcaggagtgagatcggagctggggaaaggcctcctgtggaggggctgcggggagcaggctcttgagggtagagtgcaagggggttgggtggagaaagatggggggcattctcaggcactgcgttcaggagaagggccctggaggtgaaacaaacagcttctcttttgtcttctgtggtttctcagcctttcattcggaaacacttggcaacatgggagggagcagagggccgctctgcaagacgcgaggcctggtgggaagccaggcgagaggagcagaacatggccacagcatgaagaaccatccctgcaccacacagtagagggtgagcagatgcctggatgcaccccaatcccccagcaaagccctgagctgctttgagcctcagttacctcggtggcccaatggagactgcactgtctcccggcaaggctgctgggcagctcacggaaaggacaactgtaagatacaggtgttttctgcctggcggtggtgagggctcctcacatttttcttttatcctaaaagcaacaaggagcagcagcagtttttagggaggagcatgcatggcacgacctacgtgccctttactcatctggcaagggcccaagctgagtgaaatctgacatcgtagtagagcaggtcctttgggcctatgaggaggcagaagggaaggaagaaggacggcttccctggtgttgactcagcaataaagctttcacctgcagagaagggtcgggatgctgacagcagcccactgattgcaactcagtctctcttgttccagtttcccagacgcgtctgggtcctgggaaaagaggactggagtgtcaaaatggggaagaatcatttcattctaatctgcactcgatcttagccaaaagtctgagaagcaatttccattctaattgtaaaacaagtggcaagagctaggcatctctgggactcctttaacagaagacgaacaaaggggaagaccattgcctctttctctcaatccctttcctctcccctcagctcagagctccaggtggctccagcagctctgacatcacctgcacccatagcgcttgacagggcagcacctgaacgcttgtaagtcagacctgacaggagcacctgtgctgcttggcagggtggtgtggggcgaactggagtgaatctgtccttgggtacatggaaaacatactctaaggactcctgaaattgaagaaggcttactgctgtgaccatggccatattgatagctgtaggcaggctgttggggtgtggtgagacgggcattataagacagggatagcagtggcacagaaggattgatgtggacaaagagccacagcaaaaacaccagcgagaagacagctgccatgatttaaatgagagaatatagggctctgaaatttaaaaactgacaaaggtgacacaaattcttcacttaaatttcatatccctgaattatctgcataaaacaaagggtaaaagggagaaggtggattttaatcttagcatggaaacacccacatttaaatgtaaagatgtgaatatattctaagtattttaaaaagatatattcaaaataattaaaatgtttctcattttaaagaaataagatgtcagatgaaagatgttggacagttattcttgaaagtggtctaagattgtttacaaatcatgtctgcttggagaaaacatttttcaaaaaaatttatttaaaaaaaattttcattttaaggctgttaaaaaaatttatttattattacaacttttttttgtagagatgagggtcttaccatgttgcccaggctggtctcaagcaatcctcccaccttggcctctcaaagtgctgggattacacgtgtgagttacccaccgtgcccaatctcaaaaaaatatttaataagaggaaaatccatgtattggctcctatcaatcactgcccactattcagcctttctccccaattgactaagaaatttatgtcacatgatagaagtgaagaaaaattaagtatattcacgttatatctaaagctttgtataatatctaattattccaacaccaataaaatctgttatcacctattagagggaaaaaatgtccactatttagaaaatgtatagagaaatgacctggaaataatgaccattctaaagacacatgtaaatatctatagttttaaagcatattttaaaatgagataatttaacaaataagagttacaatgataaaacaacaattatttcactaaagtctatattttaggtcatagaaagtgcttttttaaaaggaaaaaaaaaaaaacattcctgtgcagcattttacagatttcaaagcatcattaaacaactgagaagtgaatttcttttcagaacaggagaggccatgcatctcttacaccacatctccatctatttcatcagcagttgtgttaaaattcctagatgagggatcagaaagctttggaacttgaaatcagtttgtcctcaagactggtggttaacatgatatcattgactattggaaacaactgaaaaactcttttttttcctattagaacatcgaatacttctacagaatatttctattctatgttctaatgtaaaaatattcattttttaaattttttaattcttttaaggctttaaattttgacaggtttgccagtactcttgctcggcagttttttctacttcatctgttagtctgccctcctccctgtctggaatgatctgcatagaaaggattgtgcaaattctcatcggccacaaacgttctgctcacatgtaccagatgaccctagtgccttgcaagaaacttgagacccatcgcatgatttctccagaatcagatccaacaggatgcactgctcctgctgaacaactaagaaacgttattttcaaccccagcttgaaaacttgatagatagtgttttcttattagtaatgacccactggctaagcccttttcagacatctaacaggtcatgagtatgtgattatcatgctcaaatttacacatatgaggggccctagtatggtttctctctttctatatagtgcaaaaacctaacgattaaatattgatttaaaagagtgtttggagctcagccagtaattgtgcagcccggttcctaacaggtcacagccaagtacgagcctgaggctcaggggctggggacccctgatgtataccactggcgagggactctaataatgggaaagactacacatgtatgatggatatgagggcaaagggtatatggggtatctctgtaccttcctctcaactttgctgtgaacccaaaactgctgtaacaaattaaggtcttaaaatacatatattacttctcttcatcactgaggtttctgatacccccttaaattttgtactccaggccaatgcctcagcaacctcaccccggtcccaggcctgtggctcatcatatgtttccaaatcaccgatgggttttgcttctagtgacttatgtaaatataagcattattttacaatgtttttaaatttaatgacaaaaatactgcacactcataaaaagtaaaaagtagaaaacagcaaaaaaaaaaaaaaaaaagagtgggtaaattgttgactggtcatgattttgtagaaaatagtaaatttgagagcataagaagtttgagatcagctttgaagttcctgagttcaggtcattagcatttaattatcaatgccacctttcagccatggttctccatttttataagtggatgcctagagcacttggtgggatttcagcaatactttcatagctctccaggtgatgtcaatggctagggtaaatggtgtgggtggcatgatacagaacatctgactttcccctcattcttcccatatgtttacatcctacttatctacatagatcaaccaataaaccctttgcgtaaaaattacatacacactataatgctcttataaatcttcacactttgttgacacttagtaaatattaaaaaccataaatcacagaaaaaatattattaagttttgttattatgggtccaatctacccagtggcttaccatgatctacggaataaatttcatactccttagatttgaattaaacatccccagagtctgttgccaagattttccagcttctttcaaactacttcctatccatacacagggctccagtgagttaggaattatattctccgagaggaccctggaatgtctgccttcgtatctttgctagttttgttcctttgacttcaaacacacttagcccagactccctattcaaagcaaaccacagccatctccttaggaaactttctccattccccacaagggcgtgcctccatggccccacactgcacacatccctacagtaccaggaaccacgcctgaccttggagctggagttgtttgttactggctagtttcctccaggacaaagtaaactcactgaagacagagaaggtttcttatagcttcttccttgctgtgcactttatagagaatgaaaaagtgttccattgaatggaatagaatcaagaagtcatgtttgggtagtagaaatggaatggacaatcctcttttttaaagaatacaacactggccagtcacggtggctcatgcctgtaatcccagcactttgggaggccaaggcgggcagactgcctgaggtcaggagttcgagactagtctggccaacatggtgaaactctgtctctactaaaaatacaaaaaaattggccaggcttggtggcatgtgcctgtaatcccagctactcgggaggctgagacaggggaattgcttgaaccagggaggtggaggttgcagtgagccgagatcgcaccactgcattccagcctgggagacagagagagactccatctcaaaaaaaaaaaaaaaaaaaaaaaaaaagaatacaacattaacaaaataagatatatctttttttttaaattaaaaaaaaatgtatgttttgagatagagtctctgtcacccaggctggagtgcagtggcaccatctcggctcactgcaacctctgcctcctgggttcaagcaatttttctgcctcagcttcctgagtagctgggactgcaggcgcgaaccaccacgcccggctaatttttgtatttttaatagagacggggtgtcaccatattggccaggctggtctcgaactgctagacctgatgatccgcctgcctcagcctctcaaagtgctgggattacaggtttgagccaccgcgccgggccaagatatatctattaaaaatatattaaacatgttttcctgtctttagagtcatatcctgttgtgtctgtcctttcaaatggaaaccttgacacagctgcagtacactctgctttaattacttacttaatttgaagaatgttaaaggtaaaattgtaataagaaattgtttcccaacatactttccttaggttccctgctacctctttagttttgtttttttcttttcattccatatctccaatccacacagaatgaattttatttccttccctcgtcagtctttcaacctcccccgcaattctcaaccctgcaattcaacactctgctcccaaaccagccttcttgtcacttccaactcatcttcttatttaagctgcattgcttttccgtgaattagactggatcttaagtgaaggagacacaaaccaactgcaaatgatgaataaataccatcagtggggacttagtgaatggctaggtcattttcacccccagtgccaggaccatcatgggaaagtcgtccttttggctgttccggaagaagtggcagcatagtgactttctcctttccctgtggatagcatgcaacaggaccaaagggagtattctgggctcccaaaacatggggaagagcctatgctctcatgtttggacattcctagcaacgggttccattaaaaagctgtcctaaactctaggcttatcaagacttttacataaaaagactattgcatttttaaaacataaatttcattcctttatgaacttcaaatttgctgctactaaaaacatgattgctcttgtttccatgggacttttcttctagtgagtctttgtggaatgcctgtgatggccaggtactagtatagcggcgcaaatacaacagcaactagtcagacacacctacactcaaggaatttacatttgtgttagtgaaacaggcaataaagaagggaatgacaagcccacctttttgctcttgttcaccactcagtgaaggtccatgggctgaggtgggctgtgggtctctttgtctggtgcaccttgttctgaagcaagggcatcccaacagacaacagctgcccttgtgtggcccaaggctcaatattgtccttgacgtggacatggaaggaaacacagaaatttcaacctctgcttccgagaaatgattgccaattcattcagaggttagtctgcagagctgactgagatcaccaagggaaactggaagcttattgccttccaactttatttctttgagtgcaaagcctatgaagataatctgttctcagtcaaagagaaatttaatatagcactccctgatttcttctatttaattcatagtctcctggcaatccctaaagtacattcactgtgtgttcaagttttgccttgttgtttgcttgcatcaaagagagaattaaattgtacacacacacacacacacacacacacacacacacacacacacacacacaaagtgaacccagatcccggttccctcaaggctggcctaaaagttattgttttcatatcaggtttaatcaacagcttctgtcatattccatatgccacctcgttctattgctaacacttttattttctaatgattaaccttaacacacacaattttgccttagcttagccattttagttatataatcattctgaaggaaaaggtcaaatttatgaatttctagactgttcagcaccctgtagggactgtcaaaaccttttaaaataaaagtgattattttccatgccaagaaatcgctgggtcattgggaacagtgggcgcatcttgcttcccatgccagcatgccctgagtgtccctggccaatgcatttctaggggtttccatgctagatgtcctctttagacataaacagttttcacgcccagcttaatcatttatccgagggttctttaaaatgtgaaagtcattctataaagaaaaatttttttttttgagacaagagttttgctgtttttgcccaggctggagtacagtggcgcgatcttggctcactgcaacctctgcctcccaggttcaagtgattctcctacctcaactgcccaagtagctgggattacatacaggtgccaccacacctggctaattttgtatttttagtagagatgggatttcaccatgttggccaggctggtctcgagctcctgacctcaagggatacacgcccgcctcggcctcccaaagtgctgggattacagacatgacacaccgcagctggccagaattttaaaatttaatttagaattaaatgattaagaaaaataaattttgcagctgaagatggaaattccatgctctaacttccccatgccaccagtgattacactgtaaggtggatcctaaaacatgaggtcattatagggagacaccactctgtgccttggtgtgagtcccccactctctctaccagactttttactgtcttgtctttgcctttccattcagtcagggctgtcctggcaatggaaggcactgctgcgcaccctccttacactctggccattgagagtttggtgtgtaaaggacagcagggatttacaatcccacagacacagagtttgaattggaactttcctctaatgtcagcaggctgagctccattatggacacatcccagagtccttacaagaggaagaatctggaagatgctggaatggcttggacttaaagagccttctaacctgactcactgttaacttcctgtgatggttaattttatacatccacttgacaaaatcatgggatgcccagatatctggctaaacattatttctggttgtgtccgtgagggtgtttctggattagcatttgagttgagaaaagcagatggcctccccagaatggatgggcagcatcccatcactaaggacccgaacagaacaaaaaggcagaggaactctgaattttccctccgcctgacctcttgagctgggacatcaatcctctcctgccctcagcactcctagttcttaggcctcagactctgactggaatgcacaccattggctctccagctcccaggccttcaaacggcatcagcagctttcgtatgactccagcttgcagatggcagattgtgggacttttcagcctccataaacgcaagaaccaatttctcataataaatttctattaatctatctatctgtgtatcgatcgattgaacaatccatccatccatccatccatccatccatccatccatccatccatccaaccatccgtccatccatccgtcctcctttcctttccatccatccatccatccatccatccatccatccacccacccctatcctattcctatctatccatctatccacctattcctcaatccatctatctttcctattggttctgtttctccagagagccttaacatactgctttagaaacctccatctcttccacatactgcagtctaccagttggatcttttgtaggcttcaaccctaacctctcacttcctgagttcagtgcctggaaaaacagcctcttgggtctaatcttttcttccgaagcaaggcccctgcaggcagctctcacccgggtttgccaggcttcatggcaggttcagttctacttttactatatctctaacccataagttctgctttccaagactttttctaaaattggggatcaagaagtgctggggctgaaagcctaacaaatatctaggaaggagaatctacttaacatggggaataggactttctgcatctctgtttttgaatagagattatctggagcctgtctaggttatctgctcatgctgaaaaaggcttctctaacacatgtattttctccacaaggcacatcatagccttcttgcacttaggaatactagacagcactatgcttggggggcattttaaacagtaagatcaccaacaaaaagcacaaaaatgtaaaaaccacggtactaaataggccatgaaaaggacatccttgttcatagcatgagagctgaaacaagaaggcagagcattgctctttcatccacagcagacagcaagagtgttgggtgagtcaaactttgttgctctgcaaatgtcgatgaagatcttaaaggcgtctggaatactgattttggggttacaaataagacttagcgagtgggcaaacagcaaagacagaaactgtgatgacactgtcatcacacactttgaatacaatgttttctgagtttgccgatttgtggactatcctgaatttgtgctcaatttttatctctctccaactgcttatgttttgcctctctctccatgtcaacagattacactctataagggaaaatggaaataaagatgcaggcgaaacttgaatatcggtgtgggttttgcatggcaaacactgacgccaaatttgcctctactctgaatgctcaagttgtgggagcgctactttaagatggaaatatgtgctctaagggaaataataaccagaataactttagttttaaaattatataccaagaggaaaaaaaatagtaaaaacccaactccttcttactaagtttttaaagaaacactcaaaaaagtaaaattaaacccccagagtataattcccattctaatgaccactgagcacgtcattgcttttggttgataaaataagcacatgttcttctctttacctcgaaaacttgaatgatttcaaagacaacaagtaggcagtaatttaaagtctttttttgtgagcttgccattctgctcttcgtggggatctttgtgatgggaaactgtaaatacagttttagaagtaaaagctttcatcttaatgactataggattagaaaaagataagaagctactataggaaaagtgggtgggctgggcacagtggcttacgcctgcaatcccagcactgggaggctgaggggggcggatcatttgaggtcgagaatttgagaccagcctggccaacatgttgaaagtgtgtctgctataaaaacaaacaaaacaaacaaacaaacgaacaaacaaaaccaacccccccacaaaaattagctggcatggtagcgcacacctgtaatcccagctacttgggaggctgaggcatgaggattgcttgaacctgagaggctgaggttgcagtgagcagagatcataccactgcactctaacctgggcaacagagtgagactctgtctcaaaaaaaaaaaaaaaaaagaaaaaagtggatggatattaccacatatttttaaataaaatttagcaatcctggtaattttgggttcttgattttaaacacaatatatttctgattataaaaatatttttctgatcataaaaatagatgtctttagaattaaaaaaacacataaacataaaaaggagataatttaaaaagcttataaaacatagaagaaaaactagccctaaatatttctgaaaaccaatataatgtcattttaaatggcacacagggcaataccaacatagatctctttgttcgaaagatagattttttctgtcttttaatttatctaaaaataaatcatggtgtatttttttccctccattctttacaggagtatgggtgttttatcttatcagatttccttcatggggaaaatgtatgtgacttagtcacccagccaggtgatggttgactacaggtggaccaaggaatgaaagttggcaagtttgggcactttttttatattcaattctcaggaaagagatacccaaaattatgtgtctctgctgaacaatacatacaattatgaccagcaataggagttgtggaggccatagctctggggttcaaaatgatcctgaaataaagtattagaaaccctctcatttctttctaatattggaaaagtcacatgtcttttaaaattaacaaccacattatcatgagcaattctaattttccccaatgtaatcatcacgaaaacatttgtgattgacaggttttctaccccagatgtaaatttttggaaatactaatatacaattacttttcataatgggtgcacagctactaaatgatgtatggccaattcccaaagtttcaaatggataaatattagtctaatgtgctcaatcaatgcagagaaatagctctaagcccttttcctgcaagggaaaatatttaccgtatatcacagatagattggccacaggcactaagcagtgatggagaagcctagaaatccttgtaaatgtccttgtacttcagtgaaggacatcctcaaaagacagaaaggaaaaagaaaagaaaactctgaatggtgttacctcaagcattctctaaaacacagcacttagaatcagacctgcatcagcacgttgctgcttgacacacgaaagcccctttgcatttaacaacaacacaacaaaggttacagagaacttttgatatccttcatttaccagattatttcttccatccatagtttacagcactgaattagagattgttaatagtaataataataagaaaaaaagattttgaccatggactatgatgtaacccatcatagtggatcaactgtatactgagtctgactagaaaaaaatcaaaacagtaaaataccaatcagatgcacttcacataatgttgtccttttaaattttgaattgtggtacaatatacataacgtaaataccctttggggtttttttttaagcaattaggcacacagtgtgcaatttataactgctatgaaataaccctacccctctttatttgggcaaaggtcactatggattttttttttaatttttaactgtagaaaaggatggaatttcccacctttccttaaataagaaattccagacaatcacatcatgtccattacatcccaatactcggttttgactaagaactggatgcacatctatctaactgtccaaatccctttttggattctcaaatagtgaatcttcttggaatcagtggttaaagttcccactttttcacctggaccgtatgggtgacagactccctgtttgctaacatgaggatgacagttacagatttcaatgcaaactaaggaagaattctcagctgagttgtgctgtgtagaaaacagaattggcagctttgtgaagtgggggctcccagtacttagaagtcccgaactgtggcttgacactcactgcgggatcagaatctcctggtgggcattcactaaactcagatgcccagacctcatcattaattgtcctcggtgggacccaggcatcggcatttcttaaaaacctccccaggcaattccaatctacattgaagcctgccaatccctgtgtagtcacaggctacaggctcccaggtcaacccaggtggcctctgacatccctaccagccccaggactgtggactaggacacggttttgcctaatgactgattatatcctgccttggttaagggcaatagaattgagaagattagcactgcccccaactggctacaaaaggaatggaaaagctcaaaggaagaaccatggaggtagaatataccgggagccaagaaaattgttttcaactacctgaaatgagagaggttcctctataatgatgaacaaatgacagagaaagcagttttgatctaataatgtccagtccaggggtaaatggggttcttccgctcctaacacttttgttgctctttgcccacttcttggtgtactagtaaccaccctattgggcactcagtgtcttcccaaatccacatgtgttctcagcaaaggcctgatctcagttatttacaccagcaaagtgaatgcaagtttacctggtaacctcactcaaaagtgttgcattttgagccttaactccacaaaatgaagagtctgaaccattttgaaaggaacctaaagacaactgagaaggcaaggacatctttgtagagcagaagtcttttcctgtaagtctgagatctttccatagaagcggctgctagagggaaagatgagagacagggtgaggattaatggggacaaaaccctggaagagaaagttggaaacggtacagtcaatcatgagagcacaggacatttacagagaaaagagtgaggaggtgtttttcaattccataaaatagaaaataggaagagtgagcttagatcatagcgtgatcaattttaagcaaatagacgatgagaaatacttttctgattacatagtggactgggtggcggacagaggctgaagaagtgtttaaaaacaggccatgcattctcatatctgcatagaacatccaagcattacatacgtctctcattattccaaagcattacatacatctctccttagaagagcgatgaagctataggacacaagacccagtccaggatacagcatgaaagagaagatattaaatagctagcagagagtcagatgacaatcagtagataaaaagggcttggaaatggtaagcattatagaattttggaaaaccatttttttcccatagttaagagaccccattcttcaaggccttgatcctgaataaatgtcctttcagggttgacaccctatttttatgacttaaaatatttggacgggatatttggaagtttctaaactctgctgaactaaaatctgctgaacaaataaagggaagaactctgttttgtaccatgtaatttacttaaatgccccactacagtgtaaaagtagactagaccattcacttcatgccctcaggttttcaacatgccagatgtccagttgaggaacgtatctaaatctaaggatattcctaaattcttctgcaaagtttcaaggctattggtaataacatatatttagtggtcaacttggaggctaacgttggtctttctatttctgtaacagcttgcacagtatcatgcaggcatacatgtgagtctagatgtagatctagacatatataacccaatcagtgcatttcaagtatctaattctaccctcttacaaagttttatttattgttaagattatttcagaagcaccatagataggaatatgtatgttaaatttagctaattcatgctattcacacaaatgcactactactttgtgattttattgtaaaaaatgatatttgcatgctcagtcagcctcagtactaagcatccaacttcccgatttgctgattttttgtaggtagaactgtgcatgactcagaaactaaagagaacatgtaagccctacattctttcattgaaatggtgattgcctggatcacatgcacagagccagtattcattgcacataatgtagcttccctgttctcagtgttccctggatctggcagcacctcagggtcatttaaactacacaaacttttcaaggatcctgcactttctgtctgtgtggctccgtgtgaagtagcctgttagtcccttagcagcaaagtatgagtggatcataatatagtatctgaaataaggaaactataagtgattctccacttgggatgacacctttcttgaaactcatcctctggtaatgtggaatttgaagagctgatatttgtaatctctaacttttaggagagaaggaaagacaatgatatcatggaatgcacacattataatatttgctgtgaattacgtgcttcctatgaaaagctacaaagatgaaggcatctctttctctatgtagcaactgtgctctagcaggctgttgcttcagtaagagcactctttactcacagcccctgtacaacctgggctcctacaataaaatattccaaatgtaagcttgccctctcataaagtccaacaaattcagtctctagtctcaacgttctttatctttgttgttggttaatttgctcctctgaactgatagtatgtaaaacagtattctttctctccccaggactgaatagcagaattagaatgtctccctgcctctcttctctaatcttgtaagccattggtaagttcaatatctgtttcaaacacattgtcattgaccattatccaggaaaactcaattcaccatgacctttaagttgaaaatactctttaattaaacatcaaggagggacaattactgaaaatcaatccctggcattttctaattgtggaacaattttttaaatgtcagggtccatgttcatgtaggccattttacatttttatttttcatttttattagttttccctcaattctgtatttatagattcattactcccaacaattacccttataaaaggttccaagtgtttcttttcatgtcttggattaatgggccataatttcacacctaacactttagtaaagaaacatgcttacttataaaacatacaacatgggtcaaaatccaacaaaagcttctaatatgagactaattaaattaaattgtgattagattgaaggagtgaatcaattaaataacaatggcctaaacttcaagttacacttaaagatctatatatttaaaatgtcaacaacatgcaaaaaaaatcacaccaaatacaaatatgcagacaggctacatgtagccagaaggatatagtaggataatgggccttacagatcaacaaattggagaatttacaatggagaaaataacaccaacacataaaaatactatacaagtcaagcaaaggtaaattattcatccattgaaacaaatatttattcaggataatgcctagagtctaaatttgtctaagaaaccacagtagttagaataaatcctaatttggagaaattgatcaactgattctaaagtttatgtggaagggcaaatgacttagaatatgtaaactgtttttttaaaaggacaaatctgaacaactaacactatctgcttttaagacttattagaaatgtacaattatcagaataatgtggtattggtacaaacagaatagatcaagacaaaaggatagagagttcatagatagaacctcacatatatggacaattgattttttgacagaagtacaaaggcaattctgtcaggagaaaacagtatatttaacaagtaatgctaacataatttgatattcatatgcaaataaactttgattcccactgatttgcacaaaatgaataatagatataaaggtaaaacactaaactataaaagttctagcagaaaacagaagagaaaagcatgatccataaaagaacaaactgacaaactggacttcatcaaagtgaaaagatctgctctttgaaagacactattaaaagactgaaacagcaacctttaccttgggagaaaatattttcatgtatctgataaaggacatgtaactagagtatagaaatcactctaaaaactcaataataaaagtgtaattaagtagtggcaaaagagttgaatggatgcctcacaaaagaagatacaagggtggcaaatgagcacatgaaaagaggctcaacatcgttagtcattaagagaatgcaaattaaaaccacacctattagaataaaaccaaaatttaaaacatgaagcatatcaagtgttgagaatgaggtggaggaaatggaaccctgattcactgctagtgggaaggtacaatggtacaaccactttggaaaatagaaacatacactatccaaatggcccagttattccactcctaagtatttacccaatagaaattaaaccatatgttcataaagttgtaaatagtcataacagttttatttttaatagttccaaagtggaatgacccaaacgtccaccaacaggtaaacggataacaaactgtgaaatgtctccaaaagaatgaataaaaaggaatgaactattccattgataagttacaacatggataaccttaatataatctataatctcaataccgtgtatctcaatataattaggctgagtataaaaagccagacctaataagagtacaggttgtattattctatttatataataaaaatttcaggaaatgcaaagtaatctgcattgacaacaagcacagtggttgcctatggatggggaaagacagggttgtgtcagaggaagggattacaaaggatgaggaaactcttgggggtgatagagaagttcaccgtcctgatggtgagggtggtttcaccgatgtgtacatacaacaacatgtatcagactgtacactttcaacatgtgcagttacttcaactatttccaaattacataatcctttgtttttccctcctgtccattatctacaactttgaattggttggagagctttagaagcctttgttggacactattagtggcctgcagggtctgcagtcatgggtatttctaatcttccttgacctgctttgtcttcctttggttcccacctttgttgctgttataagccctttaatcactgcactactagatgccatctagtaggacaccatgttccccatctttgaacatcttttccatcttcttttccaattgcagtgcctgtttggccctcgtttacctccccagctctccttggctatactaattcctcttaattccttcaacataccctacttcaccttgatttggggtcttcttattagaagttctctatttctggaaaactttccttctaacctctttgatcctggctaattcctacttattctttaggcctcagctgcatgttgttttcttgggaaagtccaattatttctcccaccaaagtttggcttcagtggccctgatagaagaccctgaacttcccatcagcacttctccactcaattacattgccctgtttacttaccagtattcctccagggcacagggtcacctcaattcagatctgattagggacctgatgtatatcaggtaatggggttagctgttggaggctacaacttccccatttcctggagtaaatttaaggatatgtccaactaaaaccaaaccaaacatttgtttcctgcctgtgagcacaacataagaaattcaaactaggtgaccaactgtcttattaaacttccatttgtaccaaaagcaacttcttactgagaggacattttggtcctgagaaattcttccctgtagtgttttaggataaggacatttggaatttgaaattgcagtctactgtgtcattttctcaaacctggtcttattacactctagccaaagaaatatgaaatgaagatctgatccaatttgggacccccaaaaggaattgtaatgaaggttatatttcaaattatgtaggctggttacatggtcagtatgtagcagctgactgcctggtgttttattttgtttgtctgtatagatatagcatatctaagaaagacaacttcattttatagagttagaaaaacaacccttgagatttattaggaaagtcttgtgccagtccatcattcctgtaaatatacacgttgatcactaaatggtaagaaaggtgataggaactgaaataaccaaagtaggaaaatgtcacaacaaactcttcttgatcttctgcctgtccctgtacttggctcactgtgcaggaaagagttcttccttgggttaaacaggagcatgctcagcctgaagcagagatgatatgcctttcaattttgaaacacagtttccattgtgtgtgacccattatgtgtgacctcatttgtgggtgattaaaatgtgagtgattagaatgtgatgtcctcatagttactctctcactccctttgaatttcttggaataagtaaaacaataatgtaaaatgaaagttgctgattttttatacctcagatatgaattgctgataaacattttatttagggcacaaccaattcatataaatttaaaagtaaccataagaaatggatttttcagttacatcatctgtagtttttacatttaacctattacaaaataataaatcattgaaccatattcttttcagtgtcataatcaatgccagacaatcaattaaaaatttaggcatatgtattaactagtatagatcaatgtggcttgaatacacaaaatacgtccaaattctgtccaaggtaaataattatgatgctacatggttgttgtgtatatatttcacataaatttagaaattagtatttcaagagacattacaagtcattatgttcattctacgtctcaaacatattatgggaacagaaatacctttatttataaatagcatgtatcccaaaaaaatctatgggaatttgaatggcgggcatccagaaacttcatgtggtcgccagtgggaagtatatttttgacaagccgcatacacttagggccagccacggaagtagtgccaaaccaatgatgctactgcacttttacttagcttattgtgatttattgcaacagttaattctggctttctgtttcagaatgatctagtcatctatatttataatcattttaaatgaatatgtatttcatgttttcagttattcatgatcccttaaaaaatataaatgccttactgctagacacataagaagattaggttctataatagtaaaaatgccatcggaagatgagagaagagaaattctaccaaaattaggtaaaaagataaatttttaggacttcaaaaataaatgcaaggtggaagcaacaagccaagtgttcactgatgaatgactggatctgcagcagcccatccatacaatggaatactgtccagccttgaaaagagggaaattctgacccagcctatgacacaaatggaccttaaagactatgctaagtgaaataagccagtcaccaaaggtcaaataggtatgattgtatgattccacctatataaggtccttggagtagtcaaatgcatagaggaagaaagtaggatggtgaccatgagagaatggggggagggggaggagaggggaattggtgtctaatgggtactgagtgtcagtctgggaagatggaaaatgttctagagatgggtggtggtgatggttgccaacaatgtgaatttactcagtgccactgaactgtacatttgaagtggttaaaatggtaattttaggctatgtatattttaccacaataaaacaataattagaagatataagtgtaaaatgtaaaacatgtaaaagtgttaaaagaaaacacaggagaaaaatcttcatgacctggagttaggcaaataattctgaggcctgataccaaaagcatgagccatagaaataatttgataaattgtattttattataataaaccaattttgatctgcaagaggcactattaaaagaattaaaagactaactgtaggctggaagaaaatatgtacaaatcatgtacctaccaaagaatttaaatatataaacaatgaaaacctctgaagattcaacagtaaaaaaaaaaaaaaaagaaaacaatttaaaaatggataaaaagcaggaggatagcttgaggacaggagtttgagaccagccttggcaaactagtgagacctattgctacaaaaataatttttaaaaaattagccaggcatggtagcacctgtaattctagttacatgggaggctgaggcaggaggatttcttgagcctaggagtttgaggctacagtgagccatgatcactccagccagggcaatggacagagcaagaccttgtctctaacaaacaaaaaacaaacaaaggataaaacagacattttgccaaaggagatatataaatggcaaataagcccatggaaagacaatcaacatcactagtcattagtgaaacataagttaaagtcctgaccaggtatcactacatgcccattagaatggataaaataaaggccagataacaccagggctggcaaagatgcagagcactaaagactccaaatgacaagattgtatacatagaaaatccaaaatcatacaaagcattagagtgattccctgacagccacacgattcccacctcacctctgccaggcttagctctcatgttgacttttcagggaaatctccaaccaccaccttgtttaataaacattgtaatgcctctccaatccattctctcaatcctaggtactttatctcccctctacaaccttagcatatgaaactaaagtcctatttacataatttgtatgtgtctagtcagtttctaccagctggaatgtaaaccacatgaggacacacatctctctctctctctctctctttttttttttttttttttttttttttttttttttttacagagtcttgctctgtcactcaggctagagtgcagtggcacaatctcagctcactgcaacctccaccttccaggttcaagtgaatctgctgcctcagcctcccacgaatctaggattacaggcatgcaccaccacacctggctaatttttgtgtttttagttaagacagggtttcaccatgttggccaggctggtcttgagctcctggcctcaagtgatccaccagccttggcctcccaaagtgctgggattgcaggtgttagccaccacgcccggccgaggacatgcatctttgtttagttcagggatggaaagcagagcctgtgtggcatctagaagacggaacactcccagtacatacttgctgagtgcatgaaggcagtctcaggttgtattctctccagctgttggactattttccccccatgaatcagactaaaataccccaccactggtttggtcatccgctcagctaactaacctaatttcccctcatactctgactcgtgctgccatctttcgtcagtttacctgtgttctctacttaaacctcaccttagattttatccactccctgaaaattagctttcttggtttttcttctttatctcacccgctgaatctggttactctgggattcgtttcgtgccctttttacagtcttgtcccacaggtctcatctaaatcaagggctttacaaactgtcaaatataagcagaaaatctgcacacccaggtcctccggttccccacctaggttagagctgcctcatggtcatctccctgagcctgtgcagtaccacaccaagcccaaaagtgcctcatccggtcatttctgaccagtcctctggtctgacttcccgactgtatccctttctctgtatccaaatgattcttcccatcacccagggctcaaacgttgcaatgatctatgcttcctcctccatcatacttcacatctgctcagctataaagagggttgttcagggtccctcagcagtaccacgtttctcagttacatatgtgctttagaatctacaggggacttttcaaagaatgtggatgattgggctccatcccaaatatcctgatttaattggtttggggttgagaataggcactggcgtttcttaaaggttctctgggtgatgccagcatgcaacacaggatggaattcactggtgatgactatgagctttggagtcatgcatccccttatccaaattattgtgggcatgactgtttgatatgctggagcctcagatcctcaactatatatagaggctcctcgacttacaatgggattacctcccaataagcccattgtaacttgaaaatatcataagtcaaaaatgcgtttaatacacctaacccaccgaacatcacagcttagcctagcctaccttaaatgtgctcagaacacttactctgccttgaagttgggcaaaacaatctgacatgaaacaagttttataataacgtgttgattatcttatgcaatttattgaatactgtacaaaaagtgaaaaacaaggttggattggtacttgaagtatggtttcaaccattgtgtatcacttttgcaccatcataaagtcaaataatcatatattggggactgtctgtgtagggattctaacatcagcctcaaagggttactatgtagattaatagagataaatatttgaaatttctaatgataaacggtaggtccttgatatataataattctctgtctcttcagttttcccatctgtaaaatgggaataaaagtactaagttcactggctgcattgaatgaaagtaaagttcccagtgaggcacctgtccctaactataccgtaccaagctaaagggacagatggaagacgctttaccaggttagacaaaggtttctttgtaaaccttgcttctttgtccattctcattctctgcatttctgtggttctactggtgcatacccctatgttgttgtaccttcttagcttctactccattgtcagattcacattactaatgcagagctccaaccgtgtcattattaaaactcttcaatggctcttcactgaccaccacactaatcatatgctcctcctgctgtcactggaatggaacaaatcagtccttctagccttgcttccagtagccccactctttcccctgcataccagataatgtggcccttcgctgttccacacattgcagcccactttcattcccctcctttccccccacatcctcaattctacctaacaaatctctacccatttcgattcatcctgtcctaatgcactcaacatcaactggatgctgtcatggctttcacgggatccctgggggatatcatctgaagaagccccacagaccaattcacacctctgtgccctctctcaccagcatagctttgcccatgcaagatcccacccgcttttcaggacctagctcaggagtcacctttctgaaggaaactgtcgctgactggcctcagtgggtcttgtgcccaccaaggtgctcccataacaccccgggttcacgcctctcaaaatgcatctcggacacactgtcaagctttgcttcactgtcatttgcttcttgacagcagcaagggtgccttactcatctgttctaggatgcaactggcacgcaggaaggaatcgataaacgaaagacaaggagagaaaagcagcattggaacctgtgcttgcagtattccaggtgactttttttttacagtctctctctgtcacgcaggctggagtgcggtggcgcaatctcggttgaagcaattctcctgtctcagcctcctgaggagctgggattacaggcgtgtaccaccacacacagctaatttttgtatttttagtagggatggggttttgccatgttggccaggctggtctcgaactcctggcctcaggtgatctaaccgcctcggcctcctaaagtgctgggattacaggcgtgagccaccacacccggactgactcatttattctgttcttaaacattaaagaaatattaaacagccagaaagagaaatttttaatgctgtttaacaataattaggaaaggcaagaaaactgtatttttaggaaaagcgatatcgaaaaactttatagaatttttcatggtccaaattctgatagtcacatatttctcataaagctttcaatttttcctgtctcattgtcggttttatacatgtgtttggtagatttgaagcaatgctagttcagtttaaaaaatattgacttcaacattatagctaatttccaaggggatattataccatctagttaaaaataacccttggaaatgtggttacttgtgttatttacacattttaatgttagcaataaaatggaaggttggttacatttaatgaatctgtacagttataagagaaagacagagattaattctgagtaggtcgttgctgctataatcaatagagtacatcataattgtgcgttgaggaaacgccggtatgctaaggcaaaagaacaatagtcatcaaatgagtggtcccttgggagttaatgaagaatctctttctccaataggaaagaaatgctttctaaaatttataataccatatggacacccacacatatggatggctcataaatgctctacatcaaagtgttatttttacattttcgacacaacaaacacactaaacaggtgttttaaatgtcacactttgaacagcagtaatttaatcagcataaaaaattcttagtagtatcattgaaatattagtgggatagagatgttttatttgggatatgcttcaactatatattcaaaggcagttttcgattttaacaaatttaatttttgtactctaagatcagactttccaattcagtgctctaattcctgtgcaatttgacagcagaccagtcctcatcctacacctccgtcactgcctgctgctttttttatccaggcaaggaagcttcctagggcttcaaacatacaatgaatccaaaaggactctgttggttactggctcttaacatttatagattagaaattctccttaataatgcccttctctgaaagtctaaaaatgatctaaatattcaaaaacaagaaaatgactatctcaaaactcacatttcatttttggagtatgttgccctcatttaatgatataatagttttagtgtctagaatcatacctagcatctggaattaagtgtctgattctaactatgaatatgattcttctcaataatataaaaaattataatgatagaattagtgaatactaagtttagtgagaagaccagaatatgaaattgtgcatacggcattgaaacactatgtttttagaagcttgtgaattttttaaaaaatccttaaaaatgactgtctgatggttgaacttagggaacatttattttataatgtctactctagtgtttcaataattttcttttatggaattataaaactttaatgtgaatttaaacatccaaaatattgtaaatattactactctttctctttgcattttaccactgccccaattacctttttcttttctttaaggttctgtagatttggttgatttcagaaaaaaaaaaaaaaaaaggagaaacattatagaaaattggaggattctgtgtatgggggggaggtatttctggacttagtgacattgcaacaggaacgtcattcacttaaccgttctttcaacagatacttactatattttcaaaataattaaacaagcaacagtaacagctagtatataaagagctccttctatgttctgcattttatgccctagattatctcatatatcattagagcaactttgtgaggaaaatattaattttattataaaagagaaaatcaagcctagaacgatgcagcgacgtgccccaggttgcctgtaagcagtggagctggtttctagagcccacatggctacgaataatgttgcccgatgcaacgagggaagctggaaatcccaggtgaagaaaacccagtctctgtcctcaagaaagtgaagaatctaagcaaagctttgcagcaacacttttagtgaaggaaaggttacacatctgtgctgtacagcatgacagccactagccacctatgacaactgagcacttgaaacgtgaattttaaattgtgtttaattttaattaatttctacttaactttaaagagttaaatatgactagtggataaatgattggacatcttagttttaaaggttgaggaagatataaagaggcatttataaaacactgcaggagctaatatgttttaaaaataaaatagtaatccaaatactcttgggaaaggagatctctgctacaattgcaatgtatatatgctgctttctgagaataatttaaagtttctcacttcaactgaaaatacaattttaattactttaaatgaaaataactggcattcaacttgttagatggcatatatttttatttctactctaacatgaatttatcagactcaattaattttatatgattgtgcatgagagctcttttttcagagaaaaagtagaaacatttcttgcttttctctcataacacatactttgtaaagtaccaaagtctgaacaaataattcacgtggaaattttgatattaatttaacctctaggagtacaattctaacctttgttctaagcatacaaatactacattttgaaagaagaattgtgggccaactgggtatgtatttagtttggttaatagcagatcatgagactcaataatctgaataaagagcagagactgttaaaagccaaacacttcacctgttatttccctttatttattgtatttgatttgctgtctccattaaatctcaaatcccaaataacctcagagtttccatgtattaagctttaagcattatataagaattctatatgtaaaacatctaagacaaagtttaaggatgaataaaattaccccaaaacatacaaattaccaagataccttaaatgtctttggaatatagcacaatataaataaatatttttgtagaaacgcaaatatattagaaaagttattcctcataagcaaaattatcactcttcctcaacagtcagtgcttcatggagatttcagtgagctttctgggtgaacttctaattaaatggcttccatgattaagtgtaactcagctcagaaaattggtatttgcatatatttgacaaccaaaaatgacaagcattggaataattccaattaaaaaaaaaaacctacagaaaagagagggaaaaattccccatgaagctttgtcaattgttcaattccttcatccttaaaaaaaaagaacctagataatcttatgtcatccttaaaacaatagctatatagatggtccctgacttactatggtatgcctcaggatggttcagccttatgatggtgtaatgctttcagcacgctcattcacttcccatggggttacatccacgtaaacccgtcctaagttgaaaataccatttgtgacttaatgatattttcaatttaggatgggtttactggaacatgacaccatcataagtcaaggagtatctgttgtatgttttttcttcttcttcttcttcatatcctcagttttaagctaagaacataggcatggagtgtgtgcatatctgtgtgcatgtgtatatgactgctcactgttctacaggcatttaaacatcataagaatgatttgatgatccagtcttctgttagaggtctagacatattccacttctacacttctagagaactgttctaggccatctgccaacaagccaaagctagctgctcaccaccgggctctgtccgcaggagtcacagcaagaaataagacattttcttgcttcttgaatcttgaatgtgcctgcctgcttaacttccttccttcttttctttcttccttccttccctccctccctctttccttccttccttccccctttccttcttcccttcccttccctttccttccttccttccttctctccctccctttccttcctcctccctttccttccttcctcaccccttccttccttccttccccactccctccctcccttctccctcctaccctcttttcccctttccttcctttcttccatttgattgtagacatggagaaaggatatttcttattcccgttgatctgaaagacaaactagataagaaatctaaaaacctatcttttcagacacttaaaaaaataggcacaaggagaggggtcatatcatctgatcattttcattatgtatcattgtttgggttgaaaaacatgaaaagcattccaaggacaaaagacattacaggtctggttcctgcctttgatagttttactgttagaatggaagaaagggaaatacatataacgatgagaaagcagcacgatggtaatgcaaatggaggaagcattgttactacagtaaaaatacacactgatgcatgtatacattatacatgaattaatacatatagaaaggtacatatatgcattgtatgtctatgactgtgtgtatacagaatgtgtcagaagagaagtcgtcatatgtggaaaagaggtttaactgcttcagaattcaagatttgtctaaatttgaataataataaatacatttagattggcagaaaggagaaatttagaagaacaaagttgagaggagtgatggttaatactgagtgttaatttgattggattgaaggatgcaaagtatttttcctgggtgtttctgtgagggtgttgccaaaggagattaacatttgagtcagtgagctgggagaagcagacaccctcaacctgggtgggcaccatctaatcagctgccagcacagctagaataaggcagcagcagaagatggaaagagcagactggctgagtcttccagccttcatctttctcccatgctggatgccttttgccctcaaacatcaggctcctagttcttcagcttttgactcttggacttaaaccagtggtttgccaggggctattgggccttcagccacagactgaaggttgcactatcggctttcctacttttgaggttttgggacttggcctgatcaccactggcttttttgctcctcaacttgcagaaggcctaccgtgggactttatcttgtgatcatgtgagtcaattatctttaataaactccctttcatatatacaacacctatcctattagttctgtccctctagagaaccctgactaatacatgaggtgaggtaacaactcagttagcattatggtaacagagaccagatattgaaagtgggaaatcacttgggagaatattcaaatgtgggcctcaagtaaatgaatttcacataacaagcagtaatggagtcactactgacacttaaaatggcttaaagttaggttattagcaaataggttattctaatagaaacaatggggtcaactggatgaaatgtgggcaggaagctgggttaggatgttgctatactgactctgtaacacataaggatacattccgtatcttagctcttaatactcctcaaagaacatctatgacacctttccatccagtattagaatccattttacgatacttctgaaactagtccattcagactctcaaaaaaaccttccaatacctgggagcttatgatttctctaggagtctcattccatttttcaatagcactaattctaaaatttgtttttattttgaatataaatctgttccttattaaatttacttccatatggatctaagttcttctgtaagaaacaacacagatgaactctactctctttttcacttgataggactcaaatatctaaaaacatatacgtatataaatgtcatgactatctcacagattctccccaatctccaccatatctgttctggaataaggaaaacaaaaacaaaaacaaaaacaaactgtttttgtccttgcactcagacactcaacacagaacacttctatgaccagatggtggtgggggggacttgccacatataccaagcagttctccagtggacaccaactgggtatcctataattcaactcgattctgattctacctacctggaaatagcatcagatcccacagattgagggctcagccccacaagactagagacctcaatcacaagttggggccacctgtacctcagaccgatgggctacaaaccaaggttcccacaatttcctcaatgggtaagattaatttgctggaacagttcacagaactcacagaactcatgaaaacacttatatttattggtttattctaaggcattataaaggatgctgatgaacaccagacgaagagatgaatagggtgaggtggggggatgcagcttccatgcccttgctggagctgccacccttgcagcatctctacatgttcagtaccccagaagctcatcaaatcttgttgttcaagagtttatagggagcttggtctctagtacccccttcccagaggtcaatgggtggggctgaaagttccagccctctaatcttcaaattacttggtctttctgggccaatctggaggctctctagggggtgcaccctgagtaaatgcattagcataaacataagagttatccaaggggctaattatgaataacaaaatatactactatcactccaaaatttccagaggtttttaggacctctatgacagtaactggggacaaagaccaaatatagttcctattacaccacagctcttcttcagactagactcacacatttttcaactgttccttgtacgacctcactgtccatcactctggctcatactcacttgttcacatttatgctgctctaaaaagggtgctccaggtttgtaacaccgtggtatggtttgactctgtccccacccaaatctcatcttgaattgtagctccataatccccacctgctgtaggaggaacctggcgggaggtaattgaatcatggggccgggtttttgccatgctgttctcgtgggagtgaataagtctcatgagatctgatggttctataaagggcagttcccctgcacacgctctcttgcctgtcaccatgaaagatatgtctttgctcctccttccccttctgccatgattgtgaggcctccccagccatgtggaactgtcagtccattaaacttctttttctttataaattatccagcctcaggtatgtctttattggcaacgtgagaacgacggatacacacggtgattcacagtggcttgatctgagcaaaatacactgtaattcaatattagcaatagatgacaagcaactatggccatggtgaatctcagatgctgaaaagaggggaagaaagagagccccagccctcaccataaggcttagaagggagtgctatggtttgaatgtgtcccctccaaaaatcaggtgttgccaatgcagtattattaagaaatggcttctttaagatgtgattaggccacgagggctcctcccccatgaatgggatttagatacttataaaagaggctttactccgcattaggctctcttgccttttgccatgtgaagacacagcaaggaggtgtcatcgtgcaagcagagagcagccctcaccagacaccagtgctgaagtctttatcttggacttcccggcctccagagctcagggtgataaatttctgttctttataaatgacccagtctgtggcattttgttgtagcagcacaaacagactaagacagggagtgtccatgtactccatgtaaaacactttttttaaatggccatttaagaccgtaaacacagaaaagagaaaaacaaagacaactttctcatttactttcacacttacaaaacagttctcaaatgaacacacagagattagtgaatgcattatgaaagaatgaagatggtaagacacttgttcttattcccaggacagaaccggtgagagatgtgttcgcttttgttccccaccgccaccccacaaagacacatatcagtgtttacttccttgaaattggcattttcaggattggaatatccccacaataaacttccagatgcctgcacatctttcaaatacggcatcttaaggatgccatatttgaacggtattcttaccattatccttcccgcctgcttcctaaaacactttcataaccagagataataacattcctcgtctacaaggcagctgcatgccaaagacacaagcagctgcacctccgctcagtccacattgctgggtttttataacgaaaatgtgcacattagacttttttatggttttgccttcctggaggcggagtagctctgaggtccatcattcactgatattagaaggctgcctgtggtaacacagaacccaatgtagcagataacaaaaggcaaatataatttgaatcagagaatggcaggactggaagactcaacagaaaaaatcccgttgtcttcctgactttcggtgatgatctgaattacctctgaatatctggaacgccatagcagccttttcttggtggtgggattatgcgtatttcttagttctcttatttttgtttatctgtatgttatttttactcagtgaatatgtatccctcttcaagacaaatatatgtgttcattaaaaataaaggagattaggttagtcatgatagttttatgttcatttaaagatgtgtcctcctaacagcttttatagatttagggtggctggctagttctaaataaaaactgacattgttccttcttaaacatgcggtgaaaactagaggttcaccactgttgcccaggccccagtttccatccagttgagttaggatgttgctcagttaaatctcagctgacagaggacgttacatagccagctgtggctgagaggatccagtgtttctagagctgatgcagaaccccagtcactggggggaatgacgggaagcttctcagtcctcacaagctcccctaccatccactaggaccctctgctctgctgtttgccagagcagtagctctcagggactccacaccagcaccatcagcaacatctatgaatttgttagaaactcaaattatgatactccaccctagacagactgggtgagaagcgctggggtggggccctgtgatctatatttaacaagctcttctggggaattggatctggtttagcgacacagccaccatgctgtgctgggcccatcttaccgactcctctcctgaatccccccagagctcctctaagcaccactgtgtctccagttcctggtcaaatagaatacagaggagactgggttaatttgatgctcacagcaaccttgtatctgatgctcttttcatattattgctgttggagtaatattctattgccagatgtcagtgctgataaagaattcagaaatgaggaggaactagaggcattttctgggcctctgctgtttctctttatttccaacatgccactggcatgaaatatagctggctgcattgaaagtagcagtgcttttttccccctaaatgtatagaaatctgttttccttatgcgtgggtggcaatttgctgctggtagcttcaaaaccatggctgcactatgaacaaaaaaaatgctcttaccgtctcagccctgttaacctctttctcccaaacaaacaaataaacctaaacgctatgtctaagcccatctgtcaacaggcatttactgagtacctattgtgtttaagggattttatgtgcaaggtgtctcaagagggggggaaaagaaacaaaggctatgtacttaagatattttcactgaggttgggcagacaaggcttgagaacaattatcaggaaatctattagaccaacaatggtgaaacaaaacagtgccaagtggacgctggaaggcagcggcaatgcagtgggggcagcgtgggaggtgaagtggcccccaaggtggcatggccagagcagaatgtgatgagagaccaggcggctgggaagaggccttcagcttagaaacaataagcaacagggaaccacttggagttcttgagcgagggaaagacaagatgagcctggtaaccataattagagaagcatcacactgaagtgtgggctggttatcggagggtaacacgggcatgtgttctaattgctgtgtgcagagcatgtcatgtaggctgggctggccaacacccagctgtcagaggtcttatgttctactagggacagatgtgaaacaaccatggcaagaaacacacaggatgtgttagtccatttgtggtcctgtaacaggctaactgagatggataatttataaagaacagacatttctttcttacagttctagactgggaagtccaacatcgagaggaggccatccagtgcgggccttcttgctgtaccagcccatgatggaatgcggacgggcaagaggactgagaatggcatgaatcccccttcacctcccaaaggtcccacccacctcccaacactggtgcatttccacacttgaactttgaggagcacattcaaaccatagcacaggataactttacaccataataagtgctgtgaagacactagaacaccatgagagagtcaaagggtgggggtcctgcttcaagacacatctgtgttctgacatcgcaccaagggctggtctgtctacgagactgtggggagcaggaatatgaggaggaagaagcagattgcggagatggtggggcggtagagggaaatgtcttccggtgttcctaattcgtgaatactttgattcttattcatatcttctggtcagcaaatcaatattagtatttgtatcaatcataacatctcacatttgaattatactttgtagtagccatgataactctgtgaagtagacacagaaactctttacacaagaccttctaagagaggaagggggtgcctgtgtgtcacgcccgcgaggggtgggacttggatcctgcctgagagttttggcccaggcccgcttccatcccgctgtgctcatgcaggcagctttccccttccatggtgagtggagcctgctcaggtcctcagtgtcattgtgcatgagagtgaagaggatgcccagagggaaaagcgctcagctgtgtgtgtttccagcaaaacagacgcatggcagaacgtggggagaaacacatcgaccagagctagctactacgtatcactaaaattgagccgttttataaatattttatattcatacaatgtgccttgcgatggttggaagatacatttttcaagatggtcttttttcactgcccttagttgagcctattaataattaaggtaactttcttaaatgagaaaacggatttgaaagccaggcaaagtgttgtgtactgggaagagaggtttcacacattctcaaggagcgtccatagcaatcaccaagaggcacctcaaaccctggcatccagggtgcaactgcaggaagactgagatgggcactaaacatcattcgcctaataattcccatatgactcagtttccctactgagactgatccagtgtggaggacatgggtgctacttctttatatcccacactagagagtgcatgtagaaggtaattgacaaatattctttggaggcatgaatgatggtgccttgggaaccaaggaaactagtcaatgaaaaaaataaatgagtccacccaatttcagggggctagagatgtgctgggcaaaggtgtggccttctcagggtcattctcattccctagggtgggcaccccgagagaaacagcccagtggcctcgggactatccctagcaggcacctgccagtaaggctgcacccataatagacaaaccctctgatggcctgatacctgttgtaaacaggttattagatattgtaaatatcactctttctggaaatgatgggtgcaactggcttttaaatcttcctcccgttcagtgactcaagaggtcttctatccttcaagtgtgttatcctgcagaaaaaaaatttaagaataactgctccagaacatcttctgagtctcatgattagagggccagtgaaggggctttagcggcatctcacaattatagataatctcatggagcaggctaattacattccaatcccttcactcataactaagactgttatcaataagcctgacattattgctgattacaaagactttcttatttgctcgctgtttaattactcagcttttaaatgttccttgaagaaaaactagaaaatggagataaacaaaataagaaaggggaaaaaaatcacccctcatcgcctagcgaagggtacggattgccaacattctcgagtctctccttccagagatttccctgttgtgctgacagtcttcattaatggagttttttttttttaagtatttttaagtatttctcaagagttgcaggagaaataaagaaagtaaagagagaagagaggaaggaaaaaggagaagagagggcaagcaaagtttcagaagactaccttgccaggcatctagtgtagggtgggcaaatgttttctgtgaaggaccagctaaccaacattacaggctttgtggggcttgcagtctctatagcaactacccaacaacacctttgtaccacaaaagctttcttgtctgcaacactgctttcagatatgtgactagggctatcatgtgtgattatggacatcatgatataatttaagtcatctctgtgtgcacatttaaaaatcaggaataaaatgaattgaatataatactatttagcctgtatctttcatagggtgtccctcttatataagtcttttgttctcctatcatgataagagaagctcatgtaatactgcctgatgacccttgctaatccaactcctgcgttcaagccatcctcctgccttagcctgctgagtacctgggactacagacatgcaccaccatgtatggctattttgttttttaaatattttgtagagacggtttctcgctatggtgcccaagctggtcttgaactcctggcctcaagcgatcctccagccttggcctcccaaagtgctgggattataggcataggccactgcacccagcccgctgttctaacccacttcactgagtccgtggctctgcagtctttctcgtgtaactccagttttgcctccccgtttgcactatgctccagttttccgtggttctgcttcctggtcttactaggattacagcacaacaaaccaacagagaaaaccattggattccactggaaagtcgaaaaaaataattaaggctaaagtataagaataatcacaagcctgaagtgctgccacctgataattattaaccatactaacaataataaaaaacattatcaacaattaaaaagttcaaaagagtagcagcagtcattaagagctaatcacccaccaggtatgacgtgaaggtcttcatgtgcattatctcatagcagccctaccacaggtaactactatctccctaccttatgcaggagggtaactcacagctggtacctggagaaatctgaacttatgcatcctgaattgggactcaatgctgtcaatcctcctgtgccccgacactgcagggtctgctctggaagcacatctggaggcaccgcaaactcatctgccccacatttcagagggcactgatgggcacaggtgggggggggcaggtgggcagaagaaagtcaccccctgcagagaggaggcctggcattcatctgagaaggggctctccatcctacagacaatgtgcaactgtcttcatcaataatattgaaggtttaaatgtacagtttcctaaccaggatgattaagaaaaatatctgtcatcaatgaaaatgccctttgctttcaaaatagaaaattctacaagaagttagtatattctcataggtacttttaaaactatttttttttttttaactatttttaagtcctgtatatttcttcattcatcctgcaaataaagatatcttgaccttacaaattagcaaatgttgttctcaatcagttctactccaaaagagtaaagagagattaagtgaaccttatcatttcagaagtatgcattacttcccgttcataatgcagacagactgtttttaattaaagcttttggacttaggctggattttctagaggaatatcatggaaaaactttcccaatggttggtaatcacatttgatatgaataagatgaaggtgcgacataacatccgatccatgggcagaggtccctcaagtttataaagtttgtcgtttgggaaagataaattgttattgttgttatttttaactaaacagaaaagtcaaattaaaatgtgattttgatccaactgtgtatgtataaaatgtataaaagtataaaataaagctgtcccttgaaatatgaccaactgatttgtaaaagtcaatttcattagaatatgcagaatagagagaacatttgagcatttttatttcaaaattcactttgctagtgcatttaggaccgatgtgagggtgggatacatagtttctctagcagggcagcatccctgccttgcccatggctttcctcgtgcctgcatctgctcaagggccagccctcctgactaaaaacggagatgccagatctacatagaggacactagagctttaaggctaagtagtgattatttacttcttgataaaataataaaaagtaataaaaaataaaatttaaaaaggcttctaaggccagttgtttatgcagtcccatcacaccagaaaacataaatggattttatggacgcacctgttcagggccctctttggtgggctctgggtcccccccgtgctggggctgcgtggatggcccgtcagccacgccacccaccgtgatctgctgccttcagagggctgctgcctccctgggtcatggtgtcacccctactcggtgaacagaaaaaagttcaaacacttaaaaatcactgctcccaaacacagttctgcttgggtaagtggcagattccatgtgaatctcagtttttacagattaagtggaactgtttgaccccagctttcaggtccggataaaatgagaagtttttgaaaaggggattagaaaaagaccttagaagcacttggtttggaagctaattttttccactcagactcacagggagggaatccattgaaagcaccaattactccttctttcatagtctgggaaactggcctctaaatctccgcctttactggtaagtcaggctcagcaaccctccttaggcttgagttaaacaccttaacacctgcctctgctcccaacatgcacacaaaccacaaccaaaccaaaaaactattttctgagtatatagaaaattcggggggaaaagcaggaaagcacaaatccccataatgcccccagcatacaaatatcataatatttttgtgtgcattgatttttacgtaactggattcataatgtatacattattttacaatatcattgtacttagtatatttcatattagtaaatacttatctacaagaagggttttggtagcacagagttctcctcctaacactgtattataatttagttagctcagcacctgttgttgaactctgacttgtttccactttgtcacagctataagcaacgctctacagaacaatgaacataaccctggctacatatctggtaattttcttaggataaatttctaacagtctattttctggtccaaacgtgtaaacattttcaatattttgatatatcagcaaatttctgccccacgaagttgatccaatttatactcctgtcagtattttttgtgattccatgaatccagggcaaaatggaacattgaatgcatttaaaaatattttataatgagataaaaatggtgttttattcttcttttaatttgacattaatttgtctatgcctcttatttaaggaattgtttggtcttgcatttttacaatttttctttaaaaattctctaagaagtttttctttttgaggtcattgggttttctctcctgactttaacctttaaagatttccctctacttttagctcttgaaacatctcccttagacctttaagttctcccattctcctaaaaagagtcctcatttaggagttaaacagtgcacgctggctgggcacggtggctcatgcctgtaatcccagcactttgggaggccaaggcgggtggatcacttgaggtcaagagttcgagaccagcttgacctacatagtgaaaccccatctctactaaaatacaaaaattagctgagtgtggaggtgagtgcctgtaatcccagcttcttgagaaggtgaggcaggagaatcgcttgaaccccaggaggcagagtttgcagtgagccgagattgcaccactgcactccagcctgggcaacagagcaagactccctctcaaaaaaaaaaaaaagtgcatgtctacatgattaaagtgacacacaacagatcactgtttattacaaatcctcatgtcttttaaagttcatggtaatatgtttatgttttaacccaaagtctctgttcctctcctattcccaccactacttagagcaaggatctttgcattggaaagcattggtgtgggaggggaaacctacagtttctgctggggtccccatcttgcatattttggctttctggctcctgttgttggcggctgggagaaatgacctatgcagggtccatgggcagccctagaggttgaagttcaaactcagggatgaaagaaagaaagacagacactttctttcacgactgtagacatgatcaatggcctgcacaaaaatgagtctatcactttacacccagggccactagtcaccttggaaactgaatcacacactctctgaaaaaagaaagtggagccacagatctgggcacagtcctccccatgctctgagaatccacgcaggctgcctttgccgctcccttctttctcctctcatgggtgtttcctgtggatgcttccctcaagctggttcagcagacctgttctgccctcacggcctcaacagggaagacagagaacagtagggggctcggtcttcaagacacctgtctccaccaccctctccactgcgcactcacctacagctccttccactgtgagtgcgtggaagcagctccttccattgtgagtgtgttttagaaaatgtgggaaggtagatgtttcagcaacatttctccattcagtgatgctgggggaagtagagcttcttgcctggtgagtctgcaatgtctagatttaagggtccccatctactgtccctgaaaggacgggcacatggaataagagtccttatctgccaagtcctagtaatgctactgcagaggggaacggctgaagagctaatagctccctttcatgttaaatgattcaaagtgatcgtgaatagcatattttgatacaaggatattgcaactttctaaatttgaaaggatatacatgtgctaatgcagaaaagcttatgtatggacatactacaagtgacagtcatattctgcatttgtaaaagagacctggttgaaaaatatggtaagcgttcatactttcaggaattgcttctctctcagggatggtgcctctgatgatagtgtgaattggaaagctgaaaaattatactctcagtactgctggttacatttgcaatttctgctcaaattttgatttgtccaaagcctgatacattttatctagccatctaatatcatttagtttctggatgctgaggctgtaataattttcatagcctctgtactaaaatgctacattttgtttttctttgtattttatcatgcagggtgaaaaatatgaacacatttttataattctgggaccagttatatacccggaggtctggcaattactagaattccccaccaattattagaatgataatatcaataactaaagtttaattgtgggtgatataatttggatatatgtccctaaccaaatctcatgttgaattgtaatccccaatgctggagatggggcctggtaggaggtgtttgggtcataggggtgaaaccctcatggcttggtgctgtcttcacaaatagtgagtgagttctcataagatctggttatttcaaagtgtgtggcacctccccttcgccccactgtcttgctcttgctctcccatgtgagataccacttttgcttttcctcctgccatgagtcaaagttccttgaggcctccgtaggagcctagcagacgctggcgccatgcttcctgtacaacctgcagaaccatgagccaatgaaacctctttcctttataaatgacccagcctcaggtatttctttatagtaatgcaggacggcctaacacggtggataaatgttcaaatgattaaaaattttgtttaatgcaaacatttaaataattcaacaaaccaggtctctggaattataaagacaatgggtagggtaacctcagaccagttcactagatcataaattgattgaaggcagtagactcaggacaaataaaagtaagaactacattacttggtgcctgatgaagtggggaatcatttatcttcaaagatagtaccacctaaatatttcattagattccagaagggttcatggatgatagatgcagaagtgatttgctaaaggcacaggcagggaagagcctgaatcttttaaggtacaaatttcaaagacagcacaggtattcacaaagcatcccttctagtcactggctaaccgcatggctcaccctacccatttccgcagtttgtggcagtcattattgccaacactaaaaagagcctgctgggttttggaggtacctggagccctgagccccaaagtctcaggaagatcaattaactttaatacttagcttcctcatccacaaaataaagaaaattctttgtttgcagggttgaaatgagcattaaatgagatgattttggcaaagatcccagtaccatgcctggcacatgctgtgattctcagggaccagtccctcttctcccatcctcggtcattgctcttgagtttttgatcttccatatactgtcagagcaggaggttaactacagcagctctgagttttgtcccttcaaatgaaatatgtcccacatttatttcagcacattcaatgaccattataccaggagaaggcagtgtcgtatgcagctggaaatgagggcactgacttcacttcacaaatcaaaaggcataaagttagtctgaggctctcgtcaatgtgcaccttgtaaatctgcggccctgctatgagacactcattcctgcagagagggactgaaataaaatttagttcactttctgtagtagaaatgacagtttttctatgtaaaaatagcattccagtggattcaaagatgtgtcatatcattcaatgtgtttctggaaactctgttactgttaagaattctgaggaccacttgctgtagtaaaaatggcatttattctatgtaaacagagtaaatctataacaagacagatcattcagttgttgcacgtggaaaaaaaatctgccaaagtaacctatgtcgtgaaagcacttaatgtgttatccggcacatggcaggtgcttagtaagtgtgggtttccctttcatttccttttcctaaggagtgatccatggagtcatcttgatcttgaatccaagaatgtccctctaggaccatcatttgaatacagttggtaagaagaaaaataaattcatcatttatgagtaattgatttgctaaatgatcctctacttagtagatttacataagtgacatttacaaaatgaaaatatgccaaaactgaaaaaccatgacatacaaatttgatgagagaggcaaaaacaaagataatgataataaacatggaagaaaaaaagagatagatgcctgataggtcagatagagagatgccctagaggaccctataggccctcccaatcaggaatcacaactcattttctgaaactatgaaaataaaatctaggcttgtattctttcaatttaaggaagttcttcttgttctagatctttgtttggctcttccaaaatagtgatactggccagtcacatctgaaagtaggctgcttctgtcctggatgttgtcactaggtcagaaacaggggaaagaccctgacttctcggttcccctcttcccctgcctgtagtgtctggacgaggcggatcttttcattcacaaggatcttgtcatggatcctaagagaacaggagacacacacaggagaaaccaagggtggcgatgggctccataactcccagggagctgctggctagctgtcgtttcttcacaatgggagtcctattttcttgtcctggacaaaggcagtggggaggaacaatctcacacctctcagccgtccaaccaacccctgcagggcaaatgcattagttcccgctgttatcctgaggactgtttctctgcagagggacagaagagggagtgctcagagcacacagtgagccgggtccccaaccttcctcctctcctgcaactcacagtgcaactcagtgatggatccttcccataaataacagggcctaatgtgctcatgagaggggattgcttttagataacaaggatgtaatggaagcagcctcaaatgaagaaacttgcaaatgattaattatggatcaataaaagatgatccaattgattgtagagaaagtctgcagcatgacttcctggattcgctcaatgtatggtctttttaaaatgcttgctgtgatcatcctgtgttgatggatctacttcacagggagggacagtctaagtccccctttaagccttctgtgtctgcctttagcaacttaacacacaggcatcagaacacaggacattgcattagctgttattcctaccagacttcatgatgtcaataaaggaggccagtaaaggctgtcactatgcaacttacaaaaaggttttgcttttttgttctgtttcagtaagactggcttatttattgccgtgtattcctacttacttttctctgaataacaagattaatttaatgaaaagaaaacccaattccataccccagaaaatgatcctgaacatatcatcttattaaaaacagattttaaaaattaataaattaattgagaactggggcctctggtattccagtggaagatgcccgtcatcacccattttcgcttcactgatgggaatttccaagagcgaaaggtttgtctcatcatttcagtgtaaaaattagcgctttgacaatactttgcatgggctaaaagatgctgggaaagtttttgacaatttgaaaagatgtctatctgtttaaagttctctcagttctcagcaggtggagctaggagaatgattgtttttctcctaccaaaatgtgagaaaaaaaaaaacattccacacctatagaaattttaatcacagaaaatgagtgattctcaaaatgaaaccaataatagtgtcttctttagctagcaaatcttgcctctctattttgcttttaattttcaagaacaaccagtcacattagcctacactgccctccaaaaccccgtgtgagggatcccaccagactcgcactgcacctgccaaggttgagaggaagaggggcttgtcaccgccccccacctgattgaaagtagaatatatagcaggagaaccaggctgcacacgtactgtacaaatttggggggaaaatattgttttacacaatcacataatagatgctcatggttaaaaacaaacacaggaaaaaaaggagaggctttcttcaagtgtgtatttatttatcttctgatggaatattctttttgggcttttgaacccagcaatgccctcaggagcgaggggtgaggggcattttgctccccatgatgatggcatgtaggctcctggggcacaaggcaaaaccaccgtatgagttcccagctccactattcttcaaaacataaacaggccaaaccaggcaggagcctaatagcaggaacatattttgtattataaaaatacacagtagcatatacttaacaaatcttcttacgcagtgacccctctcctgcaggaaaagtaatcatggcattctagagtttgcctgcattcaaccaacataaaatcaaactcaaatgtgcctagatgtacatctaaagcctctgaaataattctaacagttgaaaaagatgaatgagataaacagaaggaattaacatacaacaattattcttcctttgttcaactcttcccatgaagtataatttcttttactattgtaattctcaaattcagcttaggcagctgagaatgtgtatcactgctctttaatgaagaaggtttaatattattcacattgactattatactctcctatatgcttagacacttcaactctaataacaccactaggtaacactaaaaggacaccaagctttacataaaacccaaggtcaaaaataattaaggggaaaaaagtcaactttttaagaaattctttggatggaattcttaaaaattaaaaatgacagtttttttttgcgcatgtgtgtaaagtaacagttaagtcaactctatttttaagtgaagatattattacatttgattattataggttggaaaaatgtcttcaggtagaggaataatcaattcaaaaaatgtcttccaactttacatttgtagaccattttacagttcaaggcaatttctcattccttatttcacttaagccagttaaaaaacccagttttacctgactcattgagatgtctgactcagatgtgatgtgtgtcaaaaggagtctgtgattactgagggagcactaaaattggcaaattaaaaatatatagttcaagaatatgttcaagatgaaacttgtgaggacttcattctaaggcttttgctttctgatgtgttacattctgaggtgttgcattctgacatgctgcattcttcctgatatgttgcatattctgacatgttgcattctttctgatgtgctgcattctgacatgttgcattctttctgatgtgttgcatattctggcatgttgcattctttctgatgtgctgcattctgacatgttgcattctttctgatgtgttgcattctgatgtgttgcattcttgctgatgtgttgcattctgatatgttgcattctttctgatgtgttgcattctgatgtgttgtattctttctggtgtgttgcattctgatgtgttgcattctttctgatatgttgcactctgatgtgttgcattctttctgatgtgttgcattctgatgtgttggattctttctgatgtgttgcattctttctgatgtgttgcattctgatgtgttgcattctttctgtgttgcattctgatgtgttgcattctttctgatatgttgcagtctgatgtgttgccctctgatatgttgcattctttcagatatgttgcattctgatgtgttgtattctttctggtgtgttgcattctgaagtgttgcattctttctgatatgttgcattctgatgtgttgcattctttcagatatgttgcattctgacgtgctgcattctttctgatatgttgcattctgatgtgttgcattctttttgatgtgttccattctgatgtgttgcattctttctgatatgttgcagtctgatgtgttgcattctgaagtgttgcattctttctgatgtgttgcattctgatatgttgcattctttctgatgtgttgcattctgatgtgttgcattctttctgatacatcacattctgatgtgttgcattctttctgatgtgttgccctccgatatgttgcattctttcagatatgtggcattctgatgtgttgtattctttctggtgtgttgcattctgaagtgttgcattctttctgatatattgcattctgatgtgttgtattctttctggtgtgttgcattctgaagtgttgcattctttcagatatgttgcattctgatgtgttgcattctttctggtgtgttgcattctgaagtgttgcattctttctgatatgttgcattctggcgtgttgcattctttcagatatgttgcattctgacgtgttgcattctttctgatgtgttgcattctgatgtgttgcattctttctgatatgttgcagcctgatgtgttgcattctgaagtgctgcattcgttctgatatcttgcagtctgatatgttgcattctgaagtgttgcattctttctgatatgttgcattctttctgatgtgttgcattctttctgttatgttgtattctgatgtgttgaatcctgatatgttgcactctgatgtgttgcattctgatatgttttcttgttgagtttaaaagatggagctgtatgcagggttacaggaataaggcacaaacaatggacccatccatgggtgtgaagcacatgtgcggccagaacccacctggtgggtcatgactgaaaaaacactgtgaactattgcctaggcccatctcatggttgatatctttcctgctactctgaactctctgtgactgtctataataactgtaggcatttctacacaaccaatagttttttggaagcaggctaagattttttacatgtatcattaaataaatttacttattttgaatttaacataaagcataaaagatttaaaagtaaaagtatgtattttgagtaggtatttccttacattgtgtacaccgtgtatgcattttgaatgtttgtttatctaataaaagttgtaaaggcttttggaaatataaaactgaatgatcccccacatttctgaagaaatgtgaatggcaaattataggatgaatgggatggattacaagtcagaaattaaactctataaagataaacagagactgaagaagacagagaaatgcaattggaaatgaaggctaattaaacaaaagcactaaatatgtctaagcagcaagctacaattaacatggaagacaaattgtgagcacaactgcattgtgaatatacacacaccaaatataaatattatgttaataactgtgacgacttggtagaaaggtgtatgtttcagtaggtatagccattacatttactttttttggtatttttttttaacttttgttttagattcagaagtacatgtgcaggtttgttacacaggtaaactgcatgtcacgggggtttggtgtacagataatttcatcacccaagtactaagcctaatacccaacaggtactttttcttgttctatttttttttttttgagatggagtcttgctctgtcacccacgctggagtgtaatggtgcaatctcagcacgctggaacctccgcctcctgggttcaagcgattctcctgcctcagctccctgagtagctgggattacaggtgtgtgccaccatgcctggctaatttttgtatgtttagtacagacagggtttcaccatgttggccaggctggtcttaaactcctgacctcaggtgatccatccacctcagcctcctaaactaacaggtactttttctggtcctctccctcatcccaccctccatgctcaggtaggctccagtgtctgctgttcctgtctttgtgtcaatgtgttctcattgttcagcttgcatttcttcagaggttttttttttttgtgtgtgtgtgtgtgtggagataattcacttttatatttccgaaagcctttaaaacttttattagataaacaaacattcaagatgcatacagtgtacacgatgcaaagaaatacctactcaaaatatatactcttattttaaaagtgagaacatgcaacatttggttttctgttgctgtgttagtttgcttaggataatggccgtcacctccatccatgctgctgcaaaggccatgatctcattctttttaatcagccattacattaaagatgtcagagttttatggggctatttgagcttcagttagcatccagggttctttgcattgtctcgatgacctggtctcatgcaaacaatgtctggactcaccctcacttgttagcagtgagcagattgagtttgcctcaggagaattttctagggacaaatggagatctctaatgttgccctcatattccccctttggagcaacagcaccataatgagggcgtaggaacctctcagtaaagattgcctttctacttcagaaaatgctgctaacagaaaaaaacaaaaacaaaaagaaaaacggatttttatcaaattggtaatgaaacacttatttcatgctactgggtatatgaggtattattatcagaaagatatcaaacagttaaacttcacctctactagctacctaggaaaaatatgtccaaattttatctaatttaggacaatatggatttttaagtcttaaaactgatgggaaagtctatggaatctccttatatggaaaagtatgaaaataagccagaattaaaagaactgagtaagataatctcatgaaaccctttgcaggtttataatttaattttttattgttaaaatgcccatggtttatgaaccttaacttagaatcctcctgtaatagccctgttgaataaacaacacccgggtataatcatcttcagatacgaaaggcaactgcattcgcatttcttgggataacagccagaatactacaggtagtaaactttgggagtgattaccaaaccacctaggagataaaactcccttagcttccagctgatgccttattctcaagatttgtcatgacataattgcccagaatataagactcgaggtaattcactttgcttaactgaaacaaagcttgatcccaaagagagaaaattttcagtccttgccaagactgctgaccatttctttccaaaaatagtgacttggggtcagtggatcatttaatatccctgcttagtattgttgaaaattcccagggggtgaaaaaaaaaaaaaatatatatatatatgtatatatatatatatatatatatgtattccaaagtgaatgacacagaatgtgtaagtgcttatatttttaaactacaagtctgtctccaaaaaataactttcatcttttctcttctaataaatactttttaaatgacctctcttttattgaaaattcatttacacacacacacacacacacacacacacacacacacacacacacacatatttgctaatggaaaaaagaacacaacacaacaaagaagtgtatcataaggaaagtttccctaaagttcatctggatgtggttttacatcatccttccagccagtgaacacacagatgtgaagacatgtgcaagccatgtttgttaatttataaagtactgtacctcggttttcctgcaaattttaaagcaactgaaaatgaactgcagcttacattgctaacattttccagcccatacaaagtcataagataaccaaaaatcatgtttcaacccacggtattccatacaatgaatgctttcactccaggcctgcgaattaggctgacatcttccctagctgtaatatctccatcccaaaatacgttcattcaatatgttcatcaaacacagtgagaatttctgttttcatactgagattagtattgtgtggagccacctgtacaggattatgaaaggcagatcgcaaagtcttgtgatggtcaagaccctctctgatcagcagaggaccttggtactcaggcctggacttgtggaaactgaggggtaatacatttgtgttaagtgtgtggtaatttgttgagctgcggcaatagaaaatgaatacagtgactaatttccctaaacatttagaggaaatttcttggcataggtgagtttttaatgctaaaatttaaaacagttgcttttttcacttgatgttttacaaattccagtgaattgaataaatcttccaagccaatgctattgagtgggacctgagtgaataaggtatgtacactctgtactgaactgaatatttttcatagttttaccaagtttcatgtgtccctttcccatttgcctatatcacaatgatgacgcacctaacagaaataaatattaatagtctgaatgtggatatcaccactaataatttccttttaattaaacacatgcttacaaacacaatttccttagaaaaatattttctttttccaacacaagagaattttagggattataaacaagcaaaaaaaaaaaaaaaagcacatgccccctccagtgttagttgctgccttcctgttaggtgtcttctccagcctctgttccccttgtagagagaggctgaggagggtggatcacaaggtcaagagtttgagaccagtctggccaacatggtgaagggtacagttgacccttggatgacacaagtttgagctgtacacacaagtccccctcatgtggattttcttccacctctgccacccctgagacagcaagactaacctctccccttcttcctcctcagcctacccaacataaagacgataaggatgaagacctttatgatgatccacttccacttaatgaagagtaaatatattttctcttccctatgattttcttaacattttcctttctctagcttacttgaggatatttatataatacaaatagcatccacaataggtgttagtcgactattttcgtcatcagtaaggttttcaatgaagaatcaactattagttgttaagttttttggagagtcaaaagttgtacacagatttgcaactgtgcaggggctcagaacacctaacgcctgtgttgctcaaggatcaactgtatttttaaaagtgagactgtaaggccaggcatggtggctcacgcctgtaatcccagcacctcgggagactgaggagggtggatcacgaggtcaggaattcgagaccagtctggccaacatggtgaaactccatctctactaaaaatacaaaaattagctgggtgtgatggagggcgcctgtagtcccagctactcgggaggctgaggcaggagaattgcttgaacccgggaggcagaggttgtggtgagccgagattgctccattgtactccagcctgggcaacagagcgagactctgtctcagaaaaaacaaaaaaaaaagtgagactataaaaatctattttgcatccttcttcttaaaaaattcttccttttacagaaaataagtcccaatcaatacctgttacctgctatgtataacacagcacatccttccctggaatcacgggaagaaaacaaatgtctctgttcattcattctttcactcattcatccattcattcatttgctgttcactgaagtctaagcctgtacaatgtgtaagggacgtacaaaacaccacctgtcaaagaactcaaaatctcatggcaaggctgatgttcacatgaattatcaaagagaaagggcttttgaataacacagacttctgtggagatcctccctgtcctgcttgcagctgtttatactcttggcaaattatgtaacctctctgtactcctttaattgtctgtaaaatgtagaaaatcatatctacctttctgagcagcagtaaaggtgagaagagatcatacatgtagaacacatacttaggactgcagttgttcagtggctaatcggttgtggaagccctggataaacactgtgacaacacatgtctgagaagagggagttgcaaccagcctgccattcactccctccccttaccgggggccatccccagggcaaagaaaaggaggctgagacctggtctaatctccttgtcaaccaggattgttggaaggaagaagccttgtctctgaagtccttagcaggacatccagctaggaataatctgttagtaaacagaacccaagattcctaagacatgacttcccagagaatgtcatgtaagatatacaactttctgggggtacaaattagaaatgttttatattttgaatgttccctgctgtctgagaaaccccaagacctcatctattctgggtcagaagggtaagcccaaagtgggaagaaaggtcctgttctcacagctccaaatttgtgttttgtctgaggcttcaatggcctgagtctctgacatggtttagtgaagctcaacactgtgtaaagtctctggtttgtgtgagtcggagctcacagtctgaccaagcatagctcagcgttctgctcatgcaggaaggagtacagtgaaggggaggcggaggcattcacaggcagaagaaagagatgcagagatgagagagggcatggtgcaatcaggcaatgggatgtgtcaattctgcaagagcatactggaaatgggagacaaaggcccgagtgcaggtgcacaggaagaggaggggctgacggcgaggtccaggcacacctggtgaagtcatctggccttcaccaggaaggcaaggggaatccacttaaaggggaatgaactaaatcaggggactgcttgaccagaacaatgtcccttaagagggaattaggatggagcgatgaggacagcgggcgcccttgcgaaggctgaggttcacatgagggacagaacatgaatgaagagcagaggcagggatggagaggggagaacaatctgaaaactatctaaggatatataagactttaaagcagctttaacaagggaaataaagtgtggatagaaataagtacgaaaagaattataagatctaatatgatcacatttttgagcttcacattatggcattcaatgctgtatgtgcctgaaatatattaactcaataaaaccttacactaaccctttgaagtaggctctgttattattcccatttgaaaactgtggtaagtgaagcccagcaagattacagagctactgagtggcagggccttggactgtaaagcaaaactgcctagaacaaagccatgaccataccagatgactccataaacatggcaggaaacacagaagccagggcgagatggcactcaaaaagcaatcgctgttcagggcaggatgcgatttctggctagttacataaggctgatcaagaagaagtgggctcaagtttcagaacactctgcattacatccagcgtatcacatattacatcccgtttaactcactgaaccactattaccatttggaaagattctatctgcattcctccaaaataatagtttggaaaagttcatttaacgagccctcctatttgaacctggcctgccttgattgataagacttcaatatcaaatgtagcagccttgagttttgactctcgttcaaaagtgagtttcaaaagtagatttttcttaaaaatgcagatgatttcctcttctttattttactatttttctataaatagtaaaatatactttcatttctctgaaaagtaacaccaaagcttcacctataagaataacttattactgaattggtgtctttctcaggaatttaatccaggggaaaacacctttgtcactcgaaggtgtattcaagccaacagacgattctagcatcggatgtcaggaaggaccaggggtgctcccgtcatctttaaaatcttccattctgccctccatcttctgaattcacatttcatgtcctctatcttagtggtgagaggcttagcttttataaacgtgaaaagtcactgaaatggacctaatattgaaggaaaggaagtaacatgacattattgtctttaaggtaacatagcaaagggtaaaatgtgtccctgagtaatcaaagcacaggcaccacaggctccccgtgccaccagctcccacacacgcagatgctggagaggcatggctttgaacctggtaccaagtagggtagatgacaactagtgtgtgtggtcaccaggtgtagaggctgctccccgaaaccctgggtgcagtcaccactgatgggttctacatccgtcttagacctgcaggtgggggtccagcatcaggctggctggagcctgcaaccacctacttaaatcagaagtcaaatgtgagtgctggccacagtgatattctattgaccataaatctgcctgaggttcatcctgctgaggcctacacaggcatctacactagagcatctaataatttcactaagtgttagagaactgacaaaaaataataataaggcaaactgtgggaaacaggtatacagtttttgtgagataagatgatgtgggttactggtcaaagcccctactggaaataagaagatattgatatgccaggatcctcttaacgtgatttaagctaactcatttgacttcactggatccgtattttctccattgtatattaagtggagaggggcagggcggccaggtgcagtggctcacacctgtaatcccagcacttggggaggccaaggtgggaggatcacttgaggtcaggagttcaagaccagtctggccaacatggcaagatcccatctctaccaaaaacataaaaattcaccaggtatggtggcgtatgcatgtaatcccagctaccagggtggctgaggtgggagaatcgctggaacctgggagatggaggttgcggtgagctgaaattgcaccactgcactccagcctgggcgacagcgagactatgcctaaaaataaataaattaattaaattaaaacaagcaggagatgcactattttaagtgccttttattcataaaatttaaaaaacgtatttgcaatataaaaactgaagaggtgtaatagctattcatacttacgtgtataatcggattagtcgggaagagtcggcatgaggtgtttaaattctctcaccatcaacatttcctttcactacttttccaaactgctacacttgaaagatgtttgccaaataaaccgtatttcagcaattttctttttcttccttttttcctttcctttctctctgtacctctgtctttttttaactcaaagacacatgtaacaattttttttcttgtttcttttcttttttttgagacggagtcttgctctgtcctgcaggctggagtgcagtggcacgatttctactcactccaacctccacctcccgggttcaagcgattttcctacctcagcctcctgagtagctgagattacaggtgcacaccaccacgcccagctagtttttgtatttttagtaaagacagggtttctccatgttggcccggctggtctcgaactcctgacctcaggtgatctgcccagctcgtcctcccaaagtgctgggattacaggcctgagccactgcgcccggccaacacatgtaactattaatgaggacttcagatcagcctgagttaaccaatgttatcaaacgagttgatacaatttctgcccaaagcgacttgacatttcaattaaattgtgcagccttttcaaaggaaaagatatactttcctttaagtgcttttgaaatattaaaaatagcacctggatgcccatgattaattttatggatcctcgaatgggagctatgcatacgcactttgtccctttgaacctaaggatgttattgtcctcgtctatatcaactacgtacacaaaggttcacccctgcatttcctgaggcctggaccccatttccacagctcgttactgctacttgccctacctgtttcactgggactgcagggctcttttacctgtgacttcctgcctcagtttaccccaggcagtctctaatcacttgatccagacagatatgcctctgggccagcactgctcccatgtaggtggcctccctcggtcccacgtcctccagtgataattctgaatgggccgtttgcaacattgatgaacacatttagaaaccggatgtggtagttgaatcaagttcgggttttacaactgtaatgaacggctgacacttgggcaggcagctttgccatagacaggtgtggaacaggcagtgagcccaagctttgcagctgattcagtgcagagtctcacatcaagacctttgacttgttggtcattaaggaatttatcagggcaataacttttagtaaaacagtgaagaagaaagtctatcaaaaaacaaacagtaggcccgtgtggtggagaaaccacaagctaggtttcattctgatccaaggaacaggtgggctttccctatgcacaaaattgtctcactccctggactgaattgatggtccagaggctttaaaatactcacggacctagcttaagaataactgggtaaatttacaaataattgacaactactctgtaagggccagaattaacccaaagaaacacatttgctagtgtgtccacagccatacatttgcattcttaattcagcctattctcctgggttcacgctgagtccaacttttgacatcgtccttgcagtcattcatgcaactctgtctatctactctaaaaagctgaagggcatctgtcagctaatgagacaatttctccaacagctggtactcatgtgagggtaattccgtggatttattcagtggtcatgccatctaatagtttctccgaggacctgattcaaagccctcaaaattgaagtgtgggaacagaagcataagagtaacaagacactcgatgagacaaatctcagaggcagggcaaggaaactgaacggagttgacaccaaggccgaaggtggctgccttgtaccggacggggaatccgaggatcaaagtatcttgtggcaaagtctccctggggatagtgtctgtgtgccctagagcatcacatcagggggcctctgtctttccagaaaggcagtcaggttcttcatccttcagacacgatccccactgacctgggagaaatgcttgtcccagtatcagccccatggatgaggcctgggcagtaaacacaccacgagggttcaaactggtctggggtgatcctctgttgaatacacaagcagattgattgcattcaacctctttgtctcgggaaggacgttacttacaccatcccaaattaataagaactatcctccaaataactcccatgtgatatggtttggctgtgtccccacccaaatctcattgtgaattgtaataatccccacatgttaagggcgggcccagtggagataattgaatcatgggggtggtttcccccatactgttctcatggtagtgaataagtctcatgagatctgatgggatttatttatttatttatttatttatttatttatttatttattttgagacggagtcttgctcttgtcaccgaggctggagtgcagtggcacgatcttggcacgctgcaacctccgcctccgaggctcaagtgattctcctgcctcagcctcctgagtacccgggattacaggcgtgcaccaccattcccagctaatttttgtatttttagtagagacgggattttaccatgttggccaggctggtctcgaactcctgacctcaggtgattcacccatctcagcctcccaaagtgctgggattacaggcatgagccactgcgcccagccctgatggttttgggagttcccctgcacaagctctctcttgccagctgtcatgtaagatgcgtcttgcttcccctttgctttctgccatgattgtgaggcttctccagccatgtggaacggtgagtcaattaaacctctttcctttataaataagggaaaatcctgggtatgtctttattagcagcatgagaacagactaatacactggaatatttgagaatcttcatgacgctttcaaaacaatattttagtcatctgccctgaaacacctccagggtcttcccatgtgcattgtggaaagcaagaactggttgctctccttgatgaagctctcacatatgcaaggacatttcaggctcaaagtgtccacagttattgccttgctcatccccttcacttttttgaagagaaaacagaagtgataaagaaagctagtttttatggagcctctctaatcacgccaggcattttcacaagttagctcattggattctcacagccgcgcagagtagcaccatggcattttgacagaggaggaggcaaaacctggaccacacagctggtgaatgcccacagaggggtggcgccccctcatctgacaaccaggcccaccctttctctgaaggccgcagaggttgagagagaagagtccaggtttccaatccaacctggttcctggtctttcctgcttctgatagagaatatttagtttaagattctctaagctatatctgaagactgtaatactctaagaagcatcagtccctcattgccttcataataaaacttgttttccctaagtttcaacttattggctgaaatgaatttttttttccccacagattagatttggaatgaatattttacaatgtggaaattattcttcctgctgttctgccctggcactcccaacctctccttgcctgtctatactggtttctaccttttttttttttttttttttttttttgagacggagtctctctgtcgcccaggctggagtgcagtggtgcaatctcggctcactgcaagctccgcctcccgggttcatgccattctcctgcctcagcctcccgagcagctgggactacaggcgcccgccaccacatccagcttttttatttatttatttatttatttatttatttattttgtatttttagtagagatggggtttcaccacgttagccagaatggtctcgatctcctgaccttgtgatccgcctgcctcggcctcccaaagtgctgggattacaggcacgagccactgcgcctggacttggtttctatcttatctcacaatgatcaccaccctccaacccaacatataattcacgtccatccctttgtcctccgcccccacttgcgtaagtccctgcaaggccgggagtgagctctccctagaacactgccgggcacaccgtgagccccgaggaaggcctcactctgataacttacaacaaagggaacttttgaggggaagtacatgcatatgttaatgagtatagccaacagtatcattctatattgtatacattctgggcaccaattctgacaaaataaatcatcgagaagtctggtcaattctgttggaggcttgccctatggtccctgaatataattcttacgtgcctgtgcttttcagggctgcgtctttgctagaaacaagtgattaccaaactgttccacggagccctggggtttttctcgtgacttcgggggcctctgagagggacagctagggcagcacctgattcatccacttgggtatatgtggtttctgcttcagagatcatagaagagtagagctcatggatttttatatgtatgaatatgttttttaaaagccaactataaatattcactctataactcagcttaacaaaagtctattttgctaattatttactgtttttttttcttttttttttcaaactgggtataatgctcctcaaattgggaaactttcagatctccaaattacagtttccaaataaccatacatgcagcacagatgtgaacagtgggtccaaaataagcaccttagattaagccacacgatgaatcacttcgctttcaaaaacaataaaagccagaggccatgttgcacatggcacagagaagcaacagagtccatttctgtaataagcatgacccctcactgaatgcttgctatgggagatgtgtgcctcctgctgtgcgggctggttcccaacaggccatgaaccagcaccggttgctccatggcccagggcttcgagatccctgccctagagactatattaatgaattaggaataacattaacattcctaataataggagatgatgactaggaggtggattaacatggtcaaggacccaaagctggaagatcccccaggcagcattgactcgtggtctattccttcactgtactgacgctcctagcttcgagaatgatgcatgggcaggcctgttccattaacgttttgtcaagtgactaaatgaaacataagttcaagaaggcaccttccaccagagatgctggctcagagattaacaaaagccacatcaacggcatttggaatcactcatttaattacggtgatagatgccagcagcagctcccattattaccacatgcttaccattgccagacactactcgaagcactcaattgtcttaaatggctctaaaaggtcaatattagcgttatgtccacttggtagatgagaaagcagaggtacagaaaagctttaaaatgtgcctatgttttcacagctgtaagcaatggagcaggattggaacgtaggcagttttactctagagctcagatttttaatgctgagctctgattttaaaacttacaggactatgaagccattacctataatatagaagttacattagatctggttcttcccttaaaagagtttctgatctaatcagggaggcatgaaataataacataaaataaaataagatattactctgtacatgtttccagagggggccctcagtgtggacaggtgaagtcagggcaggcttcctggaggtggtggccttgccagagccttggagtagttctgagcaaggctgaaagcatttcctaacaggggaacccaggagtcatggggtcatggaaagggagtcttttcagaggatgctgacctaaccaggcgacaaggagagatgcaagaagaaaagcaggatacaaagtgttcagctttatggccaagagcaagcatgccacacctgcgaccaggggcaccaagcaacctggggtcaggatgcatgctttctcttgctgttggaacgtgaatatcttgtaggcagtttgtatactctccagttgacccctaaggacagcaaacaattaacaccctatttaaaggctagaatataggaaaaggaggatctgaaatccagtagactttccagataagagaggagaccctgggaaggcagacggcaaggggaggattccaggtgggatcaaagctgagcaaatgtctgatgtctctaacagcccgactggaagaacaagtgaccagtattttccagtcaattagacacaaagcatgattgttgcagcctggtgtgtattcaattaggactgtaatatgatgaagctaagaacagattattttgcagactttcttgtgtctgtgcctgagagcttgctcagaggatcctgggtgacagctctctgtgggggcctgtggccaggaggggagacgaggcctcatcgtggcattttcagggctgaaatgccaaaacaaaatgctcacattcgttaggaacctcctatgatccaggcaggtttgtgggtacagcacaagtctctccatgaattaggcaaaattatcccccttgcactaatgaaataagggcctgggtgcccgagtaatttcctaaagtgaaactaagatgtaaatacaagtctctctgttgccaaaacccaggaccttttcattgtgccacactgccttctgtgtgtgctctgatgaagagcttttgtaggtgttcttcaagatggaactgaaaattgagtaagacttcccagagacccagctgtgggggactatccgcagatggagaccctgggctaaagaggcaaactcttattttataagtaggggctaattggctgggtctaagtccagaatccccccagctgttatccccaagcctaatgctcaaacagacacatacaaaaaaagacaagtcaacaagaacggagaaaaatcaacccagaaaacaaaaaaagctgtaatagttgggtaaggtacatttatctatttttttatatatatatatttatatatatatatatacacacacacattatacacacacatacatagatatatacacatatatgtatatatgtatatatctatatagatatatatgtatatctatagatatatctatataggtatatgtatatatgtatatatagatatatatgtctatatctagattctagatatgcacatatatatctatatagatatatatgtctatatctagaatctagatatgcacagacatatatatctatgtatatgtctatatatgtatatatctatatgtatgtatctatatatctacgtatatatctatatctatatatctatgtatgtatgtataatactgaagctgtcatgtgactaccctagcaaagatcttatccacaaatataattataattataaatgcccaattatctgttgagatatcagctcatgatcatcttattgtagaaacgttttcgattgattttcaagcattcataagcattggctgagagactgcggtctgtaaagcactggcagaatacaaatgcttgttgagtcaacgggcatttattgagcatgtattatgtgctggtctttgaagactgaaaatttaaaaaacaaggcccctgtcctataatataacctattgcttggaatggagttttaaaaaccatgccaaggagaaattgtcatcaatgcctccttcctctctttggagatttctgtgacagggtaatgaaaattataatcactttagatatcaacctacttgcctaaagagaaactaaagagaaattgtcctgaattcacataaaccaaggtaatggaagtgatatgtttctcttttttttttttctcatcagaaaactgattattttaaacaaattgcagagaaagagagagagaggatgagatgaaggaaatgtattgacttcagagttgactcatgaactgtcatagtataagaaactgcatgaaattctgtagtgcagccaaatattaattgaaacaattaactgtagaaaacacgtgggcacgacaatattagcagtgcataatcatttgtagttaagaggtccttaccggattactgcagaaaagctctggagttctaattacttgtggaagtcccacaaggttactgcaaaacatggtaattagacggttgtaatataaggtgttagcaggggattgaggatttgctctaagcaccttggtgttttcgtggctatttactgagcagagtaccagaatttaatggaatttggtagaattctccaatgactcctatgagcacgtagttaacaaacgtatcttaatgtgagttccatggttttcttgaaagtgatgaacatcgccatctttaactactataaggagaaaatataacctaaatgaggtggattatgtggatttatttttgggatttattgctcttgtctttcggtggcatttgagtcaggtgtattacacagctttgagatcttggcttcactaggcataacccagcattagaaaggaagtagcttggtgcttctctgcaactccagctcagacttctgtgtgacagtccttttttacaacagaattgggacatcgctgcatacgtttttctcagctttgaggatgcttctacaacccatgcatgcacaatgaaagaaatattatacatttagtgatgggcacaatgtacttattcaaaaatgtcagtaaatataaaagatttatcaggtgagtgaaggagacacgtcttttttttttctttctcctttttgctgatcccgaatcactctcttacgttttttttttgtctgtgtaccacaaatgtgtacctaaaaatgaaactcagactataaactgccctaagctcccagagtagaaagcatgaaactaatctaaagaaaatattggcagaactcccacccgcgctttgattttggctcagaaaatcacctcctccttctatagggtctggttcgcctccgacagcagaatcaggggcagattccatcagtccatggaaatggggttcctggaagtaacactggctttctcatcttggtccaggcaaggggcacttgtcgggtcactgacaaaggcattcattaagagtcagttattttctgcaggtgcctttagtgagacaacagtgagaaggggcacttgggaagacgcggggagtgtatggagagccataccccactgcttctttggggttccaaacctctaagagaatttcccttatgctttagctgttgagaattgaaagtctcctttcaaacatttaagcagagcaagaggggatagctgctttgctacagttacctgttagtcaaaagcttaaaggagaaattcccttgcctgtcatgtgtattccacaacgcatgaaaagaccagacaaagcgaaacaaaacaaaccaacccgccgccagggggcagctgggaaacatttcgaagggctgggagagatggaaggttggcaaaaccaaggggagggggtccttgtacttggtgaacagatgactctctatagtaaggattcagggccgggaggcgggcaagcaggtacgcctaagcttcttgtgttgctaaccccctccgggtctaccccagttagcaatgtctactgggacctagaggggcgcagcttcgcctatttctctgacaagactgtaacatcttggaagggagaagctgtgtcacatctatctttgtaagccacagagcaacgagcaaagtgctgagtacatatatatacatgcatgcatatatgtgcatatgtacgcacatacacatgtatgtgtataatcgtataccttacatataaatctataattatgcatcatctgtatctgttaagttatacatcattttagtgcttttatggaggaaggaaagtaatttgcaggatcaatttctatgcagaagtgattcctggtacagattttaatgcattaaattttcacaaagtcttcaactccagcaatttaagttttatcaagggccctgggttttgctggctctcttcacctgtacctcttatcattaagagggaaaaagaaaaatatcctttcctgtagccccatggtacactgcaaacccctctgagaagctgtaatgagctggggaagctgtagtggggaggaggggaaaggctctgtaatccctcggcctcggggctgacatggggcacatcaggactcccctggcgaggctctgtcacttgacaaacttgtgtagttggagccataaattctccttgtactccgttgctccccacccacattcaccctgcacctctcacctacaagaagtgacagtcagagtactttaaaaaacaacaaaaactcaacagattttatcctttgtaaaagcctaccatttccacatttgtctaaaatgctgattttatagtcctctgtgtttgcattgcgtttgttatgagaactaactcctttatataggaatagcccagttgaagcaataccacttgactggatattttcaattcataggatattaatggatatagcacacataggacatatatatatatatatatatacacacacacacacacacacacacatatataaattagtacaaaattgttttgcctcctaacttgcaaggcctgtaaacccattcttttttctttttacatagatatgttgagatttttacatcttggcaaaatataggctgtaatttaattgacttagcaacactaccaaataaaacacttattcccaagggaaatttctttccacactttctgctggaacttctaattgacatctatttctgaataattgttgaaactaatgtgttggaagggctggtgatctcaaatagctataaatgaggcatcatggcatgtttttttcttcctgacaaatccataagtgaataaatattttaagtcagtattggccaggtgtggtggctcatacttgtaatcccagcacttggggaggccgaggcgggtggatcacttgagatcaggaggttgagaccggcctgaccaacatggtgaaaacccgtctctactaaaagtacaaaagtagacaggcatggtggcacatgcctgtaatcccagctactagggaggctgaggcaggagaattgcttgaacccaggaggcagaggttgcagtgagccgagatcacaccactgcactccagcctgggcaacaagtgtgaaactcttgtctcaaaaaaaaaaaaaaaagtattaaaaattctgtccacggaattgatttaatagatgaatcaataagtctggtatgaccatcatagagcaagcagataaggctctaggtacaacaaatatataattgtattagtcatcgaaaaggaatgcaatatatttcactagtcagagaaatagcaatgtggaatagaaagaaaatatgtaaaaactgatggacttttatttgaaatttggttgaacattaactgtggttctccctaaatatcatatacattttctttcacttcattggtgatgagccattaatatcataaataatacatactggtagaatgagtaaaaaaaagttcagtagaaccaattaacaaacaatgtaaaacatgtagatttagaatacctgtcatttactcaggtctacctttttgcccaaatttcataattctcctatcttggtcaacatctacaaggacaagatgaataaatctctctctgtgtgtagaacatcgtctgtttggtttcctccaagtagaaagccaggaatgattcttccttcacatttcctatcaatcataattctatcagccagctgaatagcttggtacactcagcgcctatcaaatattaaagccttcccattcttgaaattcacataatagcttggtttgttatcttgcactaaatctgtactacattacacatttatgattacctgtaaatttcacactgatatttaagttgtaaaatatgttgatgcctttaaaagtgtgtgagaacataaaattacacaatcataaagtaagttaaaaattacggcagcataaatactaaagtccaaattcttgtcttacataatccaagtgataattgttgtgctcttactctgtggctgaggacactgtgacaagcatggagaattcagctgtgagccagattacacgatccctgccttctgggagatgataccaaataaactcaccaatgaataagtatcgcaaattattacgtggggtataaagaaaacaaagaggaagctgtgaccaggtaccaggcttatggtatgggacttttcaaagccaagccttgaaggatgagaaggagctatgcacacagcaggtgaaggagaaggggcagtgaactggctggagaagagcaggtgcaaaggccctgcacgggaaggtggttcagcatctgcaggattagcgaggaggcctgtacaactgccacagggcaggcaagggaaggagagatatgaaaggaacctgcggaacattatggagaatattatgaagaatttgtatttttcctaaggaatccgttttgggacagggaactgatttaatttacatttttgaaaaaccctctcaggaggctgaggtgggtggatcacgaggtcaagagatcgagaccatcctggccaacgtggtgaaaccctgtctctactaaaaatacaaaaactagctgggtgtgatagcacgtgcctgtagtcccagctactcgagaggctgaggcaggagaattgcttgaactcagggcagaggctgcagtgagccgagatcgcgccactgcactctagcctggtgacagagcgagactctgtctcaaacaaacaaaaaaacaaaacaaaacaaacaaaaaactcgctcaaggttgggtgcagcagctcatgccagtaatcccagcactttgggaggctgaggctggctaatgacctgagcccaaaagttcaagaccagctgaggcaatatggggaaaccccgtctgcataaaaatataacaattagctgggtgcattggtgcgcacctgtagtcccagatactcaggaggctgaggtgggaggactgctcaagcctggaaggtcaaggctgcagtgagctatgatcatgccactatattccagcctgggtaacacagcaagaccccgtctcaaacaaacaaacaaaaaacatgctggcttttgtgtcgcaaatggattgtagtatatccaagaaaggaagtagagagatcatttagtagacttttacgcaagttcagtaaacagatactagaggcttggactagagtggtggcccaaagacagagggtaatgaaaatattccaggtactttgggagcaggaatcaacagaaattggtgatgggttatcaggggcatcaggaagggagggacagagaatggcatcagtatgggcagtggtaacgcttgtgtgaggaacagtgtcagaggaacaggtgtaaagggtgtgtgggttatggtgcggttagaatcaagaccgacttggaaacaagctaagtttgagatgcctttgagaatccaagtggagttttcaaggagtcagtttaccatgaaattcagaagttctgcagagagttcaggagataagacataaatttagaagtcatgagtaggtaaatgatattaaagtaatgctgatgaagagttgcatgatagttgtctgggagtgagaagtctggttggggaggagaagctaataaaggagacagaaggagccaccaccgagggagaaggaacacagagagggcatggagatctggaagcccatagtaagcacgcagtgaggattagtgttactatcatttggcattaaattgtcttatccagtggaatatcccagtgggatggaggggaaaaaagccaggttggaaagagagaagaaggaatgggaggcaagtcagtggggacaacatatggcaaccactcttagaagcagtacgaagaaggataaaaaattctgcggagggggataagaggtttatgggtggacttttgtttgctgttcagttattgactggctgagcatgggagaggagagcatgtttgtaggatgtaggagatgaagcagggagggagggcccatgaaacctagagtgcagatgactcaagagccaaccccgagtgggggagcccaagcccaatgggggcgggggggctcggcttggagcaaggccaattctctcctggtaatgggaacacaagtgccagagaaggatgcaaatggcaaggaggttgagactgggttgtgaggcaatgagaaaggtcccttctgatagtttctactttatcattttacattttaaaaagatgtgtgcagtgcagccatggagtaagggagggagagcagaggagaggttaggaaaggtcagagggtaagctatgaagagctgcataggagcacgggaaatccagcagccagagaagaggaggacgatcccagacggtgcccagtgtgtatctgcggaggaatttaaagtaaaatgggtgagcccagttgtgtaattatctccagctctgcaaagtggacattcatgtggggttcagattggccactggaatggaggcaggatttctaggggagagaaagcctcaacagcttacagggaaggcctggcagacccaatgttgcatgacaaggaggaagagtaggcgggtgagacaaatgacctgaagctcacagcaggccatgctcaggaggaacgtgctgatctcaaagagaaaagtgtgggctgagaggacaccagcttgactccgagggcctaggagatgtggagagggaggggcaagcagaggaaggggtttccttgagagacgacctggttccggagaagttcctgcagcaaaaacacgcggggcatccagggaagtgcacgggccatggcggaggctgtccgaggggtggggacacgagggccatgaggtgggtgcttgtgggaggctgcggtgcgtgattagcagcaggtgagagtagagaagacagcggaattgaagacaactgggagctaagactggagggtccctgcggcctctcagagggatgggggctgagccctcccatggtcaggtcacaggccctgcaggtgctgggggccaactcacatcccttttcttccctctcccttagggtctcaccacttccgtgcaaagatgacaaatattgtgtaaacgaatattcaatatccctaacattcacaatattcctcatatctagctcacatactttagatcctcaaattcctattttaaacaaaaatgcaactgtcgtggtgccagatgatggcatttagcctctttagtgtgttacagaatcttttcctgagacacttaggaaagcacaaactttttcacccaaacaatgttgaagatggcagagcctggtttgagaatccccactcagggggagaaatagtcccagggtgccagtatccagagagctgacctaccagggaaagtgcttatgtttctttcaggataggcagtatggcaaacaaagtcccaaacacatcaatatgtcattgatcacttgacccaacttaaattttttattcctttgttcattgataacattgcatacccatagcgtgtgacagttttctcaggggctgaggatgcagccacagacaagcccagcttcttgccagtaggggaggtgcatgacagaaagcgttttgattctttttatcatccatactctctgcaatgattctcacagacaacgcactctcccaacatactgcacccacgtgacagtgggagcagcctccctacactatctccataactctgcttggtgacctctcagatgacagtaaacatcatcactcccagatagttctgaaattgtcatgttggaaagtacttgataactgttaacacaaaagggactcagtaatatcgaagggttatggatatatattcctattatgtgaaaaatacatatcttgcattcctagcagacagtagtaggttattgctggtactttcatatgttggggggaaaaacatgtacttaaaacagtgcctcgactacggcaagcagaattgaaattatgatgatgataatgatgaaaataacattactttcattatgaaacagtgcaaaatggatagtagacaaacactatccgtaattcaatgtggataattcaacgtgaagacactggaagtaaaacaatactttgaggatccagaacttcctcatttcacattctgttaatcagggttgacgtgtgctgttggctggctgtcttcatgtcagccagatcatcaagaatgtcttatcaagcaggtgagtgggaaacagactctcccctacaggccagcacaagtggctactgccctctgttgccaatagacagtgggcaataggtgttggaaaaaacgccaaggatattaaaatgtgagccttgaaaaaggactcatgagcaattgacaattagcaatcagctgggttgaaattgatcaatgagggattcaaagtaataaaaaataatgagtccgattaaaggcaaagcagcaaaaaaaagctagtagcttctacttagaacacatagttcatgaaaattactataactaaacattgtatttaagaacactttctcggccagacgcggtggctcatgcctgtaactccagcactttgggaggccaaggcaggcagattacttgatgtcaggagttcgagatcaccgtggccaaaacggtgaaaccctgtctctgctacgagtacaaaaatcagccaggcatggtcgtgcacacccgtaatcccagctatttggaaggctgaggagggagaatcgcttgaacctgggaggtggaggctgcagtgagctgagatcacaccactgcactccagccagggtgacagagtgaaaccttgtctcgaaaaaaaaaaaaaaaaaaaaaaaaaaaacactttctctcagcttttaatttttattgctgtttcccaaattattctttctttagaactgtttatcacatgacaagaccaaaagatttttctttccttttcttctttccttctctctctctctccccctacctcctcttttttctttcttgctgtctttatgtctttcttttttttaaatagagattcatggcctgtgtgggctagtgaaatacccactgggttaggggttgaaagatatggaggcaagtcccagcaacctcacttcaaactctgagtcataagataataacatgaacctagaatagctaagataactttgaaaaggaagaacaaagttaaaggataaatgcttcatgatttcaacactaaatgtaaatctacagaaatcaagacagtacgctattggcatacagatacccagatagatcagtgacacagagcgcagagaacagaaatagaccctccagtacatggccaactgactttcaacaaaggtgcaagatcagttcagtagcaaaaggatactctcttcagtggatgctgtttgaaaaaaataaataccaataatataaaagaaactttgattcctaacttgtatcatacacaaaagataattcaaaatagatcagatatcttaatataaaacataaagcttctagaagaaaacataggggaaaaccttcatgacattttgttaggcaaagatttcttaggtatgctacataaagcacaatccataaaagaacaagctggcaaattggatttaactgaaattaaaaacttctgctctttgaaagacactgttaagaaaatgaaataataagccacacacagagagaaaacatttgcaaatcatacatctgataaaatacttgcatgtagaatatataaagaattcttacatttttatagtaagaatgcaactcatattttaaaatatgagcaaccactgcactccagcctgaacgacagagactccgtgtcaccataaaaataataataaaatatgtgcaaaagattttaacaggcacttcaccaaagaaagtaagagaatggcaaataaacacataaaaagatagtcaggccaggcgcagtggcttatgcctgtaatcccagcactttgggaggctgaggtgggtggatcacctgaggtcaggtgttcaagaccagcctgaccaacatggcaaaatcccatctctactaaaaatacaaaaattagctgggcatggtggcgtgtgcctgtaatcccagctactcggggggctgaggcaagagaatcgcttgaacccgggatgcagaggttgcagtttgctgagatcgcaccattgcactccagcctgggcaatagagcaaaactccatctctctctctctctctctctctctctctctctctctctgtgtatatatatatacacacacacacacacacacacacacacacacacatctctctctctgtatatatatgtatatatatatacagttaaatatatatatatatatttaacatcattagtcattaggaaatgcaacataattccatagtgagacaccactacacacttaatggaatgtgaaaacttaaaagattgatgataccaagtgttgagtaggaactggagcaactagaactctcgtacattctgggtgggcatgtaaaatggaaatggtacaaccaccacggaaagtagtttggcagttccttaaaaagaaactctaaaatatgatttagtcaccccacttctaggtatttacacaagataaaaagaaacatatctacatgtacaaagacttgcataaaatttcatagatgcttgttggtaatgcctggcaactggaaacaagcccagcattcatcagcagtggaaaggataagcaaattgtggttgtatacataaaatatacacaattcagcagtagaaaggagtaaacttttcttatacacaacaatgataaatttcaaaataattttgctgtatcaaagaaatcctacaaaaagagagtacatactctacggtagcatttatatacaattctagaaaatgtaaacaaataaataattgcttggcagggacacatgggaggggtcaatggctatgttccttacattgattgttttactggcatatacgtgtgtaaaacttatcaaatggtacattttaaatatgggcctcttgtatgtcaataaagctgttaaaaacaatataaaccaacattagccatttaattaacacaggcccacttaaagatgatagatcaggaagtcaaagctcagagaaataaaaggactggcctgaagtcacaaagctgaagagacttgaaattcagtctcaggtctgtctgagtatacaacctgtctcttccgtcctataccacacaaacacatcttaacctcttttgttttgaaaatctctcatttcaggccgggcgcagtggctcatgcctgtaatcctagcactttgggaggccgaggcaggtggatcacgaggccaggagttcaagaccagcctggccaagatggtgaaaccccgtctctactaaaaatacacaaattagccaggcgtggtggtgggcacctgtagtcccagctactcaggaggctgaggcaggagaatagcttgaactccagaggcagaggttgcagtgagctgagattgcaccactgcattccagcctggcgacagagtgagactgtttaaaaaaaaaaaaaacaaaattaaaacaagagataatctctcatttcaaagacatcaaaattccttcaagttgtgtaatcaggatggcaagcattttaatgtatgagttcatggcacgcctgcatcttccccctcagtaactaggatctaggggcttcctaggtcagttggtagaatgcattggattggaaaggttggccagtcactgtaaatttaaaggtgtttttctgaatgcttcagaaagtaccaaaaagccattaaaaatgaaagactaatggaacaattatgtcccattttgacttgtaaaaaccaggattctttgtgtcttcagtatttctagtatttctaagatgttaatcattccaataaagctgaatggcatgacagattttcggcacctatcagagtggcagccatttccaacttcttttttattctatatactgtcaatgtcactaacatagattacatttcaattacctttttctattcactgactcacatacatttcacttaattgctagatccttccacgcagttttcccattgtctggcttccacaaccttatttctgtcacaggttgtacagccaatggtcaccacattgcagagtatatatctggtgtttcaagtgggttttagggttccccagatttagaaatatgtacacctgaacataaaactgggttcagttttctgaagtctgaccaatgagctgacatactgatagctcactgaggtaaaagaagctttgtgatacaactgaaggatgtttatactttcagtgaacgaggcatagcagcctaaatgcaaccgattgaaccacaaataatacttctcaatcaaatggccttttatctttcttgtctctaaatatacccttttaccacacagctcgttcttaaaaaaaaaaaaaatccggtggtcacaatgtcaattgctaactttattttctatttatatcgtccactttatgaatacccttttcctcaatttaattagttagtgtcactcacactttaactgggaacattgtaagactgagctgaatttgaaaacaatgccacgatgtcagactgagtcacatcaattttctaactgcccaccacagccacagcgcaactcaacgacacccacacgggtatctgcgtcctggaattggacttttacatttttattttaatgaaaatgatgtattacatataagtaaaacaacacctttaaagatggaaaagaccctttttttcaagcctcaatttcagttctagtgggacagccaggtgggagggggtccctggagaaactccaaccagcctgccctctgcagtggggaggagcctggcccctcctcctcctgtgtggaacccgagattcaggctgagcgccggaagccgtctagcagggactctggcctagcgagagtccctgtttcccccttttcttccttttcacctaataaaaccctgtcttacccaccctttaaattgtcttgcaagcctgaatttttgtggtcgtgggacacagaaccccgtccatggctgaactaaggaaaagtcctgcaacatcagaaccttcagttccgcataattaaagctcaatgcaaaagaatcatgagcataagtcctctaagagcataaataatcaagtgttgctgatgttccctaatatttgtgcgttttcagcctacacccgcacatatctaaactgttatcaatggcatgaatgagtcaagacttcagtgaggcagcacatatttcaatacaatgcaacttcgctggccacaatcaatagagtgtttttcactatgccatgctttgagtattcagcaatcacttcagaatggcagactgccgtaaaatagaggccaaatcctacccagagaaattttatggtttaaacagatgttctagagaattactgaaaattaatgtcccagtcctaaggtattatggccagttaataagtgacatggtgaaccattgtgttgcaacaaaacatagtaggtacttgccttgaataaatcaattctttattgtcatatttttgtgtctttctccagataagacgggctgctctttgaaagtaaaaagtacgtctttttgctttgtatttctatgactagcactgtggccgagctacggtgtgcagtggatggatggatggatgatggatgaatggatggatagacaaatgcatggatcaatatgtgcatgtatgcctttgtgccacatggtacaatgtaacaggagacctcggccaatggttgcaaatgctcacatgacaaatgacaatcatcagatttaccagatgcacaagttacagtcagaaataggtagtatctgataatatcaagatatataatgggacccaagaaatagattaaagactgactttataaaaatacagaactgtaagcatcagcatctgaccagcccaatctcctggcttccaagtaagaaaaccattctgaaatgttaaaggaaaggccaatcatacatagagagctagaagcagagctataatcagaaaacagaggtaccaacttcagtccaaggcttgtatcaccttaggaattctatcaagtacacactcatgaagtgacatttcctgaggaggttggcactgggaaaaacggaatcccaaggaagaacaagatttgaaggtttttcccaaaatggttataatttaagtggatttatcaagaacaatttgtatctggtaattaggtagtgattccagaatggaacaggacatgagcaccttggaggacaggacatttggcctagggaggtctgggttggtggaggacaggacatatctggagctacagagcgagagtgggcaggcagttcaggcattctccagttggcatagacgggacagaattcctacgggtgagggctgaaaaaacaacaggcacacatgaagtcgtgctctgggagttaatgagaggaatttaggtagccaagaaagaaaactaggctgatgtgaggcaacagtaagaaaaaatacgaagccacagtaggctggaccagaacactgttgtggtaaaaatggaatctcaattagcataagacagtgagcgaatggacagcagtgggagaacctgacaatgaggaattttgaggttcttgtagattcaggagtagaataaagtctgaatgctaatagtgaccaagttagaacagaaagcaaaccaaaaagacagatgcactagaaacgtgattgaaaaagacccagaagggttaagtcagggtcttttaatgcagaagttactttcaagctattaatgaacaaattaaagactacttgatgtcaggctgtgcaatggacatttctatgacggtggaaatactctatgcctgaactaatattgtatccactgaacgtatttacattgttttgtaatcatgagaaactgaaatttaatttcatataatctatataaatttagatttaaataactacaaaaaccggtggccacatgtgaagtttggcacacaatgcattcagtgtactatagagctatgaaatgcctaaggaaaaggaataaaattctacacataataagttttatactgttatattcttgatgcataattgctacattctaggccaccattgctctcaaatatactggcaccaagaaattctattgccattttcaagttgaagttttcaattatctttcctttcctgtaacattctagaaaggatctgagacaattatacaaatgtataccaataacatttaagtagacaaaaaatggagagaacatgaaatactgagagactactgaggacaaaagataaagagagcatatagaaataaaacccagaatagatgacagtttcttaagataagtcctgaccttcctagtggcctaaggagagtcaacattgtactctgtaaccgttgtattacctatagcatagaaaacttatgtgtcattcaggagaactaatatttttcctggactgaagtttgaatcacgcaaatgtctttgaatcgcacaaatcatttgcccaaatcgtgcgactctctgtaagcttgtgagccgtgagttggcacgttcctgccggaattggagaagcaaaggctgaaagaagcaggcagattgacaggtgatgtagatgcatggagacaaagaaggggtctttggaccaatggttctgttgcccccgagacccacccctgtccctgggaaacaggagacacccccatccttgatagtaaccccctcctctcttcttatattagctttagttggttctgttcctgtcaaccagatgagccttagtgcagaggggaacatcttgcaggagttgacgaagagcggagcagtgttagtgggtgatttcctcagcgaccacgttgtaagaggagattgtgcatctgtttctgtctctgtttcttgcactgcccgttgctgtgagttgagagtttaaggctgaggcacattcagcaagggtcatttacagaacttcaacagcacactcaccagcccctttcccccccacaacgtgcaaagtgcaatatcacccatattaaattgattgaaagttaaatttttgtcatggattccatgataccactcacgagcatttgtgagctacaagctgaagacctacccgtcctgagctgaatcgagaaacctaagcattaccttcaacgcctgcctgcccttcctccacacgaggcccatcacgagtcccactgaatttggtctttcacctctcctcttgcccctttgcaaccattttcctccctccagcaggagtattcttttaaaaatgcagatctgatcatgccacttctcttatatgaagcttccagcatctgacttccaggactgcatcctccagggtgggcttgctgggccctgcccatttgctggtctctttcactctcctccagccactctggtctctccatgctacagacatgctttgctctctcctgtctcaaggttttacctcaagttgttcctttcttcccctgtcctgcctcacttcctccgtttcttccatctcttatctaatctgtaattatatagctgcatggtttttcataaatatctgaaacccccactgaattgcaagctccttgaggggaagaagcttatctattctgcaaaccgttgcttctccctgtgacgcagagcctgcagtgtagtagatactgcctataaaatggacaggatgcttggatttgctttatctgacattttaaggacacactttataaattgtagaggcctatgcaaccgtctttgtttttacttagaggatacaaattatatcattcaacaggatgccacagttccatatatttctcaaaatgtgaccagatgcaccatttttaatgaaaattaagctctacttccaagttaagggaaaattattttaagctattgatacaagttttaagaattcagtaatttaattgtgcatttctatgtgaaataaaaacaggaaacttattagggtgttttctgtaatatgaataattaatatttgcaatttagaaatctatctccctacaatgtagctgtagtctcagaaggaaagtgtattaaaacaatagctaaatgctttcaattcaaagtacttggtattaaatccctcaggcatcaaaatagctctgtagtcttttctagaatagtatgccaagcagtcttaaacacatattttattggcatcagaaaagcaactgcaaatgttttctcttgtattcaaactcctttaaaaaaaagattccattgctgagctctgacaaatatgcctcctactaccacaccaggttcctttgcaaacacacaattcacaattaaaagcaattttgtaaaatgccttggagtggttaaatatgtaattgggtaattttctgaaatgcttattacttacttcagcctcatttcagtctcactggtaaacagtatattcctgttaagtgttattatccccaaaaacgcttccataatcttcagtgttcctttaacattcctataaacacatcatatattacttggggacgtggatcatgaaacacagaagctacccgtgccagtcccttatttaaatggcaaagtggtcttccttgtctctgaacccgggttttctaaatcattcgcatagtggaaaatgaacaataggacttttaaacctccttatgatttagattatatcttagctggttgcaaatctcattatcagctttacagcttgatttatttttatttttggatcagaaggaagaatggcaaaattacagcctagacgtttgctttggaaaataaagtttgaagttagctgttgttgatttatacccagtatgctatacttagcatgagtgtacagttaagcatactttataggtaattactccttctattgatatgatgatagctacagaagctgtgtacaaccgagaacaacacccaattcttgaaacagtaccttctaaagtggtatattaggcaaataaagtgtgatgatggtggtggtatttcatccaacaagagatattagataaataaattgtgatgatgatggtggcatttcatccaacaagaggtcttactccctctgaaaccaacatcttttactacttgcttagttatatatgaacaataaaaactcaccaagatcactgattttgttgaaatgaagagaaagtaaacagtctctaactgaaacgagcatgttcaaattaaaatagggagtaacaaatcaaaaacaaaataaaacaaaatgctttgaattgtttttgaaggcaaagtgtcccaaatacttttacttctatgctctattattttaggtcctacttttctacaccataacacagtattttaatattaataaactagtttccctctatgttaataacagagatcaattaaaatttggtctttgtcattttgcagttaggttattttaactcacaatacaacatgtacagttcttttattctacaaaaatatatagtattaagaaaccaaaaccattttaatcaaaatttctgctatgacttgaagactacagaagcccctatttttgcctgttgttcccttgataaagtattgatatggaagtctcaattactaaaacagaaaaaacttatgcctgctgtcattgaccacatttttttttttttagacagagtctcgatctgtcaccaggctggagtgcagtggctcaatcttggctcactgcaacctccacctcccgggttcaagtaattcttctgcctcagcctcctgagtagctgggactacaggtgcacgccaccatgcccagctaatttttctgtattttcagtagagacggggtttcaccatgttggccaggatggtctcgatttcttgaccttgtgatcctcccaccttttttgttgtaaaataatccttgatatgctttatggacaacccctccccacggttccacagaacacagtttgataaacatcaatctaaaggtactgcagagaggctgagatgctagtgtgtcttgcagagccattaggaggcactgtctccacgtactgatttgattgtattttttcatgctgagtctgaccaatttcatggattcagtaaatagtaagacttggtttaggggccagcagacaaggatcataacatctttgaggtggaagaagtcctagacatgaaagaggttttgtgaataaaaggtggagagggaaaatgaactttacagtcaggcagacctatgtttacatttagcttctgagagccttagtttcctcatctgcagaaggagattattagtatcaaccacagagaatcactgtgaggcttatatatggtaatgtacgcaaaaggcctgccctagtatccagtagctagaaagtaacgtgaccaaaataaccaggttaagttggggtagagtcaggattagcctcacgacttatagttcagtactatttctaccatagtgatctaatttgaagaacaagttagctaatgagtgcatcttgctgtaggtccaaaaacaacctccaagacaaactcagcatttcccttacaacaatcagcatgggccgggcacggtggctcatgcctgtaatcccagcactttgggaggctgaggcgggcggatcactaggtcaggagatcgagaccatcctggctaacacggtgaaacgccatctctactaaaaatacaaaaacaaaattagtcgggtgtggtggcgggcgcctgtagtcccagctactcaggaggctgaagcaggagaatggcgtgagcccgggaggcggagcttgcagtgagccaagatcaggccactgcactcccgcctgggcgacagagcaaaactccttctcaaaaaaaaaaaaacaaaaaccaatcagcatggcagaaaaaagaacgctccgaagcaaagctgcaagcattaactattgtacttctgatgcccatctaaagacacacaggaaatttgcttagaaattataacacggtggagaagtaaacagttagaagtcactctcaactgaggctgtttaggtatttgtaactatgttaccttaaaggttactgttctaataataaagttgtcctgtcctggctgggggtggggggctgggggtgtggggatgggagtgcagggaggtaggggtcttccggacactgcatcaggggaggtagcagcccctcactcaggtgtgactaggctgggataacatggatactgtggtatccctagagtatccatgttatctggctttagtgatggcattcctgaaaatgaaatgtgtatctgaaatgtgctttctgttaagatgtatcaaaaatttatgttttcctgaattttaaaactgactggtttagaaaaatgaatggatgacttcattttttctactttgttcaaatctagtctaattaagttttttttttttctgcagcgtaagacatgagttatgtcagaaacaagaggttctgatatttgaaatgactaaacacgaagggggctcccaagggaagttagggtattccttctgaaagtccttcaagacagggttgatttttaagtgtttgggatggctcaaatgcatctgaaatagattaaaactgaaaatattagtgcatcacatatagtaggaaagtattattttgtgaaagggttttcaattacatgcgtgtgtacattttatatgtttatagctcttgatgtaaaatgtatctctttccataggtagcagcaacgtaactttgaaatccactggcctagatcagtgctctccaaaattttggtggaaaacccctattagtaaaaataaagaattgattatgaataccaatactgattcaatgcaaatactgcttctattttatatacatttaaacacatggaaaacaaaagatagaaaaacaaaaaaaatttaaaggaggatataaaaagtaaatcaaacacagaaattataaagttttcttcctgtagcccaatgaaccatagtctggagtccacttcttttagtgtagctcccaattccattagaataccgtgaccccaatttcaaactacatatctgtttaatatcatacttgatttcagtccacaagcacataaatgagttttattcattactcatctgcagcctattcagaatacaaaattttctggaaaggacttagaagttatactaacaacccagttaaagcagcctaccaatgctatcagtgagaagagaaaaataatacagagtggtagcctcagtaatgccgctatttatactcctacatatacctctttctgaaaaagattagtttagaaaatctggttttgtgcaatagatctaatataagaattttataaagaactatcaataactttccaagttatttgttttcacaagcacgtatttatggaacgttttacatttcttataatgttaatccctgattcaaaggaattaattattcctatatcaaagtattaatgtagaaaatgtcaaaaagaaaataagatttttacttttcaactatacaacttcaattaaacctacatcgcagcttcaggtttcccgtgtgagtcacgcgtttctagaatgcattctaaaactggtgcataggtttggtggtgactgggtaccaggtactgtgccagtcatttttatataccatctgatttatgacctctgagttcagaattctcttcattttaaaacgaggaaatcagctcgacatccagttgagtgggctggtcaatgaattggcaccatctgagtacagggtcctcactttgcccaaggttcctgaagcatgaacataaccaagcctactccttggaagctgggctcccagtacccctagaggaatatctttttgacagaggctgccagatgtccgcctaaattcctcttttctctggttcctaggcctctactcaagggtccattactgagactccctcgaaggtatatatagccaaatgactaaggcctagcttaaggatcttaggggtgtgtgctatttctgggctgggattatatgaaagatgcatgcctagtttataatttcattcccctctgccagctggatcttggatgtggggattaagcttgaccatggagatatggaccaggcccagtgggataataaaggcaaaagatacaaatgcccctcagaagataaccaccacccacctgaaacgcccaccccaggcaagaattatgctgcggttgtgtgtgagccactgattacattgttggctttactgtaactgttggcagtttagtccacaataactggacgcctcaggtcctgacaatccatcctgggagagccagggactgagacatgaccacaaatgctgtcctagccacctgcacccccaagaagatgcttgaatctttacatttacaaagcacaggaaagttaggaggatccatcctgaaacgtctgctagtgagtctagattttcaaatcagaaaattggcagaaagagccctgcattccccagggacactgcgttgaagctcaggaaaccagcccacatggagcatggggaagggcttttgggaaggctggaggacaaggcgtgtcttaggaacacccagtagcttaaccgcagggagcagaacttacatacagagggctcacgttcaataggccttttctgaacttgggggtgctgagtatttaaaaactatttcagaattgagaaactgattgttataggataaaatgtgtacccccaaattcatacattgaagttctaaccccagttcctcaggatgtgactctatttggcaatagagcctttatttatttatttatttatttattcatttatgagacagagtttcattctgtcacccaggctggagtgcaatggtgccgtctcagctcactgtaacctccgcttcccaggtgcaagtgattctcctgcctcagcctcccgagtagctgggattacaggcgtgcaccaccacgcccaactaatttttgtatttttagtaaagacgggatttcaccatgttggtcagtctggtcttgaactcctgacctcaggagatccacccgcctcagcctcccaaaatggtggcattacaggcgggagtcactgtgcctggccggcaacagggcctttaaagaggtaacatgaggctattggtgtagatcttcacccaatctgactggtgtccttagaagacgaggagatgaggacagaggcacagagggaaaatagaccacaggaggacacaggcaggacgatatctaccagccaaggagagaggcttcaggagaaatcaaccctgctgacaccttcatctcagacttccagcctccagaactgtgggaaaattaattcctgccgtttaagccacccgggctgcggtattttgtaatagaagcctgggcaaactgagacagtagttgatggccgggcgcagtggctcatgcctgtaatcccagcactttgggaggccgaggtgggcggattacgaggtcaggagatcgagaccatcctggctaacacggtgaaaccctgtctctactaaaaatataaaaaattagcctggcatcatggcgggcacctgtggtcccagctactcaggaggctgaggcaggagaatggtgtgaaattgggaggcagagcttgcagtgagccgagatcgcgccactgcgctccagcttgggcgacagaacaagactccacctcaaaaaaaaaaaaaaaataaaataaaataaaataaaataaaataaaagcactgctgtgcttgagccacaagaaagagctgtcacaggtagcagcttgggggagggatcaggagtgatgctgaggaagtaaataagattacttctttgaatgctgttcttattcctccttccttgtgtttcaccactgccttttgtacagtgttttcctctataaatatataattccaagactggtgatgtctagtaatggttcaaaaagcagaaaatataagaaatattattttttccaaacactcgagtagaatcagtgatggaacatgtgagatcacctggagggcattcagactttactgcaaataaataatacaattacttggtttgggtattagatatttatgttcatcttgacattagaatattaagccactcctcctcttgctaacttggtatgcattgaaaacatgaaattctctcagtctcctgctttggaaccaaacagtataaaccctcataaatatgtaaatcaacccctctaagcacattattaattatttcaaagatagtaggaggtcactagctcatagcaatttctatgcatgaagtctcagtaacacaagacatcgcacagggaggaagaataaagttttatcacagttaccgaatgtgtgtgtgtatgtgtgtgtgtgtttgtatgtaagtggccaaagcaacatacagtattgaatgcagcaccactaggctctgaatagacgcctgtgggtgatgatgatggcggtagtgatgaaggaacggaatctacagctagaacagtatttttttttgaacctgtctgcaccaggaataatatttttaaaatccaaagggattccagcctcagatacacttaaattgttcttgacccacatggccctgctttcttctggaataaagttctgactagttgcaaaaatccatagctcaggaagatatagcaggcatctcatttcctgtgacactgcagagatcacagactgtgttgctcaatgtgtctctaatgttgcatattgccgagcggctctctggctgctgtaagtcagcttcgtttaggtgattctcagcaatcgacatgttctgatataggccgtggggctcgctgaggtggaaccacccaaaacaccaaatctgaagcagttgaggacgttggatacaacactgacagatgatggaggatatttaacacaggcaatgaactctgctttttacaattcatcaaacaaatataagacgcactctcaccaaagtgcaataaactgatcttgtcatccaagcaattcttcccagtcactagtccagtttgcttttaaatctctgattgtaagcttaaaatttatctgatgaaaaagataataaactattttcacacccaataacacacatccctcaacccaatgaggaagacagccattatctagtgtaattaacaaaatatatataacaaaaataagaatgaaaaaaccttgaatggaataatttgcacatatattcagaggttcaggactaggagtattactggaatttagatggttctggagagggacatttggcaaaacctttcaagcactactagtttgaaagttaaaagcaggcaaaaacttgcattatttagggttgtatatataggtggtagtgctacaaagaaaagcagggaatgataattattaagatcagatagtagttatatctagacaggcagaggaagcggctatggaggagatcacacggaggcttctgggctgctggctcacattgtgtgatccaggtggtggttacagaggttttctataactatgcaaatctataactatacaagtgctataagcactcttgtgtatgcataatatggctcataataaatttaagaatacatcaaaccatttaaaatgatatatttaaaggtcaattagtattttattgactacgttagaatcctcccagcctcaggaggtgcccactctgatgacaatgcagaatgcatacattcaaaaattgtgccaactgctgacgaggcagggggaaagaattcaggccattctactatctgtttatctatctatcatctatctatctattatcaatcaatcaacccatccatccattcatctatccatttatctatctgcacatacacactacacaaacacacactaaaaagaagaagaaatcctaaagacagctgttttgagcaacttttgtagctaccttaagtactgacagacatctttccacatttctttgcataagtaataaatttatagctaaaaattgtttgtgtttgccctcataaaacaaaggtagaatgtgctttttaagagtttttggcagaaatgggtggaaaaaattatttttattctctctgctattcagaacattcccaccttatttttgctttctcaaatgttattttatctttaaacacttaataagatgcagaaaaagaagaagaagaaggggaaagaagtcagtttggagagtcgaaattcaaggaaagtaagaactgggcaaagttgtcttggcgttcctcccagagaggaagggagtgatgctgctggagctgtttcaaacggacggacggaatcacttcatctgtaatccagacacatgcatgcatcaggcaaacataaaattctgttgtcttctctgaagtagaattctataaaggcagcatttccaaggccaaaaagatgaccgaacagacagtgccctgttgatccagctagaatgagctctgcaacaccatcaattttgtcctacagctctttttctggtccttgtccgtgtaccagtcactccttataatgaagtcacttgattgagtgttgttcctgttgcaagcagggagaggaaagctgagaagccattcaataaatgttatgtttcgccctcctctccaccagcgttagagactgctgtgtgttgacagcccgtttgctttttctccttggcacagggccagatcctgtttcctcccccatcctttctactccctgagcacacacacacacacacacacacacacacacacacacacacacacacacacggcgtggctaggcagggccatgtggctgagttctggtacaaggaacgtggaaataagtgacatgctccatttgcaggcctgggatctaaacctgagtctccagtgtggtgtgctgcttgctcttcctccgccagctggccccatgaagaggatcgagctgagacacaggggctgctgtgggtgacagaaccagaagatggcaggattcgggtctgggtccctggataacggagtggagcagaggccccttggccaacccacactggaccatgacatgaagggaaatcaatcttgaccctgttcagccactgcgattccagtgttgctttggttagagaagttagactattaccctgactttacaccgcctcatgcatccaaatcaaaggaaaactgtcaaaattgctaaatcattcccaaaaataaaacaggaaggagtttaaactccgaagcttaggaagtttgatttaatttcaatcaatttggaggcagaaggaactttgaacttggactacaagcacatcaggagttagtttcaatgtggcttcaatcctggtgccaccattttcacagtggcaattataattatacaaggtccaggagctagaaagagaatggactgtctgtttcagcgaggcaggcaaacagacaggcagacacatggagattgcatgtggataggctctgggtagtttaacattttaaagcttataatacggattgccaaattgctttatggaaatatatgaatttatattcttacctcttttgaatgtgtgtccatcattttatattttatgctttaagttagcaattcttttttttttaagacagggtctcactcagtcactcaggctggagtgaaatggcacaatcatggctcactgcaacctcagcctcccaagctcaagcaatcctcccacctcagcttcccaagtagctgagactgtagatatgccccaacacactgacctaatttttaaattttttgtagaaaaggggtctccctgtgttgcaccaggctagcctcaaattcctaggcttaagtgattcacgtagccctcccaaagtgctaggattacaggcttaagccagggcacccagcctaagttagcaattccgtagcaactaattatgttgaatttttaatatgcgtgttggccatttgcatatattcttttgtaacgcatcttttaatatatttacctagttttccaatgtgttttaggagttatattaacatgattatttgtatttaggagagcaatgttcgaaaaccaaaaaatattccttcatattagattttatgttttgctccctaagtaggtgtctgcaacccaagtttcttgactccctaggcatcgagaatatctctgtatctaaacaggatcagaactgtctgtctcatgctgcactatgactgacaacaaccaagaagcataacggactatagttggtgagctgagataatagatggaaagggaattgcattctaagttaggtgaaaactagaattacatgaaaagtgacctgggagtacaacagtaaaaacaaaaaacaaaaggcaaaaacataaccgatggacttgaatggtactaatggtgaggctgatggcatttcatagggaaggtgggaaactacttcctcagcccctagagcaacagaaaaatctgtgctaccagggcttataaaggacaagaagtaagtgcattttgcatagtagccatcattctacagtagcactctcaacaaatcaacctaaatacatgaagctccaccaagttgggtgagtgctactcagttttaaaaggagatgcagagggtgcttcatcatttcaaaacaattccgagcatagactactagtaatagctggcagcaaacctttcaggataattaaaaagattttaccaaagcccatacctttaggtaagagtttgtcagaggttctggaaataggctgttttggctatgtttgtcaatcttattttcaacttcatcaaaatgtactgaaaaactcatgctagctagcaagtcaaatcactagagattacatagacatgggcagagggagtatttttgcatttatgaatgctacagactcccattgaaaatgccttcttgcttacagactgcccaccccagagtagttcttaaatatttaaacgtgggaactttaacaaaccatgatgcctaacctaaaaggttaccatttaattggtctgaggcatggccttggcattgggatctttaaaaacttccatgtaactgaaaagcatatctggggttgaagaccacagcctagggagaggcagggcagcagagaagcaggagtacggagctctggagccaatcgtatctgggttaaactctcagctttcctcctcctaactctgtgatcctggttgcttaatgatatcgagcctttacttcttcctctgtacaaataagaataataatttctaccttatagttgttttaaatatgaaatagtgctaataaattagaaatgttcttttcttgaccttcttcccatagaactttcaaaggtatgatagtttaactgttgaggcaggcttatctattcacacagtgattaggaacgcaggcgctagagccataactctctggctttgtacaccagcatgtgcaatttaatgaacttctgaggttccattccttcatttataaaaatgagaagaataacaacatccatcctaatagggttttctggagattcaatggaggtttatgagtaagcactaagaatggcaccatatttatagtaagcgctcattaatcattactcgtttttgaattttagggaaataaaatttcatatcctacccttagaaagtataacacaatatctggtcaaagaatgagttcacactaggagagcagggtttctacctggatggtattttaagccagttttaattattcaccatcataattttgtcaatgaaaaagattggttcattgttgcctggccataccttgaagaatgtataaggtgtttagcttaagaagtttgaaagagacacaaaaaactagacgatggaaacagaaaagaacatcttattacacacatcttgatagcaagaggtattagatatttatctagaaatgaatatatacagacactgttaagacgtttggtgcatgagaccagtgtaatttggaaaatggtttgctaactctacggatattctcatatatatatattatatatatgagaatatatatataatatatatatacacaatatataagagatattttatatacatatatatctatatatgtatatatagatatatatgtatatgtatatatgtatatatgtatatgtatatatgatatatgtatatatgtatatatgtgtatatatgtatatgtatacgtatatatgtatatatgtgtatatatgtatatgtatacgtatatatgtatatatatgtatacatatatatgtgtatatatatgtatgtatatctagttaacagtcccaggggtttaaaaattattattatggtcttataacatctgtattcaaattctattacatgatttcctaggctaaggagacactaaataatgaatttgggggaaaggaccatttgtatgggctaggggcagggtggagaggaggtgagggctatagctgcatttatggaaaagcacagaagatcctggaacagtgccatgcatgggacatttgcttcttccacaggttgagtggtgactatgccaccccagcaggaggagtcattccaatttgtggtgatcaaagtcctttggaccacaccaagatagaaatacaaccaccaaacaaattcaaagaacatatttaccaataaatctaccccatttgcagcttcattcacactcctaagttcaggaaaatcaaggaatggattggagctatggattccagtaccagattaatccatcttttatgattagatagaaactttatcattgaaaggaaccgatggctttagggataaaatgtcctttgattgcataaataaatcttgctttaattttcttggaggaattacaatccaaaaatagccagtagtccccacgggggctcaaaacaattcgcacaggcattttaagctgggatggtggagaggttaatggaccactcttcagagaaatcagcaagggccactcccaagattccatacgtcaaagacaacactggggtctgactctggaggtccagccattttatacaattagaattgctgaggaggtcagccaagaacctccagagaaacattccacagcaccaggagtgcacgatcagcaacgtgcccaaagtgcccatcgtgttgtcaggggctgtgctgcatctgaccacagacaggatcaggcatggactctgaagccttcccgtagcagtccagcttccataaagctgtgctttcaatacattatttgtttctttacagaattaactgtcatttctgttttccatacgtattattaatatatgttatttatttatttattttttgagactgagtcttgctctgtcgcccaggctggagtgcaatgatctcggctcactgcaacctccacctctctggttcaagtgattctcctgcctcagcctcccgagtagctgggactacaggcacctgccaccacgcctggctaatttttgtattttcactggacacggggtttcaccacgttggccaggctggtctcgaactgctgacctcaggtgattcgcccaccttggcctcccaaagtgctgggattataggcatgagccactgcgcctagccaacatatgttatttataagattcatagacattgatataacctttagctccaccacagaagaaagctgtgccctgggagtaatatgggttccatcagctcttgttcctgataatctaccattttgatttatagtttgataagctttgatcctattctttcctttcctttcttttcttttttttctctttttcttttcttttcttttttttttttttttttttttgagatggagtctcgctctgtcactcagtctggagtgcagtggtgtgatcgtggctcactgcaacttccatcacctgggttcaagcgattctcctgtctcagcctccccagtagctgggattataggcatgtgccaccacacctagctaatttttgtatttttagtagagacagggtttcatcatgttggcctggctggtctcatgcctagcctcaagtgatctgcctacctcgtcctaccaaagtgttgggattacaggcgtgagtcactgtgcccagactataaactttgattttctatttctattttgttatcattttattttatgtgtcttgttctatgctccacgaatcaaggcaaagccaaataaaccaagaagagagatcaccagatagatgggtaattggctgatttatgcattgaattataggaaatcccaatcccaacctacaatgaaagaatgtccaaatgcatgtttctctgtaaatatacacatacatgcagacatagacacaaacacaatatgtatatgtttactggagtgcatgcttaaatcacaaccaaaataacaaaagccagtgtacattgcgtgcctactgtcttcagcatgtaccctaaaggtacttcataaggcattattttaatgtgtccacataaaatgatgctaatgcattatccccattttacctaagatgaaatcaagtcacactaaggtgaagaaccttgccctgtattatgtatatagtaagattcagagccagcatttgaactaggcttttctgaggtgccgtatataaaccaggatttgtgaaaaatggttcactggtttatgggggtaatattaggacttacacaggtattatgcaaaaaatatgaaaagaattgacctccacaaagacttaatgtacagaatgatatgtgtaccatctcataccctagcctgtatattggatggtcatatgtcatgtattgcaaaggggttatcccaagggaacagggagtcccacaaccaccactggagagtggagccctctcttgtcagtcacctttcagcagaaggtcatctgtgcttggctaaaagaataatgaataacttatctcattttaattaaattaaccctattaaaacagataggtgacttaaaaataatccttcaaagaaactattaattaaagatagaagtaataatctaaacatgaggaaaatgagaaaacggcaacactgacgatgtcggtacatacgtgaacatcaatgtgattataaaataggctccgagacagaagctaacgagagtagggagccattatatttagcaagacatttaaaaactaagcaagtaataaacaaaatgagtgtctctgttgagcaaatattaaagaaaatccagtttgttcttgacaaaataaaatctatgacatctgaaagtttctctttgcataatatagggaaacattgtaattggatatacagtttttaaaaaggctgaaataacacatgctaaacaatcttgtgacaaaccgaactatattttctcatgagtgagtacttacggagatacatactaaaacatggctgaagctatgaagaaacagggatggaaccgaaccatgccatgtggaagactgactacacagttgaatggcagtacagttgtttctagcctgtctcagcttctggttactagttcattttttaaaatagcaaaacacacaaatatgtaactttagcacttgtagttattaaacattaaggaaaagaggtgccagggaatataagttctcaatagcaactggtattttaaaaaataaaagcaaatttctatgagtattatatttaagtaaccagtgatgaggtggccacattcacaaaaaatgtgtagaaggattccaaagaaactttgcaacgcaacatctttccatccattcatccctgcctcactccctattaaaaccaagaagttgaacccaagagtgcataagattctgaggatggcattggcatactgaatttaaaaataaaagtctaaaaggtgtttaaaacacaattaatatttagtagaatccatataatgcattttaacaacatagagcttgaccacgcaaaattcttttcaaggaggttgttagttatctcgtggcaaagaaccaccgaaattaaagttaatttacgcacattctttacaagtgacccaactttgctaatcttttctgtatctacaaggggctgtcaacagtgtgctatacagaaaatatttttgaaaataatatatgtaacctgtccctgaaagaaaaggtgatgttttcaacatgactgagaaaaagaaacaccaaaggatcctaaacacatgaaaagatgctcaactttgtttaaaattaaaaagaaacatacagccaactacatagaataacatttctcaaatatataattagaaacaaagcaaaagccttgcggctcccctgttggggaggaagtggagagcctgatactgcactttgcaattgctgatgggcatggaaagcgcaccactactgggagagaaatttggaaacagtaaaataaatacacattttccctttggtgcagtaacccctcttctagggagcagatcccagtaatactctgacaacaatatgaaaatacgggtgcacacaagtctattagttgtagcaatatttacagtaaaaaaatgaaaacttagtgtttgccagtaaggaaaaagtaagctatacctacacaaaggaattcaataatgctatatatttttatatgtaagaaaatatctatatcggactagggagtgatctttaaaatataataggtactatagagtgaaaaaagcaaggtaaagaaaaatgtgtataatctactttctacttaagaaggtgacacatctataccatttttgatatcatctatagtatgtttacctatttttaaaataggtgattgtttttaataaacgtttacctttgggagagaaaaggaatattatttacctttatttatttattatttacctttgggagagaaagagaacgtagataaagggtgtatttctttgaatatagcatgttttgtagcttttgctttggaataatggaaatattttacatattatgaaaacacaataaatttaaaagcaatgaaaggccaggtgcagtggctcatgcctgtaatcccagcaccttgggaggctgaggtgggcggatcacctgaggtcaggagttagagaccagcctggttaacatggcgaaaccccatctctactaaaaatacaaaaattagcagggcatggtggcatgcacctgtagtcccagctacttgggaggctgaggcaggagaatcacttgaacccgggaggccaaggttgcagtgagccgagatcatgccactgcactccagcctcggcgacagagcaagactccatctcaaaaaaataaattaattaattaaaaaatttaaaaaaaagcaatgagaaatacatattcaattgatgacataactatacattaacttatatgagtttatatccctataaggatataccctaatgacaaaacaaactgcaaaaatcttaacattgttttcaataatcacacttaggtgatggtgtcgatactgtaatactgatactgttgtgggtgcattccaaagtaaggcaaatgagtaattttgttggtatcactcagtaacagaatttttgccaagggtgaaagaaacaacagttgtaatattggtgacttttcaatgaaaatttggtaacactggatttgaactgaaaatgttagtataactaatattgcatttgtacttaaaaaaaaaaaagtctcctagcttattccactaggcctagaaacagtaaccaacatggtgacaatgagcattccaagcaccaagacttttaaatactatttcctacgaaagggagccagaggtcctgagaaaaatggctgcttgcaggtcattcggcgagaattacaagaaaggtcgagagcaccttggtacactgcaaatcctgactaatgggtgcaggaaggttcactgtagtatttttccttacttttgtatgtttgaaatcgtctaaaataaaaagatacacattaaaagaaaatgggttcaaaatgaactgataactaaaaagatagagtgtgaagggaagacttgaaaatgtgtgtttagaaatgtttctattgtttgtggctttgtgaaggcagaaggcttaccaaaacaaaattgtcacattaaaagcattacagagttttccaatctgtaaataataaacttcactagattttggatgcttttgttaaaaagaaaggcacaataactttcaacaagttttccttaacaatatgttaacatatattatgtgaatcttagttttaaaaatcattgcattattggtagatatgcttaaaagtgagtatcataatttacaaagtcaacaaagaaattaatttattccatttggatctttttatcatttggaggtatatttttcagctataattgacattaaaactaaatcttgaaataaattgaacttaaaacctcaccattgagtcaaggtatcccatagtttcaaattaagttttgaagaattaatgaaacatatttagtcacattgcagtcatttatacatagagagagataggaacttttacttcactccaggtacataaattacctcaaactagattaatgacctaaatacaagaggtaagctattggtagaaaatatggaagcaaatcatcatgatctcagatatggcaatgaagtcttttgtttgacacaaaaagtattagcaacaacaacaaaaacagataaattgcatttcatcaaaactagaaacttttgttcaccaaaggacgttatgaagaaagtgaaaagacaacctatagaatgggagaaatatgtgcatatcctatatctggtaaggatccagtatccagaatatataaagaactcttacaactcaacaacaaaaacataactcaatttaaaaatgagcaaagaaaggacttgaaccgacattcttataaggaagagatatgaattaagataatcaacatcacagtcattagagaaatgaaaatcaaatccacaataagacaccacttcacacttactaggatgactagttagaaacagtaacaagtgacgacaagaatgtggagagagagaaacctgggacattgctacactgctggtggcaatataaaacggtacagcagctgtggaacacagtgggcagttctcctaaaggttaaacttcgaattctgcttctcggtatatatccaaggtaaatgaaagcaaatgttcatacagaaacttatatatgaatgtttacaacggcattattcataatagccaaaaagacggaaacaacacaaatgcccatcagcagatgaatggacacacaaattgtggggtatccacacagtggaatattattcagccacaaagaggaaagaaatattcatacacgctacaacttgaataaacctcaaatacactatgctaagtgaaataaggcagacacgaaaggtcacctattgtacgatttcttttataggaaatacctacaataggcaaatccatagagaaagaaagtgattggtggtggccagggctaggacagggggtcacaggcagtgattagctgggtaggaggtgttcagaaagttttgaagccaggcagaggtagtggttgtgcaacattgtgaatgcacaaaatgccactgaattgtacacttgtaaatggttaattggttacatgaatttcacttccattaaaatgtatatatgtaataacagtatagtacaagtaaagggtgctttgtaatgtgaaaagataaaatattaagtagttcaggtttatctcattctgctttctttttcacatatgttattttatatatattgggtatgtgttcaacattttgagtgatagaggtatacgatttaaaaattaggtaatactgctctagttccacggtaacaaatctagaacatggagagtgactctaacccacagaaaaacttagtataccttggctgaataatattgacaaacttattctcaatgcctttatgcaaataatgcattttccagttcaacacaattccttcattccccagaacttttatcttttgcgatccaaacattaatgtttcatatccagcaatgatcaaatttaaattcttctgctagggtttacgtatatctaagccagttttacatcaataattgttcttctgttcttcattagcattagagatggagagaaaacatgctagacttacccacacaaggcagggagtagccaagttgagggtcgtgaacaaactgccgatcattgagtcttgtcacacagtataagtggaaacagtctaagcaaatcacgtggcgggagttgcactggaaaaccaggacggggctcctgcagagagaaaggaagatgtttcctctagtacctgtcagtgtggaaaggcagcacgtgctttagaccaatttctgtaatcctggagggttgtgtagactgtgctctgtgcaaagaccggagctgctaagcattaagctcatgtataccaacacaacatcttaaaaattggaggcactcaatgaactacatagaaaactgattctcctaattttacattttttatgttaacacatttatcaatcttttgattaaacctgagctaaaatataatctctttctggaagtcttccctgactcagaattcccaattaacctatcaaatcatcccatctgcttgtatatatttctattgatccgttattacaccacagtattcatatcttctcctttctcatagactgtgatctcctggaaagtagttcctatgtttattttgctattcccatagtaccaggcattgtaaagttttaaatgaatgttttaaaaatttaaatctttaaaacattttaaatatttttttcctccaaagtattttaagggaatcaaaaaaatttaggacttgtatatagtgatttactagtaatcccataaacataattagagaaaattcaacagtgaaataacagattttcaaaattctgctatcccacttattttaaagcaatatgtaatacaaaacaaagaaaataaaattccttggtaatttaattataactatgttataacaatagaatctgaatttccccactatcaaaagaaaaattactattgcatcaaagtaaaaacgttaaacattttctcacattttattggcaaataaaaaagtagaatttagggataaaaggttatccaacagggattcttctactgcaagattttgtctattgtgccatctcgaaaccatccaaatattcagtttctcagagtatggttatgggattactaattaatcaatatatataaatcctaattttttttatccctttaaaatactctgtagaaaaaaaaatcttaaaagccatgtatttttactggaaaacgaaccacacaagtttatgtcaaacaggagacaagctcaatacatgaatttgaaatcagccccaaggcgattttaatagtaagaaagttattggagtctatttagataagcctatttcctatgtaattgtaacaaaatacaaaataaacatgttcattttatacccaatctttaacgcctataagagctcttcaaaagccctttttctagagaaatgaataatactaataatataaaagataatttcttaacacctaaaagattttcaaaattctgttatcccacttacttcaaagcaatatgtaatacaaacaaagaaaatacaattccttggtattttaatgccatggatgtgtaagtaatcggtcaacttaatctgagcaagggcgcacctaaaggtgcggcttctcctttcccctcttggaacctatccaagtccttcataatgctttcctatttctaaccaaacagtcactcgcatacacatgctcaagcacacacatacttttttcactttgcgaccctatgaagctgctgtattctacctttttctctcacagctgttatgtgaaaaatattctccatcttgctttcagcaacatggtagactaaaacctttatagacctcccaatctgctactaattcatggagaaaatattagaacatttatgaaaatgtgcctgtatataacaaagttaaaaagaaagcttagaggccaggcgtggtggctcacgcctgtaatcccagcactttgggaggctgaggcaggcggatcacgaggtcaggagatggagatcatcctggctaacacagcgaaagcccgtctctaccaaaaatacaaaaaattagcccggcgtggtggcgggcgcctgtaatcccagctactcaggaggctgaggcaggtgaatggcatgaacgcgggagcttgcagtgagccgagatcgcaccactgcactccagcctgggctacagagtgaggctctgcctcaaaaacaaacaaacaaaaaagcttagaaatgaccctgtagaggaaacataaagaaaacttacagagcctaaatggtcagcccacgaactcccgccacagtggcccagaaagccatggctgcgtggtatgcggccatcagtgtagcttctgcaggcttttccattcctgttagaagagttctctctcacatggatggacaacagcacacttctatagttgtctccttcagttttaatatgatcccaaatgactcataccatctagacaacacatggaacatcaattgtcctactctattaatgacatcctgctatttggagaacattaacaagaaacaagcactacgttggcggccatggtgtgaaatcaaccctgtgcagtgacaggagccattagggacattagggaaagtttagaggtccaagtcttggggcctggaagtgcacaccttccaatataaatagtccatcttacccatcctgcaactggcagtgaagcatagacagctgcagatgcggtgggtccagagttttggttcccacagagtgaagtgtatcttcctagggacacaggaagagtcctactgaaaactaagctacagctgcaccaggccacctcaacctccttgaactgaggatgtctaccttgaataaaaaataggagaaattggcaccaggtaacagtgggttaccagagagtgagcagtgaagggactagcattggaagtgaagacagagactcatgtaactcccttgaagaaacgccactgcccagacgcaggtgtggaatgcaaccggggaagctggaatgttgtgtgtgtttctgcatgtcctcttcggaaaagaaagaaatttacaagttacagggagtcaaaaatgataaatgagtcattcaggaattctgattgtctattactatacatacacagtcaacttggatatatacctatatacagatatagataaatgatagatacagatatcaatatatgaatgtatgtgctaagatacacagatgaagatatagaaaagtatatatgctgcctttatacacacacacgcacatacacagataatgttataaagacggtgtatatgtgcatttcacatagaattatcagtcacctggaattcttgatacagctgtgagctaagattgctcctctcctattaagatattccttgtagttttggaaagttaggtgaggaataaacatgacaccaataaaaagttattagattaatcacctaaggaaaggagtaaaaatcttttcatggctagaaggtctacatcattaacttcctaaatgctaaatcaaagaggaggggaaagctagtgtttatgggcacctacttcgggttaggtggcttgctaggaacttcgcagacttcctttcatttcatcctcgtaaaataaactgcccctcccctaccgtccatcctgttctctccgcacctccgtcccctccagctgggaaggtccttgcgtagcctaggattcttctagttcctgtacacctagatgcatgctctttgccatctagtctcacggtaatactcaccttcatattcaaagccaaatcacaaattcctaggtccagttcaagactaaagatctccaaggaactttctctggagcctaacacctcactgcctcttccctttttctttacctttcttcaatagttatttaaaaagttcatctgtaatgtacttcaatactggcctgacttttgtttaaagtgtttcatatactccttccttagctatcaacattaaatgaaaagtcatgaaattgtagagaccctacttgcttaaccctttcatgacccatgcctcatcaaatacaatgctgagcacctgatcgttttgtaatcaagagttattgattattctagtggataaatgaatgggtcactatttttgtagtttctcatacttttataatttctctgctctcatttacatgttgttcactaaatttcttattgaacatctactttgactaaagtaggcacttagtaaatgcatgtggactacagcacccagtgagtggataaataccttatagttatacttggcttacacaatcacagggcgtagttgagagacataagattaccatggaacaagtattacaaggaagtatctgtaatccccaaactctgggagcccgaaagttaggaaaagagaattattgagtcaggatggatccattagggaacttgaattgaatttaaagaaacgggaggattgatgtttggtcactggaaagaaatgttgtttctaagcaggaaggaatcacagacatgcaagtatgcttggaacagaagagaaatcaggtgggctgatcaaaaagatgtatcaggaaaatggtgggggacaagatgaaaagagttgagaacagaggagattctggccagggatcagggttgactctaggagacacacctagcataaggcctctagactgtgggattcactgaaggtttctgctatggtctgaatgtttgtgttccccaaaattcgtatgttaaaatccttatctccaaaatgatggtgttagaacacggggtctttaggaagtgaatggtgtgagagaagagccctcatgaataaaatgagtgcccttttaaagagaccccggaaagctcccacacacgttccaccatatgaggacacagtgagaagccaccgtctatgaaccaggaagtggggatctcaccagacactggatctgccagtgctttgatctaggacttcccagtctccggaaccgtgagaaataaattcctgttgtttataagccaccagtttatgggattttgttatagcagccagaatgtactaagagagtttttaaacatgggaagggaatgatgttttagtaagtttagctccgacagaagtatggagggaaagctggaagtagtgagaactacttgaggtcattttgataatttagacatgagttactaagaactggactatgatgtgcaaatggctctgggagtggaaatgagaagaagaacgggtgacatttcagagcaggacccgccaggacttatcctctcatgggtcttttgttcctcctgacattcctgtgtgccctttgctctaattatctacatataaatgttaattgatcgatccagagatgatttcaccccaatgggccaggttaaagagcggtaaattaaaggttaagtaaagttctcaattatatataaaaagacttataaatgctttccttgacaatgccaaagagttatttgtaaccaatgatttctctgttttgataaaaagcgaccctttgtttgcagaatatttaagcacaattgaaggagtttgagttacaaataatgtggcaagtcattcacatacattaaaaaagtagaatatggttacacagtgttccaaatatttaaattcttgtaaagttagtattctagcatctacaaaaatagcatgcgagtttttatgtttatctagaaaaatgtgcaatttactctgctgtccaccttgtttgttctctctcatttgccctccttcacacactctctggcaaaatctgtctgtttctctttctctccatttgcctgattctttcccatgtgtacatcttcatttatactcattaagagagaggctgtggatgaaatgtgacatatatcgaaagcaatgtgccagatatttcaagctatgcaaagatgaggaagcaaatctaagctctcaaggacatataaatccagtagagtgggcaggagagggaaacaaatacttactatacaggacagaatattttaagtcatgttagagagataggatatattgccacgctcacgctctggggtaagcagccttcaagatgttctccagtgagctccacctcctctgtagttcctctccacattgaatggattgactcacatgcaataggaaaagtgcagaaacggcaatgtgtgacttccaagagtaggtcagaaaagacaccgcagcctctgtctgtgctcttacagatcacttgctctgaggaaagcgagcagccatgttgggaggacactcaagcagtactatggtgaagtccatgtagcaagaaactggggccttctaacaacagctggcatctacttggcagccagttggcaagccctaggatgactgaagccctggctgatattttgactataactgcatgagataccctgagcaagaactatccagctaacttgctcccaaattcctgacctgctgaaactgtgagaggcaatgtttattattttcttcagccactaagttatgggatactttgttattcagcaatatctaactaattcaggttcagaggaggaggaggtcatatataggttgaagaccagaaaagaattcatgaatgtaggggcatttgaaaaacggtcaggattccagtgcataaagatgcagacaacacctgaggtcaagagaaaagaatggagctgtgaaagcacagagcaggaaaagagaatgctcagttatcaagagtggctggtttcttcattctccccagtggaaagcaaagttattacatatgtatgaagagcagcagcatctgaaatgcaatgaaaagcagcacaagttaaaataaaaatattacgtgcaaaatccttgaggaaataaaaactaaatttcctcacttgagggagagagtcttgcaatttagctaacacttgacccttgaaaattcacacattgtttccactgttcttagtttgtgcaatagtaacacagaagtcatgccccagttagcaatctttcaaagctctctgcaaactccacacatggagaactatgactcctgggcatttaacacagtatttgattagataaaagtaattaaaagaggaaagctacaccattaaaaaacatgaatttatcttcttaacgactgtcactttaagccccttttagttagagatggcttataaacaagaaataaatgactgaaatctcagagaccaaatgcattttaatttgatctatatttggcaaaattacatactaattgccaaagtgcacgactgacaaagaagtaaccggcacagcgcctgcccacaacaatgccagagagagcatttcagcccacgtgggtcgtatgagttcattatttgaattagccaagtgagcaacccccctcactggagaggagcctgctccgagatactaattgatagactcaacttttagaaattaacataagcttcaacagttgaatgatcttcaaaattccttccagcagccaagtctaaaatcctgaaatcagttcagttgtccattggcctgcttagaatcacagtcctattaaggcactggcagatcctgaatcagctcactaactaccccttctggtttttcttgcctcctctgctcatgttctccctgttttatccagtccactctgctgcatggaagagggtttactttggttctgtaagcttatttgcagaagtcccaatatttcagcatatacaacgtagccaaggtaaaattcatttatgtctacatttttgaatcacttttattcacccattctgccaacacagtggaccggccactagatgccaggcagtgtcatgtcacatcctataaaagtgaacaagaatgttccatctcctcaggaggtcacagtctatagagttgaagacaaataattaattattcatagtgtggtaagcactaccataaggatgaatttggagacacctagcctatctctggggttggaggaagggctcccaagatagctcatggctcagtgcatccagtctatatagtgagaagaggctgaacaaactaaatggcttttcctgtttataaaggtttttaacaaattactacataaaataatattgtaaatatgttacaaaggattatgaaaatataaattctctatctcctttcctaagagttcccttctcctcttaaattctcatccagtaagtcaacatcccatctggggtattcaatattgttaaattcaagagactttctaacctcggtgtttgtttccaagtttgactctgctgctatctgccctcggcactctgtggaccctcctgtcaggcacgttccctttcactcctgggcaacgacttgattttatgcatctcgtggcattggcttgtgtctacctggaatttttttatttaaaagttccctatcaaattaattatgttcccattgataggttaactcattttatttactgtcatgaaaggaaatagaaaagtttcaagtaacagccactttttctgttgcagacatactcccttcaatatatacctgctgaggttgagagtctgcaacacaggtgctataaaaataattgagtcaagatttaggagtggccacggtgcagtgtgccccagagcaatggattaggtctcatgagtgttggcggagtctgaattctcacgagcgtctgtctggccaagacctacatcagcaccgaggctgtctccatcccctcttccctccctggaccccctgtctgatcccagcagctcaccccagcaacactgttctaaagaggcttccatcctgacagttcttggccccaaaatatgaactagtttcgcagtgcccatgtattaaggcctcaggtttttcttctatcttttggagcctccataagctggattcaccctatggaatgtctttccctctttcccattcacgaatccctctgtttctctcaagtcagtctctttgctgctttcttccttatgctcccatccctacaggcaagactcctcctcttagtccttattccccccaaaactacaaggttcagctgaggcgcaacctcccccataagctttttcaataaaactccagataacatcgatgtgctattcactgtctaatttcttgtaatgtttacatttagaaagtattgcttttatatttaacttagcattttttttttgaggtggagtctcgttctgtcacccaggctggagtgcagtggcgcgatctcagctcactgcaagctccgcctcccgggttcacgccattctcttgcctcagcctcccgagtagctgggactacaggcacccaccaccacacccagctaattttttgtatttttagtagagacggggtttcaccaagctagccaggatggtctcaatctcctgacctcatgatccacccgcctcggcctcccaaagtgctgggattacaggcatgagtcaccgtgcctggcctaacttagtattattacatgttatttgtattactgttttcttttctttttttttttttttcttttctgagacagggtctcactctctagctcaggctggagtgcagtggcgcaatctcggctcactgtagccttcgtctcccaggttcaaatgattctcatgcctcagcctcccaagtagctgggactacagtcacctgccaccatgcctggctaatctttcctatttttggtagagatggggtctcgccatgttggccaggctggtcttgaactcctgacctcaagtgatccgcccgcctcagcctcccagtgctgggattacaggtgtgagccaccgagtccagcctcctttgtattgttttctacctgctttatgaacctgcaccaggtctctccaactcaaattcaacatatactaattggaaggctactatgcaccggtccctgcactagacctgagagggggatgcagctgttgctctcaggaagtctgtctgatgatgagaaaactcagtcagggacaccttggaagatctaataagaggccactcagtccaatgttggtcaggcacaggatatttcctgaaagaaggaaaatacaaactaaggccgaaaaagcaaaaatgagttagcctgaccaagaaactatagggaagtgggaaaaagatgtgaaaacacttcagatggagtaaaattaggtaagatcagggaaccatgctgtatacggtattttcatactgtcttctcaggctttattaaagtcccaaattcttccagaaattaaaaattatattaaaatataatgataatgcttctataagccacatacataaatctgcgttttaggtttatataatatcccaagtgtggttgaattgggttccattgtttacaacattttgagccattgacaataaactggctacgcaaaatagaaatacaaagccacgattacaagatggaattaatgtattattaattttctccagatgatttcagtcctggaagatacccatttgcctttagtctaatttgtgtattgcatttctaaatataattactgttgacaggttgaacccaaacataacccattaacttctcaaagtgctagattgaaaacattacaatgtaacaagagatattagaaataaaaaaattaacttctgttctttttaaaaagtaagttaaaagcaaagatgtcagtcctgttttgtagtaatttgttagaatgatttggtttaccctagctttcttgccgaggcttttatactagaaaacagacactgacatgtaattgtaaatagtggataaatcataatgaaataattgttgcgtgtaaaaagaaaagaaaagaaactaaaaattccaaagggtatttggcccatgggagaaaaacgcagctcataaaaaattatcacgatactttcctatcccccagttaatggagttatgttttttcaaggatgctcaaaattacgtttataatagtccaagttcttcagactctaatttcaggtcacattctattcagactgtcgatatgtataactaaaaaaagctcaagccagatttaacataaaatagtttctgggtcatatcatttgcacagagctgttatgtggcacaactatttagctgttggagatgccatctgtaatacatactaactcatgcacatatcttgtctttgtttttgcctctgtgcaaaacagctagaagcagataatgcccagatccactgcaaaagcattctgctaaattgagaaagatatgaagacagatcttgtttggataagaaccccactgtgaaataaattgttctgatgtatccccaaacctcatgacaggaagaattaatgtgctaagaatcagtccagtggccataaatgttagaagctatttaacataagaaattatttcagacacagagtggttttaaaaagatacatcttttgctgttgactcaccaaaaccctgcacaaacaattgtgtaccggtttttcattcattcttaaaatgaatgaatgtaatcgtatgctgggtcttttcttttctttttattctttctttctttctgtttttttgagacagagtctcactcggtcacccaggctggagtgcagtggcacgatcttggctctacaacctccggctcactgcaacctctgcctcctgggttcaagtgattcttgtgcctcagccccctacgtagctgggactataggcacacaccaccacatctggctaatttgtgtatttttagtagatggggtttcgccatgttggccaggctggtctcaagctcctgacctcaagtgatccacctgcctcagcctcccaaactgctgggatttaaaggcaagagctactgtgcccagtgggccttttatttcttttattagaggaatatttaaaaatcaggttgtctgaagtagagtggtttgaaatgaggagtctgccgaaaagattgtagacatcttaaaacagttcaacaatgaaaatgtctcaacatgagaaggtactgtgaaatttctaaggtatcattagatgagttcagcattaaaatattgacataagaatttctggcatatagtagataaaattattttcccaacttagttgtttttgcttgttttacgtgtatccagaaaaggattgtataccatcccaaagtattttccaaaatataataaaaatcaatatggcataacaatacaaatcaaaatgaattcagagccaggcgcagtggctcatgcctgtaatcccagcactttgggaggccgaggtgggtggatcaccaggtgaggagatcaagaccattctggctaacatggtgaaaccctgtctctactaaaactacaaaaaattaatcgggcgtggtggcacgcacctgtagtcccagctacttgggaggctaaggcgggagaatggcttgaactcaggaggcggaggttgcagtgagctgagatcgcaccactgcactccagcctgggtgacagagggagactccttctcaaaacaaacaagcaaacaaaccaaaccaaacaaacaaaaaaaatgagttcaggtgcaaacccaagataaaggaattcatgcaaagatgtgactgtccacccagcacatgggatgcagctggtggttgagcgaggtttgtaaagagccctaggagggtggtgtgagccggctgcagcattagctggcctcagaatcccatttctgtgaaacgaggacctgtgacatcagcaggttagatgggaccatctccagagactttctggatatagaggtattgccatcttcaatttatatgatcacaacatttcttttttatcgaaagcttgtaggacttaatcctcacttgaaagcacatacaaagcctattcatattttggatttcacctttcttgaattaatgcatatgctgcaagcaagggtgagaaactggagatttctagagattttactccctgggagacttatgagagggagatcttgatccagagtattccaggaagatcagaaaagatgttttggtgttaaaaacaaaaaaggccacaaaatattacatatagcttttagttttaaggctcctttgttcttttttcaactaagtcagctgatcaccagggccaggcacgcttacatggaagaagagcctgtgcagacaggctccctgggtcagcctgggcctccctgggtcaggcgcccctccactgtgctcggggctcccccacacactgccctcacccttttcatcacaggtccccggggtactcacccactggcttcaatgtctatgttctcgccagactagaggccagaaaactgggatttggccctcagactgcttttgccaataaagttttattggaagccagccattttacatattactcgtggctgcttttgtgccataatagcagcattcactagctgtgacaggtcctagatgggccaccaagcctaagttacttcctatttggcccttatcaggacatgtttgcttattcctgttcgaggctgttgactccacaaacacagggctatctttctgtattcccaatgcctggcctgtggctggtgtttggtcaatgtttatgttctcagtgactgacagtttgactcaaggaatgaatgactatcaaggaacagggacaaaagcgaggcaaacaacaatttttgcagtgtccagaggtctgcagtagatgactggttttgagctaagccattcaactgctgtcaaaagctgaaaacaccatctccccccatctgccagagttaggctcatccgttcagagagctgagtccagtttggagagcacccaatacttgcgacttccacataatggaaaggaaaaggcacaagaactttgaagagggcaaataggacaaagaacatattgattcccttattgaacaaaaatgtactgcatgcctactatgggccaggcacttagcattcaggatgtcattgtctcttcagattggaagggataggtattaagcaaacaagtaaaaactagcaatgaaaagtgacagcaaggaaatgccatgggatcatgtgatagtgctggtgcactgcccatgctgggtggcctgggaaggcctggggatgggacatttgcattgccatctcaatgacaagccatgtgcaggtctggcgtaagagggtttgcagggaaggagcaagtggaaaggcacttaggtaggaatgctgggcatttgtgaagaattaatcagggggttagtgttttggggacacagttaccaaggaggcagtggagcaagatgaggtctgaggagatgaaggaagccacatggggcctttaagacatactcaggaattcagcgcttggacaatggcaagtcaggacaaaattttaagtagggatgcaacataataccatttatgttttaaaaaatcactctaacttgaggtaacgaatggactggagcagggctacaaaggaagggagatgcatggacatggtgaaagccatccaagtaagaaaagagagtgccgtggatcaagcagtggagagggagaggcaacgacaggtagacaatatgtttggggcaatcgagtgcttgatgtctcctacctagctttgctttcctactaccatttgcagatttctcgctttttaggaaatctcagaatcatgccccaacatccatgggttcatggttctaaaagtcacacctttcatattactttaaatggaaatgaaccctttctggttctaagcaaatttaaaatctttgcttagagcccagattaaatgataatgagcctggtaacaaaatactatattaatacagttttaaaactatagctccctttaaaaaacatccactggattgactgatcccctctaccatgcccagtgctgggcacagagcagtgggcatgggatgcatgggctctgctcccactgatgacctgttgtgggcagtgtctggcctatgaagccccgtgaggctgttgggggaccatagctgatatcttcaacaggggagtgacggcactgggggacaaaagtgggaggtgtcagatatttaggaactaaaattgtcaagattcagagactcattaaccagagtcagaaaggggattcaggcacaatgtctggtgactcttctcatcatttagtgaatgcttctaatgtgccatgtttcctgctaagtgctttctcggcatcactattttaatctgcagaatgatctgcagaatgattctggagggcagggcccactcctgtgttttctctgcaatctcactgcctaatgctgggcctgtacctaggaggagctccaaaaatagtggcttaatgcatgaatgcatggctcccccacccctcccatgacaacaacagtgaaatccctaccatagagaaggacacgggaggaaacggaggcctagggcgctatcaaacacccactgtccacagcccaccggtgacggagcaggcaccagagccagcgctgcataagttccacccacattcctcaattccgcatgccagggcccggcctctgcggatgctacggacatttgctgacacagtacagtgactggaggagcagcagggctggaaactgagtcttctggttctaggcttgctgagtttgagatggctttgggatgtcccagcgaagatgtgcagaagtcagtttagttcacggttctttcgggagaaagatggggctataaagggcctggggacccatccatggagagatggcaatcacagccatgggagcgggtggggccaccccaaggaaatgctgagattaccgtgtgactgatttgattacggggctttaacttattgagctataaacatcgaacagtgtcacggtttctaagacctgcctctgtgcatctgtcaaacacagtgggcaacaacctagagtccacgactttcagccacttttacctgtggctgcttttcagttatgaaaataatcgaacgggccttagatcagccggttttaaccttccatctcacacctcactggaagctctttcttccccacagtcaagaccaggaccggctccagctgcttcagatgtgaggcgcagggaaggcctgtgcaactgcgtgtgtccaggactgggcaccccaggtttcgggtgaacaatgggatgtaatgaagggacccctctttttcttgtctcccactggaatctgcttgcatacaagcaggtatttctggttttcattccttcattcaactaatggttgtgctgagggttaaacaacaggcaaggcagagaaagtttctcctcaaattgaacttgcagattcacaaggaaggtgacatacacaaacaaggaattcgtgctaaatgaagtgttaccgagagttgcaagaatggagaggagtagagaagactaaggaacaggctgacctaagctagtgtcaatctcagcaaaggctcattggaggaagagtcattattctccaaacagcaaccagaagatgctttcaaaatcaaagttatagcctctcactcctctgctcagtctctgcaatggctccccctggtcattcagaaaaaggtccaagtcctaatggtgactttaatccatcctctaagcctgccacactgccccttctctgtcccttagctccttctcttctcccactcgctgtgatccaggctcagtgaactctgtgaccctccccacacaggccccacatatgacacacacacaccccacacaagccccacatgacccacacacgccccacacacacaccccacatatgacccacacacgccccccacacaccccacatatgacccacacatgccccacacacacctggctcccagcctttctccggctcctcctgtgcgagcgtgcttccccaatggtcacgtggctcacaccctgccctcctgcagctcttccaatgtctcctttgcaacgagcccctctaaccaccacctgctcatgtaaaacggtggtgaccccaccctacattcccacattcccaattcccatggcctgttttagtctttgtctccataacatcaatcacttcctatagtagatttgccttcttactcgcaatgcctcaaccctccctgttccccagccattgacctgactttgtctttcctcagttagaagctgcatatatttccccatccagttgatggtgagctgagccacgtggctttgtagggtggctgaatatgtcaccccaaaatatgccattttggccatataattacttaaagctaaaggcccttgaaaaaaacaggtgatgtgagaagggtgttctgatctccccttttatacctggaaacaggagatgaaaactcccatgtgaaagacaccctccttgcatgaggagaaaaaccactcttcaattgggacttatagcagagtgaattctgcacaaacagccctcattagggtatgtatgccttatcttcccttagcctccaaacacttgagttacttttccacaattgcctctgctggttcaacccaacacaaaagaatgctggttttgccacttctttgggtcttcatttcctaatgagggctcctgtgtcacataacgcttttattaaacttgcatgctttcctcctgttcatctgtttcctgtctatttcattctcaggcccagttgggactctgggtagaagaaaagctttgcctcccctgcagcttcctttgccaataggatagtagtgtatgtgacataatccagtacgtggcatgtgcttgtttggtgaggcctgcccttctgaattcctgcctttcaccacgagaagaactgtccttgggtagccactggcttaaggatgatggactcattgagcagactggaaacatccacattcactgcccgaagcagggccaagctcagcccagccccagctcaactcgggtggagccgagaggtgtgagaaggctggacgtagtgtcaggggccagtgagctgcccggtttcttagtactcagccatagctgaccagtgaccttctgtacagttaccgatttattagatgtgtgacctattgtctgtctcttatcacaagaagggaagctgcattagggccgagagcttttccgcactgctgcctcctaagttcctggcatgtggcgggtctgcgacacagatgcatttcataaaggaagcaaagacctcaagtccgaacccccaccaaagtgagaagcaggagtttgtcaggtactatttcgctaaaaggaatgaaagaagatggaaccaaagaaggaggcggtgttgccgatgtgtagaggtcagaagtgggcctgctgccatcagacacatggggggtggcacagcctccaggtgacctgcagctgccacagcaggagaacactgacggtaacacatagcaagtgcacggacgcctcagggacaggtttcaatgtcaatgaaggtcattattggctgagcagcacaagggttccctaacaatcacgaataatgaagagcgcagagtatccacccatctcccaggacactgagccacctgaatgcaggctcgacacccaagaggagagaggacaatggggcctgaatgaacttggggtgatgcagcagcagaacttgatctatgaggctctggtgatgagcagtgtggacactgataggcaggtgctcagatgctgccagctgtttttaggtttcagaacagaatctttggggcagctccaccaacgtgcctcgatgtaggaggaaggcaaggctggtggccttcagctctggatcctgcaaggacatctgaaatctgcctctgccatctgcctctgaactccctctccatccccttccctcccctccactggtgaggttggacccataaggagaaggagaaggtaacttggaaggattgaagtaaactctggtgtattgaagagatttggagacaaggttgacaattcatagaaaataaatcatatatctattttaataacacttagctatatattaattggcaaactctgttgcatctacacattgtcccaacaatgcgttttagagttctgcaacaataataaccacaaaacactgaaaaagtttcaaacatcttccagcacttggaaacaaattctagattctattttcccaatctattgctgtctatgagcagtgctatggcagaagggcctaatccagtactcaactttctaagcctgacattttccacatatgtaaataggtcttcttgaatttctattaatacttttatagataagaaagttggactattaactgagactaaataacttgccaaaggtgacagagtggtttggcatcattcagactatgagtttcaacatacaagtcatgagaatctaggttatcgtatggccactaaaccacatttccactttgcctcccactacaaaagaatgcaaattgaagaaatttaacagtgggaggcttctgaatacagtcatgaattttctgcctgggctactgtagaaacaatgtgtctcaattcacagctggtatgttaaaaatcatcttccccaagtcaataaatcccctctgtcgcctcaacttgaaactgcctgttcttcgttcttcatgtttactcgatgcttatttccatatcgtgtcacagaagcagtgccttttccaatatccatcctcacagaccttataccctcatcacatctggaagcgttcttctggataagcatctgaggatgccatcgaggtcccgctagggagccctccttctgtggccttcctgagtacacacatgcacacacacacacacacacacacacacatgcatgtacacacacatgtacacatagagctccctgtttgtgctttcatcttctgatgaccagatcctgtctttactatttcctgttgctctagtgagtctcttccagggctccagcgcaggccctccgatggccatcactacccccggctcctctgtgtgcattggtttgcacactcttctgacttcatttgctttacaatgaggcaaggattctgttttctagaacacaggagaattatcatttgatgtgtctgaaggatctttattgcaggagaaacagctgttgatggagagccggggtggttgggggtggaggggagtggtgatggtatccatctcagctccaccttgaatagatgctgtccctcctatttgccccatgggtccacctggcctggaacactctaaatgcagcaagtccacgtacacctgtgctgcttctgcctgtcagcagctctgcttagcaagcttagccaagagaaagtcctgctcctcattagggtcgacgagttcttccccacagagcagcctactccctggcataggccttctgggatgaactggtgcccagaagcaaaatcaaaaaagaaattccatcgtaaatattggagattcattttctgtccacttcaaaatcaaggcctctgatgatcaacgtgattggtcgtccaagcagccatgtcattaccaacctgccccacaacacagttgctcacacatgaccagcgacagctagacaccaaagtagtgaagcagcctgcccatctgcagcagagggtcccacagaggccaccgctcctggaactgacgggccctgatatcgcacacaggaacagcactcacggttgtggcttcccgaacacaggacagaggcagcgcatgatgtttggactcgaaagcacccgcatcatttctcctttcccaactcatactgaactctgcatggacaggttccctccttagcagcaaaacttccccagtcagacttacaagccagacttgcccagtctctcttgtttcttcaacaagagagagttcagaccctatgtggctatgaagcacctcaccaggtcatccctcgaggaggctggagaaggaggcagctctccaccgagctctgattctggaggagcgagcaggctctccacctccacccagctcttattctgtaggacggaacactccaatgcaggatgcaagacaagattcatcactaagctgttgcctaaatgtcaatttagcctttattgaacatccatctggtatttgaatgtgcattggggatctgggggaattttgtttagaaatagaaaacacagacccttcttcaagaggccataatcgagttggagaaatgtttgatattaagctgtaaagagagtcacgcaggatcaattgagaacatgtgaaatttttcgcaaatagtgagaaatcatccgaacaccacctgcataaaaacccacctaactcccactgtaagctccatctgaacctaatgaggatggtagttaccgatttccaaaaaggttgtcttcattcctttgatttgcgctgtaagtgttaaactttaaaaatagtctaaaggtactaaaaatgatttcatgtttttctcagtacaattttgttaggtttatgtttaattagccaagtgttacattgaggatatgagaacgagcaatattctgttgctataaatccttcagttactaaaccatacggagatttcagtaaagagaggtggaggcaacagtcacacgtgtgcacacacacacgaatacacacacatacacacataaacatgcttatacacagatacacgcatgcaaacatatatatacacaaagatacacgcacacatacacatgcatatacacaaacacatgcatacacgcacagagctacatggacacacacaggtgcatacacacataaacagacacatatacacatacatatacacatagattgctagggctgccatgacaaagtaccacaaaccaggcaactaaaaaaacacaaattgattctctcacagctctggaggtagaaagtcaaaaaccaaaggccacgcttcgtctgaaacctgggagaggagcctttcttgcctcttcctggcttctggtgttgccagcaatctttcacattccttgtcttggagatgcctccctccagtctctgcctctgtcccccaggggcagttcccctgtgtctcctcacatcacactgcctctgtacgtcttccctctcctccccttgtctctcgtcctataaggacaccagttagatttgattaaggccctaccctactccagtaaaacctcatcttaacttagatcttcataacatctgcaaggactccatttccaaataaactgccactcacaggtaccagagattagggcccaacatctttttctgggaacacaattcaacccacaggtacacacaccctccacaaacaaataatgttggcttagtttttaattaattgtgctgaagtgatatgtcatttacattttctgtctgagttcctgtattgtgcgatcttgaattttccagagtaattgacttaatctattcatttctaagatacagaataaggtacccctaacttttaccattgcatagctcaggcaggactagtataaatgatgaagacaggaagattattaatattttcatcacagacccctcatattttcattatttaacacataataatcttctaagactactcaatcttctaataatatttaaattttcaatttaaaatattatttttattctgcaaaggacatcattgggtcagctgacaaaattggaaaacagctggtaacttagataaaagcactgtatcaatgttaaattgacttgaataactgtactgtcttaatgtaagagaatataagttgcttaactgaacactaaagtatttattagtaaaagaccatcatatctgcaaatttctcttaaatagtacagaaaattgtaatgaataacgtgtgtgtgttgaaagacacagaaaaggagatatagcaaatagggtgaaatatgaacaatagctcaactgtgacagatgttataaagggtgttcttaatattatttttgtattatctataaatttgaaattttcaaatgaaaacttaaaaagagattaaactgcatttttaattgtattgagagatgagtctaagaaacaacaaaatacactctccaattttcaaaccatgctccttatcttggtgggaggacttcaaaaaggtgccatagtcatatgacaaatgaaaagtaattaaacttagtttactccattatcaagactgcgataaaagtcatattctggtattttgttctgttttgttttgttttgtttttcagacagggtctcactctgttgctgaggctggagcgcggtggtgcgatcacagttcgctgtagcctcaaactcctgagctcaatcgatcctcccacttcagcctcctgagtagttgggaccacaggcatgcaccacaatgcctgggtaatttttgtatattttgtagagatggggtttctacttgttgccaaggctgatctcaaactcctgggctcaggcagtccgcccacctcagcctcccaaagtactgggattataggcataagccacagagcccggtcagatcatattcatttaactttaaagttgaaaggatgacacagatagaaaatattttttagttataaataccatattgggtgtaccccttacccacacatcaacagtcctcaaaggcagggggggaagggggatgactcagaaatcccgagtcctgaggaattaccacttggggctgggtacttgatcatacgagaaggtgaggaggtggattctggacttgcatttatggtgacaatgaatctgaagtacaatgtcaagggtttagataacaatgttaagaaaaaaatgttagggagaaactgggtcaaggtatatgcattttggaattattggttctgtgtgggctctagaaataaagcgacaaaaaaaatagcaaatatcccagttgcttaatagcttattgtcctgcgtagcgaacttttttcttaagggaaatatctattttttggatttaacattatttaacatgtaagtcaccttattcactcatcaatttttgaaaactaaaaatataaatcattccattttggtgataaaattttaatttcctatactgataataaatttttccttgacaaatgcacttagggcacccttcacactgaaaaactacaagagacaagtcccacatcatcaacagaatgtaagaatgtaggtggatgaaggataccacctgagactctacatttctgttaaactggcttcaaattattaagtagctaatctaaacaagtgtgcctgtttctgctctaaagcaatgtggaattctttcaatcccttaggacgtgtttttaataataaacttttaaaaatgtgtttaataaaatataacaaactttataatgagtattcatactcatacatacatagtattacaggttgagctgtgcccccttaaaattcgtgcattgaagtcctaacccctagtgcctcagaatgtgattatagttggagatggggccttcaaagagttaattaaggttaaatgaggtcagatatgtggaacttaattcaacatgactggagtccttacaagaagcagagactatgacacagatatgtacagagggaagcccatctggagatacagggagaagacagccatctgcaagcgaggaagagaggcctcagaagaaaccaaccttttcaacaccttgatcttgggcttctggtctgtgaggaaatacatttctgttatttaagccacctggtctgtagtaggcagcctgagcaaactaatatacatgtatattttagttttgtctaagaaaactcttgaatggattatgacagactggaattctagactgataataaattactgtgtgacctccttaaaatttagagataagaggaggtcctagacaacgtctaacgtttcatcattttatacccatatacaaaagctttttttctgaaacagaaagcatcataccttggttgggaagctgacattcccttggatcaagacatggctgctaactgtaggagtgactacttatgtaacagtcattcaaatgaaaatacctatgctaaaaatgattatttgcaacattcatgtatttacttcttattagacaagtaattattaagcatatggcatataccttatactaggcattggaaaaatcaaaaaataaaatacagtcattatccttaggattctaattcaaattcaacacgatgtatgctatagcagagacataaatacagccaaggtggtgtctagctttacctggggaacttgaggaaggcttcccagaggaggaaagtcttttgagctatatctttaaggatgggcaggggttcgtctgatggggaagaggaagaaagggtactccaagcagagggaagactatctggtaaaatagtaattctcaaaatgatctgtagattcgaaataatcccttttgaaatatcatcaaagtttttaaagaactagacaaactaactctaaaatttatatggaaatataatgatctgtattagccaaagcaattctgaaaaatgaaacaaaatctcaggccttaaacttcctgatttcaggacttgctataatgcagcacacaagccaataaactaggccaatcaattgtcagaaagaaagttttctgggttttactaatgattccaagcagtaattgtcctttagtttctcaaaaaaaaaattgtttaattttctagttcacctggcaaaatgaaagacagttttagacatcatcatatacagttacagaaatcaagccagtgtggtactggcatcaggatggataaatagatcaacagaacagaagagtgagtctaacagaggagccaaggtagctcaacgggagagggctggtcatttcaatatacggggcttggacaagaggagaaacatatgcacgatagcaacagtaacataaccattgtcccttacatcacaccaaacacaaagattaacaagaaattgaccaaggatctaaatgaaagagctattactttaaatcttctagaaggggccgggcacggtggctcacacctgtaatcccagcactttgggaggccgaggcgggtggatcacctgaggtcaggagttcaagaccagcctggccaacatagtgaaactccatctctactaaaaatacaaaaattagccgggtgtggtggcatgcacctgtagtcccgctactcaggaggctgaggcaggggtatcgcttgaacctgggaggtggaggttgcagtgagttgagatcgtgtctttgcactccagcctgggtgacagagcaagactctgtctcaaaaataaataaataaataaataaaaattaaaaaaaaatctagaaggaaaaatataacagacattttctttgtaaccttgagcaagacaacaatttctagataagataaaccaaaaaatgaacagtaaaagcaaaaaatcaatatattggacttcatcaaaattaaaattaaaatgttgttgaagccaggcatggtagttcacacctacaatcccagtgctttgggaagctgagacgggaggactgcttgatcccaggagattgaggccagcctgggcaacacagggagaccctgtctctaaaagaataaaaataaaaataattactcaggtgtggtggtgtttgcctgtagtcccagatactcaggaggctaaggcagggggtgggagtccctttaggccagaagtttgaggctgcagattacggcactgtactccagcttgggcaacagagcaaaagcctgtgtccaaaagggggaaaaaaaactttgaaagtcaccataaagatgaaaaggcaaccttcagactggcagaaaatacatacaaatcatctgtctgagaaaggacctatgttgagagtatacataaaaaaacttacagtttagtattaagaaaacaaccaagcaaccaacaacccaattaaaaatggagaaaaatttgaatagatgccacagtaaagaagatagcagaatgtcaaatgtgcacatgaaaagatggtgcagatcattacacaacagggaaatgcaaattaaaacaatgtaagatattatcatgcacctactaaaatatccaaaattaaaaagactgacaataccaagtgttggcaaggatatagagaaactaaagcccttaaatattattgtggagatactttaaaatgttttaaaaatagtttggcagtttctttaaaactgtaaagtttctttaaaaattgaatatatgctaccacagagtttggcaattccacaaagtctgctcccaagaggagtgaaaacatgtatacacaaaggcgtttacacaaatggtcacagcagcattatttatgatagtcaaaagtgatgaaagaattagaataaaacctgaataggacatggaaccagaagttttcaggcaggaagtaacaaagtgaggcttgtttattcaaaagataaatcagacatggaagttggactgaagcaggtgagagactcgtagcaggaagaccagatgcttaacctccttggatggattctgttttaactgacaggaagacagttggatttcctaaaggagaggcttagcttgtgggaggaagtgcagtggaaaggatatgaacttctcatcatcctggttcagcatcccaggtgcgcacctgagcatgtgagtccccctttgcccaacctccagtctcaggcgcctcacccaccacaggaggggatgtccccagcctcaccgggctgcggcgaggcggtgcagtatctgtggacagcttctggctgatgcctgccacatgggtgggactcggggtagctgagtttccttctccttctcttctaacttcttatccaaggaaaaggaaaagacctgtctggccttccataatcagtaaggtaaattcatccatccacagagaaaataaccgggaagcctacagtgcacattttctctctgcccccaccccctatgcccatgccgcatcaccatgacgactctctgccctgccaggcttgctctgcatcccagaaagttgggcccttggggctgtacccacaaggctcccctgatctctggctgccagctgccacccagctctgggtcacattttctgacagtggcttcatccttccctgctacagatcctcttggccatcctcttcctctcctccatgcctcctggagctgcggcagcactaagcaggccacttacttctgaaagactggggtgctgatggagctggcagtttctgggttcctcactaccactgcccacatctctgcaaattcatctttgtcattaaagcatctagaattatttggattgattctgtttcatactcagaccccaattcaaagggtctaaaacaggtaaaatggacagaggtggggcaaatatatccaaataaaagaggatccttttatcttatgctcagggccttgctgacagaaggtagcatctttggtgatgcgacgttttttcctctccaggagcaaacatccaaggagcacaaactgccagtctctagttgtagtgagcaacactggctacactgctttctactcttattcaagcattgtgctgtgagtgaattaatattgtgctgtttccattcctgttaaaatattcttcatagtgacaaagaatacacaaaaatgtccagactgacataacggtgccacctgaagcataactcttggaagtcaaatgtgctgtgaccaaagaggtttctaaagagacacagtgtattcgtccattctcatgttgctaataaagactcacagtttcacatggctaaggaggcctcacaattatagcagaaggcgaaagaggagcaaaagcatgtcttacatggtggcaggtaagagagtgtgtgcaggggaactgcctttttttcttttttttgagatggagtttcactcttgttgcccaggctggagtgcaatggcccaatcttggctcaccgcaacctccgcctcccgggttcaagcaattctcctgcctcagcctcccaagtagctgagattacaggcatgtgccaccacgcccagctaattttgtatttttagtagagacagggtttctccatgttggtcaggctggtctcgaactcccgacctcaggtgatctgcccacctcagcctcccaaagtgctaggattacaggcatgagtaaccgcgcccagccgggaactgcctttcatagaactatcaggtctcatgaaacttattcattatcaggagagcagcatgggaaagacccgcccccatgattcaattacctcccacagggtccctcccatgacacatgggaattatgggagctcaagatgagattgggtggagacacaaccaaatcatatcacacagtttcttctctgaatttatgggtctttgaggtacttttatgacaatgagaaaaactctctctaggtgtgtgcaaccacataccagggaactaagtctagggaacagaccataagccgcatttcatccccaattcattgctgcagccaggtatgcctgtgcagtatacaacctacacaactgcaagtggcagccgttacttcatatgattctaggacactcgcacttacttcttggactcaattttcatatgtataaaatgaataatgctatacacttttcacctagctttatacaactagaggtattgtactttgaattcaaagaactataacttatctaaaaacattcaggtatacaaagttcaaccatccaaagtgttcacctatacaaagaaaagttaccattcttttgtgggctgattataggttacttagcaggggactttttgttcctggtggttaacgcagatcctaatatccaacttggtcaactttcaaaagtgccttatcagactttcacttctggctacaatggaataacaagcactgaatttatctccctccctgaagcaacctaataattccacaaaatatatgaaacaatggttttcaagacagtgacatgagacaatgtgggacaaaggtccgtgagagacaggaagcaagcgtgctgagtcctgcaatcactccagcctcctgccttcagagagtggccaggccctggttcagggagggagaccccagcgggagctcagcagacttgcggaattgaacccacaggtctgtgtgtagggggaagacggggcagctggagttaacagaactgagcagagagagctgcacagagaagactagaaaactgtacgacgggttcacctgaagcgtctggctgctggtgtaaacctgcgctttggaaaatggtatgcacacgtacactcactatggaaaaatagtttggcaatttcttaaaaaggtgaacatgtatctaacaggagatccagccattcttctccagaatttctaaccaatgcagagaaaacccgtgtgcatgcaaaaacttgtacacaaatgctcctggcagctctgtttgaaatagccccaaacaggaagccacccaaatgttcctcaactgatgagtgaataaactggtggatccctgcagtccatgtggcggcaggctgctcagtaccaacgaggagggagctgggacatatgcagcagcatgcgtgagtcttaaaataatgatgctgtgtgaaagaagacaagcagaaagaaacacacactgggtaactccacttccaaaacctctaaaaaatggtaactaatctatggggacagagaacagatcagtggtctccaggagatgagaaggggaggcagagtggggtgggagggagagaatccaaagaaacctgaggcaattgtgggggtgatgggttcactgactgtgatagtggtcttaccggtgtatacatgtatcatgactaattgaattgcacactttcaatatgtgtgttttatcacacaccacttatacctcagtgaaaaatttcatgcacagaaaaaaggtttaagaatacagtggcttgtttaaccaaagattttcatatgtggctgtcttctcacaatgcagctggagggaggccacaagaagaatgtgttcacaccccaggagttggaggttgcagtgagccgagatcacgccactgcactccagcttgggtgacagagtgagactccatctcaaaaaaaaaaaaaaattgttcatgcgcagtcactttcttaaccccaattttgctattgagcaacgtgtaaaaggattgtcactatgctgcatttgaaagcatgccctgtttcagatgtcccaaatggcaacagggtcactcacaaagagaacagggttcagtatatgccttgattcctgtcctccaaaacggtacccataggtaagttctccctgcaaaagggaactgaaaaaatgaggtcctggctttgggctttcattactttcatacacacacacgcacatgcacacgtactcacacacacataaagtttttgttttgttattctaatttgtgcttcgatttgcccaggagactgggtcctagaatttgatcaattctaccttcccggtccactgctagagaattaatctggaatcacattaaaaactcctggagcccccatcactatagcttctgaaggaaaagaataggaagaaaaatcaatgtgctttgtgtattcacagacttctgataaactctgggcatgaatcctgtctcgattttaagaggctctaaatggtagtgaattgtgagcctcactgcagagctaagaagtagccccctcagaactggagagtaaacagggccacgtgggtttcccatgcccagtccccagggatttagacctagtgtatgtttgtcaccaccaactagtgacaaggacaaattttccaattagaagaaagtcctttatttgaaactatatatttcccagatttcctgttaaaatgattcccttttattaagtgatgttgagactagatacttttgttactgtgtttttaaacatccttacatggtaaaatgaaatattgtaaacctatattgctcagtcctccactttatttttaagaaaagttaacttgttaataaaactgaaaagtcttaaatgtatcaatacttgtcattgcatgtggaaaattttatcgacattttggttttggtttatatagactaagttacaataaaaacaaagaactgtgaacacaatcacacatgatcacgaatgacaacgctactcctacagcgtaagaaatctcatcttaaatttcctcaacccaatattttcaaaaagaacttgacctgccaagcttccagaaaacacaaataaggaggcagaataatcacttcccaccgttgctccaaggagacccccgaagagcctgaagatgtgaagctctgataaggtaactaataattccttggatagtctactggcgtaggagccatggaaacagagaaacagcattggcaccaatgaaggttaatcaaatcataacacagacatgcattttattactctgacggcacacagcaacacagagttatcaggtgcagatgaacctaattagattgggtagggggaaatggacagctgtgaggtgactgctttgagctctcctgaaagataaggtcagatttaccaaagacacataggtggaaactcaaagaccagtttttggtagaggggcaggtccttgtgagactcagtcctactatcctgaggtcaagaagttcaaaacaaagtggaaagactggacatctgattcacttgttttaattttttttttttttaatttttagagatggggtctcactctgtcacccaggctggagtgcagtggtgcgatcacagctcactgctgcctcaacctcccatgcccaagtatctcctgcctcagcctcctaattagctgggactacaggcctatgccaccatgcctggctaagttttgaatttttctgcagagataggatcttgctatgttgcccaggctgatcaccaacacctggactaaagcgatcctcctgcgttggactccctagtgctgggattctgggtgtgagccaccgtgcccagcccctagtcactttcaaacagaatttagcaagtttggaaaggttactagatagcaaggaaaaccattttcacagaaggcagtaagacagtagcaatgatgtaatttttccctcaaaaaaactagaaggcaagagatctccaacaacaagggcctgggaatttgacacacttgtttccacacacttcatagagctacgaactggagaagtctttgaatgtggggtaagatagggaaggtcaagccctgtaggtatacaggtgggcatgggagccagacggagtcagtggacaggtgaagagggccttatccatctaacatgtactgtggttaggcctggagacattcaataagtggcatctgagtgcatgaatgtttcaataccctcaacgcactgcggttatgttcttgaaaatgtacattgcattcaaacattatactccgaacttaggtgcccaaatgaacagtattgataaatggaaatttcatttctcatagagtccttgactgtcctctcatatcataaaaaataaaggggatacataggtagatgaatacagatgtgataccctttaaaaataatagcaggccaggcatgtgggctcatgcctgtaatactttgggaggctaaggtgggcagatcgctagaagtcaggagttcaagccagcctggacaacatggtgaaaccctatctctactaaaaatacaaacattagccaagcatggtggcatgtgcctgtaatcccagctactagggaggctaaggcaggagaatcgcttgaacctgggaggcggaggttgcagtgagctgaggtcacgcactgcactccagcctgggtgacaagagtgagactctgtctcaaaaaaataaaaataaaaataatagcaaataatgagcataaaagtaacaaagatttatgttaaactcctaaatgtttcttgtatctctataggtattacccccaatcaaattcccaaattaaataaattttataaaaatacatgcagagcttctaataacagaaattccactctactctaaggatgtcagtacaatagtgctattaaaaacacatttggtttacattcaaaggctacctttcagagattaaggcacatcacattttaaagcgaatctcaaagaaaaagtagataaatttattttatccaccactgaagtccaatcactaagcatagcagcagatatttaacatgtgcttagaaaatatttttcaaataaaaaatgatttatcaaaactcgtaagagatacttcaaagcataatatccaaaacagcataaaattaactggccaaattaagcctaaaaatattagtaataagtaacactgaaaaaattattatcctcagtatataaagagctcttacaatttagtaaaaacatgctattatcaagccacagaaaataggccagtgacataaacgtacctatcccagtaaatgcttgaaactgtttaacctcattattaatagtaatttaaacttttttaccagaaagagagcattttgctcatcaaatttacaatctttctaaaaattcaataaccaccattgaataaaaattcaatggtagttagctctggcaaaatgggttcactcatacattgctagtgggaatataaattagcaaaacctctctgaaaaacaaactggtaatataattcatatcaagagttttaaaaagtttataactttcaacacagcaactcctagtaataatctctcctgtgacaataaaatatatgggcaaagatggtgtatgaagatgtttattacaaataattttttaaatatttatattttcatttataatgttaaagtttatatgtttataaatatttatataatatatactatgtaatttttcataatttaaaaaataaaaattttattcatttactttataaaaaattacaaataaatataaaatatataaacaaatattacaaatataattacataatatacagtatacaatatgcaaatatttataaaaatatatgaataaaatttttattttataaatggcaatttttataagtataaaattttatgcataaataaaattatataattatatattcatttataggtgtatatatttataagcataaatatataaacaattgtttataaatatatttttaaattgcaaacaacttaaattttcaagaattggaagtggttatgtgtaacatagtatgcgtatgaagaaaatcattaaaataaacctttgaagtataaacgcctttggaaaatacccccaatatgacactatgtaataaaatcaatacaaaaactctctgtacagcgtgattctatctatactatcttatgaatataataattcacagacacagatatacatacacatttatgcatctaaaaaatggacaaaaagcccaccatatggttcatagcagtgaatgactatgtgtattatatgttttcattaaaaatattttcagagaaaataatttttgtaaaaatactaattatataaagcaaaaagtaaaatcccccaattaccaaaaacccccaaacatactcactctttgtcctccaccaacatacccactgatatcagtctgaagcataggatgtatttaaacataaatcttttaaaaatataggcagaattaaatctttttaaaatataggcagaattatcctgtgcatatcgatccatcttggagatctttcctagcccgtacataatcatcattcttattaatgtctggttataattctatggctatataaaaatgtgtttaacccatcccaataaaagggattttttttttaatccagactttcactattacaaataatgttgtatgaaacagcttagtacacttctttctatcctctttaagaaacatatccagaagtgttaactttcaggaaaaagtgatcacacattcattttcacagacaatggcaaattttcctcctaattatccctaccactttatatccccaaaatagtacaggagagaacttacatccctacagccttgactgagtattttctttctgcttcacttttggaaaatatttccactggtgttctttttttttttttttttttttttttttttttttttttttttttttttgagatgcagtctcattctgtcacccaggctggagtgcagtggtgcaatctcggctcactgcaacttctgcgccctgggttgaagtgattctcctgcctcagcctccccagtagctgggactacagatgtgcatcaccatgctcagctgatttttgtatttttagtagagacggggtttcaccatgtggaccaggctggtcttgaactcctgacctcagatgatccacctgcctggcccctggcatctttaaaattactagtgagttcactttttaagttgcttggctattgacatttctattgataatggtttatttatatctggagctcagaccatttgctgttctctaatattcactcactcagtctttcttagcaataacaccccaatatttaatgggacatgcggtcatacaggatgaagactacattgccaagtctcttttaaagttagggatactcatgtgactaaacactgggcaaggggacatgaagaaaagggtttgttataagacttccagaaagtgattttaaaggaaaagtgcacatctttcctagttgttggaatgtagacgcaacagcagaagctgaggcatgcatcttggacgatgaataaaagacacatatggctgggcacggtggctcacgcctgtaatcccagcactttaggaagccaaggcaggcggatcacctgatgttaggagttcaacaccagcctggccaacatggcgaaaccccgtctcaactaaaaatacaaaaatcagccaggcatggtggtgtgtgcctgaaatcccagctacgcgggaggctgaggcaggagaattgcttgaaccttggaggcagaggttgcagtgagccgaggttgcaccactacattctagtctgggcaacagagtgaaacgctgtcaaaaaaaaaagacaaatgttttggatgttacagtaacaaaccagaggggtctcagatcatgataatgtttgagaagccaccttaccagtcattgaccatttacctctggacattgtttatgtgagaattaaatgtttgtcttgttaaaaacccttttatcataaattttctatcatcttcaatttgacctaattgtatcctttgccaattttttaattggcttgtttacttatatccttgccaatttttttaactggtttacttattaattatttattttttgagatagggttttctctgtcactcaggctggagtccagtgacatgaatgtggctctgcagccttgaccgcttgggctcaagtgatgctcccacctcagcttcccaagtagctgggacgagaagcacatgctactatgccaggctaattttttttttttttttttagagatggggtctttctatgttgcccaggctaatctcaaacccctgggctcaagtgatccctctgccttgttcccccaaagtattgggattgcaggtgtgagccactgtgcccatcctggtttttctttttttcctgttggcatgtacttctttatgaaataaatagaatttcttctgtcggcagcaaatcatgaaataaattccattcattcatctattcataaattagcttaataattcattatcatatgcaactttcacccaaaggcaatgcgtgggtgtggctatgggtgtgatgggctgggtacactgcagacactaggaggaatccaaacaaacgaatctttaaaatcctgtccataagtgtatgaaatatttggcattcaagttaccctaggagaagaagatatttttctcattttcagtaaagaaaaacagaaacctaacttcttgcttctttcattggccgaaaggatggtattacagatttgctttaagagaaaataatctcaaaatctcatcttttaaaatgttagggtaacccattaaagccacatttggcaagtcaggtttcatgactgcagatgcaaatatttaggtgcacactcccttggtgtgcaaaccccgtgcactgaggaaggtttttctgcgaactgctgaagctgaagcttcagggctgttcacttgcttgggcctgtcaggaggtctagtgaggactgagcaaggtgatcacatggctatgtattccccaaaatttaagaagatattttcacagctgttgcttaggacaggtgcccctttccactccagcactgcctctggtagaaatccccctgtgtcaggcggccttggagtggtaatgggtatttgggaagctgagctatatatgtgcagtttgtctgccatttagtgagatgtggtatggagtttacagttattccttcactgaagtaacatactcccaggtgtttcagtgtaagcatggcttccaaggatcctcctcgcacagactgtgtccacacacccacccaacgccacgaagtagggaagatcagagttctgatatggcacccagcacctgaaacgtgtggatggagaaaaaggaagcaggtttgaagtttagggagccagaagcctgtctgtggataattctttcaatcattagatgtgccaagtcataagtgcaaggtgcgattctcatcaacaccttgtcaaacagaagttcattttggccaagaatatacttgataaggccttgtgcataaacacaaatgaatcatgtacgctttttgtttattttaatggaaaccacttgagagagaatttaccggtatttccacacttgaagtgcagaaacctgtagaaataaatactacagtgaatatggcagttatgaagttgcgtgatttatacaccctaatgtactagatcatgtcttactgtatcggaaacatctcaaaccaaagaaatctgggctccagatgaaaatagtacacaaattgccacatcctaacaaaatgcctgcagaagcaagtgctatattccagtgactaaattgctacatttatctactaataatgaactgcgtgtagcaatgaacaggccattcaagtatttgctaattaactaagagaaataatcatagggccacattgaaaaaaagatttaaatgttttcctgatttgacatgatatactaacattgactaagataacattcatttcataatatgccaacacaaaaggacatattgaagacatattcattgatgagttttgtcaattgatcaaatatgtaagcagtcactatgcaataagacttgaaatgctctgcaatcttacacaccagaaataatggaaaattattagaagttacctcaaatttgaaaacaagcctcaaagttgtcatatttccaataatttgtaaaactaaaaggtacttttcaaaaccatcaataataaaaataaattgtaatcgactatgcttggaagactaaattattttctattctttttatacaaagcaatacaataaaagtcatatgccaagaggcatatgaccaaaaatcataggaaaaagagtattaaagggaatatcacacagcaagaaaattgaaatatgttatttttctaaaagtatgattttcctggtatctactgaatttttaaaatttataatctgttgtaattttcttattatcaattatagtaatacttttgcattctgtttcttaaagaaggtctcccaaatggtgtaatttaagatccccacaaaatctgaacttgtctctgcttagttaagcacctcctcaggaccccttggcctcgtcaatatttccaaaatccttctggtctgggctgctcatggccatgtccctttccaggaagtgtccttgtcaaactctcaagagatttaactttaaccaagttagtcctgggtttacccggccctcatccccactcaagggacttttcagcatggagcttccgctctactcccaagcttgaatgaaatctcttgatcttctgggcatggggttttgcttcctgggcaagtgcaaggaaatgtgatgtgaactggaaatgcgagggtgtctgctccccccgggacacaccttcatccatagtaatgggagacaggaggattctgggtaaacaaaggcctccttcccttctccttgccttcagagggctggtccaagttgtggtttcttccttgcaaattttcactaagagtcctctgtgtcatacaaacacacctgctaaggaccaactgtggctctttagggcccctgaagctgcggccggcaagaatgcttcgagttgcttctcatgtttccttgcctttattcccctctatttttcaccctagccatcccgggcttccaccttccaaagaaagtgtcagctctcactcttgccccaagctctgctctctagaggaccctggctaaaatgcaaaccatctaacagaaattaaaaagcctggcaatctagcaggtaggagccctcattactgtagctattatcattaccacgaagattcataccaaaacatgtcagtacggatgaccttgggtcactgctctgaaattcaatacaaggaattagagaaatgaatgaaattcatgtaaaaagtagaaaaatcatatttaagacaaattttaaaacaaaagaaaattaaaaataaattattagcttggaaaatgatagcataaaaatgagctttattttgataagctccattttgggttaagcttgataaatacaaaatacaatacatgcatctatttatacacacataggcatatgatgactatagcaaaaatagtatatttctgctcatccttgcagaaaacccattaatgtacaaatgcaaaagtgaaggtttctaaaagttctatttgtggacgtctgcacccgtgttttatccattgccatttttctcctatggaaggaggtgaccaacccatctcagacgcaggacaagcttccttgttccacccagtcagttctagacagatggccacaatacacatttttgaatcatgccaaaacaaagattgaatctggcagaggctttaacccataacttcttttcccaaagacattaaatacatttgcttggtatcctttctgacagcaccaattcaacagagaggcatgtaggaacggacacgctgagtgagttttaggggagaaagtcaggcaaatatgcatgatcgaaatagcctcccaaacaggaagacttatgttcttctctcttctggaaatctaaatcccatagtgtgtaattttgatttgcattggcaggacaagaatatagctcaataagatgacacagcaccacgtccaagtgtacacctcatacctgctcttcacaatggggaggcttaattgtaggtagggaatgagcttggaggactatgacatatataaaatgagccaggaaaattctgtctgcctaacttacatggattcatggccaaactgttctcctttaattaacacatctttccacatctcagataagggggtccttacaacaccacatttcttcccactcacacttaatcacagtgagcacgagctatggaaggggctctgttcatctgaagaccctgaagatgctgtctttttcacatgttgttttcctctcagatcagaggtagtctagggaactgagatttcccaatgggtttgagttttactgcaattaccagaaggctattgaaagatgggtttttagaatctgagcaaattatcactgcaggtaggtattcagaggatacatgtatctatataactgtggcattgaatttttaaaaaatataatcattttagactagaaattagggctctaccttgtattcacctcaattgattttacttttttttttttttttttgagacagagtctcaatctgtcacccaggctggagtgcagtggcgtgatctcggctccctgaaacctctgcctctggttcaagcaattcttgtgcctcagcctcctgagtagctgggactacaggtgtgtgccaccacaccgggctaatttttgtatttttaatagagatgaggtttcactatgttggccagtctgctcttgaactcctgaccttaggtgatccacccaccttggcctcccaaagttctgggattacaagcgtgagccagcacacccggcccttgattttactttttaaattgtagtccacttgctcaaatttggaaactaaaagacaacagaattctatttctaccaagttttattgactatttagttaccagctttactgatcacaaccaagtttactaactgactttgccttttctagagtgccaccgttctgctcatgaatttgaaattatactggttttcatgcacttattacatacataattattctgtgtgatgaacagctcaagaccttaggaataaaggaataaaagacctctgtgttttgaaaataagaatctgaataaatagaaagattccctttcaatcaaatcttatttaccacacaacttgtgagtaacctgcaaaatactgtaggcaataacagaagtaacagaccctgctcctttcctcaaagaattcaaaatttagtcaattaagccaaataaagccttaccagtaactatttagcttaataatttcttgtttttctggcactttcagaaaatgaaccctacataaagcaccaaaatatttttaatcttatttgagtgaatctttgatgtgacatcctgttcccaagagtattacaaatacgactctgtggttcagggtcttcacggcaaacagtgatgcacaacagcacggcagacccttgggagcaatctagtgctggctgcttcctgtgggccccccgacctcacgccactgtgcttctgcccaaaggggctgctggtttgcttttcctgcccctcccacaggcgtcagctctgcttcccgcccctctgtttctcactggctgcctctcactgtgctgtgttgagagagggcactaaagaatatgcagaacaggccaggcactctgtctctcagcactctgggaggctgaggtgggcggatcacctgaggtcaggagttcgaatccagcctgtccaaaatgacaaaaccccatctctactaaaaatacaacaataacaaaaacattagttgggtctggtggcagctgcctgtagtcccagctacttgggacgctgaggcgggagaattgcttaaacctgggagatggaggttgcagtgagctgagatcacgccattgcactctagtctggaaaacaaagtgagactccatctcaaaaaaaaaaaaaagagccggttgcgacggctcacacctgtaatcccagcactttgggaggccaaggtgggtggatcccttgaggtcaggagttcaagaccagcctggccaacatggtgaaacctgtctctagtaaaaatacaaaaattagccaggcatagtggcatgtgcctgtaatcccagctacttgggaggctgaggcaggaaaatcacttgaacctgagaggcggaggttgcagtcagccaagatcacacgattgcactccagtctgggtgacagagccagactcaaaacaacaaaaacaaaaacgaaaacaaaaacaaaaaaaacaataacagcagcatagtaagaagccctggaaagtgcaagtgcttttgcacccatgagctcctttgccaaccacagtctggtctgcagggctttcttccaagtagactgcactggtggcattgtgtttcgtgacagttttgttttgttttttcccttggagacattttgatgaatctaggcttttggcggttttcactgatctttaggctctctgtgctccctgcggtctgaggatcagacaagcgggttatgtcagactgacatgaattgaaacaggtttcctgaggtctctttggcctagagagccctgctggtggtcttgccccctgccaggtggatactaacgctcaggaagccactctcaggatgcagcctctgggtaggccccgcaaaggcctccgcagaaagctttgtggacagacgcccctgcaggatgccccggagagcaaagaaagcaaagggaagctgcagcccagctcctccactcccagagcctggtgaacatgtgctctgaaggcaccagagcttcgggaacctgtgtatgaggaccccaagtctttaaccttcatgccacttagcactaaatgccaaaaaaaaaaaaaaaaaaaatgccaatacaagaaccaaggatgggaatataacatatgtagcaagtgaacaagtttgcagagctagggatctgcctctcgccaagtccgtagcttggccgggagctgggtcatattcatgttggtgccctgcttcggctacactggcccctttgtccctactaccatctctcttattcacctcccacagcaatttgtacaggttacaccttactgtcccacttgtagggcgaggtcagtaaggctcagcaaggtaaaaatcaatttgcccaaaaccatgccccacagttaaggactggggttgcccctctggccctggaaccagagtctctgctgcgtgttcctgtctcctagtgtgtcggggttacctttgttttttttgttttttgttttttttttttgagatggagtctcgctctgttgcccaggctggagtgcggtggcgcgatcttggctcactgcaagctccgcctcctgggttcacgccattctcctgcctcagcctcccgaggagctgggactacaggtgcccgccaccatgccgagctaatttttttctgtttttagtagagacagtgtttcaccgtgttagccaggatggtctcgatctcctgacctcgtgatctgcccgcctcggcctcccaaagtgctgggataacaggcgtgagcccccgcacccggcccgcctttgttttactaataacaaggtgtcactgggtcactgctacttggcgcaaggcattttttacatttattagattttcctttttaaattgaaacataaaaattgtatatattcatggtatacaacatggtgctttgatatatatacccattgtgaaacggctacatcaagctaatttagctaacaaatgcattacctcacatacttatgattttttacttatgattttgtatgattttttaactgaagaataaatacaaactccttagcatgggattctgtttgctttgtccgcaacctccttctaatggcatccagcataccaaggagaagaaagaggtgcagcctggagaggaagatggccaaaagtctccctttcctatgaccctgctccccaaccacagcaagggaccaggtcatcaaaaacacaggctggccaagctccacattctggttcatctcactgttatccagatccctttttatcaacaggaaacatcagctctgcagtaacggttatatggtcctgtaagaaccaagaaagagcagctaactggcccataaaggggattgaactcacatactcagcctcattaggaactactttctaaccaagagatgcaaacaactggagaaacatacaggtggtctgcagtttccacttacagcattagcaaaacaaaacacaatgaaataaaaataaaagccctgtattaagaactgacctctatcccaagaatgatgttgattggatgtgaagctgtaatttgtccagatgtatttctaagtacatgtgacatgtcagctgcttacagatcatcggcttcctcctcacatatccagcacaaaatcaacacgaagtgacagagggaagaaacagcattgtcttgtgttctgcttccaaaaccaccttgacaagtcaactgacagcagaaaaatcccaggctccgtggaggttcccgattttcataacattagccatgcatttcaaggaaatgcatttcaagatgatcaacagtgaacttggcgagggagcactggttctgtgcagaagcagcagaaatgttctttgcctctcttaacattttgtggactcttactgtccagtctcatgagtgggaatttaagtgggaatgaaatgtaatctgggtggattcctttaatcatattgtgcaggtaaatgtcagctggcttggtaccctattcagaatccagaaaaaataagaggttcagggagggaaacagggagaggaggcagaaggaagagggtctgccacagccctttcctactacaacacaagtctgttcctggtccaagtccctgcagagaaggcttccaatagcagcagccactttgggccatgccaaatgactggggagccacaagggcctcttgggactccctcaggaaggcccccacgctccaggatccagcaactgtctggctgtcttgtttctgtccccatgtggaagtttctcccatgtaggattggatacatttaccaactggacacattactagattcacatgttcttccttttcaagtcattagtgccccattatttactcttgacacttttcaattagcaaccatttctgcaaaagagcaacttcaagagaaatgcaaatgtatattagggatgcctgatgttttaaaactcaaaataagcatagctttatggggacccatagaaccacgtattttgaaaatatcttagtactttcttgaatagaagtatggtcatgagaataatagcgttgtttttcagatggtaaacatcaatatcggccgggtggggtggctctcacgcctgtaatctcagcactttgggagtccgaggtgggcagattctgaggtcaggagatcgagaccatcctggccaacatggtgaaacctcgtctctagtaaaaatacaaaaaatagctgggtgtggtggcatgtgcctatagtctcagctactcgggaggctgaggcaggagaatcgcttgaacccaggaggcggtggttgcagtgaggtgagatcatgccgctgcactccagcctgggcaacagagtgagattccatctcaaaaaaaaaaaaaaaaaaaaagatcaatatcagtgtatacccgcggaactgtaatacaggccgatccctaaggcctccatggtgtcttacagccacacagtgtgacacaatgacatgcgccatcctggagcagggcatctcaccctccccattctctacggtctgtctggagaaagctttgtggcggcgcctgtgccctgcagggtctccagcagcatccccgctcctgcccactagatgccagcagccttctcctacttgggacgaccaactatgactccaaccattgccgaatgtctggctgagggtgggaggtgatagtgagtgtccccccatccccggccgattgaggagcagtcctagaggtattactatgatccccaggctgcagtcaataggaagcctcatgagacacacatacttgcccaaggtcacatacaattagttcactgtagacaatgcaacgtctactgtgtgctatggaacaaccgggaggaaggagacggagcccgctctaagagatggtgcccactctaagagcccccttttctgattgagctggtagcacagaaaatgtcttataaagccagggcagcctaagaagccgtgatccctggaatggggcaccgccagatacagtctccgggtggccaaatgacttctcgtcactgaagtgcttgcccggaggcctgagcgatttcctaatcctcttgcttaatgtcttctgaaaggctcattttaataagggaatgaagctgttttaagataagttaggtagcttataatatgaagtgctaatccctagcctagaaaaacgcaaaagaaaaggttttgactaaatgtctctagctataacctgatgctgttctaggaccattagcatttttttttccctgggctgcctcagtcttgacacttccttatctctcttcattggtgcgaacaatacctgagctctccctcacagcagccgtctcccacagactcccctcggatgtccgggtgggcaggtggggatggagtgagcagatcggggttggagtttggttatgcaaccattgagaagtgagatgagtctgcagcttctgcctcactgtatggataagtaagttgttgtgtccgaggctagcacccacgacagtggacacagaggtggagaaagggtatgtgggaagcagcactccagctctgttcctatcccatgggtcctgaaggagcctttcggtttcctactagatcttacctagaactatttagattatacatgtagttttgcagtaaacctagcaacttaaaggaactcatgattcgttttttattttggaagctatgtctcagaatctatgggaaaccaattacttagaaaacatggaactctggactttttaattgatcaaacactaaaagacagtgagcaaaagtcccaacctaagacagcggcacagacatcgtgtaagagcagccgctgggattcagggtctccagcacacagtgaggagaggccatgtctcagcttctccatccactcagtcagatcataaaactgaccagttttatgcactgatctaggagccgagaggtttgctgtataaatgcaaagtagtaatccaaacacttctcccttagtcggtctacacagccaaataatccccctccagaaaggcagtggggaaaagctccttcttcctttgcaggtagaaggcctcacacattctcactcttaaacgggtcaggcttctaaggcttcccatggaccatatctaatttacaggaaaaagactagagtacacagccctggtctccacagtttcaaaatagcctgcggtaactaggcattgttattatttaccagttcttatccataacttgtttgggaaatggtaataaactgatgctccgtttgaataacaccatcaatgaggtaagatactttataattattcttctacctggggaacacgctcattaggaacaagccggctggaagcttcagattgttacattgtagacactgcattctgcaaattgctggaagcactgggtagagggaggttcatgtgtgaaaaatgaggatgatgatatccacaggcagaacagtttgagggtttcagagaatgcaagaaaagctgatgctacacacgccctggctctcagggtggctgcgatgggaggggtccctcccaggccagggcaaccattctgggagacagcaagtttgccttgttgtaccattgcctgcctgggatttaaagaaggtctgtgggatgagccaccccacctagctacgtgatgactgaacatgtagcaaataagcctgtgagcacctccaccccaccccaccccggagcacccccgtcagcaggcagagcttggcctatactcactaggcatcatttctgcccgctgtggccaagtcgctctccagggtaagtccgtctcttactgatttcactaattctttctcccctctggagtttcaggatactgaaaactactcagcaaattctttaaaatctgaaatacgacaggagttaaatatgctctaaggaaaagggggaatcatttttatttagtattttcaaataaattaaagacctggcttatttaacccacaggatgggatgctgtgactgtcaccaatccatggggcaaaagggaactgacttgagcgtatggtgagaaggaaggggggcttcctggggcagggaaaattggaaaacagattcacgcagaacccccactccacaccccctgggaaacgtgcttaccccactcttccgtacccttgtttaatctgtgacattgtgattgaaatttgtcactctgggagttacatctgatgttacagcctgcagcggagctaaaccaaaataaacaatctgctctattctgcttagactaatacgacagtgatgtaaggcccgagacactggcagcggcaaaatgcttttcccacaccgcatgctgcagctgggccccatgcgtttccacgccggggataggcggcaccggcttatccacgcatggggagggttggggaggggctcaggcacaagtgcaaactttgcttgtaggcaactgagttatcctgtttcttctatcagccggcagcacgtgctcttaaggtggacttttaaaagcctttttaattttattttcccgggcatgggtgacccctgtctctctaagcctggagggtttgcaaacacgctaactggtggtggaagtgttcattgcagttcacataaagggtgtgtggctccagcacatatcgatttgaagctgcccacacagacgcattttcagttgtcttaaattaaatacccaatttattttttggtacatatttggttgcttgccagcaaatgactctcagtatattcaatggctttttgccagaaagatgacaggcttttttctttaaaaagggggtggcccctaaatagcttcctttctgaagagctcttggtggccctctggtttgtagcagctaactcggagtgcggcctttttacagccagctttgggggtgctaaatctgtgcatttttcaagcctcagtagttctggtctcaatgcagtagtattcgcttgctttcttttctcttttaaaatttccacacagggtcctgagagccctgccatatgtgggctactcatcccagcagcatgcagaggttctgcgatgccagtggtcacagggagtcccctcatctggtcatccttccatccaagatccctggctctggatgagggggaaattgccgtacatgattcagttaaaattccagcctgagtggcctcgattaaatccagcctcctacatgcaatcaattttcaattttatcacctcatacgaagcaaagcgtgaatgagagttcagggaacttggatagagataaagcagggtcctctttaatacacagatgcttgttaaacctgctcattattctacactgtgattttctacgtgtaaaccagagacgatcataattatcatatgcctctccaggatttctccacggagaaaaacctaagagtaagttcatcaaaatggaaggtagaaaacaggaagaagctaaaatgtcatatccaggtgcaaactagaagcccctcgtccaccctggccatgagctccctcccttcctctactaaagcatcccctgaaccggggagagggactccacttcccagttcttgggccttcactgctcccgagcacaagccgtaaaatgacgggagctgtgtgaggtgccaaggtctcaaatgaatgcgggcagcagcacctgtgaagctgataaaacatcagtttgcatttggctcaccttgcaagagggggttttatgcctctcgttttcgctccgctcccacactcctgtcacccagcagctcacactataaagagcatcccctgcgctctgtcttaaggaatgggcactaaataaaagaggcagcatggtgctgttaatttttcagcataggggacgctctgcctgtgacaccagatggaagaaaatgtcctgtagcctcctcccccctcatcaatgctcagtcacacctctctttaagcatccttcagctttcccgagaaactggtggaaaatggtgttgtctgaaaatctgggaatttttcccttcctcctgctaatggcctgggttgaataaacattgaagaggaaaatttagaaaaatgaaagagagaagagaaacgctctacccctagatggggctactgtccgcaagcagagtgtgtttgttttttaaaattcagttcacttacagtgagactgagattaggtatcaacagagaatttacaatttaaatcaaactttgactcatttaattaagtctttagtcctgtgaacctcattcacagccttagcattgggctgctctaggactccaattgataaacttcttaatttcctgggtgtctgggttttttttcctttaaaaaaaaaaaaaacaacccatacatcaaatccaaactgttgaataaactacaaggaaatagtagccagcagcgaatgtttatatgttccagggtaatagataatgaataataagggactgagggtgagggtagacttaacaaaatgcttggaaaagcccaggtgagcttcaatctgtccacttgggaaataagtctgaagaaggagaactgcattccaattaacatctgtaatttgcattgtatgaaagcactagaaaataatagttttgagagcttttttaatgtttccagaggtaggagtacagataatcttatttaagaagcaagcataataggtctttctgtcatttctgagctgctgaatcataggaaggacaggaaactctacctcaagtcatgagaagaaaaggtctgcatgtgtctccttagccttaacccccttgcctaggacagaaagcggctgaaggagggctctgcctcaagtgtttcttaatcattcccttcagcaatggtgctgcttttgttacatgactgctaaaagagctgacgtgtctgtattgtgtactgggcaccattttacatacattgactcatctgctccttaaaaccatgctatggtttaagtattattacaatatttactagaaaattaaataacttgtagaaactcatgacccaaatttttaaaccttattttagattcttctaagaccagggcaattgtgaaaactcagtgttacccataaataaaacagcggggcactctccttatcaggaggcagtgtgccttaaaatcagctttgaagtcaagccagacttagctgcaagtcccccctccatcactgcaggctgcatgcctttgggcaggtcacttcagccttccgagcctcaggttccaagtctgtaaaatgggttagcatcattcccatctggcaggattgtcatggggcttaaatgagataacacattaaaagtgttcaggcctcagcctggatgttagcccaggtctcgcaaatacaagaccagccaccttcctcttcctcatccttaatgcttcctaatattctctctcacctcccacactagcagcgccattgcaggaactgtccccgtcccactgcactggctggcccagtgccacatactgcagggaggagacacaagcatgcggccctggggagcgctggtctctgcacaaacacggctcttgcagctttcaccctgagctcgccctgcgccagggcagccagtcatcttgacaagagcaaggaccgagttataggtcaaggtaagtggcagaagcaactcactttgatctgtaactagagctcagggagtcccattcgaccctgcaaggggcctgacaagcacaagccccacccaggagccaatgtgtctccgcagtgcttgctctagaggaggagggactgggcgaggtggggggaggagcagcctttggttcagaagcaaaatagggggaaaaaagaggcccagaaagaaacagagaggggagaagaagcgctgttaagtgacagagccacaaacagagctctcttgtctactgaagtgatgtaggggaactgaggtggcattggagatatgcctcccacagtgagaaagattgtactgggaagagatggagagaaaggtgcccctgagggaagaaggtaagccggacactgagacaagaaaccaggaaggctgagggagcgcctggagctgggatgggctcactccaggtatacaatgtgcacgtggggataaggctgcactaagtcgggggtcacggctagtaataataagcaaatcactgggaattactctctgggtaggcacaagtgaggcctctcaaaccaccctgacgttcagggtgagggctggagctctctgctcctgacagggagcacagcactgcatcctcgcagcccaggaaagttctggcccattcgaggaggtagccgggggtcccactgactctggaatgcttggggctctattttagtccttggaaccccaggagagtcagatccctcgtctgcaaagctctagatatccctgtcccttgatttttcttgaatcaggaatgtcctctaatttcagaaattaatttgaacaatttaaagccttctgggattcagaggaggcagcttggatgctacgtggagctacaggaggggcgcagccaatcagccactgatcttcactcctcaggaacacacggaaaaaagtccactgagcaaatcagaaggcacatacccgtgtgcaaatacacaaaatgtatcctattataaaattttattagcagtgacagttttaagggagctttagcaatatttcaagctctggcatcaaaatctgacatattcaattttgcttttatcaggttatctgatgacatttctgcaaaagaggcactcgcccatctcaggctcgcccctcctctgctgggcaacacttgcctacagttggcggagccagcatggacagcatctctcttcttctgctgaggaacaaacaagggttcaaccctcaacacacaaagaccaccagcactgcttgccctttcattttatagcaagctcatgtctaaagaaacccgtaggctcgtgggcaggggaccaaatggcaagtgcagatagtgtcattacagaggactggtgagctctgcagatggcatctggggcatcacaggtgacaggcaggctgttgtggggccctgcgtgtttgtgcattattgcaaagaccgggaatcagcagctaaagtgcatctacctggttagggggcagcctgccctggacagctgagagctgggaaagccatctcgaagattgccacatcacaggagaaaagccccatccattccgctctttctttttaacaagttcaggggtacatgtgcaggatgtgcaggtttgttacataggtaaatgtggtcatgggggtttgttgtacagatgatttcatcaccaggcattaagcctagtacgtgtcagttatgatttctgagcctctccctcctcccaccctccaccttctgccaggccccagtgcctgtttttcccctccagtgtatgtgtccatgtgttctcaccatttagccctcacttataagtgagaaaatgtggtatttggttttctgtccctgttttagtttgctaaggataatggcctccagctccacccatgtccctgcaagggaaatggtctcattcttttttttggctacatggtattccacatggtatatacgtaccacattttagaaatgcaaatcaaaaccacaatgagataccatctcacactggtcagaatggctattattaaaaagtcaaaaaaaaacagatgctggtgagactatggagaaaaaggaatgcttatacactgctgatgggattgtaaaaaaagttcagccactgtggaagacagtgtgatgattcctcaaagacctaaaggcagaaataccatttgacccagcaatcccattactgtgtgtataccaaaaggaatataaatctttctatgacaaagacacatgcatatgtttgttgcaacagtattcacaaagcaaagccatggaatcaatttttcttaataaatgaatccaggaacaaaagagaaggctccatgaaacccattaggtgcacagcaagagggtgaggaggttaagagggaatgagcatatctcctaatgacagagtctctccttgacccaacgttagtcaggctcttctgaatcctcttcctatctgccatgacttttaggctttctttttccttttttttttttttgagacagggtctcactctgttgcccaggctggagtgcactggcgtaatctctgctcacagtaaactccactacccaggttcaagctattcttgtgcctcagcctcctgagtagctgggattacaggcgtgtgccaccacgcccagctaatttttgtatttttattagagatggggtttcaccatgttggccaggctggtctcgaactcctgacctcaggtgatctgcccacctcggcctcccaaagtgctgggattacagatgtgagccaccacgcctggcccacttttagactttcttatccatctttgcatccctcaattttagcaagatctggctaagttggtttaccttcaatatctgatcacccttgatataagattggtttcttcattccctgccatcttccaggtgacatctgatcacctcggcctgcctacagcaagaatcctattggcaaataattactttgccttctgagtaattttctatccaacaacccccaaccactctgtctcatcctgctcttggactacaaatccccaatttttccttattgtatttggagttgagtccaatctccttcccctgctgcaaaaccccattgcagtaatcccctccaaataaagcctgccttactgttctttaacaagtgccaggaataatttttaagcactaacccaaatttctttcctgtactccttacaacaagatgtaaggagcacactcggcttgtcctcaggttgcatttattaaacaaaagctaaaatccccctttcaaatatgagaacataaagcatataagagagaagtgtttcctgggtgatccaaattaaaaataagagccatgggccaggtgtggtggctcactcctgtaatcccagcactttgggaggccaaggcaggcacacttaagttcaggagttcaagaccatagtgaaacctcgtctttactaaaaatacaaaatttagctaggcacctgtaatcccagctacttgggaggctgaggcaggaggatcacttgaatctgggaggcaaaggttgcagtgagtggagatggcaccactgcactccagcctgggcaacagaatgagactctaaaaaaaaaaaaaaaatagccatgggcaagagagacatgtccttgctgatttctccccttgaatctggcccactgaggacacctcttccttctcttttttttctttttctttttttgagacagagtctcgctctgtcacccaggctggagtgcaatggcacgatctcagctcactgcaaccaccacttccagggttcacacgattctcctgcctcagcctcacaagtaggtgggattacaggtgcctgccaccatgcctggctaattgagatgggttttcactatgttggccagactggtctcaaactcctgacctcgtgatctgccctcctcggcctcccaaagtgctgggattacaggcgtgagccactgcaccccgcctcttccttctctttattctgcctgaggatgcacgttctcttttgacagtttcagcggattgaggctgaatgttaagttttctgccaaaatgggttcagtatcttgtcagctatttcctctgctgaaacgaactttcatctttaatctactcaggagtgctatgtatgacaggcgatccttggaggagagaagtctgagggacagcctgctactgtatttaaattggcttcacccagacagataaatacaaagataaggttaataagggttaataatttatagtcagaaaagtttaagaggattgcataatttaagcctcccgtgaaggccccaaaccaaactctatattattatcctgaagccgggtctactccgtgactctccttctgaataacagcccctcatgagtctcccagatacctgacctcaaaaccacagagccactgaagccaccttctgtctccttctccatcttctctgagagacagctggttaatcaggtcaaattattcttatctgattattagtcattagcagttatagttattctctagtaccttccacatttgttcttatttttattctcacttggatacttaagaataaaattcttctgcttattttgtttgaatccgtggattttaagaattattcctggctgggcgcagtggctcacgcctataatcccagcactttgagaggccaaggaggggagattacttaaggtcaggagtttgagaccaatctggccaacatggtgaaaccccatctctactaaaaatacaaaaaggaattagataggcatggtggcgggcacctgtaatcccagctacttaggaggctgaggtagaaaaattgcttgaacctgggaggcggaggttagagtgagctgaaattgtgtcactgcactgcagcctgggcaacagagcaagcctccatctctaaataaattcattcattcattcatgcattcattcattccatagtacagctacgatcatgttggtgccccattcaaactcagtttgcatcgagggtgaatctccctcccctccctaggatccctgttgggatctctggagatggtaacctgcgtggaaggctccaggctctggtcctcaccctctctgtgaattccacttgaaagcctttctgcctacgtgaagatgcagatgaaggacccgaggcttaaggcaacaagaaaatttagaatagttagcagccgagataatgaataagaattttcagtaacttctgggcaacataaaagtggagtgctcagtctgcaatttttgccccatcacctttaataagcatgaagcaaaatgaacaaaaagaatattaaacttttaaagactaaaagatctttcaaaatatattcctcgcttataatggtggcaatgaccctttccctttgttacctagctgaaaaaaaattacaaagtcgcatcaaaagcagaaatgaacattgcagaatgggagtagaatagtttgcctccaaggaaagtgattgaaagttgattatccggtttgttaaacagctaacattgaaccctgtggtcgggttttgggtgaagactctaagcctgaaaggccatggtcagggtctctctacggagctggacggttggactttctgctgtcgtggcaatgttctgtatctactctgtccatatcctggctactggctgcatgtggctgttgaaccacaactgaggaactgagtttttgttttattgaattttaattaatttttaaggctaatttaaagagctacatgctgctagaagctaccacattggacagcacagaataaggcattcatgctgctccacctttccccgattcttgttcacaaggtcagaggttgaggaaatgtcaatgcaaaacagaagggggtataaggcagcaggacagaccctccacccccaccccggaagcagaatcacacgcttcgcttcaggcctgcctgcctcctggtgtgcaatgctgatgtcagccgtggagttggcgtatgtgttctgtggaatatctcataagttaaggagtctataattagtactgggaatctaaataataatcatgataacaagaactaaccttgatagagcgtttactaatagaaagtcctttacacaggtacaaaccagttgggtagctttatgtaaatgagcgggacagaggcctagaaaattcaaacagcttggccaagaccataagattaataagtggtagagtcagaacttgaacctacttctctctgactgaaaatcaatcaactcttaaacagtaaacatttaaagtgggattgtggctcagctgctcaaccagtggaccaaacaactaattctctgagaccctgggccaccagtagatgcccaggacagcaagagcccctggccagtagcctctaggctggtggcgtctgtccagaagcagcagtatctctccaccacagtgtgccctacaaatatcatcactgtcttcacgtggaacgaggaaaaaatgtctaggaagcactgaacgacattctaaggaaaaccatgtgggtcattcccaaagagctggtcatgaacaagaccccaaggatgctagcacaccatttgactgactccaagaacagtattggaggcaggaaaatgtcctcacgtgccacaagattttaaattctaatttgcagtagaaggaattataaataggacaaagtcagaaatcaccccaatttttgcatagccagggtcggttaaattcatgaataatgatgagaaaatgaagaccctaggattaaagtggtagcttagtttccgtaaagacattaaagatatatacatctcagtaaagaagcttcctaacactgtcattctcagacaatggtcaaatcaggtgtttccacatggcttcttagagcaaagtttcttcaggacaatgggacatttgtaaaagagacccaagctttgatctgatccatgacagggaggctgctggtattcactgagtctgtcgccacatcaacctggtgaaggcttgggcagcacctgtcaatccgacacgaagaggtgttccatgagtttaatggacaccgtgtgccaactccattttaggttattaatatcaattggagggaaaagaggaaaacggggagagattgctcaatagtggattttaaaagtcttttgttgcatcttgctgaatttggtcccaacttccctcatctaacaaaagataaaaataggctccaaggctgttatgctgagagttaacatgagggaggacttatccctcattttcttgatatctatcccatgtgaagagaagttttgtaactgtgaaatgatatctaatgcgggttctaatatagaaacatatttcttccaatgtctcacactccctttcattcgagcgaccaagtcctgctcacatataattttattagaacttttctcaagggttactattaatactcagaataccaataacaactataatgtatttaccacataccaggtaataggctattttacatagattatcttagaatttccctaaagcccttgaaagataattattatgctctttatgcaacagatttgttcactcattcattcaacgcatatttattgagcacctgcccaacagcagtgggcatttcttacccgttgctgttgggagcacagggcccaagcaggctccctgtccccagtgaggaaaatacaggtatatccaaaggattacatcatagttcttacataaaattattctgttaccatatgctcacatgacaatactgcttctttacaaaatggtatctgcgtgagtgaaaaacaattcagggtgggtgggtgggagactcgggtcttgtgtctccagatttgggtcccaccttaccaaattccatcatgtagaaaaagaaaattcctcaatgtaattgctcctgtgttgatataattgatatccttccagaggaggaaaacctagtttttaatctattttgcattgttcaccttctcagcaccacatacttagaataagcaggaatgatggctctatcactgtaccatgaggagatgagactatggatgctgtgccagggtctgtaagacttttaaacaagagctttgtttgattccattattaatctcatcagagagaggcccaaaagtcatttaagatttggttactgggccaggcacggtggctcacacctgcaatcccagcactgtgggaggccggggtgggcagatcaagaggtcaagagatcgagatcatcctggccaacatggtgaaaccccgtctctactaaaaatacaaaaattagccgggtgtggtggcgggtgcctgtagtcccagctacttgggaggctgaggcaggagaattgcttgaaccagggagttggaggttgcagtgagcggagatggcgccactgtagtccagcctggtgacagagcaagactctgtctaaaaaaaaaaaaatttgttactgaatgtgggtttgaatgggttaaaaagctggcacagaaatgcaaaaaactaccgattttctctaaggagactatcagaagaaatgcaactttgtcctgccttgcccaagggcagagaaggttgcagacatcctctcccctcctcagctgtctacatcaagtggttgaggggtgggtattttgtggcatgaataagaggattattgtgcagcaaacacttgatttctaagcattttacctgtacttttttagattttagtctttgcctttttttttttcctatttgtttcccacttagtaccttagaatttgcctttttaatgcaaaattagcatagtaaaaaaattgaatccggggtgcatcacttagaaaagttaaagaagattttcaaaattaattgttgacaagactcagcaaatatttgctgaatacctgttatgtgccaggtaatgtcataaaccctaggcataggactgggaaccaggtcctctcttcttggaattcacattctatttcacaagggttgggaaagaggaagaaatacagaatggaaactctgccctgagcacaaaacctgtgcatttggttagaagaaggctggtgctctgcacacaggggcctaagagaggaatatgaggtagtggagctctcagtgacctcgctgttagagctgtagggaagatttaggtcaccgccttatcttacaagtgaggaaactgataccaaaagagactggaattattgtctgaggtcacccaggctgtcccactggatgtcaggtaccgcctcttcaggactattcattagcatttgtgaaagtcaagatataacagcatatttcgccttatttctttcttttcctctttatgttgtatttttctttttgggtcattgttttgcattaatgttcatagacaatttttcaccatttatgtaggattagttctcattgaaatattaattccacattttcaataatttatatgatttgatgtcacaaatatctggataatttgatatagcatcaaaaaaaggctttctctaccttcatgtattatcatataatgcattttcttatcatagggaaatcaaaatgtgtctctctaattccttttggttttttaaattttatgagtttaacatgcgtgatatataaatcacagtcaaacattttcttcttacctcatctgatttcgtttgataaaatcaactccatctatatgtatgtcttttagaaatacgtctcagtttttcccaaatgggtatgtcttacatctaatgcgtgagaaaaaattccagtagcacctccctggggaatctgaactaggccctggttatgctaatagaagccaagaggttttcaaagcaaaagaactataataaattattcataaataggtctctctcttgatggttttggtgtttccgaattttccagaccatagaggatatgtgaaacgatacatgcacgctaagctgaagatgttacagagggaaatgggaattgaaaactaattggaattttaaagcattgcatttttgcatttggtacactttctggagctggtttgggcatggacaagacccaggagcctgcttttctggtggtccttggtgactacggatatttttaacaggcagggactggtttctgaggaaagtgtgtcccagttcccaaaggaaaatgactcctcagtgactgttagccctcgaggcagttccagatgaggtgctagacttaattcaggttgccagtctacagaaatgaagactttacttggcatactgctcgtttgcacttggtttgtcagactctctacctcctcttccttctttttcttaaacttgtttttcagtttgttcctctgggtctctacattgccaaacccaagggcacctcctagtctgcgtgacggacccccacgcctggtccagtccacaggtgccatggttttgttgtacctgccaacatttcaactgttttagaattcttttttgtcttaatgggtgttgacaggttttaaaatgtttcctgcttatttctacttgcaattttctgatctctgtaatttaaactaattgcatctactttgttatttattccattttttgtactcatttaatagaaaaaataataatttcttcaacttcagtcttttgtgtttgccgaaacccaccctggcctcacatgttcaagttaagccctgcccccaccttcctcacactcccatagggtcacagaccatgcactgatttacctgcctttaggagcccccaaactccttccttttgagatttttctttgtaatgaatgtcctcgccatgatcacaacccaaataaaaactcttcagtcgtctgctgtattttgtctttaacagtgaacagaattcaattcgaattttgggttcacatttagtcttataatttaagaaagaataggaaaaaacggagagcaacttgatttgaaaaagacaaatctgaggcgggtgagagattctaagtcctgatgtgcttggaacagtccagacctctgtcaattgtcccagcaaaattattaccagcacccccttttacactcagaagatcctggtctagatgaagaatcatatgtgcgtcagctattttcgctaccgtaaagcccagcccagcacagtcccaaggatagagtaagcagccaatatacatttactgagttaggaataaaaagatgccagcggtcaccctccttccctcatggtgggagccagggaagctgacgctactacaaagctatggcgtcacaggtactggacactggctagtcacatatttatatgactcctggaagacagccatgagtagatggctattatccatattttaataatatctgctaagaaaaataacaattttgagatagcacttgtggaatgagtcctccatatttaatgaaccagggaaacataagggaaaggttaaacaattctatgaagccaggcgcggcagctgacgcctataatcccagcactttggaaggctgaggtgcgtggatcacgaggtcaagagatagagaccatcctggccaacatggtgaaacctcatctctactaaaaatacaaaaattagctgggtgtggtggcgcggctgtagtcccggctacttgggaggctgaggcaggagaatcgcttgaacccgggaggcagaggttgcagtgagctgagattgcaccactgcactccagcctggtgacagagcgagactacgtctcaaaaaaaaaaaaaaaaaaaactctacaaaataggagaaatatctaaaagtttttttcttgtttgtctttatgaagggcttcttcccgttcagtaataatttcccttgcaatggagcaaaacttgagacaataagggactcaggaatgtgttgaaagctcatgaggaatttagtctaattccttcattgtgagttgctggcattctactccatttgcattcagcctcctgttaccaccaatgctccccatcagtaacagtcatactaatgtggggtggaatgagaaactctcagtgcttccaatgctataaccacttgcctatcccagtttccaatctcctttaaatactggggatgttaaaggtaactgagtttatgccttggattgtctgtgaaatcgtaggaaaatacatgtgatcttccaatgccccagtacttacaaataacgatactttattgccatggatttaacgtgtcctccaaagttcctaagttggacacttaatccctgatgcaacaatgttgagagatgggacctttaagaggtgattaggttatgagggctctgctctcatgaatggattaatgtcgttctcatgggagtgagttccttatcaaaggatgcatttggcccatttctctttctctttctctctctctctcagtctcttgcccatgtgatgtcttcaccatgttatgaatcagtaggaagaccctcaccagatgcaggccccatgatcttggacttccagactccagaactatgagccaaataagtttctgttaattataaattgcctagtctgtggtattctattatagcagcacaaaagagaataagccgattactatattatgtttcagaagcttttcaagaatcactcttatattatgcacaaataatgtgttttgtttgttttttttttgagacagagtctcactctgttgtccaggctggaatgcagtggcgtgatctcagctcactgcaatctcggcctgatgggctcaagtgattctcgtacgtgcctcagcctcctgagcagctgggaccacaggctcccaccaccatgcctggctaatttttgtatttttggtagagacagggtttcaccctgttggccagtctggtctcgaactcctgacctcaggtgatccacccgctgaagtcctgggattacaggtgtgagtcaccgcacctggcccaaataacgtgtttttaatagttactgtgggccaggtgcagtggctcacgcctgtaatcccagcacttttggaggccgaggcgggcggatcacctgaggtcaggagtttgagaccagcctggccaacatggcgaaaacatatctctaccaaaaatacaaaaattagccgggcgtggtagcacacacctgtggtcccagctgctcaagaggctgaggcaggagaatctcttgaacctgggagacagaggttgcagtgagctgagattgtgccactgcactccagcctgggtgacagagcaggactccgtctcaaaaaaaaaaaaaaaattaattgttactgtgaggaagatgatagccacagagggaattttttaaataaacaacctttcaacaggaagacagagaagaaatataaaacacaatcacatgggaggctgagatgggaggatcccttgaggccaggagtttgagaccagcctggacaacatagtgagactccatctctacaaaaaacaaacaaagaaacaaaatgagccaggtggtggtgcaagcctatagtcttagctactcgggagttggaggcgggaggatcacttgaacccaagagtttgaggctgcaatgagctatgatcacatcactgcactccagcgcgggtgacaaagcaaggctctgtctctaaaccacacactcagacacatatgccatcacacacacacaatcacaaagcatcagtcaggaaggccagcaagagcagaacacagaatgttaggatttcaaggtagaagctcaacactcaattcaaggtaaacttgataagaatttgcaacaagaccaatgatctgctaggtattataatgaatagaaaagcaatatggggttctggctgtaaagcaactgagcttttttgaagaaacattaaatgcacacataaaacccctgaatgtatgtcagcagatgacgaatggctctaaagtggtatggaataaaaaggaaaaatcatgaaaaaagaaggcccaccaaattggaacatctacttggaaaacttgagaaagaacagttttggttgggagtcaagtgcagttaacaggattcagagtgagcaccgcgtgggcctctgaggtcagaaaccagagggaggccagagaaatgagatgagctacaaagtgcctcaggaaagagacagctgggaccagatgacacacacaccatggcctgtttttatgttttatgtcagttttaagagacactgggattttcctaaaacaatatatatttgatggaaaagtgctgtccatttcagtagcaaaatcactttattatattgctgggaaaacttgagaactgaaagttggaagacagcaggtggaggttataaatttgatattaatatggcaatatggagtgagatttatgggctctgatagaatgtgatcttttactgaaaactgtttttactttcttatatgtatctcagtgatttgaccctggttttatgtgaatattgttttaggggatgtagttttctgaatacaatttattttattcaaatgactgcttacggatagatagctatggactagtgcggctacagtttcaataaacagtccaataacattggaagataagttttgaaagactgtaagaagccaaagaataagtttagacaattacatatttggatataattgcttttgaagtcaatattcaattttaaactgtttaagataatatgtttttgcttttatctaaagtatatgagagacttacaccaagcactaaactgaaattgtggtatgcaacatgactctacttaacagagctaggaatactgtcagtttgcaaaggtaaaattacttcgactttttctctggaaaactgaaatgaattcctttggaaattaaagtcctcgttgctttacaaacatcatttcattatgcaggagatctttactcacaaacattcatatcacacaatgtcagaaacacgacaaggagagaaggcatggggctgtggtcaacccacaaaagacaggcttttatccccagctctaagaatttcccacagacattactaacccatcatgcccattcagtgcacacagagtgacaaggtttcaagtggcgctgcagtgagagactactatgacaacgaacacaaaagaacagacattttaaaacactaaaaattggcccggtatggtggctcatgcctgtaatcccaacacttcgggagaccaaggcaggtggatcacttgaggtcaggagttcgaaaccagcctggccatcatggtgaaaccctgtttctacataaaaaaaaaaaaaaaaaaaaattagccaggcatagtggcaggcacctgtaatcccagctacccaggaagccaaggcaggagaatcgcttgaacctgagaggtggaagttgcagtgagccgagatcacgctgttgcattctagcctgggtgacagagcaagattccatatcaaaaacaaacatacaaacaaacaaaaaacaaaccactaaaaattaaatgaaaattaagattaaaaaatattaaaaataaaaaataacagaaaaaaattaactgaaaattcgaaatgcatatgtgatgaaatgttaggcaggaagaatcagcaggagggacaaccgccaaaaatgaaagctgcaaaaagtaattttttctgtctattcaacccacaatcatcacaggctatatttgaaaagtaggtaggtgtacttacctacatatagctgtttgtaggttatatttgaaaagtaggtaaggtgtacttacctacatataactgcacttacatacagttatacatatacctacatctaatgtagttatggttttttaagagagtaaagaataaaatggaagactaccattactgacagtcttctaaaaggcagtcaccatagcatgattaatttattcctggtgttctcttggtcctcacatacttgattctcttgaaaccagtgaaaaactcgcatgtcttactgctagatctagaaaagtggttctcggccgggcgcggtggctcatgcctgtaatcccagcagtctgggaggccgaggcgggtggatcatgaggttaggagttcaagacaagcctggccaacacagtgaaacactgtctctaccaaaaatataaaaattcgctgggcagggtggtgtgtgcctgtagtcccagctactgaggaggctgaggcaggagaattccttgaacccaggaggtggaggttgcagtgagccgagatcatgccactgcactccagcttgggcaacagagtgagacttcatctcaaaaaaaaaaaaaaaagaaaaaaaaaaagaaaaagaaaagtggttctcacaatgcacaccttgcaccagaaccacctggagaactttgtaaaaatgcagctgcttgctcaccacccccagaacctctttctgcgatgatcagggtggggttttgggcactgatatttgtaagatctgcatcaagtgattctaacatgctgccagttaagaaacactggttaacaaggagacacatatgaaacctcatatatcagacatctaacctacccttatttcttttattctcaaatctccatctcagctttcttcttcatttagaatttggatataaaccgtaactattaaaattgactgaatatatctaaaaatcattgattcatttacttattgcacacatacataatccaccattcatctgatgagatcacagcatttagaagagtactccaaacacaggctgctaaatcctcatctgttgattgggtctttaaaacattactattgttcactttcatactgacaacaatgttatgctatagggtaagctcaaatttaattttctttctttacgctgttctttattgtattttttccattaaaataatatttgacagataatccttatacctgttgcttcaaataataaaaataacctaacttattttatgagactaatatcttgttacccaactggataagaacaatgtaagaaaagaaaattacaggccaattttacataaggctatagatataaaaatccttcgtaaatattatctaacataagaaagtgtacagttaaaaaagcagaatcaagcagggttcatcccaaggatttaagaatagtttaacatcagaaaatctatgtatgtagttcatcaggttaacagactagaggagaaacttttcatgctacttagatgctaggaaagcatgagtccaagcacagggtctctgtctctctgcctcaataattctccagattacgatcaaagatctgctaggtgcggtggctcacgcctgtaaacccagcactttgggaggccgaggtgggcagatcacctgaggtcaggagttcaagaccagcctggtcaacacggtgaaacccagtctctactaaaaatacaaaaattagccaggcatgagggcgggcacctgtaatcccagctgctcgggaagctgaggcaggagaatcatttgaacccgggaggcggaggttgcagcgagccgagattgcgccactgcactccagcctggtcaatgagagtgaaatgccatctcaaaataaataaataaataaataaataagattgaaaatgaactgcttcttctacagagcttctgtaggatgaaaaaaaggcgctgatatatgctttctgtaatttgactcaatgggtttttgaatccttcatataaatttataacatcatatttcatttattagaaggtacatatactgtttttttagtagcacatttttaccataaatggtgactgtaatcgataaaacagagtattcaatatatttctacaaatgtgtattcccttctccccagagaacatcatagtataaggtgatctccagttttcttctgattctatgatttaaaaatcatccctgttctgaagctcttaagtattttgtttcttttaggtgcattggaacaccaaaatcactcatctgtttctttattcttgcttcccgctactcaagaacataaaataaaagctctcaagtactaaaatactgggctttatataaactagagtttatataaatactgaaaaatatttcttcctagaggtcagactgtcttcagggtcatggctaacataagcatttgcttagataaaaagttgacatttttttctgtaaagaatcagagagtagtcctggcacagtactttgggaggctgaggcaggtggatcacctgaggtcaggagttcaagaccagcctggccaacgtggtaaaaccccatctctacaaaaatacaaaaattagctgggcatgatggtgggtgcctgtaatcccagctactcgggaggctgaggcaggtgaatcgcttgagcccgggaggcagaagttgcagtgagccaagatcgaaccacggaactccagcctgggcgacagagtgagactccgcctcaaaaaataagaagaatcagagagtaagtgttttggctttgtaaaccatacatcctctatcagaacggctcaactctaccactgcggtgtgaaagcagccacagacaatgcatatgagtagggttgcatttcaatacaactttacttacaaaacaggtggtgggctgcatttggtgcatggatcctagtttgctgacacctggcttagatgcagtgcacccactgaggaacaggtgtgtcctactctgaaagcagcatgagctagtctgactacttatttcaaatcaatactatattttttaaatggcccacattttcaatctagcaaatctacattggggtatgtgtatgggtgtgcccatatgtctgtatctgttaaatgtatcagtttgcttttaaaatgttgagacacagctcacataagcagaatatcagttcaaagcagttctggccaactcagtttaaaaaataacaacattggtgtgttactaatactaccatttctatacgtagcatgatttctcctctctggtttaataacagtcatccaagtgtgacttcaagtaatgatcacttccagtgagctcgagtttactgctaaggtgtgaggttggaaagaggaagacacaacttcatggagatcaaatcactcatgaccttaacagccaaataagtattaaatggctgcaaggtaacaggtaggcaaggtttgttgtagcatccaattatcacgttggtgcaaagacactcagtagacaacaagtatctaatggccaaggagctgaaacttatgaattggctgtttaaaaaatatatttgccataattccttctcacacctaagtttcccaaaaggaatgcataaagcaggtactaataatggaacaaaaataataaagtgcttgccagggtagttgattccttttgaaaactgatcacaagtaagagattttagttacagctttcttttgcttcaatgatttgctaagaatccataaggataacctattcagatactattatcacatgagacatgatatgtgaagcaaaaactgttacgggaatttctgcttgcatgtacactggctgttaggttacagaatagaaataggattcctctgcatatttaacattggttctccatttgtagccggacaaccagatagtactgatttcaaagtcactgttaaaaactctaaaaacttagatttcggtaacatgtcatcacattgcacgaaaactggacctgccactaggcttggagaagctctgatgtgctataaacagccctaaccatcaagatggtaaaggctagtgtgacccagagacttctgctctctgaatacccacccccaccttcacctattccctttataaatgctaacagagcccgggaactttctgttccagagtgagcctgcaacagcattctcttgggtgaaatgctcttcccgttggcggtgagaatccttcctccttattctaacccatgctccccacagaggaggaggaaccctgagcttctcttagggaccatggcagagggttggaggcatggaggcagctctgcatggccttttaatgcttagtatgctcagggtgccgcctttcaattaactagcacagctgtacttttttttttttttttttttgagacagaggctcgctcttgttgcctaggctggagcacagtggcgtgatcttggctcactgcaacctccgtctcctgggttcaagcgattctcctattctcctgcctcggcctcccgagtagctgggattacaggtgcccaccaacatacccagctaatttttgtatttttattagagatggggtttcaccatgttggccaggctggtctcgaactcctgacctcaagtgatccaccacctcggccttccaaagtgctgggattacaggcataagccaccacacaaggccacagcgatactttttgactaagtaaggcttccgtaagagttttcacacacatgccccaaatcctggattatatgagacaaaaataaataggccacgtgtgctaattgcgtacctctctcttctcacatttcggttttctagaaatgagaacgcaggccagacgcggtgactgacgcctgtaatcccagcactttgggaggccaaggcgggtggatcacaaggtcaggagatcgagaccatcctggccaacatgctgaaactccatctctactaaaaatacaaaaataagctgggcatggtggcgcatgcctgtatgcctgtaatctcagctactcgggaggatgtggcagaagaattgcttgaatcagggagttggaggtttcagtgagttgagatcatgccagtgtactccagcctgggtgacagagtgagactctctctcaaaaaaaaaaaaaaaaaaagagaaagagcatttcttgtatgtcttgtgacaagagttaacaaaaacagtcctgcttcttaactgttggtgacatttgtaaaggtcccatggttatgcttattcagtgggattccgtcttcttgcatgtctaatggtgttagaaggcctgaaactatgcctaaaactatggttttatcccagagagaaaaataaattcatatcaagaaaaatactaagatttatatataaagcaacaataatggcaataataattctatggtgtaattcccctgagaaaaactgaacggaacaatggttaatcttaaaatattctacagtagagctcaggacttagtataattgcctgctactagtctcgtgataacagtcgaagctagttttgtggagggtttttttgacacttcaaaattatcatgttgtcttcaaggtcacaaatcaaagtctcatctattagtgtataatagtaagtttacagttttaaaatattttatcattaagaaaatattaactgcaaatttaaaaaaagtactaagtggaagtaagcgaaaagacagatattgtgatgaaaagaaagaccttctttccctgcctttttgagtgtattgattcattcatttaactgatacttgttgagtgtctcctttgttgtggtccttctgtgaagcacctccattcaacagaccctttctttgggtaagtgtgtataagtttcaacaagggaaatccatgtatgcatgcaattgtagagactaggacacttggtgataaaggacttgaaaaggaaattaatatcccacttaaatcttctttttcaacatcagattttacaatatttgcgatctcgcactcactttttctaaaacaactcattggacaccgttgcctcatcacagccctaaaacagaactccctctttcggtcagtaacaccatcatcttcctagttttaaaaccttggagtctgttttttttcttgtaaatttgttgaagttccttgtagattctggatattagacttttgtcaggtgggtagattgcaaaaattatctcccattctgtaggttgcctgttcactctgattatagtttcttgtgctgtgcagaagctctttagttcaaccccatcaaaagaggacaaaggatatgaagagacacttctcaaaagaagacatttatgtgaccaacaaacgtataaacaaaagctcatcatcactggtcattagagaaatgcaaatcaaaaccacaatgagataccatcttacaccagtcagaatggcgattattaaaaagtcaggaaacaacagatgctggcaaagctgtggagaaaaaggaatgctcttacactgttggtgggagtgtaaattagttcagccattgtggaagacagtgtggcgattcctcaatcatctagaaccagaaataccatttgacctggtaatcccattactgggtatatgcccaaaggattataaatcattctactataaagacacatgcacacgtacgtttattgcagcagtatttacaatagcaaagaaccatcccaaatgcccatcaatgatagactggttaaagaaaatgtggcacatatacaccatggaatactatgcagccataaaaaaggatgagtttgtgtcctttgcagggacatggatgaaactggaaagccatcattctcagcaaactaacacaggaacagaaaaccaaacaatgcatgttctcactcataaatgggagttgaacaatgagaacacatggacacagggaggggaacttcacacaccagggcctgttgggcaatggggggtaaaggcagggagagcattagaacaaatacgtaatgcatgtggggcttataacctagatgatgggttgaggggtgcagcaaaccaccatggcaaatgtatacctatgtaacaaacctgcacgttctgcacatgtatcccagaacttaaaagtaaaatttttttaaaaagtataaacattcaaaaaaaaaaaaaaaaaccttagagtcgtcagttgcacccctttttcttctccctcatatgcagataatccccaaatcctaccaactgtcccttgaaatgtctcacaatctgttttttccattcaactaagatataaatgtgaggtatctttcaaaaacctgatagtaattgaaaaatattctaagaacttccacttgagctgatattgaagctgggtgactagatttgtttcctgtcacttcctcaactaatgatcacaaacttgctgccttaatataacagaaatttatctcctatcaaggggaggccagaagtctaacacgactgtgcttgctctgaagagtctatgggagaatatattctttgcctctttcagtttctggtggctgccctggcattcctggatttgggccacatcactgcaatctttgcctctgtcttcatatcttctcttctaaggacatttgttattggatttagggcccacccagataatccaggatgactgactcaaatcaagagccttaatttatctgcaaagacgctttttccacatatggtcatattcacaggttccaaggatgcagacacatgattttggaagccactattcaacccactacagtgaattagttcctccctttccctgaaatgaatgcacaagtctcctagccttttttgagtcaggcttgtcggggattactcgaataggaaattccctaaattgttctagccttggcaactctaagtgggagcagagagagtaaggctggtggtgaaagcagttttccttcctactgcaactttattcacctctgcattggctgagcttaacataatggaaggttaaatacagaaataaatgaatgaataagtgaataggcacaggaatgaaggagtaattaatgaatggactaaagaccaaagggatctcaagagtataaattcccatgagctcccctactgtgaccccagcctggagtaacggggtaaaaaaaaaagattccttttggtctactgagcctgtggaagagagaggaatgaaccaccatggctgtgaggtccagctacaaatgggaggtttgtcccttagaatcaaaggctggtggcagcttcccttccattcagaggcgagaaggagtccaagccattcagaggtaagaaggagtccaagtcacacagaagcaacgaagacccgtctatctctgaagtggtcagaagtaaaagctatttcctgtttggtttgtttttttaagagaaagactatgatgtcagaggtacaagacaccatgatcatattgcaacagtcctaagatggtgacacatgtcagacaatcagatcttctcaaattcttaaaattattatccaggatgaactgattttcacctaaacataaagatcaagaagaatcaagctgcttttgtgttcatatgaacaacaaaatgtctcaaaataagcaaaacctcaattgaaagagaggcttgagattacaacgtgaaaactgtttcttgccattattctgttttgggatattcttctctataatgcatttatcactaaagaacattcaatttttgagacagaagaataacataaaagattattccacaagataaagaaaatgccactttgacacagacctctccttttctgtttgtcattcccttgactttgtaaaaaaggaaaaccatgttccttggatttattaaaaaaaaaaagggaaaaaacattctgtgttgttgtgtatacgtttttaaattatcaatctgctcaggactgacaaacatgaaaagaattaatttaatgccaaaaaatctgagaaataatttatgtttaacaagtatgcccccttattcctgtgtgtgtactgtacaacagtgtcctactcttaagaaaagtgagtttagaaagatatttgctcatgtggtttttcaaaattgagtatgacatttcctggaagtgatggtgaaggtaatctctgtatgacaattaacccagtcatcagcaccatacacctgggcaaggggctcaagaatgaaaatctctacacttcccgcctctactccaggtggaaagtcacagggtgggagggcaggcttgagatccaagagaagacttttaacactttaaggtatataggcatagctcatagctgtcatgggcttggttccagaccaccataataaagggaatactgcaataaagtgagtcccatgaatgttttggtttcccagtgcatataaaagccatgtttatactatgccatagtcatattaagtgtacaagagcattatgtctcaaaaaagtacataccttaatttaaaactattttattgctaaaaatgctaatgatcatctgagcattcagcagcttttaattttttgctggtagagggtcttgcctcaacgctgatggctgctgactgaccagggcagtggttgctgaagattggggtgactatagtggttccatacaataaaacgaagacaaagttggccccatcatttgactcctcctttcatgaaagatttctctgtagcatatggtgctatttgattatattttactcacggtagaattttttcaaaattggagtcaatcctctcaaaccctgctgctgcctcatcaactaagtgtatgtaatattctaaatcctttgttgtcatctcaacaatgttcacaccatcttcaccaggagtagattccatctcaagaagccactttctttgttcacccataagatgcgattcctcacctgttcaagtttgattatgagattacagcaattcagtcacatcttcaggctccacttctcatgctatttctcttgctatttccaccatatctgcagtcacttcctccactgaagtcttgaagctctgaaagtcatccatgagggttgaaaccaactttttcaaagctcctgttaatgttgatattttgtctttcacccatgaatcatgaatcgttttaatgacatctagaatggtgaattctttccaaaaggtgtttttgtttgtttgtttgtttttgttttagtttgttttgtttttttgagacagaatctcgcactgttgcctgggctggagtgcagtggcatgatctcaactcactgcaacctccacgtcccaagttcaagtgattctcctgccctagcctcctgagtagctgggattacagtcgcccaccacacctggctaattttttcgtatttttagtagagacggggtttcactatgttggccagagtggtctcaaactcctgaccttgtgatccgcctgccctggcctcacaaagtgctgggattacaggcgtgaaccatcgtgcccggcctccaaaaggttttcaatgtattttgcccagatccgtcagaggaatcactttgaaaatgtgtttttaaattgcaattcttagaagtcaaaaaaacttcttgatccatgggctgcagaatgggtgttgtgtcagcagggatgaaaacaacattcatgtccttgtacatctccatcagagcgcttgggtgaccaggtacattctcagtgagtagttatattttgaaaggaacccttctttctgagcagtagttttcaacaatgggcttaaaacattgagtaaaccatggtgtaaacagatgtactgtaatcccgactttgttgttccctttatagagcacaggcagagtcaacgtggcctaattcttaagggtcttaggattttaatggtaaatgagcatttgctcccacttaaagtcaccagctgcattagcccctaacaagggagtcagcctatccttggaagctttgaagccaggaatcgatttttttttatccaactatgaaagtcctagatggcatctttttacaacagaaggctgtttcatctgcactgacaatctattgtttaatgtagccagatacatcaaacatttaagctagatcttctggataacttgctgcttcaccttgaactttcatacgatgtagacggcttctttccttaaatctcatgaaccaacctctgctaacttcaaacttttctcatgcaactttctcacctctctcagccttcacagaattgaagagagttagggccttgctctggattaggttttggcttaagggagtgttgtggctggtttgatctatccagaccagagtttttccatatcagcgataaggctgtttcactttcttaacattcacgtgttcactggagtagcacttttaatttccttcaagagctttcactttgcattcacaacttggataacttattggagcaagaggcctagtttttggcctatctcagctttcaacgtcttcctcactaagcttaatcatctctaacttctgatttgaagtaagatgcaattttcctttcacttaaacactttgagcccattgtaaggttattattaataattggtcttatttcaatattgttgtatctctgggattagggaggcccaagggtggggagagagatgtggtgatgggcggtcactggagcagttggaacacacacatttatcaagtacgttcacaatcttatttgggcatggtttttggtactgcaaacaattgcaacagtaacctcaaagatcactgatcacaggtcaccataacagatataataataatgaaaaagttaaatattgtgaaaattaccaaaatgttggccaggcgcagtgactcacacctgtaatcccagcactttgggaggccaaggcgggtggatcacgaggtcaggagattgagaccatcctggccaacacagtgaaaccctgtctctactaaaaatacaaaaaattagccgggcgtggtggcgcatgcctgtagtcccagctacttgggaggctgaggcaggagaatgacatgaacccgggaggcggagcttgcagtgagctgagatcgcaccactgcactctagcctgggcgacagagtaatactctgtttaaaaaaagaaaagaaaagaaaagaaaattaccaaaatgtaacagagacacacaaatgagcacaggctgctggagaaatggcactgatggagtggctcagggcagggttgccacaaaccttcaatctgtaaaaatcacaatatctgccaagtgcgatacgatagacggcaataaaaccaggtgtgcctggacaatttttatagtgattgctgtgagtaggtgtgggaggatgtggggtaaggacagggaggagctggtggaaacaaaccttttaaagtagctcaggctctgggaaaggcctcagtttgttttctctctagagttggctctggctgaagaggatggatggggtgatgaggaaagcttaatttaaatagagtcccacctggactgggatcactgctggcctgagttctctattagctggtgactcaagcataattagtgaggggcccacatgatgagcctcgattttgatccaggtctgaaccatgcattattttagtatctggacaaggaatacatgtttttttcatcagtctttattttatttggatctgttctatattgcgagttgattttgtctttccaactgagattggaaacccttagaattaactgttttttaccttaatgtggtattatcattttttctgtaaaacatgtagaaagggccagatagtaaataatttagcatgtgaggtccatatattcccttctgcaactactcaacttcatgctgttgtgacaacattttatttataggcactggaaattgaatttcatataattttcatgtatcacaaaatattattctttaaacaaagaattgcaaccttgtaaaaatgtaaaatacattcttagctcatgccctgtacaacagcagactgctggccacatttagtcagagggcctcagtgtgctgacctctcaccttgttttattctaaattatggaaaagcagatatataaaaacatgaaaagatgatgatgaaaatagaaaaaaggtggtaatgatgatgtctgtttagattaattacataagcagataaatacttgccatagtaaagagctatttggcatcataatgagtgacacaaaagcaagagaactgggttttattctaactttatctgtcaactattagcaatcatgggaaaaatctttcatttatttatttatttatttatttatttatttatttttgagacagagtctcactctgtcacccaggctggagtgcagcggcacaatcttggctcagtgaaacctccacctcccaggttcaagcgattctcctgcctcagcctcccgagtagctgggattacaggcatgcaccaccatgcctggctaatttttgtatttttagtagagacgaggtttctccatgttggccattctggtcttgaactcctgacctcaggtgatccaccaccctcggcctcccaaagtgctgggattacaggggtgagccattgcgcctggccaaatcttttaatttctttaatcccaatcttttacttctaagataatggaaatggattataatgtttctaagatcattttcactattgagattattccatccttgtttacaactgctatcttctcccgtgtataactagctaccaatttactattgttttacgtatagtatacacaattataagacgcaagatcctaaaataagaggtgattgttacaattgaaaatgaatactttgggcccggcgcagtggctcacacctgtaatcccagcactttgggaggccgaggctggtggatcactcgaagctaggagttcaagaccagcctggctaacgtggcaaaaccccgtctctactaaaaatacaaaaaaattagctgggcatggtggtgcatgcttgtaatcccagttacccaggaggctgaggcaggagaatcacttaaacccaggaggcagaggttgcagtgagctgagatcacaccactgcactccaacctaggtgagagagtgagactctgtctctaaaacaaaacaaaacaaacaaaaggaaattaatactttgctcttaatttgtccttaaagcacaggctgtttgtggagaagcacaatctttaggcctcttaatgatttgtagcatatcatcactaagcagacattttgaaaaggctaagaaagatgaaatcaaagtagaatataaattatacatcagataagtcccattatgaggagggaaaaaaatatttggatgcacatggcctacctcttgctgtcatcaaaagcacttgtcaggatgaggcccttgcagcaggtactagagttctactgatttagacttcaatggctggtgtgttgtattttatagtgtaaaataattacaattactttaaaaattgttatggtccagcacaggccctataaatggcataataaatagtctataaataataatgtgaacctcactggaactaaaccacattttcccatttttctaaagcagaacatgctaagaaatagaagttattaaaaattaaaggggatagctgggcgcgatggcttatgcctgttatcccagcactttgggaggccgaggcgggtggatcacctgaggtcaggagttaaagaccagcctggccaacatgacgaaaccccatgtctgctaaaagtacaaaaatcagttgagcgtggtggcgtgcacctgtaatcccagctactcatgagtctgaggcaggagaattgctggaactcaggaggcagtggctgcagtgagccaagatcacaccactgcactccagcctgagcgacagagcaagactccatctcaaataaaaaataaaaataaaataaaataaaataaaagaaaggcgatggtcaacccatacacatgcttttaagagccctgtgctatgttttgagctgataaatacgaggccaagaagaaattaacctcacaatgattatattttttagtataatggtttctatttaacttgagcatacttaaaacgaatgcatcacctagaagccacatcaccccgcttcaactcagactctgctgtttctgtcaagagaatcacatttcttccactcacaacacaaacatgctgtccttgacccaccctctgcgtcgtcttaatcaccaagccttgtggatccctcctttgaaagagctcttcagctgtcttctcccttttgttttcctgccaacttattcattgtcttcttcccagggcagaccacagttctgccacatacaggagacccaaaattgtctatgaaagggagaagtgaaggtagtcctcagatagtttatgtaccaggacaaactagctacatgtgggaagataatctacacaggtttaattcagctgatgggttgatttcagaagatttcagcccattttattattttgtttcttccttttttacttaaaaaacaaacatatattgagcatttattatgtaccaacaaaacaaaataaaataccaatcatctatgtattgagggtagaggatagaaaagtacattttctcccattcaagtactaaccagggccgaccttgcttagcttccaagatcagaggagatcaggcacgttcagggtggtatggtcatagacagagaagtacgtttcctaatattaagatattgggctgttctcagagtgcctacaattgggaagaaaagtggtacaaagaaaatgacaaaatcagaagcccccccacagctcagcacatactctattaccaaattagtgatacggatgtcaagtgctgtgggtcatgaagaaaaggggatggctgtgtttcaatgtcctttaacttttcatgcactcagacttggtctaattcaggccacacagaacaaagctagctgaatcttgctgtctcccacattctcaaatcaaacacaccttacataattatctcatgttcttctttttagaattatgtatgccactgtttccttttgttggcatgagtcagagtacatttaacacgacttatttacttctctactaaaaaaaatttttaatgtttcatgatcagaaggctatcaatattttatattaatcactgagtaaatatatcagtagagctatttaaaaatcctgctggcctgtgaaggaaaggcaatacgagagaaatgattaattattaactgataaggattaattactgaccatatattatgtgccagcgacagtgccaactgttttcatggacctcctcttctttaattcttgcaatggacattggtgataggtaggtctccttgttatgaagaatgtttttagaggtaactagagaactctggggagttaggctgggaatcatggaatagttcttttgcctaaatgagacatggggaaaaatactgaagagagattttcttgggggatgaaattagagatagggtaatcatctactcttcagagtcagaagatagatgcagaagacagagaaggggagaggagagaggaggaggaggatgaggagagagagagagaaaataagagagagaaaataagaataagagggaaaataagatagatactttgtagcaatttaaacgtatagagattatttctagagttttcagtaagctatgagttttcctgggagctgttttaatcatttcttttttggaaaatacaccatcacagaatgtttcttattttacatcattagacgtatgatggtatctcttccagagacatggcccccaaaagtctgtgatagagaaaaaccatatggtacttttggtgcagtcatttaaggaacatgaagaaagagccctactttgtattaatttggggtctacctggaaaggcccttcagagagaaacttgtgttactattgcctcagccaccctaaagccatgcacacacttagaactcagggtgcagtttttagacattattccaaatgaggatgttgcactctactttaaaaagtataataaaaagtgttatattttacaatcctagactctacaaagaatgataggatattctcagggatcgctttgcagcagagggaactggaccagccagagccctcttccttgcagttggacagcacaaagctccctgtacacactttttaaaacataagttgtacatgtgaaggtatttggtggctatcatatgaagtttaagatgtgtggctatttttcccttccatggatatggataggaaatcaaacatgggttttaagcatgtatttctcagctggtgtagtctgtgttcagaatacttaacatatctgtgctataaaactcccgtgtatatttgcatatgggacacaccacaggcacgaggacgtgaacggctccagcattcactgaccgtcttctgtgtgccaaacctcagtggggcactttaataatcctctcatttaattttcacagaaacctataaaataggtatctgaatcattacatattcaaatatttcagtgactcttcactgagcagcgacttttgccaggtgttcttgcagggctcacagcagacgcatttcagccctatttagcttacattctagtgggagagagaataaatagacaaacaagtgcgataagatgctatggaagggtaagtgcatgaggaactacacagcaggattggggacagagaacgtcagtgggaggacgcagcagctgagtgggggtcctatttttcagaataaggtcaggagatgtctcctgcacagattcgaaaaggtgagaagatgagccataagccattgagtaacttgactaaaatcaccctgagaatgcatttatatatttaaacagggcagcatttaatacctctagggattatgtaggacacttgtattgctttatctttctcaaatcttctccattgcatcaagtatccaatctgttcataaatttgtcttaattaatgccctcatatcagacatacctcatagccagcatcaggcgctcctgtcctcaactccatgtgggccctgatcaaccctggcgctttgcctcctgttctgggctttcctggtcacacagagggcatttactgatacccacaatgcttaatccatggtccctcatattaaagccatctgctgggcttagcagcagccagctccataaagtgtcctagtttccctgcttcactccccggccctcccgcctctgtcctgggactaggactgtaacggagtaagagcacctgagccctctgcctcaggctctgcttcctggagagcccaggctcttatattatatttcaaaatcccagaggagaaggagacctgtcttcatttttcatctctcccagtgtcacaaatagagttattctcctgagggttaaccagaagttattccaattttgggtccaattgtgaactgatggctgtaagacatacagtaatgactttttttttttttccaaaaaacctagatgcgagctagtgtgtggctggttgtcaagcagaaaactggctgataataagggagggagctgggagcttggaacaggggatcgatgaaataaatcggctgaaaatgcagaatgaaataaaggcccgttctcaatgaatctgtgctgagtcccccaaacctccactcacaccccagttgcagtcagtgtgtgtctcttccttcgaagcacgcgtcagtctcagggactccatctctggagcctttcccgggcctgcctctcccggtccttccctgtagaaacggtctctcctaccccagacactcattctcgctccatgtttggaacatgcttactctgaagttagatatcctggggcataagttatactgtggcgtgtttggaaactatgcaagcatgaaatatacacagtcacgagacagaagaggaggcacgaaaaaccaccccgacacccagcttttcctgacgggaactaaatacaatgcgtatcggactcgagaaattccgaggaatggaaaggaaaatcgccggtagcatccaccgcgcatcagacacgagtcacactgacagccagaaaaaaatggaaatccccttcctagaaagaaaagaactattttatatcccaaactacaaaattaaaacaacaacaacaacaaaacaagtctgccagttgaggcgtttgattgtagaaggcaggccactgtgataagcatttgactctcgtcaaaaaaaattcctgtttcccttgaaatctttgccctatttcccctactattaacttggccatagtcactttcctctaagctttcaaaatttcctagaggcttgcgattattttatatatctaaacaatatatttaagacttttaaaagacctgttttttgtttatatataaataaaaattatatactatatataaaatatataaatatataaaatatataatatatataaaagaaatatatattatatgtaaaatataatatataaaatatatatgtaaaatataatatataaaatatatattatatgtaaaatatatataaaatatatattatatgtaaaatataatatataatatatattatatgtaaaatataatatataatatatattatatgtaaaatataatatataatatatattatatgtaaaatataatatatattatatataatatataatatatattatatataatatataatatatattatatgtaaaatataatatatattatatataatatataatatataatatatattatatgtaaaatatataatatatattatatattatatattacatgtaaaatattatatataaaatatatattacatgtaaaatattatatataaaatatatattatatgtaaaatattatatataaaatatatattatatgtaaaatattatatataaaatatatattatatgtaaaatattatatataaaatatatattatatgtaaaatatattatatgtaaaatatatattatatgtaaaatatattatatgtaaaatatatattatatgtaaaatatatattatgtaaaatatatattatatataaaatatatattatgtaaaatatatattgtatgtaaaatatatattacatataatatgtgtaatatataaatatatattacatataaaatgtataataaaatatataatatataaaatgtacaatatatataaaatatataatatataaaatgtacaatatataaaatgtactatatataaaatatataatatatataaaatatataatatataaaatgtataataaataaaatgtataagatatataaaatgtataatatataaaatgtataatatataaaatatataaaatatatataaaatgtaaaatataaaatatataatatataatatataatatatattataaaatataaaatataaaatataatataatatattataggtactttatatataatatataatttattatattatatactttatatataatatattatatattatatataaagtatataatataataaattatatattatatataaagtatatacattatatataaagtatatatgatatattatatataaagtatatatattatatataaagtatatattatatataatatatataaaaatatacaatacatatataatataaaatatatgtgtgtgtgtatatatgtatacatttttttctgagacagagtctcactctgtttcccaggctagagtggagtggcttgatctctgctgactgcaacctcctcctcctgggttcaagttattctcatgcctcagcctcccagtagctgggattacatgtgcgagccatcacacctggctaatttttgtattttttgtagagacggggtttcatcatgttgggcaggctggtcacaactcctgaccccacgttatctgcctgcctcggcctcccaaagtgctgggattacaggcgtgagccactgtgcctggcctgtttatgaatatattctcatcagcacctgtcaactgctgaaactatggaaaatgggctaggagctctgctcaacactgcggctatggcaataagaggtatcatggcagtcctcacaaatctccctcttgttgaatggggatctgatgagagactaacatttagaagaggctctgtccgttttgacacaggaggaacttttagtatttcacgtgggaccccaaggccacaatggcatggaaatgactgtcagcattcacctaactgctctgaggaaatgtgcccgtggtgacataattagtaaagtgagacacaggatcttgacctcgaactcatgtcctatgatcctcccctcactggcatcccactcataagtactggggccatgcaggatgttaccagatgttccatgggtgccgttatgtaacccatgactttgaccttcactcaacactgtaggacctgagacttacattcccaggtagtgaaagactctcagaaggcaggagtatcagaggatgtgctgaaacctacatatcttcagccattgcttttcctgttcattagctaccaaatataaatggtttaatatttttgtgctgaaagacacatatcttatgtcattgcttttcctgtctcattagttaccaaacaaatataaatgttttaacatttttgctttcttttaagccatattgattattacactgcttcttctgggtacttaaactatattactgaatatctcccatcatccttgattttgagattattgtctttccattttttgttttttggatgccaataattttttactcatcgttacttttctgtttttgacacagagtcttgctatgttgtccagacggaagtacagtggcacaatgacagctcactgaagcctcgaccttctgggcttaagcaatcccttcaccccagccacccaagtagttgtgactacaggcgcatgccgtcacacccagctaattttttaaatgttttgtagagacaaagcctcactatgttgcccaggctggtctcaaactcctgagctcaagtgatcctttctccttcgcatttcaaagtgttaggattacaggcgtgagccaccatgcccggctttattttcacttttcttatgaaaaagtgtgtagtgtcatccaagattaatatatccctacattaagatcctattattttcaacatgtatgtgattttgaaaatattcttttattttctactattattttttctattctcctatcacagttggatgtttagaagccagtatctgtagaatattttaagttttatagactaattgatctcctcaaacactgataaagatccctccctccttcttaaaaaatacccactggaaaccattgaaatctttcatattcaattcaaaatgtcaagtctattaaaatttaattcttattgaaatatttgatttgccatttttcagaagtattcatacttcttgactagaactgctcatttgcaatctagagacctattctgagcatcaggtccttttgataaaggatatattgaccatcacaatggacgcaaatgattcaatgcctgaatcctatatgtagtcccgaccttccctcttgcacagagactctttttcaagccacgtagttgcctgaaccttcatttctgatgcaggtgtgcacagtggtagtcatagaggaggaaactgtgaagcagcccaaatcccactggtgtcccccactccagccacggcggccccattcctcctgtctggaccctgctaggtgaggacagcctcaggctcctgtgaagggctcatgttcctgaccatcccagagctctcaccactgccctccatggcccctccagggaaacacctctccaaattttgccatttcatggcctacatcatgactattttaagcaagactaaaggctgataatgcaaatatggaaacatatttgcattttttttttttttttgagacagagcctcgttgtgtcacccaggctggagtgcagtggcgcgatctcagctcactgcaagctcagcctcctgggttcacgctgttctcctgcctcggcctcttgagtaactgagactacaggtgcccgccaccaagcctggctaattttttttttcttttgtatttttagtagagacagggttacaccgtgttagccaggatggtcttgatctactgacctcatgatctgcccgcctcagcctcccaaagtgctgggattacaggcgggagccaccacgcccggcccatatttgcattttaaaaagagctttagttaagagtgaccgaagagagaatgtgaagccccctggcagttgctaggatggcatgtggggtggacaggccttgtaaggtcccctaaattcccccgtgtagacagtgacacactcccatatatgcagtatggcgctcaatgagggagtgggtgggctcattttatgcaaaagggatgtgataacagctaagccatcccatggccgacacttggaggtgttctcttgaagggtgggtcagcctcttcctctctgctggccagtttcttgtgtcaaagagccatggattctctacacagtcggctggagggagctatgaagctagtggctcggaatggggaaagagtaaatgctccaaatcaaaatgaaacgtatttgctgattacaaccgatgagttgctccagtcggctcgatgtcaaaagtagaaagaaataaatttttaaaatgtaatcttctattgaagtataatgtatatacagaaacatttgtaaaccatgtttcctgttaataaaatttcaaaatggaaactcactcatataaccaggaactgaatcaagaaataaaatgctttaagcgccccagaaacctttcttagtggcccctcccaatcaccatcccctttcatcccagagccgaccactgtcctgattttcaacactaaggatttattttttcttccttttgaaatcgcacagtacgaattattttgtgtttgaattttctcatgcaacactgagtgagatttactttatagtaggatcagctactaatttgcaggggccattacgaaatgaaaatgcaaggccattgttgaaaaatcaagaattccaagatagtgacagcagcacattaaaccaagcccagggtccttttagtgcagggccctctgcaactcaaaggtggcagaccccaaagccagccttgtagagaatcccaaagcatgactatactatatttgtccatcttactactgatgaacatatttgtgagatttccattctttggtgctcctacaaacattcttgcacctctttggtgaagatatggatgcatttctaataggtatatagttgtgaatggaattgaaaggtcctaggcagacagatgttcggctttggtagatgcaagcacaaatttgttgtatcaatttacacttctacagtcagtctttgagagttccagtggctcctcatccttaccaccatttcatgtcttatctttttcagcctaggcaggaatttaaagtgccgattcctaccctctgctccaaaccttatatcattagcatttctctccagattctatattttcacagctccccaagcgattctccgttaagttaggaagcactgctaattaactgagctaggaagctatgagaacatcacatgcaatgttctcattgcaccagagtcaaatatgggttgaaggactaagaatattgagctcacacttttaccctctaggtaaatcagcaaatgattaccaagtgtatgggaagtggccaggacagggacattctgtatggtcattatgacatttctgccttttttttttttttttttttgagatggagtcttgctctgttgcccaggctgggtggagtacagtggtgcaatcttggctcactgcaacctccgccttccaggttcaagcaattctcctgcctcagtctcccgagtagctgggactataggcgtgagccaccacaccagctaactttttgtattttgagtagagacgaggtttcaccgtgttaaccaggatggtctcgatctcctgacctcatgatctgcccacctcagactcccaaagtgctgggattacatgtgtgagccaccatgcccagcccattatgatatttctatgaaattgaagggagtagtgtcaaagggtttataaaagagcattatggacttttttaatgttagaaacttgatactctgaaaacacactgaaacttatcgttatagagtctttttcattttcaaccttctaatttttattttagataatcaaagtaaaatcacaccattttacataattacagtgtattttaaagcttttcttttttgtttcagatctgtaggacatccacttagcaacagcatgccattttcttctattttctacactttaggcatatgcacattagaagtagatgaaaatgcacagaataaaggaaattctgtcaaaatatatggttcctcagcaaagaagcttggagtctgatactatgtgaaatataaacagtaacttggggattcagatgtatcatatttatgctcttttcatgtttaattttagaaaaacacattcatggcaatggtatatgtagatactgctatttctaaaatatcttattaaaatgataatagacaatgaatttcaatattttatattttcagagcaaaaatcattcacaaaacaaaaattccttatgccacatggcatatgtgtatggtgcatgtgttccatgttcgataacatgtgctaagatatataataaaaatttctatttctggtcatcctcacataattatattttgaacatgcatatttagagcgtaaatgtaaagctctatggcactgagagatatgatcatatttatcttcattttaggaaatgtaagtatatgggtaatttatataacctcagctatctacatctctgcatcgttatttttcccccacagtattagggtattcttctccgcaagtgggatatgagggcattaccttatacatgtccccggaaagacagtgcggtcacagccaccctgcctggggaggagcaccggcccacgaggtggggtgggaggtttggctgctcctggcttggtctccaccggccatgggaagccagcttttcctacaaggaggcccacttatattcctcaagcccagtgcatcatgagaagaacgcacttcctgggcactacctccccttcccctgcttttcatttccattgaagagtcggtggtgacccgggaaaaggcaagaaacttaatctgtgcttccaagacagccggaaagagcagcggcccttgttctgaaaaagcacccaagaacccctttagattccgccagcacgttcagggttataaggacgtgggagattgtttccccaacacctgattagttaactcaaacagtacctccagaaaactagttatgtggggtttgcttttttcagtttctaagctttcatagttaaagacatattttcatgtaaaaatgaaacctttaaactgcacttgtagaacctacaaagggtagaaaggagggcctcaccaatgcctctgcacatcttcagccctctaccccatactcagggttcccacagaattcgaagaccttgaaacaagtttccctggaaaacagatgttggagggacacatgtcatcctaatgccccctgtgtggagacgcatcagcagccagggaactgctgaaaacagatgtggaagttggaatccaatccgggtttgccaggggagtaggaagttccgccctgccaccctttttctttgcgggagaggtggtacacagagtgggaattatgtgtaaactacaagcgtcggaaaaatgagaggctaatgcaagaatatggacctgtccggtgagtgcagtgtgtttcctgagtggggctgagtggtttagggctgcgaccaccacagtcctcctcacacacgaccagattccatgaatcccactgcaaatatgcattccctcctgcactcggtaaggggccaggacaaatgggaagagcgttgcaaatacgtacaatccccatgggtctgatggtcagcaactcagagcaatggaaatgatacttaatcgtctctaagaaaactggaattcaacaataaggttacatttcacagactatacacctacagcaactcattagagcctcctgacactggggtgggtggaaaggactaagcatgattgtcccgctttacaaaaacattggactcagaaagggcaactgaaaacggacaacacagaagtcgtggctcctttgctcccgatggcaaacccactagtgtccagaggttctggagcatcttctaggcctttctcttttctgatgctgatagggaatgcagtggccagctaggacaggcaccatggcagagtgggaaactgaaactgccaccactgcccatccccccacctgagttttaaaatttaaaactgttggtgggcaaatgatgaaccacccggatagctagcagattattcagaatagctatatagagccttggtaatcacctcaattctagaatagaaacagcaaatataaaattaaacacaatacaaaatccaaacaaaacatgtccattcctgtgctttggaacttcagctcaacagctcaccttgaattatgtaaataacagcatcacctgttattcctgacttcctttttgtttgtactttttattctattttattatgttgtcattttcccacaggtgaaagggcatcgtttctgatgtcaaagcagtaaacactttgatcacagcaacggcatgggggcggggcgggggcgtgcggtgcaagaatcaggcaggtggtgcggccctccagggaggggaggctgcggcaggcagtgagccgcctccccagcccaggcggcagcttccctccgggccttcctgcaggaaagcagcactcccacaatgagctcatcctctgaccattctagtcagcttctcatcaattatcccagttttgggggctctgagtttgggagttaaactgcataaagatcaaactcaggcttctcaagtttcacttactgtgggagagagtacagtcactggagtcaaatatgttttaactgtttcctctcatttccatatcaaagcaaaatgatgtgaagatggatgaagaaggttgaattaagatacaactccacggctgggcgcggtggctcacgcttgtaatcccagcactttgggaggccgaggtgggtggatcacttgaggtcaggagttcgagaccagcctggccaacatggtaaaaccccatctctactaaaaaatacaaaaattagctgggtgtggtggcgggtgcttgtaatcctagctactcaggaggctgaggcatgataatcgcttgaatccgggaggtggaggttgcagtgagccaagatcatgccacagcactccagcctgggcgacaaagtgagactctgactcaaagaaaacaaaaaacaacaacaacaacaaaaaaaaaccaaaaaaactccaggtaggtattttttctttaaaacttacctttacatatagataaagataaagaaaggcagaaatagaggtaagagagataataacatttttgttagagaatagaattgaataaaataaatttcctaaactttggtttaatcatgttttagaaaggaaacatctgaggccaggcatggtggctcatgcctgtcatcctagcactttgggaggccaaggtgggcacatcacttgaggtcaggagtttgagactagcctggccaacatggtgataccccatctctactaaaaatacaaaaattagccaggcaaggtggtgtctgtaatcccagctactcaggaggcagaggcttgagcccaggaggctgaggttgcagtgagctgagatagcgccactgcactccagcctgggtgacagagcaagactctgacaaagggaagggaagggaagggaaggtggggaggggaggggagggcagaaacatctgaaacacaacactgcagactggttacctatatctacctgtgagtagtaactagaaaacacagacacagcatgcagcaaatcataaaatgattttttattaatttatttttatttttattttttttattaagacagagtctcactctgtcgcccaggccagagcgcagtggtgagaactcagctcgctgctgaaacttccaccccttggattcaagcaattttcctgcctcagcctcccaagtagctgggattacagccgcgcgccaccacgcccagccaatttttgtatttttggtagagacggggtttcactatgtcggccaggctggtctcaaactcctgacctcaagtgatccgcccatcttggcctcccaaggtgctgggattacaggcatgagccactgcgcccagcctaaaatgattttctttttgttactcttgaaaatttatgtgattttctttttgttactcttgaaaatgaagtggggtgggcggtaaaatataacattaaacataacatgaaactaactgtcaactaacatgaaactaactaacttacttggttggttatttctggttgtacagccttctagggtttatttaccacgtggacacagtgcccctatatatcactaatgtattttagagtttcatgaaaacacactgatgaaagaaacagctcatgtttttatgtacattagcatgtttctaatgcagtaaatttttgtgaagatgtgtcgtgtcaactaattcaaccatttaagtaggtctatcagtttatatagaatgaaaatgaagtttcaaggcctatgacaatacacagcagaccactgctatgagctgaatttcattttgcagcttagtttcattttaagattctactatgacatatttagctagagaaagatattaaatccaactcttatgtatttaatataattcgactcaagtgcttcaggccttcacctcactttatgtaaccttaaaatgatggatatgcaacttttgatgtagggctctattttaactgtgagattacgatacgaatggtgattcttttatcaagtaatttatttttaaattctgctttctgtcatttctaattttgttgaaatagtaaatccacttagcagagagtactcatgatttagctcataatttgattcaatgaaattagttcttgtacctcttctgaatctgtagtagtcaatgagtctagacgggttatccatgtgtagatctatatatgaaatgtacatttattgtctacacaaagggtcagcaaacattttatatgagaatcaaataatgaatatatttaaattttgcaggtcatgaggtctctgtcacaaccacccaactctaccattgcagcaaagaatagcactagacacataaatgaatgggctgactgtgttccaataaaactttatttacaaaaaaaaaaaaaatgctatctgtagtttatagacccctggtctaaacttttgctattcatgaacgtagttctagacctactgcatcttcattaactagaagcttattataaatgcatttaaccatgagaaagctgatttgaaagaaagaagaaaaactaaaaaaaaaaaaaaaaagaaatgcatattctcaggcttcaccccggacctactgaatctgaacctgcttcttcaagatgcccaaggcattcaatctgcttcttcactgcccagggcatctgagtgaacatcagcgtatgggaagtgctagtttaaaccacagtgactggcttctatctgggttcacagagcagataagggaggtttcatttgtcattttagctgtctattcaacaataagaatgtctgggccgggtgcggtggctcagcctgtaatcccagcactttgggaggccgaggcgggcagatcacgaggtcaggagatagagaccatcctggctaacacagtgaaaccccgtctctactaaaaatacaaaaaaattagccaggcgtggtggcgggcccctgtagtcccagctgctcgggaggctgaggcaggagaatggcgtgaacccgggaggcggagcttgcagtgggccaagattgcaccactgcactccagcctgggtgacagagcgagactctgtctcaaaaaaaaaaaaaaaaaaagaatgtctgagccctcctgtagaacaacattctctgaattaagtcattgggatatcataagaaaaaatgaggataactgttcatataatttttaaaaattttgaaaatataaactgaagttaagaattactgatattcactgtgcaggtggacactggctccatcattcagactctatgtcccaagtttgaggagggaagaaaggagttttcatcacacaaggaggtggcaatggtacctccatcaatgctaacctgtttcctctccaaatgtggggatataaaataatggtttgcatttgcaaaactgagtgaaatgctctaggtttaacaaatgaatcttctccaaacaagtgctttaaagtatttcctgcaaagaagctgcgaaaataaaatgatactaataatataagcacaactgaacagcaagaaaataagacagctatgctctaattcatgtatattctattcacatatcacattatgtaaaaaataagaattaaatttttaacttaaaatgataaatgatgtgatacacaaatagaacatgcatgaattcgacgaaatacagatttactgataaatctcaatctgatagaattctttgaggtttttcattaataatttcttgaaaccataattaaaatctaagcattgaaaacatgaaaacaaacttctccaaagtttgtgatgttggccttggtgctttaaaatcatcaagaatatttaataggctgggtgcagtggctcacgcctgtaatcccagcactataggaggccgaggcgggcggatcatctgaggtcaggagtttgagaccagcctgaccaacacagagaaaccccgtctctactaacaatacaaaattagccaggcatggtggcacgtgcctataatcccagctactcaggaaggctgaggcaggagaatcacttgaacccgggaggtggaggttgcggtgagccgagatcgcgccactgcactctagcctgggcaacaagagcgaaacttgttctcaaaaataaaataaaataacataaaataacataaaataaaataaaataataaaataaaaaaaaataaaataaaatgaatatttaataataaaattctagaagtctcttttgagtttttcttgtttcatttatttagtttcttaatcgtgaaagaagaaaagctatatactttagggaaattttctccgtattgcaacaaaatgactgaaatcatacaaagaaaatactgtggcaataaattgggatatgtttgcttgtcaaaaacttctgaagaaagatgtgtagaaattattactgatgaagcaaagaagcaaatgttagaacaaatacattccaggtttgacacacgtgtcagctgatggtattttatatattctctcccaataatgaagtacctgaaaaacttatttttcataaagcattaagttgtactgtaagagatgtggtctcaacatagtttcttgcattaaaaactattatttgatggttgtgttggattactgtagcactgatggagtaactatcttgatttgagaaaaagactcaagctgaatggttacagaggtagtactggaagagtattcactcaatgtatgacttacaaaaaagatgctgagcaaagaaattaaagccagaagtaaaaagtgctacaagtgttactgatgtagttaatttgataaaaacaaaccttcaacaatgcagtaggctttcctctgctagttggaataaaatagggagggactataaatcctatttgtaccacagaatttcactccttaattcacagtataaacgttgaaagtactgtgaaagagttactcatttttcctttcagcaagttagtgaaacttttcaaggtcgtcatgtatgattgtataagagatgcattcaacaatgttaggggtcaccacttatattattcctaatgtattaatacaaatatctttactctgaaaacattttccagcagatagcaatgtgtcttgaaagaagtttttaaaaatttgcataaaagtgctacttggacttgtgtagagctttgatatcaaatgactgccggtagaaatgcaatctagcagatattttagaaaagtaacaaaaacagttattttgtcccattaaggtcgatgcgatttttaccagatatagaaatatcttttttataaaaggaagttgaactctggagcaaacactttgaagacagatgtttagaatatttccactgttttatgaatttgttttaaaaaataattgtgtcagttatgaaaatgtatatcctcaccctttaaggagcttggaaatagaagtgcatattctgtttaaaaatctttcaaataaaatgtcttagttttgaacatatggtttaaaaatgcaataatggcccaccttctaaaactgcttgacatcaatggagaaatttattaaatttcaagaaaaatttgaccatttgcctaattatcagatgtgatttgaacattaatatcatgttccagtaggcagtagacaatgtgtccttccatttgggggtattatttttgctcattaactccctccaatatcagcatatgacagctgaatgtcagcgcttaccttctacccattcatgttaacagcttctgcagccctcctagctagcatcgaggtcattttcttactttccaacacttctgttgtaatgcggtacaacctcaatgttctcacaacacattcattcatccaaactggcctcaatctttttctcctcacaccatacggtcttgccatcctctcaactttgcccacctctcctggggttgcaccatgtaccagtagttttcaatctctgggagttgctcttgcatccaaaaccaactgaattagcctttctaggagtggggcatggggaactatatttacattttttccggttgattttcacacattgtgacagttgagaaccactggtgtaggcctgtcattatcaataactgcccataatcttcataatcctccagcatcctttgatcatcacttcataccctcagctcaatccctttagtaaccccacttgaataatttttcaactctactagaaccttcaatccattaaccctcctaacttttcattattcattactccctcctgtccttagctccctccttgcccagcttagacttcatgcttcctcaatcccattgctggatttcttttttagagtacttactgacaaagtctctcccaaacatgggaaaataaagttcattaccctattctgtgcctgcctcaagaagctgactttgggcagacaaaaatttacatccttactaatttaaatgtaatttaaacataagaacctaaacttcaagtttatttccataaaaactgtacttggatatatgatcggcaagaaaataaaattaaaagaaataagagaactacggaaataaaaaagatatattccaaggtaaaaagacgaagaacccaacaaagtaaccacgaagtcagagacgcagagatgtggggtatctgagggtcaccgaagaaaagttttaagaatgaagaatggacaaaacaactcaattttgaaaacagagagaaatggagaccgatgatcacacaaacactgtatatgaatgtacacagcagctccaatcgcaactgccaaaaacgagagcccagatgtcccttattgagtaaatgctcaaatacactgtggtgccagccacacaacagtcaccactgagcaacagagagggatgaacaacgggcgcacagcatctcaaaggcattgccctgaataaagggagcgccttaaaggttacctactgcatggttccattcatccagcattctcagacagacagactggagggatggaggccaggtcaggtggtgctgggagatgacgacacagccacagctgcagggatttgcagtgagggaagagttttgaatcctggttatgccggtagccacagtaatttctacaggtgttaacattcaagtgtacatcaaaaggaaagaagtcaacacaactgtaagacaatttaaaagttttaaaaaatagtgttggttgagagaatgcattcaataaatgtaaacttccctcttgagagttttgttaaagaaactgcagaactcttcagagaatatagggctaatgaaaatgacagcttccaattatctgtaatttttttaatgttttcaaagcacttattattatttattgctaagaagcttaaaataaaatgtagtaagaatagaaaccaaaagaagccccatacatttagtaatcagtatatatttgaaagtacacgcattcgaggagcagctggggtctgaggcctctcacttagactcatggggtcagaacaggtctcgtatcagctctccagctcccaacttctattattctgccgtctcccttgtgtgactaaagcaatgagatgatttattcattcaaatcctatgaaaatcagttcttattttacagtattctgagaatgttatcttacttcctagctttttaaaaggctttcttcctgagatgctatttttcaaaatcagatttatttctgaaagagtccctgttctctttgccaacctccttgtagctggcaaacttcccttttttccttcaggatgaaagaggccttaatccatcttacacaatattcagtgtacagcagccctggtcttggcatcgcatcacactcagtaaatgacacagagcttcccaagatttcagactctggggttccacaacggagacgagagcaaaaggatgtagtcatttaatctatgctatgcgttcagaaaagctcactgagtttgggactcatgggctgaagacgaagaggagccatgcggccggatttaagccttgggggaatgctggagaaaaggtggatgctgtctcagatctaatgtggtcctaacagagttgggaagacagatgtctgtctgtgccgtgaacataacactctgtcagggatttaccctgggaaaagtctgtctttctctattcaaggcactgttgattcatttggggaacagaattctacattccagtcaatgaatctacaagacaattgggaaaggatcacattagtttttaaatagaatttattttccatagtgttatttcacagcaaactctgttccatttcccgcgctctgcctccggggtcttagaacaatcacttcttcagaggaggaccttgccaaccagtacactagatgccaggcggaacttgcctttacagcagaaaatgaagtgggctactgtgatctatcgtcagagtttctcaatccattctcaagataccccgagggagatttcactcttgctacaaagcgggaaataacaacaataacaatcaccgctgtaatagaacacattatgagggggcattcttttaaaagcctttaaaatgctaccaggagagttttatggctgctccaagtcagaacttggccgtgtttaaaagcacggggagagggtgttccggaggcggaccccaggggggccacagcgcctccccttcccctgggggctctgctagttttttggctgataggatcacagccaagttcatgggcgccccgaggaaacactaggcacagcttgtgctgttcaaaacaatcttaccataaaagtgacttttctttttaatctaaaaagcactttttgtaatgagaggttgaagctgagatgccagtgagttctgctagtttctgtttacttccttcaatttcgtattgttcggtgtgtgactgaaaattgggtatcaaaggtaagtattagggtcttctcctgggtccctaaacatgaggcttcgaggtcttacaggcttgaataattcttcagaaactacagcaagtttgtttttagagtgtcttccaagtaccagccctttgtctaacatctctacaccctaaacattcctcccaacctttgaaggactccaaattgtggccagactacaggggatttgtgaagtgcatgcatatctacagggggtaagacaaatacatcttcattctgacatcatctaggtttttcagaggtaaaagatgtagagtgtctgagccacctatggagaaagcagttagatctaattatagctcttgggatagaggagctgctgtctcaagaaaagcaaatatgtaggttaagagccctgttcgaccttcagagatcatgctgttgcacgcttgttagagtgatgcccttgtttagtccttacctagacatctcacaaatattcctgtgaagttttcttggaagtggatggtttacgaaattcccaatacatttcctttgcatcctgatggactctctgggtgacctcttaactataacctttcaagaagcaaattttttgaagtttgcaatcaggcaaacaatcctcactcttcttataaattctcatcttccctaagtgcttatatttgaatattcttaaaataatgggctgggtacaggggctcatgcctataatcccagtgctttgggaggttgaggtgggaggatctcttgaaccccagaagttagaggtcagtctaggcaatgtggtaaaaccctgcctctacaaaaaatctttggaccagccacagtggttcacacctggtatcccagcacttagagagaccaaagcaagaggatcgcttgaggccaggtgtttgaaatcagcctgggtaacacagctagactccacctcaaccaaaaaaaaaaataaataagattagttgggcatggtggtgtgtttacttcctccaattccttttgttcggtgtatgactgaaaattgggtatcacaggtaagaactaggggcattttgctgggtccctaaacatgaggctttgaggtcttacaggcttgaataattcttcagaaactacagcaagtttgttttcagaaaccaaagaggctgaggtgggaggatctactcaagaggctgaggcaggaggatctcctgagcgcatgagttagaggatgcagtgagctatgactgtgccactgcactccagccttggtgacagagcaatatcctatctctaaacaataaaaaaaattaaaaattttaagttaaaaattaatggtcattttgtgaaattggtcagagtttaaggttttagagaatgtacctggtggcagaaaccaatatttagttgttttatgagacggagtctcactctatcacccaggctggagtgcagtggtgcaatcttgcctcactgcaacctctgccacccaggtttaaccaattctcctgccttggcctcccgagtagctgggataacaggcacctgccaccacgcccggctaatttttgtatttttagtagagatggggtttcaccatcttggccaggctgatcttgaactcctgacctcgtgatccacctgtctcagtctcccaaagtgctgggattacaggcgtgagccaccgcacccagcccatcaatattttgttttaaaggtgcttaaaaaagacatatttatacattccccttttatagttaaatcaaaagcggcttttggtatgctctttcaaggcaaaggtatagataatcccagccatcaggattttactgagtgattgaaagtagaggggtaccatagaatactaacatatcagtaattagcttagccagttaaagcacagaattgaggagggctggttatctgttcacacgccatgaagttgagttagctttgttctcatcaggaaacaaagtatcctatagatgcctaatgttagaaacaacaataatatagtttaaatagacactgggctcaaaccttaaacactgtctgtgccttcactatgttatcactacgttactgttgcaggaacagagacagactagaggagcgaccttgggcaagttcttcatcttttctgagcctcagtttctacatgtaaaatatggaccagtcagtagtatccacctcagaaagtgtctctgaaaactaaataataggttctttacacacactgcttggtgcctggcaaataataactcaacaaatataagatgataacaatgatcccatccagtcccagccacaaagtgagcaagaaataatgattcagagttttaaaggagctgtgtctttcttattctgttactctgtggattctgagacttgctcaagatgcttcatgcctttctccttaaacctatctgtgttctcctcgacggatctgggtaagtcatctctccactgccaaacattttggcacacgatttgtcacaaagaagaacacaaaattatttttgaatgaacaaacatatgaagtaaaaagccacattcattatcgatcctattcctatccccagctaagttctatgtgctataaatagtgagttctgtttgcattaaatggtgtgaccttctcctgtgtcctcagatggaaagttctcaccattggagacttttctgacactactctctcttcattagctccactacccacctgccaaccccttcgacctaccaaccccaccatgaactactgacaatctttctgtggccactgccttcaatgactttcccatgaattcctttccttttctactgtggtcactgatttcatgcgagtctcattatttccttcctagaccactatggtattcttataacatctctcttcaccccagttcagactataaatgactgacatattaaccttcctcaatcatagctgtaaaaacattcctactttttccaaacttttcagcagttttccattcccttctaaactacaaccaaactcatcaggatgggattccaatcaatcctcaccacagcacctgcctttccaagcctcatttcccatttagtgctttgcttggaccttaatgtatcttaaatacttcctgttttcaaatcgtgcgttactcatgcatttctccatgtctggaatatgctccttgcgatatacttatctttgaaattcttcccgtgtttgtgtcctaagtgaaattagcctttctctatgggaacgttttcacatgcccttccaggtggtcacagatcctagtgatctcttttgtatgcgcttctagacacattgttgatatctggcttgccatattggcagaattattacttacaaacattaaaatgatatgcatgttggacaaatgtggtccatcatttataactgtatttatttaatgaggatatgatttggtcctgttctaaagtctaattatgtgcttattccaccaatgcttaagatggaaaatttgaagcacctccaaaatctgaggtgggaatagatgttatttctgaagatctgacctcactctgttataacaatattttatagaccgcttatttgttgctatttttaaaactttgtattgactttccttacatttggttgctttcatgaccagtgaaaaaactttcaagttaaaatatagctgagaagaatgaaagagaaatggtaatgtaaagcttcacatttaactgccacagcaggaaaactcaaaattgaattccaaccctagctactaaacaccctggtaaagctttgctccagcttcactgagccaggaaatttctctcttttcccctctgacactagagtcggcaagaggagacctgaacgattggcataagaaaataaataccccttccatggagggctcacagaactagagcctgctaaccgtggctggacttgcttgcaccctgaaggtgctgacaaggtgtgcaggtggccaggaatctaaaacacaacactgcctgggtccccctggggagccaaaccccagtgaggcttctgagattcaggagtacgcccaccccacctgccgttatgccccccagtgaggcttctgagattcaggagcacgcccaccccacctgccgttatacaccccagtgaggcttctgagattcaggagcacgcccaccccacctgctgttatgctccccagtgaggcttctgagattcaggagcacgcccacccctcctgctgttatgccccccagtgaggcttctgagattcaggagcacgcccaccccacctgccgttatgctctttttcacccgtagttagctggggtgcctatgagtgcctcagtaaatatctgttgaacaaacaattgaatggacacatgaatgaatggatgagggcacagtgggggtaaggggcagggttggagggaagaattcttagagaagctgagcagtgaaggaaaaataggaattacccagacgaagggagctggaaaggactgaggggcacagaatcagctgagctggtgggaagtgaacaagtaaagctaaggggctagagaccaccttgttatcagtaagaagggaaaatcccctcagcagtgttggaggagagactaaagtgcgggtgaagcagggcaggtgtgacgggtgatgaataaattatgtgagagaaaatatagctgtcaggtatgcttatgagacactacatttatgtgtagaaaggactatggaagaattgaaggtggccatgaattcttttgccctcctcctattgtaaggtggggtctccccttgaacctgggcagactctgtgactactctgctgaatagaagacagtggaagtgctgctctgtcagttttggggctcatgcctaaaaatgggcagcttccattccctgtcttttagatcactctctctgggtgccctgagctctgacactgcccatttagcagaggccatgtgtctatctcccatcaacaaccatagtggaatccattcttccagccacacctaccaagatgcctgacatgtgagcccctccaccagctgagcaccaccaagcaacctcagtcaacgccatatagagtagaaacatcccctgacctagccctgcccaaacccataacccacacaatgataaggcaatagataaggaaaacacggcatgtaagaactaatggcgacgggaggagctgggggagcaggggaggtgatgtatgcttattttcacaggaccaagcttcgtaagtgtttacaagatggtgttgtcactgttgggggccttttccaatattatactcttgcctgtggttccaggttcatttcctttttctatatctcaattcctgatgctgaaattaaatttggaacaatgaaaaaaaaattccactggatctattttctggtcatgttctattcctagataatataatattcagaggacagaagaaaacccgtcattgttgtagaaaggcgtgttcagcacgcacagtcacgtacagcacattgtggtgtaatctcttgggcatgatagaattggaggacaggaagaaatgattccagtaactcaatcaatgaccgatgatatagttttctgagtattcctagtatcttctaactttctcttctacatgttggacactatcactgtctctatcccttggcctagatagcagctaaacagccgatagctgagccaacagtgttcaatactcatatcctcttctttgttcgagctcaagtgaacacgtggcattcattcctaactgcagcctcctcaagcccagaagcctgaatctgttttttaatttagcagtgaagaatgcagctacatcacatgctatgagagcagctggtgtttcatgcttcttctctcctatcatccctctcattcaacttctcttctttttcagatatgcggtcaccttatttatgtatgtgttgaggctccctttcaagactccaaaaggtctaatccaaaaaatagctgctaaagtattatctcttttttaggcccattttccttctgtaagagaagaatgcttcattgggattagggaacatagtggtttgattgattagactgcttaccaaagcaatacaatttcaaatgataaataacagatgtgggtactctatacagcaattgtttaaaaataattttgcttctatagtacattttggcttagaattgtgtgcttctaccctctgtgataatttatgttgttcatggcatataaaatgtctcccagttgcggccgggcgcggtggctcacgcctgtaatcccagcactttgggaggctgaggcgggtggatcacgaggtcaggagatcgagaccaaggtgaaaccccgtctctactgaaaatacaaaaagttccgggcgtagtggcgggcgcctgtagtcccagctactcgggaggctgaggcaggagaatggcgtgaacccgggaggcggagcttgcagtgagctgagatcgcgccactgcactccagcctgggtgacagagcgagactccgtctcaaaaaaaaaaaaaaaaaagtctcccagttgcatagaaaaggtttttctcatctgctacatcttcaattaaatcaagaacaaatctctgattattgagttttaagaaggatgactataacagaacttgtagcaaattttccatagtaaagcaaaatcactataattgatacttgtaattgatactttaagctgccttgtatttgccaattttccagttaaaacgaatctgtaaaactaagatattacaaatgaatttcaatcagcaatcagatcaatttggcacagtgaaccctttgaattacggaagtattttacttaaagtttcatgaggagtcctgatgcatataaggtagaagggaaatgagctacaggttctagggaatcacgaaggtcccacgagcaataatatttacgcattacatctgtatattgctttacactgttcacaatatcctttcatctacataatttttatgtacacttcacaacagttctccaaatggatataattatcttcatcgtgcagctgaggaaacggaggcacatacaatttgtgctcctcacagccatcgtttatgggaaaacgctgtggctgaagtgggtcatgcagatgattactaaatggatgttttcaaagctaaagttgcgggcatctttgctgacagtggaatgtcattttggtactgggcgaagctatctgggtagacagaacttccagagtgataggtggcaagtttcataaaatgtctgagtttcttagcaatagttaaaacatggtttaatcagatgataattttggtgattccccctccctaggctgcaacagctttaattttaagagaactgaggtagtggtctaattcctattgcaaatgtacgcttgtggcttcttcgtaatttgcagtgaagaatctagaaaagtgatggggaataatgtctaaaaggcccggaacgcttataactcagcataaagcagcctatcacagctcaatggcaaatcatcggttgaagtcaagggcaaaagggcagggaatccaagggctcctctgcccaaagcatcgcttacttgaggttggcagctggctgcacagcagcccttggctgccttcaaggaccggccagagtcagcatcctccaccccgcagctatgtcagcgtggcccagacagtgactgtggagtggggaggccctggccagccaggcacacatttcacagatgaggctgaaatgagaaacttcagggagatatttgcataaatatatttcccattgtccaaaaataaggccagacggaaacatctttcagtatgttccgatgagaattacaaaatgttatacaaatcaattttttacaaaggttattatgaggtttattctgacagaggacaaagcctttccccccttattaaaactgttgctgacatcactctgagggaagtcttgggaaaaaccaaaaataatatgtaggtaatattttgcaattttatcaaatatttaccaaaggctcagataaaagatatccagccacaggtgaagggtgttcatcactgggaagtggggttgaggggaatgtttattttctcactcatatttttccatttgctacggtagcacatcctacctttataaacaaagatatttcccactgcctggctcttctcttcagcttatcgatgatatcacctgcttatcttcgaatgggtcagaatcaacaactacttaccaaacatacactgtccttttttctaaccaattatttttctccagtcatctacaaataggtcttcaaggcgtattcccatacgttgtactatgtgtgtattgtgggattgagtacagcagggaagtcatatattttaaaatatggacaaccgggccgggccaggcggctcttgcctgtaatcccagcactttgggaggccgaggtgggcagatcacttgaggttaaagttcaagaccagcctggccaacatgatcaaaccctgtctctactagaaatacaaaaattagctgggcgtctgtaatcccagctactcgggaggctgaggcagggagatttgcttggacctgggaggcagaggttgcagtgagctgagatcatgccacttcactccagcctaggtgacagagtgagattctgactcaaaaataataaaataaaataaaataaaataaaaatatagataatcggaaaattttagtgaattcagaggaagcagaataaatttaaagctgaaattatcgagaaggtctttctggaactgatagcatgtaaattggactatgcaccgtgcaggtgagatgtgaacgtgttgaaatggaagtgagagggagtccactgagaagcagcagcagcagcatcaggaaacaagacatggagctttgggtgacgccaataacacatgagcctggatgctgctgccactgagtgtgggatcaaattagagaaaattagagaaaaataatatatatttttatatatatataaattatacataatttactatgtaatatataatataaattatatattataatatatattatatatacaacatatcttttatatatattataatatacatattttatatgttatatattatgtaatatattatatattaatatattatatattaatatactgtagtatatactataatatactatatattatatattatatataacatatattatatatgttatatataatatattatatattatagtaatatatcatataatatataatacattatgtataacatatatttatgtattaaatataaatatatacaacatacataattatatataaaatataaatatataataaaataatatgtaatatatattatgtattgtatattatatataattacatatataatatataatatacaatacataatatatattatatataacacatatgttaaattgtatatatatatatatattttttagatggagtctcgctctgtcacccaggctgtagtgcagtggtatgagcttggctcactgcaacctctaactcccaggttcaagcaactttcctgtctcagcctcctgagtagctggcactacaggcacatgccaggacgcccggctaatttttttgtatttttagtagagatggggttttgccatgttagccaggctggtctcaaacccctgactcaggtgatcctcctgacctcaggtgatccaccggccttggcctcccaaagtgctgggattacaggtgtgagccaccgcgtccagccaataatcaataaatttaataagaaaagtaaaaaagcagtttggatcgatggcccaaggaagagacgtagtgtactgagtgcgaggaaaagcatgtctccagtatgtagttaaactgcaggataaatcagtcctgcctgggggagagaaaaagtagggcagaggatgggcaggccagtctccttcacccctgtgcctggagtgagtaaattcgtctcattttcctcatgtccaaatactcacatcatgagatattacaaagctgccaagacaacacacctcagattttctgaaatggtctaaatttcaaatattccactccactctgcccataagtgttctaatgtggaatttttggtctggcatacagaaacaacggcattcagacaacagattacaaacaatggagcgggtctgatttaaacagggagaaggacataaaaatgtagatatttgccttaaaacaaatattaacaagaacaggttttgattgttacattttgtaaattcatcgtggctgcaggaaagactcagtgatttatgcatttgaacagagagaggtatgatggcaaaaggacggtgattttgtccaggaggtaactggagattctcagaaagggtcctctgaccctgctgctgcagctgcgagtgcttcagcttgggctgcgaggtgcaagttcccctggagagagtgggatgccgagtcatggagccagcagcctaacctggcctgcacattaagtgatgaatcagagcgtgtgatgctgacacacggggctttgcttccgaatggtactttcttcccaaacgaaaggcaaattcctctacctccatttcactgcaatgttatcaatagcagactcttcctttgacttgagaaaaataggagaacaggggtttctaagttaacatttccctaaagaccctggctgggcttatgctgcctctttccagcaatgcgtcagggcactcccctggccggccccgtcctcgcaccctctgtgagcatggtctgcttcatcccacttgcaagatgtcaaaacgtcaccaggctgcagaggctcagaagagactggcttctgaactggacttttgattaaatcacgagagaagactgctgtgtagtcttttcaaactgtgtgttgtgattcaataagaagtctaacctaaatgggttaagacggtctaaatatttcatatggttttgcttattcactcaaaataattatatttttaggcagagagtggtttagagtcactggtgtgtgtgtgtaaatgtaatagacatccgtctatctatctatctatctatctatttatttatttatttatttttttttttttgcgacagagtcttgctctgttccccaggctggagtgcagtggtaccatctcagctcactgcaaccctccgcctcttgggttcaagtgaatctcctgccttagcctcccaagtagctgggattacaggagcctgccaccacgcctaatttttgtaatttgagtagagactgagtttcgccatgttggccaggctggtctcaaactcctgtcctcaagtgatctgcccacctcggcctcccaaagtgctgggattacaggcgtgagccaccttgcccggctcatctatgtatttcttacataggacaaaagcactaaggcacagcgttagggaaacacctcatgctgcctgtataaacccctgctctcagaaagttgtgtgctgcaagatgggcaagacggtgcactgtgctggaatactggtttctggctggttctctacttaacaagtaaggcagtgagtcatctgatcctcaccttcaggggaactgttcatcgctattgtctttaaaggcagatgtccgaagttgcccagcacccagtgtctagatctagtgagagggatttagaggagtctttccaaaggagacaggacggaagcagcgttgtgctggaggcggctgcactggctctagagccaactgtgtctttccttcccaagtctgtactcagtgaggagacactggtagcttgaagctggcccagatgggtgtatttacaccacagaaattggcagcaactgcaaagtgggctcttttgtttacctcggagatctgcttgctaaactttcaccaattgttggatgaaagctagttctgagtcaaaaagatgaatatgtcttgaccaaggagacagaagtcaaacttcgcgaaggcaaagaaaagagggtgggaccttcgtttctgagctgacagccgccatctacctccatgcagcctctgatgggaggaaaattgttgtttttagggtgaatgaacatcaaatattatttgttgggttgccaaccaatttagagtcagaaatacagggaaagacagaggacatgagctcatattttattcctaacaaaacctacaaaacacagtgctttggatttgtggtcaaaagggctgatgaatattttgcctcagaatgaaacagatatacccacttaagtatgaggaaagagataaagaaagtgtgcagggaggagcctgggaacacagagaactttctttttttctttttctttttttttttttaatggtcccttttattgtatgtatgcgcagtgctggcctggctttgcaatgcaagtcctcagttaagatatagtcaaataactatggctgcagtttcgtctgcaggatccacaattcagatacaaacagggagctggggtgggcaggagaaacaggagggaagcagagtgcagactgtccccagcactggcctcttcacacagggttggcccaggcagacacaccccatggaatgatgaggaaatgacaacatggtcccttcccacagtgagcctggggctgctaggaaactgcccttcagaacctttgtgcccaggttgtcttggagcccaacaactttttatttggattaattaaaaaataataagttaaaattaagcaacagctgggtcctgaggatgctgagccagcacgcccacagtttggggggaaaaaaatagccagaccttttttgagggggcaaggtgtgttggcttgttttcgaatttgtggggttttttttttttttttttttttttgagacagagtctggctctgttgcccaggctggagtgcagtggcacgatctcagctcactgcaacctccacctcctgggttcatgccattctcctgcctcagcctcccgagtagctgggaccacaggcgcctgccaccacgcccagctaattttttgtatttttagtagagacggggtttcactgtgtcagccaggacggtctcgatctcctgacctcatgatctgcctgcctcggcctcccaaagtactgagattacaggcgtaagccactgcacccgacctcaaatttgtttttaaaaacacattccctgtgaggtaagaccgcagggggtgggcctctgtgaaagcctgaacttgggatgtgccaagtcgcagattcagccaacaccatctctgtatcctcttgggaaacagggactggggatgggggtgtgggtcaagaagagcgtgtggccagcaagatggggttgtgcagaggccgagctgcagagacagaccttgagatgcagaggacaaaaggcaagggaatgggaggtctgatgtggggggagtcaggataggactgcagccgtggaggtcaaggtgtggatggctctgctgctgcattcttcccctcccaatttctgattgacattctaatttttaactcttacacggacttaaattttgtttaatgcttagctacatctccatctgcgaagtttggtccccaccttgaatatccaccacgtaaaataaagaaacaggagcctgggcggtattttcacctcgtctccctccacttcccagctttttttcaactataccattattgttacattttcaagatttgttacatttacgttttattctgttaacaaccatgattacatgccttgcctctgagtggatgctggaagtgaaatagacacactcgtgacactaactaactacgtttgctggctggagcctgaaggtacagtctcattcttgtgttcctaaacctgggtcaccccaggaggaattttctgaaattcagatcaaacgaataattattccttacactaactttgaaaaatctttttgctgtatgtctatggacaggtttctggtgtagacttttgcttttcctgagtgtcaaagctgcctttccttcttcttgttgacagaagcaacacagggattccccacgggagtgctcagctctcccagctcattcagtgtctcgttaactgactgctctaagttgactccttccttttcagatccgcttccaagctgtctttctggaattttcttactgaatcccctgccttcctttatcttgggttttatttatatatatatttttttaaagtacattttcggccgggtgtggtggctcacacctgtaatctcagcacttggagaggccgaggtgggcggatcacttgaggttaggcattcaagaccagcctggccaacatggtgaaaccctgtctctaccaaaaatatgaaaattagcctggcatggtggaaacggctgtaatcccagctacttgggaggctgaggcaggagaatcacttgaacccgagaggtggaggttgcagtaagccaagatcacaccactgcatctaaaaaaaaaaaaaaaaaaaaggacattttcaggtatttttttcctcctttgggaattctttttaaaatttaatttaattttaaaagagagacagggtctcactatgttgcccagactggtctgtaactctagtctttcagcagtcctctcacctggggcctcccaaaatgttgggactacaggtatgggccagtatgctcagcctgggaattcttttcattcattctgaattgcatgtgtcttccacattgttgagtttccttgtcctttactgcagtccatatcatataataatatcatggtatattttttgaaaagttgcatggaagataacaatttctggatgctccatgtctgaatgtgtcttaactcgtttacacatttgataagaactggaataggtacaggaatccatgttgaaagaaacttcttctcagaaccttgctgacatttgcccagcttccaccatcagcatcagagggctgacagcaagctctgtgcctggcacaggacatggcttctcattgctgtagcttaagggacctctctggccaaggagaagccactcgactctgggactccatctagctttctcttggttagatgatttccagtagcttcttttgctattaattttgtgagtatttttacaaccttctagggatcagggtgagttatacccaagtgtattagtcagggttctcaagagggacaaatctaatagaacatacatatatatatatatatgtatatatgagtttatttagtagtattgactcacaagatcacaagataaggagcaaggaagccagtcctagtcacaaaacctcaaaagtagggaagtgacagtctagccttcagtctgtggtttaaggtccaaaagccccgaagctgaagaacttggagtctgatgttcgatgccagaaagtttccagcacgggagaaagatgaaggccggaagactcagccagtctagtccatccacgctcttctgcctgcttttattctggctacactggcagctgattagatggtgcccacccagattgagggtgggtctgcctctcccagtccactgactcaaatgtttatctcctttgggaacaccctcacagacacaccaggaatgatactttgcatccttcagtccaatcaagttgacactcaatgttaaccatcacaccagatattcctctgagatgtgaaattttcagtactattcctatggctttgttcttttctctgcccttatggataaaggatacacttctgtatttcattttggagaacattatttcatgctggttctagatgaatttcactggtttacaagaaacttcactgttctttgaataaaaataaggcaaaatcgtcaagggttttgagactatttggaaaaaaaaagctcgaaaagaatgggatgcacaaactagttattgttgaggcaatcagcatctcaactcctattacaccttaaaaattatttccgcaacataaccacacttgcaaatctcttcatttttacacatatatacacatattctatattagcactgaattttgctaacagctcacatttgccaagttattctaacttgtcttatttatgttcaagttttcatctttcccctactgcttgaaataaaactttgtgtcattgatttatttttgtgaatgtgcactggggacgtaagagaggaaaatagcaggagaagtgtaaacaatggcatgaaagtgacgtaagacgtgagccaggatggtctgtagagttcggactgtatttgctgagatcgaaaggaccaaacagcgctctcagcaaaggtgcaaacttaagaaggctgcaattattagaacataaagaatttccggcgaggcgcaggggcttatgcctatcgtcccagcactttgggaggccaaggcgggtggatcacctgaagtcaggagttcaaaaccagcctggccaacatggtgaaaccctgtctctactaaatacacaaaaattagccgggtgtgggggcgggtgcctgtaatcccagctactcaggaggctgaggcaagagaatggcttgaacccaagaggcaaaggttgccgtgagtcaagatcaagccactgcactccagcctgggtgacaaagcaagactccatctcaaactaacaacaacgacaacaacaacaacaacaacaaagaacataaggaattttccaggaaagtgaaactcaaaacttgacatttgtgaaataaatgtgaacagcagtattcaatcaatttagctcggaaccgtcaatgacctggggagcacgtgagagtcagtggggcagatttccggtacatggacgatacctagagaggtcctagtctgaaagaatcttccggatggaaacagggcatcttgtttatacaagcccaggtctctcacagcaaattcaactgtatgttccttctcctctcctgccagattgccagttactttgaggggaggaatatcttctaaattttctgaacctcctggaatttgacatatcgactgtattctggatatttaatgaattctgtttgatgacacaggtagagtaaaatggtcttaaatcattttgacagaggtaaaaaacattttattccacactttacttattctttttctgcctgaagtgattacaagaaaaaaaaacgaatagtttaatttaaaatccagattggtatgtaattatcacaaaatcagtgaagttcttttcaatgaaaaaaaaaaacaccagttctataatttggacagacaaaatttagcaataacaaaattaaaggtacaacccttaatctattaattatttaaaaatgcatctcgaactatttttctttttatttatcccttgtatcaatagacatttaattggcaaacaagaacatggaaaaatataaactgtaactcactgtaataaactctaaatcaatacaaagagtctaaaatgtgttttgacgtccaaatgtagctacagccactgtgtcctgtgttctataacacagagaaataatacaaaatgattaaaaaaataaaataaattgaagagaggcctgtaatgtaaggggcgctgtgtcactctcaggcagcaacgtgagccagtgagtcaatgcacgaggctctcctgtttgttggtacttcctgttctttctttataaaatacatggagaactaaatccgcaggatgctcacacaaatgattcatagagaaagcttaaaagaatctcacgttgttaatgagcatcacaataggctctgctcatgagaaggcattttgtttccgcagaaatgttttttcttactctgtcctgattttgatttctgtttaaattcagtaaacacattaccaaaatttaaagaaggtgacttgttttccccaactctcagttcaccaaaggtatttcatctatttgttctgaaaatgcagctgctctctagatgtatgtgtgccctgataagaaatgttttgtgtaacaataaaaatcatttcttttgattaaaaaaaaagaatctccagtcgtttacactggaaaacgagagagagcgcttgcatactttcttcacatatattaatggtgggaagaaaatggatgtagagtaatagggcctgaggaactcatagaaggaaccggacatgtatgaaaagatgatgactgccaggtggcactgacgcagcctccagcccctctatcttaggctttcgggacatgtgctctcttgcttccgctggacagtgtctcaatactttcctccctaaaagcaggttttaccctggtcagaggtgctcttgaggcccaaagaagagatttccacaaatagtctataagagcatgtacatactataactgcttgataagtgaatgaatggatgactaaatggagtcaatgctttcatgacctaacgttgtggttatgggtgtcactattctcttggcaatagtgcaatagtgaaatagtaaaatagtctagatgtcattaagaaccttcatggaaaacatgccggtgggggaaggaaaacaacattcatgattcatgggaggagataaaatagcaacatgaaggggaatttggaagatgctgacgctagccctcatgggtgattttgaggggttcaagtcttcagtggaggaagtaactggaactagaattagaagtggggcctgaagatgtgactgaattgtggcaatctcatgataaatcttgaacagtttacttcttatggatgaacaaagaaagttgtttcttgagatggcgtctacttctagggaagatgccgtgaacattgttggaatgacaacagaggattttttgtttgtttgtttgttttttgatacagagtttccctctattgcccagggtggagtgcagtggcacaatctcgactcaccacaacctccacctcctgggttcaagcgattctcctgcctcagcctctcgagtagctgggattacaggcacctgctaccacacccggctaatttttgtatttttagtagagacggggtttcactgtgttggccaggctggtctcaaactcccaacctcaggtgacccacccagctcagcctcccaaagtgctgggattacaggcatgagccactgcgcccggctgaaagaatctgaatattacttgtagttagttgataaagcagtggctttgacagggtttgagaggaatgactccaattttgaaggaagttctaccatagatagaatgctatcaaacagcatcatggtatagagaactcttctttcacacatgaaaggaagactcaattgatgtggcacatttcattgttgtcttattttaacaagtttccacagctgcccaaacaatttggcagtcaacaccctgcctgatcagacagcagccatcaacatcaaggcaaaaccctctaccagcaaaaagattatgacttgctgaaggctcagatgattgttagcatgttttagcaataaagtatttttaaattgaagtatgtactttcttaaagaaataatggtaataacacttaatagactacaacatagttagttttagaagcactgggacaccaaaataactgtggacttgctttactgtgatgtttgcttcgtgagggtggtctgtaactgaaactgcattttctccaaggtatacccatatttaaatagaaaatggactttcttttactaaggagaatggtattttcatttgtctcatttttggagggaaactctagagaagaagccaagacatgcccactgtccctctcccatcctatggaggctgcccagtgccaaagaggaagtggtcactctggtcactcatatacacacagctggcacaattgtcacagtcgctcccctttgtgacaggctggtggaatgacttacagttcagcccaccaaatataatacagatgaatttagtcattcagcctcatgaggtcacacttttactgttttcaacaaagcttaaacccccttcccacattctgtagaaaaaaaagtgatgacttccggggttgttttctaggccatttctatcagaactcctgcaactcgccagatatttcaactcttcggaaagccaccttgtgtccattttatgtcccccaaccctggataatgtctctgttttccatgtacctaaaaacattgcaaaaaaatctgctattcaacatatcttggtgttattgtcactggaggaaaatggaaggagaaaagcaaacagagagtatggaaataaatacccgtcagtatagaaatgtagtatatcataaaaatggcacttcaaaccagtgggaagcaatgggtcattccgtaatacagtactggaacaggttaataaaaaattacaaagtttaatttagatctccattgtattccttaaaaacaaagtaaatcccaataaaataaaaattcaagtgcgaaaaatcaaagaaagcatcaaaagtataagaaacgatgggccaggcatggtagctcatgcctgtaatcccagcactttgggaggccgaggcggacagatcacctgaggtcaggagttcgtgaccagcctggtcaacatggtgaaacaccgtctctactaaaaatacaaaaattacccgggtgtgatggcgggcacctgtaatcccaactacttgggaggctgaggcaggagaattgcttgaacccaggaggcagcagttgcagtgagtggagatcacaccactgcactccagcctggacgacagaggagaatctgtcctaaaaaaaaaaaaaaaaagttggatgatgaaaaattttctaagattgcactggtgatatcttccttgagcggacgttaaaaccagaagccataaagtagtaggtgcaaacctctgactaccaataaaatgtttaaactatttctatggcaacgtaacaaaagcagaaataatcttcttgtagtctgctctactggtggtcaccagtaaaccattcttggcaaaaggcatgcccctgtacccccccaccctcgtgaatctgagctgggcctgtgactggccttcaccaagagaatgtgacggacgcttcagaacttggcctcaggagtgctggtaggtcctgcatttgcactcctggacacccctgaactaagaagtacagctgcaagaagaacacagcacgtggagaggtggtatggaggggccacgtggagatagagagccctggaggctacatggagaagagcacagaacccagctgacccaagaactgaggccccaggactacagccccagtcaagccattccagttggctgccagccatcctcacctcctagctgagctccagacacctaagcagatgaggtctctgagacaccacatctccagcagaactcatacaggaagagcaccacactgtcctcatggggccctttccaaattcataaccctcagaattttaaaaagtaatatgttattttgttttaaagacatgggataggccgggtgcggtggctcatgcctataatcccagcagtttgggtggacgaggcgggtggatcacctgaagtcaggactttgagaccagcctggccaacatggtgaaaccccatctctactaaaaatacaaaaaattagcctggcatggtagcaggcacctgtaatcctcccagggaggctgaggcaggagaattgcccagaggcggaggctgcagtgagctgagatcacaccactgcactccagcctgggcaacacgagcaaaactccatctcaggaaaaaaaaaaaaaaaaaaaagacatgggataatgtataatgtggcaatagatagctggaacacccaatagtcaaactcaaaagaaaatcagcaaactgggaaaagactaagcaatacatatgccaagagactaacgtcttaaatatgaaaaaagagcttatgtgtaaataagaaaaaagtcaactcaatacaataggactcaaaacttactgcaaagaacaaaaacataagtggtcaaaaatcatttgaaatatgttcaagctcactcaatcttattgaaaaactgagtaatattcttttacttgcctattggattggaagatatttaaaagtttaacaatgaataaaattaaattaagtgaaataaaataaaataaaaagcaataaccagaatggaggtgatgtgaggctcatgaaccacttgttgagagcaatcattgtttacaaaaaacctactatgtctatttattcattgacccagcaatataatttctaacaatatatcttataaacatgatatactcaaggatacagcgatacatgaactgttatggactgaatgcttgtgtctcccccaaattcatatgttgaaaccattacctccaatgtcatggtatttgtaggtggagcgtctgggaggtaattagatctatatgaagtcatgaaagcagagaacccttatgggatttgtgtccttatgagaagaggagaaaccagagctcactctctgtcatgtaaggacagcaagaaggcagctgtcaataaaccacgaagagagccctcaccaggtttccaatcggctggagccttcgacttggacttcataccctccagaattgtgaaaaataaatttctattgttcaagccactcggtctatggtattttgttaaggcagccaaagcagactaaggctagaacaaagatgctcatgaagcatcatttgtaatatcttaaatgttggaaaattctacatgtctacccttaacaacctcattcaataatttgcaacacagctatacaacgtaacactgtaaagctttttatcagaataaggtagtattatatatactgatctctgaggatgtctagatattggtaaagtgaaaaaaagaataagctgtaaagtagaatttactgtaggattctatttgtgaccttttatgaaaaagatataggcacatgtatattacacacttgtaggcatgcatacttctatattatatttctaagtacacattgggagctattcatggtgattatctctgaggatagggagtattagaatggccaacttggtatgaatagggaataaagaagacttactttttatactacacccatctgcactgttttttttaacgtgaaacatgtaacttttattaaaaagaaaaaaaaattgtgaaatgcttcatagtcctttgtgtcaagagctctgccataacccaaagcacaaaacctaggaggtctgttgatcttaatctacactttggcctcatacatggatatagcgtgttggttggtaccatgcaaacactgtccctcctttctgggttggagaggaatcaggagtgtttggagaaaaagaaaagcacatcccctgaactggcaagcgatactcatgaccatcagcagccacaggctccattaacaagcaggagagggatgtttccctggtctcaccagcaataaatgtgtctatggggaagcaaagtttctaagaagtgcttaaggaactctaggcattcctagacagcccaggctctgaatttagatgggagaaaagtaggcagatatcactgaaaatcatgttgttttaaaatgttcttttttgcgttgggtgcggtggctcatgcctgtaatctcagcactttgggaggctgagacaggtggatcacctgaggtcaggagttcaagaccagcctggccaacatggtgaaaccccgtctctactaaaaatacaaaaaattagctgggcgtggtggtgtatgcctgtagtcccagctacttgggaggctgaggcaccagaattatttgaacccaggaggtggaggttgcagtgagccgaggttgtgccctgcactccagcctgggtgacagagtgagactctgtttaaaaataaaataaaataagatgttcttttcaagtttatcgattaattttcatgaacctgaaaggtgtttgtgaaagaacaccctattcttattattctatgtacaaagagaatcatattcactcttaaccctcacatcaagacacttactttgatacatttttaaaggcttgaaatccaaaatagagttttaattttcttatcaaaaaatttcaagcctttatatcaaggtggtaggattgttcatctcttttgtgtcaaccctgtaaatgtgagaactgtaattgatctctgctatgcgtgagtgacatggaagaccctgaatatgttgtagaaccagaacattttcattacctacatcatgctgtgtgtcaaacaggcatgccaatcagtttgtggatctaagcaggccattgcacatgcaaacgtgtatgataggtatgacagtttaacttagcattctcatttggaaaacattctggaatatgtgaataagtaactggaaaattcccaaatagacatagcattgcggttcagaaacatgaatatttaccattgacagagagcaagagagaaagcatgcacacaagagagggtccccatcaaactgaacaatgtataagcaagaatccacagtgcaaattggaaggatgatcatggctgcgaggctacagttatgactaaacaaccattgataaatttattctcgactatatcaaatgataaagaaaatagctatgaatttactgaaaaaaaagcattatccctaattaataagaaaaaagaaaaagaaaggaacatccagctcaaacacttgtccaccaaatagcacaacagatattgagaacactaatatttggttataaaggacaagaaattgttaagaagaaaagtaatttccactttggtatttctggccttatgaagacataagatacattgggaggattatggaaacataagtgattgagagaaaatctcatgagaaacttaagaagatgggactgtttatgaaataggaataccacccataattggacaaagacaataaaaaatttttctaattacagtatcattccataagtatacaatgtgtattatcagtaggtgaatatcataggccaaatgaaaagcaaacaagtaagtaaaaatattaagtagaaaaatattctcatgagtgattgatatgattacatttgaattttagaagatgtcattagtggagatgtgaacagaatcaggatttaggatgaagtctgggaaagctgttatgaggctactgcaatggtctgggctcttttggcatttcctctttaagctaaaattggccctttacttactatttattctcttttccctgatatttgctcttcttgtttttaaaaaatccttcaatttaattttaaattttatggctttcctcttcttctacccggttccgttccttactctgcattgcaaattacacagatagtataaacatagacgacgttagtctttaattttaatttttctttttctttttcttttttttgaggcggagtcgcgctctgtcacccaggctggaatgcagtggcgcgacctcggttcactgcaagctccgcctcccgggttcacgccattctcctcctgccccagcctcccgagtagctgggactacaggcgcccgccaccatgcccggctaaatgttttgtatttttagtagagagagggtttcaccgtgttaggcaggatggtcttgatctcctgacctcgtgatccgtctgcctccgcctcccaaagtgctgggattacaggcgtgagccaccgcatccagcctaatttttctttttctttttttgagatagagtctcactctgctgctcaggctggagtgcaatgacacgatctcggcttactgcaacctgcagctccagggctcaagtaattctcctgcctcagcctcccgagtagctgggactacaggtgtgtgccaccatgcctggctaatttttgtatttttagtagagacagggttttgccatattggccaggctggtctcaaactcctgacctcaggtgatccacctacctcgtcatcccaaagtgttgggattacaggcatgagccactgcacccggccgattttttcatttttatttcaaatttctgccatatattttggattctctctttaaaaaaaaatctgtaacattttaaaagcaattttggcattaatatttgtggtagtaataaggttttacatgatggattaggatatgatgacaatacaattcttaaggttaacacagccaggagaattatatggccaagtgaatagatctttagacctctggctttggaagcttcttatgaaatcctaagagatttacagacaacaaatgtttacaacatttaggcacacaacagcataatactagacacaaatactaagcaatattcagagtccaaatacagccatactcattttgcttgtaaaaatttagtttttcaatttgcctcctgctgcacagaagtaatatagcaggtgattcatttccacgtttgaactgctgttaaccacaatgggtgaaggagagcgagatgcaggcttcgctgatcatgtcacccttggaagaaaggggaataaaattatagggcagaatgacctatcatatttccttgacaggtgctaattcactttgatctatccttcaccataatttcattggtggggaggacatacatatttataagtgtggaaacaggcgactgtttttctgtttgcaatttacaacaacaaagaattcatttcaattttcatattagaagtcccaaggtgacccgggagtagataccagtcccctgctgtgcgggatttctaacataataaggaataaagcacaacaacagtacattgtgacctgggctcatgggtaatcaattcacatatttaccatggaaacaacagtaccacgcagaacatcgtcattgcttcaatttgctgacgaaagccctctagaacccaggaagagtgtgcgtgaaagctggctgattaatctgacttacttatgctttgttaaagagttattgtcttaatcataattaacactaaatagttactcatggaaaagctgcaagagagattcagctctacctcttatgaggcttatggtctgtgattttcaaaccatgagtcatcgacaaatatatacaatgaaacagagattgagccaaatgggaggacaccagggttttgatttcagaagtcggatttagaatttcattttctatgcaaaatactgcatggtatacaaacacctctcaggttatataatcatggtgcattatctttgtacccacaaaatgcttaacgaactcagtggggtgagttctttttcttctaaggaaggaaaacaaaacttctatgcacgggaaaacaagccagtgcacggcatgactaacacaatgccatgtaattaggcaaaagctttgaatagacatttcacttaacgagatatacgactgggttaataagcacatggataagatgtttaatatgactagtaattagagaacgtctataatgaacaagttgacaaaatctagtgtcggtgaggaagtagagaaactagaaaccaacacccccgctccccaccaccaccttttgctggtgggaatgcaaaatattgcagccacttgaaaacattcgagcaatttctgaaactgttaagcacacgactgttagagccagcaattcctctcctaggtatccaactgaggagaaatgaaagtgcagatccacacgaagagttttacgccatgttcacagtgtaactcacaataacaacgcaaatgtccatctactggtgaatggataaacaaaaggtatcgtatccttgcaatggagttttgctcatcaagaagagtttcacgtacaataactttgagaaaaatctcaaaattacgctgagggaaataagactgacaaaagattacatagcatttgattccatttatctaacatttctagaaaaaaagacaaaactctataagcagacagttgatcagtgtttgcctagggctgaaggtgggagtgaggatggctcaaatatgcatcgaaaaactttttagggtttatttttctgaaactggattgtgataactggttgcccaattataaatgtgtattagaaatgatcgaactggacatatacctggaggatttgcatgatgtgtaaattataccccaataaagttattggaattcagtaagaacatagcttgctctagatggttaaaggtttcagttgttcctgttataggatcttaccattatgaactgtcatcttcccaaaccagtgaagtcttagcaagtgctggaaatacaaataggttcacaatttaaaggggcagctggagcctcagtactccatcagtaatatgtattaagacatgccacagagcaaatgctcacagtgaaaagtgctggggagactgtacaggggtctactacatgtgattaaagaactgtgtcagatggcatttcaacagctttgtaagtgatgacagggacacaggtaaagttgaaaaatcacattcctatcctccttaggacagatagtaagcatacgtttttaattactgtcatgagtcgcttaaccacatggatacattctgagaaataggtctttgtgtggacatcacagagcatacttacacaaacctagatggtatcacctgctacaaacctagactggatggtagagccttttgctgctgggttaaaaacctgtacagcatgttactggactgaatactgttggaaaccataacaccggctgggcgtgctggttcacgcctataatcccagcactttggggtgctaaggcaggcggatcacttaaggtcaggagtttgagactagcctggccaacatggtgaaaccctgtctctactcaaggtacaaaaattagctgggtgtggttgtgcaaacctgtaatcccacctacttgggaggctgaggcatgagacgtgcttgaacctaggaggtggaggttgcagtgagccaagattgtgccactgcactccagcctgggccacagagcaagactctaccagaaaaaataaaaaaggaaaccataaaacaatggtaagtagatgcacaatgtctatctaaacacatgtgaacatggaaaaggtacagtgaaaatacagtataaaagataaaaaacatggtacccctgggccgggcgcagtggctcatgccggtaatcccagcactttgggaggccgaagtggatcacgaagtcaagagattgagaccatcctggccaacatggtgaaaccccgtctcgtctctactaaaaatacaaaaattagctgggtgtggtggtgtgtgcctgtaatcccagctactccggaggctgaggcaggagaatcgcttgaacccaggaggcggaggttgcagtgagccaagatagcgccactgcactccagcctggcaacagagtgagactgtctaaaaaaaaaaaaaaagaaacgtacccctgaataggacacttactgtgaatggagcttacagtactccaagttgctctcctgattcagtgagtgagtgaatgtgaaggcctaggacattattgtataccactgtagacgttatgaacactgtacatctaggttacactaaatgtatacaacaaagttcctcaataataaactgaccttggcttactgtaactttctgactttatacacttcttaatttttaaaactctgacacttgtaataacacttagcttaaaccacaaacacattgtacagccatataaatatattttcttcctttatatctgtattctatatgctttttttctgtttctaaatttgtaaaactttttaaactttttgttgaaaactaagacactgacacacacattagcctaacagggtcaggatcatccatatcaccatcttccacccccatatattgtcccactggaaggtcttcaggggcaatgacatgcatggacctgtcatttcctataacaatgccttcttctggaaatcctcctgaagatcctgcctgagactgctttaccgttaacttatttataagtaggagtatactctaaaatagcaataaaaagtatacaatatacataaaccagtaacataattattcatgaccattatcaagtattatgtactgtacttcatatgtgctatacttttatatgactggcagcacagttttgtttacaccagcaccaccacaaacatgaataatgccttgagctactacattgcaacagctacagtgtcactaggcgataggaatttttcagctccactataattgtatgggaccaccatcctgtgtctgtcatggactgaagtgtcattgtcattatacaacaccttactgcactcaaatgacctcctgcttcacccgtaaaggaaaatcatcatcagtgtagcctgtagctataggatggtgaagttcactaacttgccagccagtcactgtgttgaaatttggtagaacgtcatcctctgagccactcctaaatcttagtgggaacacaagtagcacaggataggctgacaactgaagtgaaagcagatagaaggaacttttcaacctctcttgtagaacaacatttcaattaccagagaaagtggattctctgggatgctacaaggcagatgtcagcctcaattggttaaatctgagaaacattgactgaatttctcaaaaacaacagggaatcctgcatctaattccaattcatgtttaaaaagcccagaaaattaagttacatacaataaggcaagtaatacattattaccattttgttgccactcaggattcaaacaaaagagactccaataaaccccctgttgtcaaatgcagaagatgaaattggcagagtgtcaacttctacagaaggcctcacttctcttccttgttctagctatttcctgcttgtcttttaaaattcctattacgtcttatggttttgaaaaatattttcctgacccctcagtgtgtccccactttcagccaccttacttacagtctgattcagaggttccattgttttgccctggtatgcaaaatggatgtctatcatttctcacattgcatgcaaacaaatattagtttacttttttctctcatattagaaatctgttaagggaagggggaaatacatatgtgtgtgtatatatacttatatttgtacacgtgcacatacatataagtaaatttgcttaattacctaggtgctgaaccagaatttcataaattatttgtggggatataatataagtacatgaggtaattcctacatgaaatggagtaactaacataggtcagcattaagttgccattaaaaagttccaaagtatgcattactcatgtttggataccatgtaacctgtaatgagatctgaattctggaaatacaggcaatgattacaggagtctaagaataaagaagccagcataagcctaaaaaataaagagaaggttttggagaagttggagttttgtttttaattttcatacatcttggattttatagcaaactcaattaactaattaaaaattagactcaattaactcataaaaaatgcatgttcttatgctgtgatcatatttcacaattgcagtttaaacaaaaccatgactcactatgctgacgttatgtcctggtgctgccacctatggacaccaggtcacagctccctccaggctggcaggcatcttgcagcatggctggaggatcctcccatgtggcctccctgttcctgatctcagcagcttgtttcccacaccttcaagtgtacatttcctcaggtcactccatagcatacaatcctccactgagtgaatccccatcacacatataaagtagattctgcagttgggggccagtgccggggctcatgcctataatcccagcactttgggaggctaagtggggcagatcacctgaggtcaggagtttgagaccagcctggccaacacagtgaaaccctgtctctactaaaaatacaaaaattaactgggcatggtggcacacgcctgtagtcccagctaccagggaggctgaggtggaaaaattgcttgaacccgggaggtggaggctgcagtgagctctgatcacaccctgcctcaataaataaataaataaaataaagtagattcctcctcctcttctttttatttgcaaaatattgcaaactcataaaaagttattaaaattgtacaaaaaactgttcttcacctaggttaaccacttgttatcaattttgtgagatttcctctttctgtctctacttacatataatgaatataacatagttattactatatgtataactgtattgttattgttgctatgtagcgtctgagttcttagagagtaatttgcaaacatcacgatcctttaccccctaattgtttagtgcctcctaaggaggaggacactgttaggtaactgcagtacaatcacgaagttcagctggtgcagattctgaatggaacttgcgagacccttcagaacgtggcccacctggcttcctctttccctgtctgcctggtactctttgtactttgcctaggaaagaaacggccattccttgctatcctccattgctttgtacacacagcccctgcctttcaagcatttttcccattctctttcctcagctgagttcactattgtttctgtgtctggacttgaatccaggctctggcgcttcgtagttatgggacaatggggaagttacttaacctctctggggctcagattcctcgtctgtgaaatgggattagaaaaagaaactgtctcctgggatttattgtggggttaaagtcagatattttaggtcaagagctaaagaatacctaggaaaaagtaagcattcaaaatctacttactgcccctatcacactaccatcatcaccaatcacttctcgggcctcatctttaacctcacacactccaggaaggcctcactgatcctcaaatatgaatccaatggcccagactgtgtgcttaggtaccctgcattaaaatgacctactataatttactggaagtattttctatttgtttcctcctagtttgcgtttaatgtcttttccacagtgactaagtctgacttggtcaattttgaaaggctagtattcagcatagtgcctgacacacagcaagattttaataactactcactgaatctataaatgaatttcagtaattcagaattcagaatgaatttcagagtctaatggccgaaataattttcccaaactcggctgacaattgatttttcaggggaagtccagataggttaagagcagaaaaggtgactcattcttcaggggctcaacacccattccccactgcccagggaaagtgtttgcatgccatgtgaaacttcaagcaagctagtttttaagctgttaaaaaaaatgagggaattaattgttctgagcagtttctcaccatctccacagcattaaattcaacattcgatttgcttttcaaacacagttaacaggcaggaagatgagataatctatttcagtgaaaatgtaaactgtggaagtaccctgtgagtaaactaggggagagagtccctccacaaacaagaaccacggctgcccgtggggaggctgggaacatgcccagaattcacctggcatcactgttgaggtcaaatgttaagacttgctgggaaaaaaatattgttgttgttgttttttggtgaatccagaggaaggaaacatattaaaattctaatgaatgactaaagtgaaaatgctttacaggcttatgaatgaaaattttcccaaatttttccttatataaagattatgcatacaaatttaaataccacaaaatccaaatataaaacaatttatgatgggctaatataaaattacactttttcaatatgatagaattgcatctttgactttatagaaatgttgtttaaaaatgtctttagaggtcaggtgcggtggttcaggtgtgtaatcccagcactttgggaggcagaggcaggcggatcatgaggtcaggagatggagaccatcctggctaacagggtgaaatcccgtctctactaaaaatacaaaagattagccgggtgtggtggcgggcgcctgtgatcccagctactcaggaggctgaggtaagagaatcgcttgagcccgggaggtggaggttgcagcgagctgagatcgtgccactgcactccacgctgggcgatagagtgagactccatctcaaaagaaaaaaaaatgtctttagaaactcctatttatatacaaactgatatctaaaggaagatccattttatacttcattagtgtaactttcagttacatggagttgtaactaagtgcattaaagatacaattgaacttattcccagatgtcaagtgtccctgccaagatttaaatccaatcacaatatgaatgatgtttaggagattcaatggggataaaacaaacaaacaaacaacatggaagacatcctccttctttgctagttgatgatgaagaaaataagggcagctactatgctttactaggcacttaccacatgccagacactgtgctgaactctttatatgtctcgtctcctccccacgagactcatttaaggtttgtatttattattcccaatttaaaattaagaacattggagctgagagaggtcaaatagctttctctaaaccactcagctagtaaacggtgcagtagaagctgaagtaagttctgtaatctattttaggaacttttcaaaacgaactgttctgtttgaaagttacggagagtctacctctaagtaaatgggagtggtgaacacttagaatgacaaggaactgccacttcgttcttgacctgtagaaaggcagtcggtgagggagacatgctatgatctattcggtagtcctaaaagagactcatacttatatacctaaatacgcaggtcaagacctgggcgaatttccctattatatattcctgtagctgagtgatgattcctttgtagcgggagtcgcagattcagtttcatctgtctgttgtggttattagactgaggtcatctccctcacttgacttaccctccaagaaaacagggaacttatctggcttggcgcacactgtctcttcagccctggagcactttgtaaagatgaagtactgaataaatatttcagaatgaatgcataagggaaatgtgtgttcagagggctgcagcagttgagttcttaatacatcgaccctttcaacacattcctggggcctggtgacctctaccaaggctaccttcatgttcgtcttatccctgttgcagcaatttgcaaattgaggaatatataatctagtgagttttaggtctggttgcactctagttgcagtctaagaaacaggtgaaagagcatattttaaaatgaaaacataggagagttctttgaaactgaatctaagtccaacaagcctacgagagatataactgtctttctctataagacattcaaatgagctctgaagtggtacaacaagggcaagtagtggcaaaccctgggaatcttctagcagaggcaaataaattcagcctttagagaaaatccctctaaattttgcttctcctttttaaaagacaataagttacattttgataaacaaggctcagataaatgagaacatttaattctaaaggatacctgttctagaatgactggtgggcagaaaattacagttttagatacttcgtgtgtgtgggagaagatactatacactaaaatgaaaaaaaaatacacatacacatgggagttgttttctagtttgccaatgatagtttgttaaccagtattttccttccttagtaatctttttataagtgaatttgtgtattctccaaacccacttgcatgtacatgcttttactcatatattttgaagaggattgcaaagtgtctgaagaactacgaaggagcttaatcaaaaccgtgaatacatcactacgtcttacatacaggaaaattaggcctccatatttttaagctgaaaaaatgctgaagaataaataaggggtaaagaggaatacaaacactacattaacttacagggtaaaataacttacacttataactagaatagaagaaaatcaaaagtcatgttaacaaaaagcaaagatgataatagagtccactttaattatatttgaattagaaaatggctaagggaaatgttattagttttaaaacagaaaagacatttttacgactgaaatttaaaagaaacatattttaggaaatcaatctaaacaataatttcatctttaatggaaatgagagtagttagaattttttaagtggttactaaaaaattactttgcttgaacttgggaggcggaagttgcagtgagccaagaccctgccactgcactccagcctgggcaacaaagtgaaactctgtttaaaaaaaaaaaaaactttacaaaaataaacagtaccatagtaaatgtctcaatgaaattattttagagtgaagaactttagataaagttactgaagaagcataaaaaatattagaacaatctgtatatcattgttaaggaaaagagtgaacaaggataacatttatgtttgcttactgttgtagaccaaatatttgttccttccccaaattcatattaggaaatacacctactatgatggtacccctgggagacggggcctttggaaggtgattaggtcatgaggatacaaccttcatgattgggattagtgtctttatgaaagttgccttctgctatgtaaggacataaggagaaagtggtctgcaacccagaagagagctctcagcagagcctgaccttgctggcaccctgatcttggacttccagccttcaaaactgtcagaaataaatatctgttgtttataagccatttaattgtgatattttgttatggcagcctgaatggataatgacacttattattaatatttgggaagatagggaaaaataatttatgatggttaaaaatacagatttgtaggaggaaataaagcacagctttgaaagacaaatcatactcgatcaggtaaattccctttatgactcactgtgtagattagaagaggcaggagatttaatatttcttagcttcataaagtccttggttttattccacaggatttagtcataaataagtgaatatatatttcagccctacaagaagttaagtggttccgtatggactagggtgggaggtgagataagatagaaaatataacaatcatcagaatatataacatataacaagatactatttgccagacgccatagtatagtatcttacacattatttcctggaattacaacagctgacctagtgaggtaggtgtttttattttaactttcacctaggaataaactgagggtcagagtgtagttaagaaacttgatcaaggtcacataagtcccaagtggcagggctgaaatctgttgatttttcaaagcatctttctgcccctaagcctttggagttaacatggggactcatgagagcatttcttaaaaacttgtcttggatctaattggaataggctcaagcacctcaaaaagttaaacacacaattaccaaataatccattaagtccactcccatgtatataccccaaaaaagtacaaacgaggactcaaacccacacttgtatagatatattcacagcagcagtattcacgatacccagaaggtggaggtactccaaatgccaatcaacaggtgaatggataaacaaaatgtggcatatatataaatggaatattatttggccataaaaagtaataaaggatttctatatatgacaacctggatgaaccttataaacattatgctaaatgaaaaaaacacaaaatcacaagtattatataatacgattccttttatatgaaatgtccagaatagacacaactatagagatggaaaatagcttagtgattgccagagactgagagatagaaagtagcttagtgattgccagaggctgggaagacagggaaatggactaactgcttaatgtgtatggagtattattttggggtgatgaaaatattttgaaactagatagaagtggtgcttgcacagcatgggaaaggtacttaatgctactggattgttaattctaaaatgtttagttttatgtgaatttcacctcttttttttttttttttttttttttgagacggagtcttactctgttgcccaggctggagtgcagtggcatgatctcagcttactgcaacctctgcttaccaggttcaagtgattctcttgcctcagcctcccaagtagctgggtttacaggcacacgccaccacacctggctaattttttagtagaaacggggttttgccatgttggccaggctggtctcgaactgaccacaaatgatctacctgcctcaccctcccaaagtgctgtgacataggcatgagccaccatgcctggtctcacgtcaatttttttaaaaggctcaaaacacttcctaaaattatgaagcccaagaataatgtctgcaacccatgaatgcataaggcaaaggaaataatgggattccttgttttcataattgaataaacaaggaaggtgttccctttgccttgcacagactgcattttcagtaaaatggaaaattgttggcaatgccactgaatttacctgttggcaatgccactgaatttacctgaagccagcattctctcttggacagaaataaaacaatgagccatactggggttcagacagcctgggttccagtcccagctcaaggaagaactaggtgaactaaggagttcacaacctgacatcttggtgtctgtttatttatccatagatgtgagtgaaatcaggccagatggatgaatgattgctacattatcttctaacctaaaaaaatttataagttaatattttatgaaatgaaacaaattgtgatttcatcttgtatataatagatacaataataaatagtgtccagaaagcactgggagcaatacattaggagtgatgtatgatgtgcagacaaaaatgagaagattgttcttcaaacattgtctggggacgaaacaagtcatcatggatcacaggtttacacaatttagtaatctacttaaatgcaacagttctcagtagaatatagcatttcactcttcacctacatggctgagtacctcgttgtaatactaaatgttcttgcccattgtagaaactcatatgtattgctgaataatcctgacactgaatcattgtggtaggcagaataatggctcccaatgatgtctatgtccaaattcaaaaaccctgcaaataggaatatgttactttacatggcaaggggaaatcaaagttgtagataataatcagctgatcttcagatatgatgaggatcctgaatcacttaggtagtagcaatataatcacaggatccttaaaaggtagaaggggaaggcaggatagtcagtgtcagagtgacacaagaaagagtccaccggctactgttggccatgaggatgaaaggggccatgggcccaggaatggcagcacctccagaacctggaaagcacaaggaaatggactctccctgagagcttccagaaggaacgtaactctgccaacaccttgatttttaggacttctgacctacaaaacttgaagataatatacatgtgttatttttagccactacatttgtggtaattggttatagcagctgaaaaaatatatataataggttgtttttgaatgaacgaatgaatgaactcatggatgtgggaggtcaaagtagacacggcggctgggcgtggtggctcacgcctgtaatcccagcactttgggaggccgaggtgggtggatcatttgaggttaggagtttgaggccagcctagtcaacatggcgaaaccctgtctctactaaaaatacaaaaaaattagctgggcatggtggtatgtgtctgtagtcccagctacttgggaggctgaggcaagagaattgcttgaacctgggaggtagaggttgcagtgagcagagatcacaccactgcactccagcctccagtccagtagacatggcacccagcacccccagaggcattgtgtgaagttccaagaaggtactggaaggtgaatttgcatctatatctatcccttgatattgaacttcccagcctccaaaattgtaaaaagtagatttctttatcaattacccagtctgcggtattctgttatagtgacacaaaatgggctgaggcactgaccaacaaaaattgtcctgagaaagacaggggcacctattttaataatggcatgagaacaaacaccattctgaaagaaagcaaagggtttctctgagttttaaaagcacacaaaatatttaataatagattataagtattgatgatgaagactacttatggattatttgtactttcccctatggaaagcagaaagattttaactatggttatcaaaatatattatgataaaatgttggaggagaatttagcacaaaactgtgatttcaagagaataaaatgatttaatttcttaccgattaggagattgtagaggagaagaaaacaattcatccatcgaaggcaatgctatcatggagtttagcaggaacttaagtgaatgctttagtgaaaatcatcaaccatatgtgactactttaaaaagcctaaaaatgttttttaatgctaaagttcacagaaaataaacttctaatcctttaaatatgttagattaaaatatttttattataaaaaattcagaaatatttaaaaaaatctcagttaacataattaagattaatcttggcaatgtgaaaaaaacacagttgtcttttctctgatgtatcgtgttaattaaaaagcaaacatacatattgttttatgttgggttatgtttccgaaacagttcaaatatgcttcctcccacataatgtttaagatcataaaaaatataaatttttgttcattgaatatttatatttttatatcaactataattatgttttccagaatatcaccttaaaaatgctttccaagatctttaggcaagttaaaaccttgaagtaatattaaattaattgaaaatcatttgatactcagaaaatttcaaagtaagataaaaagaatactgaaacattaactactaagcataattttaagtttgtatacttttatttttatttttacatgctcgagggaagccaaatctttagcttatgttaatgaccattttcatttttgccactttgcaaagcgaaaaaaggatgtgtgtagctataaaaaaattatgttttatgtgtctctgacttctgctagtcagctagaatgcttatgtacaacacacaatctcaattatctgtcaagtatcttgctgaaatagcaattatagttatatagatggttacaactatactagcagaaagagtgagagaaaaagaaaaacatatttatgcttttttttttcaagaacaaagactggtttttgaataaagcagcagttctcaacatcttttctctccatccagtagattcttaaaaattactcaggaatctaaagatgttttgtttctgtagtttataatgtgggttataagtatcaatatttgatgttttaaatcactaaaaccagccgggtgtgatggctcacgcctgtaatcccgtcactttgggaggcggaggcaggcggatcacctgatgtcaggagttcgagaccagcctggctaacatggtgaaagcccatctctactaaaaataaaaaagttagctaggtgtggtgatgcacatctgtaatcccagctacttggaaggctgaggcaggagaattgcttgaacctgggaggcagaggcagcaataagctgagatcagccactgcactccagcctgggtgacagagcgagactccgtttcaaaacaaaaacaaaaacaaaactgagaaaataaaatatatatttattaatgtattgggaaataacaatgttgactccattagataataatgtaaataacattttcttaaagaaaatttgtatgagaaaaatgacaaccttgaacatttttacaaaaatatcctgaatgtttggcttaatagacaactgatgggttttcaagtctgcttctccatttaatctcttctggtcatatagcctctgaaaaactccgtagcttagtattgttatgaaaataactttggtgtcacagttcccctgcaaacatttcagggaaccccagaagtcttcagaccacactttgtcctaaagtgtctgtctgtcctacaatgtaaatgaagctcacagttcccctgcagacatttcagggaaccccagaagtcttcagaccacactttgtcctaaagtgtctgtctgtcctacaatgtaaatgaagctcacagttcccctgcagacatttcagggaaccccagaagtcttcagaccacactttgtcctaaagtttctgtctgtcctacaatgtaaatgaagctcacagttcccctgaaaacatttcagggaaccccagaagtctttggaccacactttgtcctaaagcgtctgtctgtcctacagtgcaaatgaagtacaccacttggagagtgaattggacttgtgttggtttataatgctgatatggttaggctttgtatccctgcccaaatctcaccttgaattgtaatccctgtaatccccataatccccaggtaacgagagagaccaggaagaggtaattgaatcacgggggcgcttcgccatgaagttctcatgataatgagccagttttcaggagatctgatggttttataagaggctcttcccctttccctcagcacttctctctcctgtcgctttgtgaagaagatgcctgcctcccttttgccttccatcatgattgtcattttcttgaggcatccccagacatgtggaactgtgagtcaattaaacctctttcttttatgaattacccagtcttaggtagtatttttatagcagtgtgagaatggattaatacaaatgcctacatatatctaaaaagaaactacaaagatacatcaacatcaaaattttagcaaaaattacttaacttcaatgggtttgcttcattggtttactgattaggccttgacccacaatatgaaaaaatgtccagtgaaagcaaattcctctgccttctgtctaatctgcctacagagcagagattctgtgtctcatcagaatagttttctgtgattttagatgactttattatgcccttgattatttaagggcaaaaaatgttgcctcacttaaggaagagctaagattctttacaattgtctttatcctctatgttttatgcttgtattttaaatatatgttgttactttgagagacaggttttttcccctcacttattcacgatcctgtattaatctagtaaaacaatctcctctgacaattattaattttaacttcccaacattgaaccccaaatttagataaaaaatagaagtttcaggatgtttttttctccctaaaactaactttgagatctcccaaatggccctggaaaatcaccaaagcttgttctttcaacttataaatagatgctagaaataattaggtctgtctaatgtgttattttaagagttgcacaggaagaattttcagatctgaagaaacactagcctcctctaggttaagtttgcaaaatcttattactataaacatttcagaaattgtatgctttatggaaagtctctggtgccctttctgcccaccatatgaggaaacttcaaaagttcacagaaaatgcatattatagaaaaactacgcatggattccaatttttgtgccaaaataaactcatactaatttgttacaatgtgtctgagtaggatccagtttgaggcactaaagaggataagatggtcaggtgtggttggttgctcacacctgtaatcccaacactttggaggccaaggagggtgaattgcttcagcccaggagtttgagatcagccttggcaacatggtgaaactccatctctactaaaaatacaaaaaattacccaggtgtggtggtatgtacctgtaatcccagctactagggaggctgaggtgggaggattgcttaagccggggaagttgaggctgcagtgagctgagatcatgctactgcactgcagcttgggcaacagagcaagaccttgtttccaaaaaaaaaaaaaaaaagaagaagaagaagaaggataagacgtgagtatgaaaagagtccctatcagagcaacatgaattctgctaaaatccaagcaacttacagtgaaacttaggtgaaaaaatagtgaaatcactgatgtttcttgaaaattttataacgacaatgccccaaagaaatgagcagtttacaaattgataactcctgtttagaagggatgagatgatgttgaagaggaagcctgcagcaatagaccatccacatcgattcacaggtgaaaaattcatcctgtttgtaccctaactgaagaggaacaatgactaacagcacaaacaatagccaatgccatagacttctcagttggtgtaatttacacaattctgagtgaaaaattaaagttgagcaagctttcctcttgaggggtaacaaaactcttgtgcctagattagtgacaaaagtggagctttcaatggaaattttaaacaaatgagatcaacatcctgaagtatttctttgaagaattataacaggagatgaaacacagctttaccagtacaatcctgaagacaaagcacaaccaaagcaatggctaccaaaaggtggaagtggtcgtcaggcaaaggcaaactgatgaagaacaaaggtcatggcaacattttttttttttttttttgagacagagtctcgctctgtcacccaggctggagtgcagtggtgtgatctcggctcattgcaccaccacctcctgggttcaagcgattcttctgcctcagtctcccaagcagctggggactacaggcgcatgccacaacacctggctacttttttgtatttttagtagagacagggtttcattgtgttagccaggatggtctccatctcctgacctcgtgatccacctgcctttgcctcccaaagtgctgggattacaggcgtgagtcaccatgcccggctggtaacagtttttgggaggctcaaggcatttttgcctgttgactttatggagggccaaataaagaaaacgtctgcttattatgagagtgttttgagaaagccaaagctttagcagaaacatgcccaggaaagctccaccagagactcctcctgcaccacgagaaagctctgataactcttctcattgaggaagggcaaatatgcaagtttcaatgagaaattattaggcatccactttacaatcctaatttggctccttctgacttatttttgtttcatatttttttttttttttgagacagagtcttgctctgtcacccaggctgaagtgcagtagcgtgatcttggctcactgaaacctccacctcccgggtgcaactgattatcctgcctcagcctcccaagtagctgggattatgggcgctcaccatcatgcccagctaatttttgtatttttagtagagacagggtttcaccatgctggccaggttggtcatgaactcctgacctcaagtaatctgcatgccttggcctcccaaagtgctgggattacaggcatgagccaccacacccagctgtcctaaatttaaaaagtgtgtaaagggtccccatttatcttcagtcaatactgtaaaaaagaatgtactgatgtggttaaatgccagcagcctcagttccttggggatggactaaacggctgctatcatcacttacaaaagtgtctggatcttgacagagattatgttgagaaataaagttacatttttcatcttttaattccattttttttccacaaacattttgaagtatgcttacatgttcttactatcaggagaaacactgatatcaactcatatacaacagaaaattttattctccaaactgaaagtattggtcgcagcagtaatttaacaacagcttttaagtctttatcatctatagtcacttgtttcactctgatgcttttctaaggctttgctttaaggtacagaccacagcttgtgtcttcaacaaaagacagtttcagagatttttggaaaagcgctctgaactactgacatttcaaacagttatctcctgggcatgggtttctgagctgagaatgcttagacaactttcagatatatcagtggactatgttacgatttctagaactctttttagtgaaatcagattattaatctaagatccagcaggagaagaattaattatttaggactgaatgagctgatgaggaaaactctgttttgtttgtttgtttgcatgatgttgttgtaatattccattttctagatatatgacaaagccttttgtctttcttcttaaactttctatcatgtacaagaatctagtagactccacttttctacaatcaaacgaaacatttctaaatgatccctgatttttactgacactccagatttcatacattcttcctaaatttcattacttttcatggcaatgtaatagtctgcacagaaatcagtaaaaatctgtcctactttttaccagaaaaataattggacaacctaggtcaatataaaataaattgggcaacctaggtcaatataaaataaattgggcaatctaggtcaatataaagcatcacatttgagaatggttcttatttcatcagatctgacattctgctcttaaggaacaactgttgattttgcatgggtccacagaacactctcagggaaactggcttaccaggctccagcgatacagatgggaagacaggtaaaatcctggcacattagaagcattaatacattttcaggacttcaagagagtttacccaaatttacatgttatacaggtataacctagtaaagacagccttgagcttagttttatagtcacagaataataaataagagcaattttaaaacacaatttgaaattccttataaaaacatttgtggttttagtagttacattgtatggttctagatggaagaagtaaagtcaaggaggcctatatagtaaattaacagtcctaccaccaccatataactaattaggcccaaacaaatgagtccaatattttttgtgattattaaattttgagattattataatcataaattgggatagaaagtaagaagaaattttgaaggacgttgaaacgaaagaaacaagatgagtgggtgtgttatgaaatgccaatcctgtcatctgatttatgggtatgtgccacttacagtgtttgagccactgtataactttaaaattaatgcaaattatttgtgtctgtagagacacaaatagattttgtctatgttttagaaatgtgagtgattctttcctcctcaacaaaaaccactttgcatttattgtcagatacgtttcagcatttgtgattgcctagagatgacttccctttgcaattcctttgaactggtttttaacatctgactagtttcctcaaaatttaaataaaatctttgatgtgttcatttatatttgcctgagagtcatgactttgttttaaaaaattatacttttaacaatttaaagaaatcaatattaggggattgttcttgattttgaaaaggaaaaactaagaatatcaaccaacttcaatccaggactgctcagaagctggatagaaaaaataatgaggccaggcacagtggctaatgcctgtaatcccagcattttgggaggctgaggcgggaggatcacctgaggccagtaattccagaccagcatggccaacatggtgaaaccctgtctctactaaaagtacaaaaaatggccggatgtggtggtgcatgcccataatctcagctactatggagactgaggcaggagaatcacttgagcctgggcggtggaggttgcagtgagctgagatcgttccactgcactccaggcctgggtgacagagagagactctgtctcaaaaaaaaaaaaaaaaaaaaaaaaataccgtcgtcgggcatggtggctcacacttgtaatcccagcactttgggaggccgaggcaggcagctcacttaaggtcgggagttcaagaccagcctggccaatatggtgaaaccccatctctaccaaaaatacaaaaattagtcgggtgtggtggtgggttcctgtaatcccagctactcgggaggctgaggcaggagaatcatttgaactcaggaggcggaggttgcaacgagatgagatcgtgtcattgcactccagcctgggtgacaggagcaaaacctcatctcagaaaaaaataaaagaaaaaaaggcagatgttaaaaacaatttcaaaagaaatgggaaattttaacatggtttatattttagataaaattactaagtaatttttttattttaaaaaattaataaacagttttcttaggggtaaaattggtactaaataatggagttattctctttttttttttgagacagagtttcgctcttgttgcccaggctggagtgcgatggcgccatctcggctcaccgcaacctctgtctcccgggttcaaacaattctctgccaccatctcccaagtagctgagattaagtcatgtgccaccatgcccggctaattttgcatttttagtagagacggggtttctccatgttggtcaggctggtctcaaactcctgacttcaggtgatccacccaccttggcatcccaaagtgctgggattataggcgtgagccaccacacctggccaatggagttattcttaggccatgcttgctgaagtattgaggtgtctagtatcacaaaatttgcaaatcatgttcaaaaaatatagcaaaaaaaaaaagaaaagaaaagaaaaagaaaaaagaaagtgtgtctttgtgtatgagcacaaaggaaaagaaagaggacagagccattgagaccacctgttaatggctggtgccagcaaggtggtgcctccatggctgctcaatgttgatataatgttgatgtctctcaacttctcttgaagttgaaaattttcaaaataaaaatggggcaaaataccagagagaaaatttgcatttatttaaaaaacactgagcattggttgagagttttagaaccagaggacataaaggttcttgataacatatgtatttttcattcctcagatccctagccagtctatactcctttgttccagacacactgataagagaataatccaacttagttcatgaccataagttaatgattatttcagatcctgaaaaagaagagccggaaagtgactgttcagaaatcagaatgtctatgtggcatgtggcaagggaagaaggtacattcaggctccctgcaggcgcacaatctacaatgcaggaccacccatttccagtctctgtgatgctgaccacagcctcttagagctggaactaatagcaaacctcacttggtgtttgtggtctcctaatgcattaggttctccccgcacacaccatgaaattcatcagtactaactgctttggacacagaatattattactgacaggacagaattgaaagaggccatactgatatggaagtgctgggaagggaatggcatggtcgctttaaccaatatggaaggtggggaagggaagtgctgggtagaggagggcatggtccctgcctagggctccactcttgggcctgtgcccagggacctaggtgtggacaattattttcattttcctgccccaatgttggcatttcccaagaccaccctggccttccacatccccatcctgtgcctataaaaaccctgagagcctagcaggcagacacaggcggctggacgttgagaggagcacatcagcagaggaacacaccgggggctggatgtctacaggaacacaccaacagccaccagcatgttggccactgactggcagaacgatgtggagtgtggctgaggcagttggaggagatcccaggctgctgagcagcccgactccaggtgaaaactatctctcttctggctcccccagctgctgagagctactcaataaaacctcactctcattctccaaggccacttgtgatccgattcttctggtacacaaaggccagaaccctgggatagagaaagtcctctgtctttgtgataaggcaggggtctaattgagctaacacaagctgtctacagatggctaaactaaaagagcaccctgtaacacatgcccactggggtttcaggagctgtaaacattcacccctagacactgctgtggggctccaacagccctgtctgtatgctcccctagagcagccgggcactaaagaagtgagccacgcccccatgacatgccctgggaggaggacaaggaaacttcctgtttcaatacctggttataaatattgctggagaccataataaagagatggatcatagaggaaagatcatgtgaaaaaagggtgagtgtacaattttagggtaaaatagaaatacgttattaatgaagcaggaggtgggtgttttaattttggtccaagttttcagttaaaactttttgcttataaaaataatatctcccaaaagcataagtgggttcttgcatgaacagagaagaaaacaaagatttacattcctataaattacagacaacctgaaatatggccctcgagctaccaaatttactaaagcacactggcagtcattaaaattgcagaacattttacttcagtggtacaaccacaggggcctctggggaaaggctgggcattttactcaccaaaacaactcattggaactaaaggcatttaaaattactccactcaggctgggcgcggtggctcactctcaatcccagcactttgggaggccgaggcaggtggatcgcctgagatcaggagtttgagatcagcctggccaacatggtgaaaccctgtctttactaaaaatacaaaaattagctgggcgtggtggtggatgcctgtaattccagctactcgggaggttgaggcaggagaatcgcttgaacccaggaggcggaggttgcagtgaactgagatcgcgccattgtattccagcttgggcgacagagcgagactccatctcaaaaaaataaataaataaaataaaataattccactcagcaagattttgttgttggatacttccttttgttccaattcaaatacagtgcatgacattggaattgcaaattgctcccattatacctacctgaaatgaaaaaactcaagagatttgaccaagaaatatgaacacctttacatcaacagagtaaatgggagaagactgttcatatcatttatttggaaacgttaaggttggaaccacaatctaacatttgacagaaaaaaattatatcagagatctgtaataaaaaatacagcatatacccctttaagagtaggcaaaaagagaaaatagctggagtatccaacaggagatattttgaggcaaaaaatttaaaatagacatttgcaaagatgatgattagggaagatggttttcttctaaagacacatgcagtgaagaaagaaatctttattcttatctgggttgcaaatggcactttttgcaaaagaactgctacttacttctagagtcagctaaaatgatatcaaacttttttaaagatgccttcttaaggcagaaagtgtcttaatttagttttaagatattttaggcttattaacctcaatagtgaacttgaagattttccattaaatccactgtccatcagcctattatagacatattacaattctcctcccaacatcttgccttctttatgaagttgacgcgaagctgaaaataattctgtcaaataagacaaaaaaaattaacaaaccacaaaattctatttcatgtcattcatcaaatgctatcaatacactctgtgccaagcactgggttagaagagaacaatgatattatttgtcatttattttaactttatctaattcattttttataaatgcacgagtaagtatcttttagacatgaaatgtaatatgtggatagtatgtatattttgaaggaatataacagtttaatgctattttcacaaatgattattttatgctttaaagaagtttttggtaagtgaatgtggaaatcctgaaataaagtcaaatgatatgatttgcattttcccagcagcctctaaggaagcagcctgagggatcagcctgaggaaataccctgagggatcagccttgaggaatcaggtgaggcatcagcctgaggaaataccctgagggatcagcctgagggatcagcctgaggaaataccctgagggatcaacctgaggaagcagcctgagggatcagcctaaggaaacaccctgagggatcagccttgaggaagcagcctgaggaatcagcctgaaggatcagcctgagggatcagcctgaggaagcagcctgaggaagcagcctgagggattggcctgaggatgcagcctgagggatcagccttgaggaagcagcctgaggaagcagcctgagggatcagccttgaggaagcagcctgaggaagcagcctgaggaaggagcctgaggaagcagcctgagggatcagcctgaggaatcagcctgagggaccagcctgagggatcagcctgagggatcagcctgagggaccagcctgagggatcagcctgaggaatcagcctgagggaccagcctgagggatcagcctgaggaatctggctgcagggaaaatagaagtcctatcattggactttatctcaccttctctcaccatgttctgtattgcccataatctgttttttgatataatttcaagatactgtccctgaaactctgcaatggggggcttaaggaatgtgatagcttgacaaaggtttggaggagggtttccaggataccctgtagtgctctttcaactccaggtcttaaacagggccacattccctgcaaggcccggcacagaccccatgctgaatacatagaagctgcttattgccttgttgccccatcaccatttttttttctgttctgcctccttcttggggccattgaaggttcctcagcattgggctccaaatcccttctctgtccttcccacccacttctgtgctaagtcccagaacctggtattgtcctttcccctagatgatgagtctctgagcctgcagactgtctggatcactttctgggggccaagcacagtgtctgctaagaaggcgatccctgagacttttattttattatctaaataaaaggtgaaagaatctgtccaaaatagttgctttaggaattgtactccttataaagcaaagaacacactgtcacagaattgattttatcatagtcatgaaatctatgttagaagaaaacagccctttttctcagccaggcagagactttgaagagttaacttttactgtatcacagtggcctacttaatgctatacaagaacacagaatacatgctgtatttacaaacttcaaaggaaactagctatttgcatttttatctgtaggagaggagagaaacatgtttcctttttgaccttttatcctcaagttatatatgaggaagattaaatttgtcagtattgtcagtgtaatctatttagggttttaaaccataacagtggaaaatatcaagattgactttaaagcctactgaatataacttttttaaaaaaaagctggatgagacgctgaaatggagagaaagccttagttatgggaggccggattggaagtttttcaaaataagcatcagaaataatgggccccctattgctcacatgcagacatcaatcttttgtttgtcctggcaaggtgagaaaaaaaattgggttaccatcaaagccaggtaatacggcccgctcatttgtaaatcacatggctttagtaagcaaagatgcttcctagatttaatgaatgtggtatcagaatgttttctttgaatgagtacagtggtcttctatccggttttcttccttccatatatctgtctctttgaatgacaccaagtggattaatcttcctaaagccccagttgggaaaattatcattctgccttctcccaagctttcaaccattcccactatatgccaaataagctcgttatgttgcattcaaagccttctaggacttaacagtaacctatctttctttttatctcaaatttctctcccaggtacaccaagttgcagctaaaccaaactgtggtttgttgcctgtttctggatctttgctcattcttcaccatcactgataatgttctctctaccccctacctttcaaaatcccacctgcacttcgagattcagttcagctcacagatccatcttgaagctagacatgacagtttccctcttttgcagtagcagagaaatatgtttgtactcacaatatgtgtcacaccctagattttaaagctcccgaaatggatgagccttcttttactatttttatatctcccactgtcctgccaaggacgaagaaatattttttatatttctatatattattcctactataaattccttagggtgatgagaacttccttagggtaaacacctagtttttggtattatacttatcccttacagtatttagaatttatttagtaaatgcttaataaatattttttaactaaatgagtagaaaccgtagaatgagtagaaaattttttcctaaaactacaagtaggaattttgtctatctcagagacagcagaatatgcttagtatttcaataaaggacagttttttagaataaatagcgtactttggaagcctgaaatagctggaaaagatgaagtttcttatttattatgcctctggatgtgtttttaatttatttccctagaagagctcttaggcaaagtgataacttggcttagaatctttaggagaaataaagatgaaaataaatacggttctttaccaaattgcatgcacatcacacacacacacacacacacacacacactctctctctctctctctctctctctctctctctctcaatacaaaagagacagcgctaaccctgtcttgaatccatagaatcctcaaatgcatgcatttcagagtattgatggtgacactgataaaacattcagaaaatgacttattctgaatctgctgaaggggtgtcctcacagtgaatgccttcctttccttctgagatccaccaaaaaacatactagtctgttcagagtgatcttagaattcagttatttttatggcttggaaaatctactcctggaaatctgttctttagaaatactggcaaggctgtaaagatacatgtacactgctgttaatcccaacatttggagaaggaaaaaaagtaagcgatctcaatgtctactaatagagcaaagctaaataaattacagtacaatggaatgtatactctgcagccgttgtgataaatcaagtatgtccataggggtccttggttaaaaggctgtccatgatgttttattaaatgtaaaaagcgcgttgcaaaagatggggaaatacccaaattgctgaacacttctgtagatctcatttttctaagagtaatattctatgtatctatgcacttatatttatagacaggcatacatatgtataaatttgagtacatatgttgatgtctgcaagtgcttatacatctgtttatgtgtagatgtatgtataaatgtttatacgtgttatatgtaaaatatataagctatatatatatgcatgtacatacctttatagatatttttacagccatagataaaaagatgtagaaagattcagaacaatttagaataattatctcttttattggcttaaaggagggaaaagtgaacttttattcacttaatagaaaaaaagaaaaaagtagcagaagttcaaaactgtggtgtttaatttgggggcctgttctgattcatgaatcagatttgaaatatacttgaagccttttcttaaaaatggtcattcttctgacttgatctgcagactttattgattccaaatggttcacaatgaggctgtgttctgtcatcttttacagcaattgttcctactttcatgtatctgcctgtgactacaggaggcagcggcttccccagaccactcacctccctccttcacacctgcctggcccgagtcccacagtgatacctgtcatggaactacatcttgtattcatgtgttaaacagagctctgtagttgattcgcaagaaagaaagttcctttcagtgaaacagagttgtagcataattgttgttttaaaacggtatttttcacatcaaaagatgatttaatgtagaattattttttaaatgagctgccttcatagatttaaaatatactttaacaaatatttgacttactctcacatacttgacattacctaatatgtaccttgtacaccttttttatggattagagtttgaaaccaaaccagaggcaccttctgttatgccatcctctgaaagcatatttcaggctgagaatatctattttgcattttcttattatgtatcttgagatgcaatttctttcttttcttcttcttcttcttttttttgagacagagtcttgctctgttgcccaggctggagtgcaatggtgtgatcttggctcactgcaacctccacctcccaggttcaagcgcttctcctgcctcagcctcccaagtagctgggattacaggcacgtgccatcatgcctgactaatttctgtattttttagtagagaggggatttcaccatgttggccaggctggtcttgaactcctgacctcaggtgatcctcccacctcagcctcccaaagtgctgggattacaggcatgagccaccgcgcccggttgagatgcaatttctataacagccctcaccaactattttaggtcttcctgctggactcatttgctcatttattcagcagatagttactgaatacctacctgcttcctgccactcacttttgttaagtgctggggatacagatgtgaatacagtgaacatagttcaagtctactgaggcaggcaacaaactttcatcctacagtctcctaaataaaggtagactagcacattgcattatgacacatgaaagaagagtaaagaaggaggtgagagttgtcacaggctgcaagaatcaggacaaggaactgttctctgtggaaaatcagataaacagagacctgagacctggacaggagtcagctgcatgaaaaaatgcagacaatttctctggccatgagacatgcgaaggccttgagatacagaaagatttggaacttgcttaggaatgggaataaggcccatgtgtttggagggcaagaggggacccagacacagagccgtgtcagtaagggcacatctgagtaaggctttcaagaagctggcatttcaacacagatccttctggcagtcagtgtgcatttaccaaatgggcctgccattatccgtacatgttctcatgtagtataaaaagtcgcaggaagctttttgggaacttgccccagaatttccacaaaagcagagctctctgatttctacggggaggcagagaggctggagggaagtggaccagtgagaagtggactgcagggctgcagggaagcctgatcaacacgtgggctccaggctgctggatgaacagagcctggggtggacttcagcggggtagttccatgcaggacatgatccacacaacgctatgaagtcctgttccctgcccagagccaccagaagtatcttcctaaagcataaactggtcactctgttctcctgacttaaaaactccaggctgggagtggtggctcacgccagtaatcccagcactttgggaggccgaggcgggtggatcacctgaggtcagagttcgagaccagcctggccaacatggtgaaaccccatctctactaaaaacacaaaaattagccgggcattgtggcaggcgcctgtagtcccagctactcgggaggctgtggcaggagaatcccttgaacccaggaggtggaggttgcggtgagccgagtttgcgccactgcactccagcctgggcaacagagcaagactctgtcttaaaaacaaacaaacaaacaaacactccaatgactccctgatgactaagtgatagagttataactccttgaaggacacaggaggccctctgcaagtggatcccccaaattctttgtctacttttacttccctgagatataactacagcttacttcctaccccatatgggccaagacagagcactctctgtgattcagcacatgggattcctcttccagggatgactaaccacctcctctgcatggtaacctactgctgataccacaagacagcctgctgcctctgtcctcctgattccacagcttttggagggcagcacacggcactggggagaacagcgggcatgcccctggctgtccaggtcagctcaatttaactggtggtcagtggcttacagatattggtaccagctatccctaacagctaaactctttgcaaagcatctcctcatggggcaaagtaaaaggaaggtgggagattgggaaacagttacaggtaactaaaacagcatgtgccaaggtcctgtgctgttttgctcaatgaactggagaaagaccagtgtctggaatgcagtgtgaagtaagaagaagccaacagtggcaggctctgattaaggttttaagaagtgcaactatcttttgcttttacaaaatattagtggaatggtgactgatggacatccccgtgaaatggcagcagacaacacagaaaacatgaatggacccaaccatatgttaaattggttctatctttggccgggtgtggtggcttatgcctgtaatcccagcactttgggaggccgaggtgggcagatctcctgaggtcaggagttcaagaccagcctggccaataagacgaaatcctgtctctacaaaaaatacaaaaattagccaggcgtggtggtaagcacctgtatcccagctacttgggaggctgaggcaggagactcacttgaacctgggaggcagatgtttaagtgaagccgagattgcgccactgcactccagcctgggcggcagagtgagactcagtctcaaaaaaagtggttctctctttgcaatagcaaagagaaagaaaacaaatggttacaaaaccaaaatacagtaggggacactgataaaattcaatttagcaaattcttcctggcctgtgaacttgctaagggtatggcgttgtagggactgtgaaagatgaatgggacctacagactggtttatcaggtatgagggaaacatttaaatatttacacaaaatgcaatggggtttcaatataaaagaaggttcagaaggcatcacagaacacgtgaaaattgtactgcgtcttcgagagttgtaaaagcctcaggcgaagggctagaagagggagtttcaggagaaggaagggcagcagagtgaagacactgaaacaagaatcggaatggctgccctattccaggggcattgagccatgtccctagagcaaaacgtgtctttttagaaagaaagaaaatcatcaataaattataatttttttttacatgtcaaagaggaaaggtacgggtgttaagtaatcagtctaaaaaaagttttggggcaatttcaatatttgttcataagaattcatgagtagggtttttacgttactattactttaagttgctgtaggcagaatttagcttgaaggaaatttaagatttcttgataattaaaatacgaaacagtatggcaagacaggctggggaactccaagtctgccttaattagatgctaaaaatagatgtttctaaaagtcctgtttcctttctaggccatccaacattctggagaagtgcttttaatctcagcaatgtgctaattgtttctaatggcctgtaaacaagctccctgaactattaaccttcttctctctttagccagagattcaggaaattagtctttgaaagaagagtctccagcaggttgcccaggagggtgtcccaaagtacagacactgtcactggtttggaggaaaatcaaggtcagatctgagcagcaagcttgtaatgtggaatagacaagctcaaaaccttaaaaagaaagatcactccactcctctctggtttagtttggttgtgttcctatctggaaggagaaatataaatgttaggctgggcacagtggctcacgcctgttatcccagcacttcgggaggccgaggcgggcagatcatttgaggtcaggagttggagaccagcctggccaatgtggtaaaaccccgcctctactaaaaatacaaaaagttaccttagctaggcatggtgacgggcccctgtaatcccagctgctcgggaggctgaggcaggagaattgcttgaacccagaaggcggagattacagtgagccaagatcgagccactgccagcctgggcaacagagcaagactccatcttaaaaaaaaaaaaaagaaaggaagaaggaaatgtaaatgttggcacctctccaatggcttccaaacacaaacacaagcccataatcccaggatttttaaaaaacattaaaacaatatccttcagttgacaagaatgttgaaaatttgattgtgctaagttaaaattgatgccatattgaaaatggcgttcaatttaatctcagaaaggcaatgcctacctgaaccctcggaaaggagctggggcattgagggtgccaccctctgttctgcttgtccttttcagaacatgacaaaattaacttaatttgtcatgaaagatgaatgatcacagagtagccaaaaaatgttgtgaaaaagatggtcagtgaagagaggctttatcaaacatatttcaaactttatttaaaattacaatagtcggccaggcgccgtggctcatgcctgtaatcccagcactttgggaagccaaggtgggcagatcatttgagctcaggagttcgagaccagcctggccaacatggcaaaaccccatctctaccaaaaatacaaaaaattagctggggatggtggcgcacatctgtggtttcagccagttgggaggctgaggcaggaggatcacctgcacccaggaggcagaggctgcagtgagctgagattgcatcattatactcaagactgggtgacagtgagactccatctcaaaaaataaatacatacataacataaataaaattacagtagtaaaactatgtgcctggcacagaatgagcaatggaacagaagtaaaagcctggaggggagaacccaagagagacagatatttatgtgtgatctcagcttataaaacctttccaattagtgaggtattagatgatttgctaaatggtattagaataatcaacataataaataataataaaagttggatctttttagcattcctcaattgaggtaatcaggaggatcaaagaatcacatgtataaaacaatgaaagggtaaaagtaggatgacgacgtgagtcaatcaagttaatagcccaagaggggccaagacatgcccacgtgagcagagaaaccaaaatccactgatcattgactacacacaaatgtaataattgatatggaaagacactctaaacagagtaaacatatggaaaagtgctagcattcctgacatctgaagaaatctcctgaatttatttatttatttatttagatggagtcttgctctgttgcccacgctggagtgcagtggtgtgatctcagctcactgcaacctccacctcccgggttcaagtgattttcctgcctcggcctgccaagtagctaggaccacaggtgtgtgccaccatgcccagctaattttttaattttaataaagacggggtttcaccatgatggccaggctgattttgaactcctgacctgggtgatccacctgcctcggcctcccaaaatgttgggattacaggcgtgagccactgtgcctggcccaaatttatttatttattttttaagacaaatatccaataggaaatttagggtggggggatggcaggtcaaaagaagtaattcacagaaggataaatacaaacagccaggtttaccgggaaatcacactcagtgtcaggggagcagctagccagcaaatggcccaacagctagcagcacaaccacgtccctgaacacctgccggatgccagccctgcaggtactgctgcaaagaggtgcccagataggataggtagaaacaagtgacacacacaagtcagagggcagcatgtgtgacagggtctcatcactacagcattctacacacacatgtacattccgaacacatcagcaggaagactgggcatcagagttacaagacaggtgtgagctagcacgacgcaccctgaatttcagatccatgaataagccctttcctacttataatcagtggtactgaggcagaatggggcgcacctaggaatacacactttagtacaaaacctgggcttgagaccctactgtaacttattgactatgtgacattgaattacattccaagcctcttcccacataagtcttggtgacttacgtgaggactgggacactaatagtatctacctcccaatgttattctgagcatttaaggaggccctgcatgtaaacacagttagcacgcactaagtttgggcaggaagagatttttcacagttgggtaaggcttccagcagatgcgacttggttgataggaatctcagccgtgtagctgaaacgtagcttctataatacatcgaagcgaagcacttagaggcatatggcttctgtgaatgtgctgcagcgctgagcagtatcttcttcatcagttccactaaagactggaaactcattataatcctggcaagactgaggtttagccaagaatgttctaataccacagaagctctgtatgccacatcactgatgccgccacagtgagacagaattcgaagtacagccagatgcttttagtaaggttctctttggcctgaccttttttccactccattcgccttgctttctgtgggaataattctctcaacttaaaattaccaaatagcattaaaaattctgcaatatttctgaaatcatattgacacataatggaggatttttcagaataaaattagatgactcttgtaattgttttattaaggaactgcaaacttgtttccattcttcctgaaattaagtattcatttccactgtaaggcaagaaaaaccagctaacattatacagtcaaagggtgacacctattaaacctgatcgaggtttttggaatttatttaaaatacagaactaaattacagtttgttggttctggaaaatgactttcagaattgctttatctctgtacaaccagactcagcctctccttcacagtgcaggcctcctaatcactgcctgtttaccatgaagcatgttttccagtattggctcagccagtttttcttccttcctttatcaaaatccaatggaaaagagccagccccatggctcaatgtgaaaggccaggagttcacatgcacaatcttaaatttggaactaaatgtatttctcttcagaccatgaaacaatggagaggaacaggagagtttggaatgtacatggtttaagcagtctcggaggaagtcatcgtcctgtctcacaaaatcattcctgggtcagccccacctcttcttccacctagagcaggctttcctgacctcagcatcattgaaagttgggcaagataaccctttgctgtggggctgactcgtgctttgtaagatgctcaacagcagccctggcatcaacacaccggatgccaggagcaccacccttcattggtgacaaataaaatgtctccagacattgccaaaggtccccattgggaaaaaactaccccggatgaaagccactaacttacagctatttaagggtattattatatctagattcttgcctcatgtcatattatcaaaaaagaaaacagagttacagagaatatttactaaattttacattatcataattatattcataaaaattacataattggccttaaaaacattattgttttcataggaaaaaaaatttcaattcaactcgccaaagaagggtttgtattaaaatttccttggaggccgggcacagtggctcacgcctgtgatccctgcactttgggagaccgaggtgggcggatcacctgaggtcaggagtttgagaccagcctgatgaatatggtgaaaccctgtctctactaaaaatacaaaattagccaggcatggtggcgaatgcctgtaatcccagctacttgggaggctgaggcaggagaatcgcttgaactggagaggtggaggttgcagtgagccaagatcacaccattgcactccagcctgggcaaaaagagctaaactctatctcaaaaaataaaaataaataaataaaatttccttggacagatgatatctgggatgtgaaagcatgcgtgccagtcacagtaaagattatatactctttcattatgcttcatagaaccatggctgtggtaagtttggagaacaaagtacagataagtcaagacctgttggttcaagtaaagacttacctacaatatccccctttcagttagcaagtcagggccaaaatcttggctaatatttactgtccatatgtgatcagcactgttcaagttttatctcttgtaattttcacaaccttttgaagaagttgagagactggggaacttgcccaggaaacaagacaactagaggtagaactgggttttgaacacaacattctttctccagggcctgtgctcttgattccagcctgttccatggaaaatgttcaccaaaggctaactcagcgggtgtccttgagcaccactgagccattcaagggcaaatcaatctatgctcagaaacaaatggaaatgaagactggaaaacaagaaaatcagatatggtgagaaactgggggaggagagaaaagtctgtgccttctgccagtctcagtgcaaaatcagtatggcataaaatagcacaaatggacaagaagcaagtgagagagtacagtgctctctcaggaaagcattccactgtatttatggaaaaataaactctctcaattaagccaaattttcaagataaaaggatagttccatccatctataatttagtaagggatacaacaataaatgttctgaaatttattctttaatttcctgaattaaaatctctctccatatggactaggagttgcaaaaacatatacatatatatgcaattatatatataattccagaaaaccagattagagttgaacagtgacacctatgtaaaaaccaatgtgtgtgatggagtcatcctatttcgtgcattttagcattttcctaggatactgttctatataaattctgtaatagagttatatataatataattactgtagctattagtgatttgaaaggccactttcttggaaaatttcaacttagtgttgtcaccggcattcctggtcattttctttgtgcatcctgtacacgtgtgcaggtgtactggactctgtggtcatgggaacctccgagtcttcagacacccgctggaagaccagccatcatcactcaagtctgcagccagctgcccaatacagaatggagtgagatggcaccttccttactgtcatacgtgtaaagtcttgcagtaggagaggatctgagagggagcagcaattccaggggaaactgttcattgataataacatctgaatgacatttgacagtttcctaagcactgtcacgtgaatgttgtttctgaactatcaccacaaccttgatactccttttaagtaggtaccatcaacatcatatgacagagaggtagctgagggtaagggtaaatgactagttcaagtttatatggcaagcaatcaactgcagatgcaaatccatgtctgtttttatttttttgttgttcttgttgttttttttttgtttgtttgtttgtttgtttttttgagccagagtctcactctgtcatcaggctgaagtgcagtggcacaatgttggctaactgcaacctccacctcctgcgttcaagcgatcctcctgcctcagcctccctagtagctgggattacaagtgtgcgccaccacgctcagctaatttctgtatttttagtagagacgaggtttcaccatgttggccaagatggtctcaatctcctgaccttgtgatccacccgcctcggcctcccaaaatgctgggattacaggcgtgagtcaccgcgcccagcccatgtcttctcttgattttgtttgctttctgttccaccatgccatgtttctgacagtatcgctagacaccactccagaccaccagcaaagaaagcagagggcttgcgctcagggggcaggtcctgaggagtctcctgaagtcctcccgtgcaggtcaaggctttcattaactacgcggatcaatttaaccatctctcttgtagaggagtactttaaaacctagtcaatgagtgctaatcacagaaatcatttcagattaatcttagaaataatcattaaataaatgtaataccctttaaaaaggggcataaaaacagattcaagttaagaaagtctagttgacaacaaaatgcaattccacatcccagaagcttactgaattgcattaagcttaggatgctaatattggatgtcatgtctctatatggttaaaatgcacaaagagataaagacgcttgcatttattttaaaaacttattataatacttgggtaatttatcagtgacgttgtttatttgtactgtggttaaatttttagcgcaataattgtatttcttaaaagacacgctaaattgttcctctcttcttatgcctgggaaaccatatgaagattcagtaggaaactaaattttgaagtttattccctaacttttctttaagatacattttgactatttgaatgttttatgttgttgctatttttaagggaatcatttatatcagatataatgagagaaatttaaagtaatttctacatcaaatcaatattatggtatttgtaaaaaataataataataattaaaactctgttttttctttgcagttgttttcattgtaatatgatacctgaattttatgtaagaatgtgagagtgggccaggtgcagtggctcacacctgtaatctcagcaatttgggaggccaagacaggtggatcacctgaggtcaggagtttcagaccagcctggccaacatggcaaaaccccatctctactaaaaatacaaaaaattagctgggcgtggtggtgggtatctgtaatcccagctacttgggaggctgaggcagaagaattgcttgcacccaggaggtggaggttgcagtgagctgagatcatgccattgacctctgaactgggcaacaagagtgaaactccatctcaaaaaaaaaaaaatgagagagaaaaaagaaaagaatgtgagagtggttagtttataatatagttaacatagttgaatctgactgttttttgctttcaaaacatgtattattccactaagtggtatcagttccctttgcattacagcagtcactggaataagttaaatattgttatttttgttatttcttgtccaaaaaatacacactgtacactttctcttctaatactgtcctaaacaacttttcgcaggattcactggttattctcctgcctgttgcccaagggctgtagaagatacagagagaagtaccacccagatcccgtttcaaataagtatttgctgctcagatgtgaggcgtgtggccagggatggcctctgctgtcagcatcggcacctgtccctggcagccgcaccgagaggctgagcgagctggggatctagcggttttccctttgcaggcctcggttccgacggataagataaactcacaccaacttctgcctcaatttctgcctctggagaagtccgcccataacagtctcctgccacagcctctgcagcagccacatataagaggttaaactctactaacatttccaaagcaatccttttagagaagtcttatctttcccaaatacttttctgtcaccaatgcccaatttcttccaaaactacttcttatacaattacgtgtccacactattcctcccattaatattaaaatatatttgcttgtagcaacatggtccctcctaactcaaaatatttcctctgaggtgatactcagggttagatactcccaaatgaataaatgcctcgtttctaaaaataactatttatgacatatatttcccgagaacaggattattaataatcataagtgatttagatttgtgtacagatctaaaattttcaaagtgtgttcacagaaattaacttatttgatcctaccaccacctcaggaattaaccaaatttaggaaattaaagtcacagtgattgatctgcccccagtcagacaatgaaatcggtggtgggttcaggagggaaagctgttcttatgacctccatcctggagtcatctgctttctgtgttacaacctgcacacctacagaccttctgcaaagtagaatgtgctccctgggggattggggtatatgatcctaaactccagggcttcagaatctgtaacttggatgttgccatttgaagctgaaatggaaagggagggctgtgctaacttggctccccgctttggtgccaccacactggaaaaaaaacatggttccaagtgcttactgcatggactcacttcatccttacaataactgcaagaacaagaagatgctcttattatctagaaggacagaggcaaaagatggcagagccaggttctgtacacacagtctggcttcaaaggcagggctctgaaccactgtgcttcatgtgtatcttgggaattggaaagacggctggagacaaacgcaaaagacatccaaatcttagcagtgagtaaagaatgaaaatgaaagggaaggcagaagcagaaacttctttagctgttggggataaatcacgcgataagaatttaagaattcaggggatgatttaagatcacctacatagtcacacatgtctataaataactcttggattaatggtctatgtatacttccatatttataagaataatgcaaatcagaagagccttcaccagacgaggccatttgaaagagatgggttttaagcaaactgggaaggtgatgtggagtgacgattagttactattagcaaaagggtcagtgctgcaatgatgtaggactgcagcttgctggggacagaaagtcaatctgtcttgctttgttagaacaagaaatgaaagtcagtctgtggatttaagaacagcaataccaactcctcacctacatggtagacagcttgcttttccaattgcagtttaggaacaaagggaaggagaattcactttgtcacagaattttcactaatgaatatagacaccaatgcaggaatatgtgttatatttgtgtgtaaccctaatcactattacctatgctacctctcctgaaccccagtggctgtggcactgtaaaatgggtataaataacattcaaaatgttaagataaacatacatgcaaaatatctaacaaatggtaagaacaacttgttagcaatagttggaccttctccagccttgtggaatatatactgatgtcacattatcctgacgtacacatgtgtctggactgagcgcacaagaaaacagtcctgtgcagtctggaacaccacaaagtcacttttgttccggctcagagaaggaatctaatgtggagacctgcaatgatagcaacaggtgttcaagtttgactttgtggtcacggtctggtcatttccagggtaatatgcaaggaggaggtacttcagcagaaacggaagctacgtgggatggcttggggttaggcaggtaatgtacgtatctagccggttgggtgtaaaagaaaagggagtgggaaaactggtgcatgctctgctcaaacacatagcaaatgattctatgtatttcttcaaagttctgtcttggccaagtattataaaagaatcttggggaaaacttagcctaaagaaataaagtttgggtccctgttctaccacgatacagtgaaaatgaacaagaggtgttcacaccttctgccttgcttgaactagcccggttccgtcacaccttcacctgctagagagtgtccccgtcgacggctttccctgccatcgacagaaatgcatcaggcttgatcagaaacgcaaggttttatctcagcttgaagcacctggaatagtttcttgagccacggatgaactcagtaaatatctgttgaatgaacagactaatctccttttaccttatctttgatggtagaagaggtattaaagatctcaaatgcctgcatgagactgcgttgcctgtgatactgatataatagaatgctggtatatctgtgtagcccagtgcctctcagtgttgtgaaaatccacatcgagatctagaaactcttgaaattccacttccggtgcacagaagatacagcacatgaggtcatgtttcctgtgatgcagaatgtgtcaaattcacaaggaacagaatgaacacaccacggcccttgctgcgataaatgaatttgcactccgggtgtctgaaactattgcttattttgtcacaaatagctctacaggctttgaaagctacaaaggacaactttgcaaatacttaattctaaatgtcatgagaaaatagagctacataaaggatgtttatagagggcaaggtagatcatattagtgctaatcactaaaaagtgtcccagcagtttaaaatttctatctgaagatatgaactggcacaaacattatttgcaatgaaaagtaacttcttcccctcacctagtttatagcaaattgctaattataaggataaaattgccattagaaataaatgcacaagtaatgcaatagttttctttaaaaaaaaaagttatttaaacactgtgggtatttctttcagatgaaaatggaccttaaacacaaagcttaactgttaacaaagttctagcaagggtctcttagatgcttcaggaatgtagcaccttttttttttttttttttgagacggagtctcgctctgtcatccaggctggcagtggcacaatctcggctcactgcaacctccacctcccaggttcaagtgattctcctaactcagcctcctgagtagctgggattacaggtgcacaccaccatgcctggctaatttttgtatttttagtagagacgggggtttgccatgtttgtcaggctggtcttgaactcctgacctcgtgatccacctgcttcggcctcccaaagtgctgggattacaggcatgagccacctcacccggccgctccatctttcttaatatccaccaacaggccaggcatggtggctcacacctgtaatcccagcaatttgggaggctgaggccggtggatcacctgaggtcaggagttcgagacaagactggccaacatggcgaaaccccgtctctactaaaaatataaacttagtgggcatggtggcatatgcctttaatcccagctactcaggaggctgaggcaggagaatcgcttgaacccaggaggcggaagttgcagtgagccaagattgagccattgcaccccagcctgggtgacaagagcgaaattccaaactctgtctcaaaacaaaaacaaacaaacaaacaaacaaaaaacacccaccaacagaaaatgaagtgcttaagatccagacagttacaacacgcaaggttgaccctaacggatacaaaattggtccaggatttgcaatattgccctgctcttcccagcgggggttgctgcgcacctgcggtgacagttaaatgaaaaggtaaggcataagaatttcatgcacaagcacctgtgacatctctaggaagctctgctgacgcagctgctcacatctgaagcccacaggttcaccacgggagaaatgaaggtcactggctgacattaaaactgaatggttcacatttcaaagtaccagtggggataaaatatttcttctatgctttcgtaagtaactgaccccagataatatggcagcataatctatatcctgtgacttggacttcaaaattggacatttccccttatttctaacacctccttaaaaatctccattgatttctgactaattcattgttttatctgagttaaataattaactcaattagtctattaaattcagaagggatttttaaaaggagattgtttcatgtgaaaatagtttgctttctgtttgttgcactgcatgaaacagattttcctttaagtcagcatttatttaaacctctttgatgcaaagtcttgtgctggccacggtagggaggaccagtcacactggcatgtcagtcaatttgggtcttgccctgcaagcagcctgcaattttgcagagcagcagacttggaggcagctctgtatttttctactcttactggtttttaaagacagacacacaggacaacagcgagttcaactttttcttttctctgaatctcactttactgctacattctccttttcacatgcaaatccaccttccggcctcaccagatagccttgcttttcgctgtacagagaaagccaggaccatgcaggttggagggtaaggtgtaatgaaagaatagcaatgcaagccatgtagactttggtttgtagattggtttaaccacttccttgtggtgtgatcagatgtaatttttttaatgtgatagattcaatttcttcatttataagatggaagccctaattattttaaatcaatgtagctaaaaaattacaggtcattaagcactgcatctgaatctcaaagggagcatggtgatcacctgttattgaaggctttatgcaaagattctttctggaagggtttatagcagctctccctcaagactggattagatgagggtgtgtcacacttttcagaaaagaatcactcctggcataaggagatagaatttactcctatggggcctggggcacagtgtgaagtagcctgcttcaagctagaagatatatctttgaagttttctctttcatcttaaaaagttgtaagattttccattcgactctagaacatacccttgtttattataatataaacatatttgggtctactgggagaaatatatagctctgtgtgcacaaacactggtgctacaacacataaaaatcttccaacaatttccatgacagaaagaaaaccacttactgtgaaaggctatgttaaagattccagtttaactttttgtacgtatacctgagtttctcaccatgctcctcagagtctgatgactggataaactatcagatcccatctgatccctaaattttaagaaaatcttaagttgatggaaagtagctattggtaatgtcaaaaatcagactgacaaagaacttacacagtaattctaagtcacaacagaatgccagctatagccagaattaatatgtgaattgacaaaagaagcttaagacataacaaatgcattcaaagggaattgtaactaagatctccattccctatctctctttgttcaatgaatgaatgaaagcataccaaaatccagtcaaattatctttaagtcattctcccccaggaacacctggagaaagtacaaatggactttgagataaatctttgctaatccccaggcccaagtaaatcttttaagtctgcaatccattgtggcattgcttcaataagccgaatgaattttattttaggacaaatttgaaggcaattatgaaaccatttatatcaaacaacaatgacatcaaaaacataagtctttattggaagggttgagggaaataacatggtagaacagatttttaaatttaatgcccaacagggacctgggttttcaaacatgtgtctcgaaggttaatttccgactaagcaaatcgggctatttttcggtctgcttcagctttggaaactaaggaataatgattaaaggtgagataacatacagagattcactagctgccttctatcgatgaaaagagtcaaactctgtaaaatatttaaagagatttattttgagccaaatatgagtgacaatggtccatgacacagccctcaggaggtcctgagaacatacccaaggtggctggggcacagcttggttttatacatgttaaggaggcatgagacatcaatcaaacacatttaagaaatacattagtttggtcgagaaaggtgggacaactcaaagctgggggcttccagcctataggtaaatttaaacacttccctggttgacatttggttgagtttgtctaaagacctgggagggatagaaagggaatgttcaggttaagacaaaagactgtggagaccaaggttcttctgaggtcttataatggctacccttagagacaatagaggacaaatgtctcctattcagatctttaaaaagtgctagatttttagttaatctctttaggattgggagggcctggaagaaaaatatctagctatgttatctagatagaaaaatatctagctagctataaacagatgcaaattttcccccacaaaggacagctttgtagggccatttcaagatacagcaaagaaacatgttttgggctaaaatattttgtttttcttccttgtctcataatgttatcccgaagtcagtttggaaagtagtcacaataaatagggttaaataaaacctatctgatgagaatatacgaattgtagggcatgactccccagactccttagatagaaatttgggtatgataaaaaaaatcagagtttagtcctcaatatcttgataaggatttttctattttgtatgttttcaatttttaccctttaaaaaatttagaaaactggcactgtaaagggagattgaaggagcagaaatatcaatttcgtttgggagacactgacagagggtgagccccaagacacacatgctggctagggaaagaattccggtatccctttggcttacctgtgccatttttatatgacttaggcacccaaaaaagtcctgaaccttctgttgtaacttctattggaaagactaaacaaggcagctattttgccttcaagtgctagacttactgtgcttaatccagttcttgctttttgttcagcttgttatgcttatattcataaacctcaaactatcaactgacaaccctgaagggtgaagagcaagtcactactgttggtaaggagaggagaacacaaggcttgatggccagaagggaacctgcagcttcacaaaaaacctcaggacattctggttcccagatagttcactttttcccttaagaaagagtaaaatattttgtttgtttgtttgtttgttttgagacggagtctcgctttgttgcccaggctagagtgcagtggcacgatcttggctcaccacaacctctgcctcctggattcaagcgattctcctgcctcagcctcccaagtaggtgggactacaggtgcacaccaccactcccagctaatttttgtatttttagtagagatggggtttcactatgttggccaggctggtctcgaactcctgacctcgtgatctgcccacctcagcctcccaaggtgctgggattacaggcgtgagccactgcgcccggcctaagaaagagtaaaatattttatgtcaaatgtaaactcaaaggacacaaatcatgtacctgaattaaactgtaaacctaaaatctggccatgagtcacacatgtctcttatacatcggcctacatgttacaacatatatgtgatttggtaggcgcatcattgcagacttcatctttgatttctgcatttgtcaacagacagaactaaatacaagtatttttgcaactgtctcaatcaatttataagctatgaagaagtcttattcctccctcctgcagtccttagaaccagtcagagccttggagatgacctacttaaaatcctggattttacacggaaaccaaaggccaaagaaattgtggtattctcttaaggtcaaaaagttagctttgtggcattagagcacttgaattattattaaaaaggtaaatgaaagagttatcagtctcttactatatagaagtatatttgtaaagcacaaaaacataaaattcttactttcattagtactgacaaccgaaatgagtgactgaggcagaaggctccgtcatcaaggtctattattccagcttgagagcatgcctgggaaaaacccaagtcacagctacctttgtggctgctttttccctaagaggttctcaggagatttagcatttatgcattttccttaaaagggggaggcaatgagacatacttgtgatgattatatacttgtgagcctttagatagtgcccagtaaacctacattttacataagataaggtgaacatttaaagaaaatcagaatagaggaaacagctgtctcagggagggtgaaggactgatttatcttatcttgcctttattctgtacctgggaagatataagccagtgatggacattatcagtgtggggccttttttttcttttgagacacagtttcactctgtcacccaggctggagtgcagtggtgtgatcacgcctcagtgcaacttccgcctcccgggttcaagcgattatcctgcctcagcctcccgagtagctgggattacaggcgcgcgccaccatgcctggctaattttttttttttttttttttttgtattattagtagagatgggatttccccatgttggccatggctgctctcaaactcctggcctcaagtgatctgcacacctcagcctcccaaagtgctgggattacaggcgtgactcaccatgcccagcctcagtgtagagtcttttcgaaggcctggtttctgtttagcccttagggaaggaagcctagaggtggttagtgagggtggggacatgacaggcctgtctgacctcccaccccatcatggctggaactcagcttccaaggtgtctccacggtccccttgacaaggagggattctgttcagtcagttggaggcttacaattttatttttatttctcagtataaggagtacgcagaaactatatttacagataaattaatactatcctccgattttcatctattatgtggttaattatgtctaatttgattaatgatgtatgattaatacatatatatacacataagtaaaacaattataagaataaaaaatagatttaaaacacccttttatttttaagtctgtaattatgaatttgatttatctccaggaaaatataatattttaaaataaagaccaaagcaacatatttaaacataaattcaaaagacagtaaactgtatatttataaaggacaccgtgatattatgaatagtgaatgagaaagcaattgctgaaaccagatctgttttgtagactttttgtatagctttcatatggagaaagtttcacattgttctctcacaataaaaatgcaaataagccagtgagaaattcttgtattcataaataacaaaataataaaaaatctcctttatcaaataggcaaagacaaaaattatgctgaaagagaggcaggagggagccctctcaaacatgggaagccagatcagaactagagcagtgtttctggaaaggaaggtgacaatatggatcaagaacctcaaaaatgtccattaccgtggacctgcaatcactgttatgaccgtattcttagagccaaggcatgcagtcaatgatgtctgtaaaataatatggttttcagtcttatttgttttttttttttttttttaactgtgagtaaatgctcaaaagtggggaaatggttaaatagaactgagacagccaaggtacccaagggggtacccggagaaagtgaccagcctgtgcactgggagaaagggatggagccttgggaagttcatgctgtttggggtggggaggagcctggcctctcctgatctgggtagtacctgggatttcagctggtgaggtgggaaaacctgcctggtttctgtttagcccttaggaaaggaaacctagaggtggttagtgagggcgttggcataacaggcctgtctgacctctcaccccatcatggctggaactcagcttccaaggtgtctccacggtccccctgaccaggagggagtctgttcagtcagttggaggcttaatattttacttttattttccagtatgataaggagttcacagaaactatatttacagataaattaatactatactctgattttcatctattattttaatccatattcattttgccttatagattttcatctatattcatcttgctttgctgagagtccctgttaccctttttcttttcctttttgcccaataaattccatttttctcacccttcaaagagtctgcgggcctaatttttcatggttgtgtgacaaggactctgtttttagctgaactaaggagaaagtcctacaacagcatatccccacataacggaattttaggtacctatttttaaaaaactgttttcatggcagagaaaatttattatgattttcattttttatttttttgagacagggtctcactttgtcacccaggctggagtgcagtggcacaaacagctcaatgcagccttgacctcccaggctcaagccgttctcctgcctcagcctcccaggtagctgggactacaggtgcatgccatcatgcctggctaatttttatattttttgtagggacagggtcttgccatgttgcccaggctggtcttgaactcctgagctcaagcaatctgcctgcctggcctcccaaagttctgggattacaggcatgagctgccacgtgcatgcctggcacagagaaaatttatcataatgtcctgctaaatggaaaaagcatgatacgaaactatatatatatatatatatatacatacacacacaatataattatacagcacacacacactgcaaataggcataatcaagatattgcaaaaaaattaaccagaaattttactaagcatgagggtaaaaataacttctaacactttttttttttcttgagacggagtttcactattgtcaccctggctggagcgcagtggtacaatcttggctcactgcaacctccacctcccggattcgagtgattcttttgcctcagcctcccgagtagctgggactacaggcatgtgccactacgcctggctaatttttctatttttagtagaaacagggtttcaccatgttggccaggctggtctcgaacttctgacctcaggtgatccacctgcctcggcctcccaaagtggtgggattacaggcgtgagccaccgtgtctggccacttctaatgctttttatagtttattgtgaattatttctaaatttaaaaagaaagcattatcaggaaaaaccccacaatgatcaccaaactgcacggagtgtccgtgcaggcgctcataatgtccttacacgtggatccctcgaagtcagaagaaagagttcttctctctttcttacatatggggcacttggctgccttacacgagaagggaccttattcaatcaagtggttggttatatacacacacccttaagatgcatctggatatagtcgcttctatttataaattctcccaaaggcaatcatatgaacaaaattaatgtgacaatattatttttccagcaattatcaccctgtgtatctgggaagtaagtggctcattctcttcgaaagatgttgccagttattaatacgaaagtgacagcataacagcaggaaacggggagggcaacgctcttagtaagataataccatcatcaccacatattttaatgtcatgtttaccaaccttaatggaaagtttaaaatactggctgatgagctgttttctgacttacagaagagtattttgaatttttcctttgaaaaactgaacagtgacttaaattacctgctgctatcagcgcagtcaagccctcgcttttagcacttttcaatccctttcccgaaacaccagaatccccatcttagctgttcttcttgcatgttgaaagcgttagccatacacagtcattcaccttgccaagagaggctgaagcgctatattttaaaggcaatgttgtggtgcttcctgccacagcagtgactaaacatgcagcaaagagaaaatcacgtctcatttttattccttcttggaaacaggtttgttcaacagatgctgttaaggtttttgggcttctattaatcaacattttaattttaatttattagagaatagaaatagcctgataggagtgtgaatatttgcttatcacgaaatcacagagtttaaagcaactttaaaagaccatctaatacagttccaaaagccagagagagacaacacttaaaatgattagggtatatgactatttttgcttaaaagtctgaaacaatagattctttgactttattcattaattcattttggcatttcattaaaaagttctttctgggctgggtgcggcagctcacgcctgtaatcccagcacttggtggggctaaggcgggcggatcacctgaggtcaggagttcgagaccagcctgaccaatatgaagaaacccccgtctctactaaaaatacaaaataagcctggtgtggtggcgcatgcctgtaatcccagctactcgggaggctgaggcaggagaatcccttgaacctgggaggcggaggttgcagtgagccgagatcccgccattgcactccagcctgagcaacaagagcgaaactccttctcaaaaaaaaaaaaaaaaaagagttcttcctgatatgagggctaagttctcactattgcaatttgagcttcttagccaacttcaaagaacatgtaacgaagctaatttcttttctctgtccattcggaaagtgtagagtaaggaattgtactctgaattgcctactctgcagagcaaacagactcagtttcttccactttgtccttggctcctacaccgcaattcgtattgagtcgttttccctttttttactaacaggccatctccacatttgcttgcttttcttgtgttcactgggattagaaataacaaggtcccaaactagctacttgctttcattttgagtgcatgaatgtgtgcgaagcctcagcataaatataggcaaatatggagaactgaaatgtatggaaaagacattttaaaaataaaatgtatgggctacatgttgtggtgttcataaattttttttccattcctggccgggtgcagtggctcacgcctgtaatcccagcactttgggaggctgaggtgggcagatcacctgaggtcaggagttcaagaccagcctggccaacatggggaaaccctgtctctactacaaatacaaaaaattagctgggtgtggtggcacatgcctaatgttaacattttaaatgttagcaccatattttaattttattttggaacttaatggatgagtttacattttatactcaaatatgtgagcttatattttaatatcaactaagattacatacactattttagatatgccatctcccatcttaggaccctatttacctacttaaactaagtcactggcattttaaattgtttcctcacattaaaatatacccaaattgggcagacgcatcaaaataaagcagacactccccaggaaagagagttcactgaggaaggctcgtgtggcagaacaatattgggaaagtaaggaggggggagtgatgctatttttagatccttacctcacgtccgtggagggaagtgacactatttttagatccttacctgacgtctgtgcacgtaatgcaagtgatgttccgactatttgttgcgatcaggtgcaaagctactgatgtttccttgtcagaggtggggtgtgctccacatttaaagaaaaattcctgaaagaaagataaatatgatcacacacatggatcccggctgctcatttttcctctaaatgtttccacagtaaacaatctctttggacaagagaagaaatctgttacgaggtgtgagatggaaataaatcagcatcaaacctttcccaggaacggatgaccttgtgccaaagtggtcaacaattctgttttagaagggccctgagtctctgctattcttttgctctttaagcgagggagctggagaaatacgctgtgaccttctttaagccatgcccctcgatgataataagtgagtctagaagaatcacacgatgtggaggtgggaggaagcctctcactaatgaggaaagggagacgtgaagccatgaaatgaggtgcccacgggtcaaacagtaagaggtgaagccaagaagtaacccaagctccccgcagggaaatccagtgctttttctccagtatcactacatggttagtcatttagcggagtcaggaattgagagagccctactgtaaatagccacacaagtacacatggactcctggtagacacagaagtgcagcagaggcccggcgcgttggctcgcgcctgtaatcccagcactttgggaggttgaggcgggcggatcacctggggtcaggagttcgagaccagcctggccaatgtggcgaaaccccatctctactaaaaatacaaaaattagccgggcatgacggcacatgactgtaatcctagctactcgagaggctgaggcaggaaatcgcttgagcccggctgaggcaggagaatcacttgaggttgcaatgagctgagatcaccccactaaattccagccgagagtttagcagagcatggctctcccagccccatctggagtctgccccttttctgcctggcatcaacaccccagcattcctgcgaagactctgccgcccaccctctgtgccaggcaactggaatgctccaatccagtatcttgctgcttcttagttcctttccccagccaggtcctgccacatactccctcattttagcttttcacataggtcacgttcttttgattgataatattctcccttctcaaccacgttttttcttcacttttttctgttctaacttctgtatttgttctcactctccttctgttcactcacacaccaaggcgtttggccagcaattgctttacttcttgtcccacagtctgcatgccttccatgatactaacatctgtgaagctaaattttttgctactgaaaaaaaaaatacatatattttactggatgacagaataacccctgcataccacacatactcctaattccacttgcgtttaactacctgaaatgtgggaaggattttcccttaaaacacttgatctggtattgacaaactttgatgtaaagtgccagatattacgcattaagtgcttttggttttgtagggtatatggtctttgtcacacttctcaacttggccttgtagctaaaaacagccataagcagtatgcaaatgaatgggtgtggctgtgtcctaacaaaaccttatttacaaaatatgtggcaagttggatttttccctgcaggccatgatgagacatttgtagaatgctttattcatatttgtattctaacagtgactgacattaggataggcatgacatatacttcttttttttttttttttttttttgagacggagtctctgccttccaggctggagtgcagtggcgcgatctcagctcactgcaaactctgcctcctgggctcacgccattctcctgcctcagcctcccgagtagctgggactacaggtgcccgccaccacgcctggccaatttttcgtattagtagagacggggtttcaccattttagtcaggatggtcctgatctcctgacctcgtgatctgcctgccttggcctcccaaagtgctgggattacaggtgtgagcctgtaatatgcccagcctgacatatacttcttaagtgaaaaacaatagattaatcaacgctatttaatcaatgttatttatcatttatttaataaatgctatatgttatccccttatacgtttgacagcaacatttgatttcttcttttcctgtttataatttactaacctcatcctcctctgacatgtgacaccatgagcaacagcccttggtctgaagctgtagtgtgcatcagaatcactcgggtgggagggggcacggacttgctaaaccagagatcgctgaacccaccctgggatttttgtgatttctgggatggcatcaagattcgcatttctaacaacttgccaggtgatgttgttcctaccgctcaggggcccacacttgggaaacctgagctccaccaatgtcagaggcaaagtgagtaaactctagttactctctcgcaagaccgctgctgtggcaggtcgcttaccgtgtctgaaaataatgctacatcttacgtaaaatatgtgactctcaaaaatctggagtgtgccattttactttttttttgagacagagtctcactctatcgcctaggctggaatgcattagtgcagtcttggctcactgcaacctccgcctcccaggttcaagtgattctccctccttggcttcccgagtagctgggattacaggcacccgccatcatgccaggctaatttttgtatttttgtagagatggggtttcaccgtgttggccaggctagtcttgaactcctgacctcaagtgatccacctgcctcggcctcccaaagtgctgggattacaggtgtgagccactgtgcctggctgagtgtgccattttgatgagagtatcccaaagccagggatttggaacccaggctattcttcactacaagtctcaccaatcccaggtggtataatttagttaactaaacctatcctatctggggcagtggaatatcagccggtcctcacacctgcagtcctcagcccatggaggcatgtgtgtggagtcttgctggagtggacaggatgtccagtgtgtgtgatgggcccaggctcaggcatgcctgtggagtcctgcccatgagtccaggaccttccccacagcagcatggaaatcatgctggctgatgtttttgtttggttatgttttgttttcctgaacataggatcccattccttttactcaatcttttgaaatgtgacaaatccttcaatggccagctcaagggtattgagaaagagatttaaaacaatgtctgaacaccaaaacgaaaagtctgaaggacatgactgacccttatgaaatacgctgagctagctacgactggtttttgcagacatgaaaaaaatcctctttcaaaacataaagtaattcctccaaaacagctgagttggcaggactattgaaaaagtatttcatatacagataaatagatagaaagcacttacgttttttcttagcttacagaaagctgcagtggacattcagctaacaaatcacaaattgttctaacaccagataaaattcagccagataaaagcctttttattgggggtaggtgtttatagataatggtttaagaaattacagatagttgaaaaattctagtaacacatatagtgttgataaaactaaaactcacattgccaaccctatattaaatatgtatgcctcaacagtaaatttcagtgctttctccaccaatttttatgaaagaatgtttttgttgtagtactagaataactggcaagaactgtgaagaatgtgggattttacccagcttgcaagttagcaagttagtttgctgcagtatcataaaagctgacagaagacaagagactcctggatcagagacaaaggactgcagaactcagagcacagggagaaagaagcatgagcatcatattacaccagttcccctccacacgtctctctcagggttgaagtagataggctaagtcagattctacaggtgcagtggttttgcatcacaaatgagaactctgaacttaggaaactcaaatcttctttaagtagttctaagcaagtcatcttttcatcctgaagggaaacattgtctttattatactgcataataagcaaatctgccttttgatctggagagaaacattatcttctctactttctgtttttttggtttttttttttttttttttttttaagacagagtcttttctgtcgcccaggctggagcgcagtggcacgatcttggctcattgcaagctccacctcccgggttcacgccattctcctgcctcagcctcccaagtagctgggaccacaaggcgcccgccaccacgcccggctacttttttgtatttttagtagagacggggtttcaccatgttagccaggatggtctcaatctcctgacctcgtgatctgcccaccttggcctcccaaagtgttgggattgtacaggtgtgagccaccacgcccggccctatcttctctactttcaaggtcatttgctctaaaacttccttgaaaagatgggtcagaacaagttggtgtctccctcagagatgagcggacaaatgacagacccatggagaattgcttctcaataataacaccttttcttgcaggctaatttgcagttattttattgtattttattttattgtattttattttattttattttattttatttttttgagatgggagttttgctctttttgcccaagttgtagtgcaatggtgcgatcttggctcactgcaacctctgcctcccaggttcaagtaattctcctgcctcagcctcccgaatagctgggattacaggcatgtgccaccatgcccaaccaattttttatatttttagtagagatggggtttcaccatgttaatcagctgatgtcaaactccagacctcaggtgatccaccggcctcggcctcccaaagtgctgggattacaggtgtgagccactgtgcccggccgatctggtcatttctgctcctgtacaatcagtgggctggattgttgaagtcttttctgacacttccaatctgtattcaaaaccagcagacaataaaggaacacacaatagaagtgagaagggcctttttcgaaaattccaccttgggtgtctgagatggcttgttcacacatgggtgtcatctcacagacagtggcatgattctttgggattaactgcctctgaattctgttttgtttctcttaattactcagtttaaaaaattaaaaaagtcaaagacaggaaagctttctagctggagtccaagaaggctggtcagaaggctggcaccactgcaccactgtgaggtcactggggcatagcagggcccaagccaagtggccaagaaacatctccagctgtgctgagcgacagtggttatgcctgaggcaaggctgctcaaggtggcattgtttgagttctagcgtgtgcaggggttggccggggaagttgcttctcggtcactagggaagcagagtattctgggggagcagccgggcagtgtcctcttcatcaggaagcccagctgtcaattctagtgtggctggaacagaatcctttacggcgggtaaactgagtctcagagcggcccaccccacctcttacaaatggtagttcacagataaatcagctacagaaagattcccccacctaaccaggagctataattcccaggggcttactcacatcatttgtataccaatagtcacttctgggaaaccttaattagcgaagagagctaaaatctataacagcaaatggccagttttttgtttttgtttttccaaatgatagcctaaatgattttatacttgaaaaaaataaggctttagaaaatgtgcttggctttatattgtgacactgttaaatgccataagcgttttcaactttatttatttttttgagacacggtctccccctgtaacccaggctggaatgcagtggcacgatcttggcttactgcaacctacgcctcccagtttcaagcaaatctcatgtctcagcctcctgaatagctgggatcataggtgtgtgccaccatgcctggctaattttttgtatttttagtagagatgaagttttaccatgttggccaggctggtctcgagttcctgacctcaagtgatccacccacctcagcctttcaaagtgctgggaaaacaggcaagagccactgcgcccggaccgttttccacttcattagtattaaatggaaaacccaacaaagttgtattcctcaagttcttagaaaggctactcatgcttttaccatttctctggacaaggctgtgatcccttccttccattcttctctttcatcataactcacttgccctctcctcctcactgtcgaagcctgaccctccaaatcacatcagacccatacaaatcaaagggggaccaggggagaagagcaggaagatgtcaactggactgtggtattcctggaagccactcctgctcacttatgtcccttcacccatgactcataagcagtgccactcacaaagaggaaaactagagcaagaagaatggaataaatagcccagcaaaatctgaaaattagattgacaccaagaatccaactgtataaacacatttacgatcagaagcgaattagccaaacccaaatacaatttgatagatttcaaattactataaaggtagatgacaactggcttgaaagccctgcttatcacagtcctaatatggtcaaatctgaaaaaatcattagcagtaagacctgacttagttacccatgatccttccaatagcttttattgaacatcctaaattttatgtttatagatattgtttaacaattatgttttccaaacgaaatattgtatctatcttcacaaagagttaaattccattcttgtctccaaatccttcttagttaatatttcccaaaagaaaaaaaaactatccttctcttgataaagtaatggggacacacactttccactaacaaggttgcaaagggtatagggtttgtacttaacacgtaactgcatagctatttgcatggctcagggtatagttaggaaaacagggcccacaccaggtagttcaactgacggaattgaatgagattagttatagaggagtggaagcacagaagaactaaacagagaaaggaagccacttgagattagcgtcattattgcacagctgccatctggggctagaggacaatgggagaaggtattggagtcaccacagctctgcagctgggctatctggttgggagtctgacaatgaatgggatgaagccactgccagagatgtcccctagagagagagggagaaatgcccctggcttctgccttctcttggccctcccatctccagaaacagccccaacttacagagcagagagggggaaaaggtggcttgggtctgaaagccaccagcagatgactgctgcaccaccacgaggtggaccctgtgtgagatcaaaattctccaagtgtcaccctttgttagtggtgacacattctaatcagcctccactaaaaacaaaaatacacattcagatattgttgtgaaatatgtattgaagatacagaaatactcacacaaatatacattgtatattgagattaaactcaactatactcgtcaaaagactatccatccaaattttccgatgatattaacaggatacagggctgtggttactgcttatgagatgaactcgtaataagtatcttacatctatatcagaaagattctcacagttaccaagttaagacagacagcctgtcacttcaaatcaatctaaatgcctctcacaaacctaaaatcctgtttgtagctaacagcaacagatattccccagttactctctcctcagaaactgtccaggctagaatagttcctcgttagtgagatacagattcttttctaagacacaactactagttttaagtcttcctatccatgcagaggtttcattattaatcttaataataaagttttaattttctttaagttaaaacatgtcagctgggtagggtggaacacacccattgtcccagctatttgggaggctgaggcaggaggatcgcttgagcccaggaatttgagaccagcaagggcaacatagcaagaccctgtctttaaaaacaaacagaaactccacaaaaacaaaccaaaaaatgccagataaagcataaccacaacattctctacctaatacataaaaaaagcctttaaaatagccatggcaaagcctgtttatcttgtgacttctttattgtgtcttagccttcatactgaagtgttcgacttactgggtattacataaacccagtaactgaatttatcagttctgatacaaagtaactatgcaaactggaggactatataataaatgtacactttgttaaattaacaatgccagttttacaattaagttacacctagtcaaacagatcagacctaaaaagttaatgagtctatcaccatgttcaattacaagtttgttttctctcaagatgtcaataaagcctctagatgatgtgcaaagtttatcaggagaaagaaaatcaatatactccacacaaagcaaaaccatgtcacaactttgctgagaaggaggctgtcagtttatggtacatgtcttcaagaagtctaacttaaaacaaaagttggctaatataacaacccacatccgccccttctctgcctgattgtaagttcttcagtgtgccttgaagtttattccaggtgtaatgccactcagccataatttgatgtttataactttaagagcaaaagggagattgttaaagaagatgttaaaagtgattcctgaaaagtaaaataaaaggtttgcccactgctcaaggaaataaaagaggagacaaacaaatggaagaacattccatgctcatgggtaggaagaatcaatatcgtgaaaatggccatactgcccaaggtaatttacagattcaatgccatccccatcaagctaccaatgactttcttcacagaattggaaaaaactactttaaagttcatatggaaccaaaaaagagcccgcattgccaagtcaatcctaagccaaaagaacaaagctggaggcatcacactacctgacttcaaactatactacaaggctacagtaaccaaaacagcatggtactggtaccaaaacagagatatagatcaatggaacagaacagagccctcagaaataatgccgcatatctacaactatctgatctttgacaaacctgagaaaaacaagcaatggggaaaggattccctatttaataaatggtgctgggaaaactggctagccatatgtagaaagctgaaactggatcccttccttacaccttatacaaaaatcaattcaagatggattaaagatttaaacgttaaacctaaaaccataaaaaccctagaagaaaacctaggcattactattcaggacataggcgtgggcaaggacttcatgtccaaaacaccaaaagcaatggcaacaaaagacaaaattgacaaatgggatctaattaaactaaagagcttctgcacagcaaaagaaactaccatcagagtgaacaggcaacctacaacatgggagaaaattttcgcaacctactcatctgacaaagggctaatatccagaatctataatgaactcaaacaaatttacaagaaaaaaacaaacaaccccatcaaaaagtgggcgaaggacatgaacagacacttctcaaaagaagacatttatgcagccaaaaaacacatgaagaaatgctcatcatcactggccatcagagaaatgcaaatcaaaaccactatgagatatcatctcacaccagttagaatggcaatcattaaaaagtcaggaaacaacaggtgctggagaggatgcggagaaataggaacacttttacactgttggtgggactgtaaactagttcaaccattgtggaagtcagtgtggcgattcctcagggatctagaactagaaataccatttgacccagccatcccattactgggtatatacccaaatgagtataaatcatgctgctataaagacacatgcacacgtatgtttattgcggcactattcacaatagcaaagacttggaaccaacccaaatgtccaacaatgatagactggattaagaaaatgtggcacatatacaccatggaatactatgcagccataaaaaatgatgagttcatatcctttgtagggacatggatgaaattggaaaccatcattctcagtaaactatcgcaagaacaaaaaaccaaacaccgcatattctcactcataggtgggaattgaacaatgagatcacatggacacaggaaggggaatatcacactctggggactgtggtggggtcgggggaggggggagggatagcattgggagatatacctaatgctagatgacacattagtgggtgcagcgcaccagcacggcacatgtatacatatgtaactaacctgcacaatgtgcacatgtaccctaaaacttagagtataataaaaaaaaaaaaaataaaataaaaggtttgcagtcattactgacccttataaaatgcgtgaaaactaggaaaactaatattctctttcccagctcaaggtacttgctccaataagctcagatggctgtacctccttttcccctccccagcccaggggtgaacaggcagctctggcctcagcggtcagagtaaaacaggctcatacatgtgaccacaatgagatacctgtctgagaaccaagccggtgctcagaaggaaaaagtgatgagagaaagacagtctccaagaaagagatcacttgtaccctggatccagctatgcctgatgtttccccagttacttattaatttttatttatttatttattttgagatggagtctcattctgttgcccagactggagtgcagaggcgtgaccttggctcaccgcaacctccgtcccgtgggttcaagcaattctcctgcctcagcctcccgagtagctgggattacaggcgtgtgctaccatgctgggttaatttttgtatttttagtagagatggggttttgccatgttggccaggatggtctcgaactcctgacctcaggtgatccacctgcctctcaaagtgctgggactacaggtgtgagccaccctaatccctggctgtgtttttcattctttaatttagcagtgcccataggcacttccaagactgatttccatattatctgtcagactgcaaaacaaggattttcctttattatctttattatcttggagaaagctttgaccttaggcgttgtcccctagataatctatcactggggaatttttcagagcaaatgcttccactatgtttgttgctatttctttacttgtgcatatgatcttgctgttagcatttcatgaagggtccctgactccaaacgctttagaactatgggacagttgtcaaagttccacgctgcacagcctccctgagagtgagcaggaggaccctgctggccagatgaagcagccctccctgacctctgactcattcctgggcaggaatggccatctcaggggaaactggatcgggattacacacaacacagcaaccatgtttttttctttccttaggttttggactagtggctctggtgtggtaccagcttcccctgcatttctctcccaattccaacaaacgtttggagattgtaacttgtctcacctcaacataatcgcagtgacttatgcgatgtcatctgctcagtttataaatcgagcatatctcttccctttcaattttgtagcctagcccgacaataaaagaacatttattattctagctgttctttctctcctttagaagctaaaggtttcacatgctctcataatatgtcagcttcaagaacataacggcacccaaaacatttgctagttgcatgtttaggccaagctttccagcttttgtgctcagataaataagatgttaaaatatctggttgttaacatggaatatttccttttgtaatctcccaccaccgagtgttcgactccatgatttgacctccaggagaggacatataaacgaacatgtgttagctggtaattatttacgagaaactgaggagacaggtcacaattttgaaaattccttatgactcaccatccctagatgagttactatattcctaacattttctagggagtctctagaagacagtattattttacatttatttctaaatgtgcaaaacacttattctaattaacaatggcaaacaatgtagacgagctatgtaatcatttcactgtctgggttaattatcttccaggccaagcacactggccgagcaaggccttgtagactttctaacctccttgcctcactgcctcccacctcacctgcccacctctcccttggcctgccatggagaccctttgaggaggggctggacttccccccttcactctggccccttgcttgtggtttgagctcagcaggatctgtcttcttcctctgctttgtccactcattttgcctttcaaagccctagatgtctttcggcctcagtgtatctatcttcaaccctggaggccttccttgatcctgtccctgttttagctagtcctcaattatgtccggtgcctaagctctccataagatacatccaccagtgtgtcatgtcagtttaccattgccatggcaacatccaggagttaccagccctttccatggcaatgacccaatgacccagaagttactactcttttcctagaaatctctgcataaactgccccttaatctgcatgtaattacaagtaggtataaacatgactgtagaactgccctgagctgctactctctgcctgcagggtagccctgctctgcagaagcagtcacagagctgtaacaccaccggagctataacactgctgcttcaataaagtggttttcctctactgtcagcttgttcttgaattctttcctaggtgaagctaaaaaccctcttgagctaatccccaatttaggtcttccctccccaacatcactattcttgggaattaagtaattcactctgttctctccctgctctttggttagtctgcagtgtcctttttttttttttttttaagactttgatattccatcttttgagttacaattgggacaactgagagaggggaagagctggagtggggtgagaactaggagggctcaacagctggaggtgtagttcacttagtttttgtactggaagggttcatcactggtttcattgagaagtcaggtgcgacgagagcttctgtcacctacatattcctcctaacatttactgctgctgttgaatccattgtgctgtttatttggaaaatcccccccactccctggaccaagtgagagcggaacagccagacctgagaaatgcagccacagcaacttcacagtgtccagtctaggcagggaaagtgcaagagaaacataccttttgatagcaatacttcacaaaatgataatataactggtttgttggctatgagcaaaaagaaatattgagcaataaaaaaacagcctagctttaaaacattttaaatgactttagacttggaatctaaacttttttcgttcaaaagtccttgtttctttagcaagtagaatttaaagcttctttttattcgtgtcttctttattgcaggcagcacaagccatcataaacattccactcaagataaactgggcaaaggcaagtgcttaacacaatttaatactttctcacattctatatatttactttatttcctcattaggaaaagaagaaaataaaatgtaatttgtaaatttacctataaaccatataccggaaaactaagatgaataaaactggaaaataaatgttacactgagttttttcttttaacatgccagtacaagtgataaccaatggaagaattaaaaactcaaccagccatcctacttatgtaaaatatatatcgatgggcgtagacatgtgtgctttatacatatgatcatccctcagtatccaggagggactggttccagaaaccccctgcagacagcaaaatctgcagatgctcaagtccctgatataacatggtgtagtatttgcatataacctaagcacatcctcctgtgtactctaaatcatctccagatcatgtagaatacctaatacaatgtaaatgctgagtatatagttgttacactgcattactttttaaatttgtttttaaatattgtgttattttttgtttttatttttgaatattttcagccgatgattgaacccaaaaatgcagaagctgtggatatcaagggctgatgttacatagattgactgaaaaatttcggagtccaattaatactgcatctaaaataagttaaataacatcaaaccttttgtgtcataaggacaccattaaagttatttatttgtttatctctcctctattttttgagaaatgtatgctgtgttggagaggcaaagaaggaggatggcaaatagtgcagcatcatccggttgctaagaggcatatgtaaaaacaaagaaacatcccacaaggcaagaagaggaactgttagagtgaacgatgctccctcttagcccaggcttatcattatagaacaattctcaggcgatggcatctatgggcacagtttgtgtgtgagggcaaaagactcctgtacagctcatgcccccaccaggagagaaaagttggtggccccggccttccatcactgttggggaaaagtcaggaagagtcagttcttccaaaggggaaaaaaaattttttttttaatctaaagaaaattcttcagggctgggcatggtggcttatgccagcactttgggaggccgaggcaggcggatcacctgagatcaggaatttgagaccagcctggccaacgtggtgaaaacccgtctctactaaaaatacaaaaaattagctgggtgtagtggggcgcgcatgtaatcacagccactaaggaggctgaggcaggagaatcgcttgagcccaggaggcaggggttgcatgaggcgagatcccgcactgcactccagcctgagcaacacggcgagactccgtctcaaaaaaacaaaataaaataaaataaaataaataaataaaaagaaaaattttcaggaaacataactaggacacaataaagtgtttcaatcaggtttaaacataacttgagaatataagaattttaaaatttaattaaaagctaaaaaagaagagtaaaaacagagaaaacctattaataaaatggaaatcatgagtgaaagctcagagccatgaacacgacagtgaggacatcaatatataaatcataaacacagagaagcggaacccaaaaaaaaattgcagaaaagatcttctgtgggttaaagctacccaatggataataccagtactacagagcattttcattgactgcctgattattataacatgtttggtaagttacttaatcaaatttatggtagctgtctttatcatgtttaatttagctgatttttaaaaaaatatttacaatgagctttatcttttttttatactttaagttttagggtacaagcgcacaacgtgcaggttagttacatatgtatacatgtgccatgttggtgtgctgcacccattaactcatcatttaacattaggtatagcattaggagacatacaatgagctttagtacaaacagcttctaagtttgatcaagtgatttggattcactatggacataatcacacacatctcttttaagctttagatagcatgaattaaattgatggatatgtgaagattatgatatcctgacactttgaaataaacacttactcctttcttactttcatagtgcctggaaatatatatatacaccatccagggcctggggatcaaacagccttacccgttacagctggtgcccatgcacatcagggggcctgaggacaggtctgccttcctgctgctgttcccaccagtgcgtggatataccatcaactgggagcctgggggtcaacctaccatacctgttgccactggcaactgtgtatgattgcagggcctgtcaacaggtctgccctgtccttgatgcctgtgcataccatctggggcttgaggataggtcagttacaccccccaccacctctgctggcacccaagcatgctatatggggacctggggaccaatgtgtcccagccgccacagcctgcacccacacacactattggggacctgaggacaggactgccccacctgatgctaccactgacagtgcctgcatgcttcatctggagacctggggattgatctgccccacatgctgctattaatggctatgagcaccttccagggccctgacgatgggcctgctcagcctgccggtgcccacatactttgactgtgggactggggaacgaccctccctgtctgctaccaccagggctcacacacaactcccagaggactgaggatgggcccactcagccggctgccatcaccactgctggccatctacccatatgcatcacctggaggcctgagcactggcttgcttaccctgccaccaccaccactggtgcctgcatatgctgactaggaaccagagatgtggcttgccactactattgccatgaatgatgccacacaccacccaggagcccaaggaccagcctgccctcccagcccactgccaccactgccagcacataagcagactatctggaggcccaaagtttggcatacccaaaccactggtgccaccactgtgcccgaagaccagcccacttggtgtccctgtccccacaaaagcttcactgcaacctctactaacaagtgctgcccgagccactgaagagatcacagacacaactgatgctgattacagctgaagaaatcattgagacattacactgctgtgcccagctagaatcaaagccaaggtgacctaccaaagcaacattataaatacatctgtagaaaaaagtagtctttttctaaaaaagccaatccataaaattggaagaagcaactgctacatcagaggcactgtaaaaagctcaatgagatatgatagaacacaaataaaagatacgaaatatcagaaaaacaattcatgatctgaatgagaaactaaacaaagagaaagatatttttaaaaatgtctaaacaaaaatcctggatctggagaattcaatgaatgaaataaaaatacaattgagggcttcaaaaaaagatgagatcagggagaggaaaaaagaattctgaacttgaaaagagatcatttgaaataacccagttaaaaaattttaaaaaattattaaaaaataaagtaagcctatgggatatatgggacaccacaaagcaaacaaatggaatttggggtgttccagatggtgaagtgatgatcaaagacatggaaagcctatttaacaaaataatatctgaaaacttctcaagtcttgcaagagacttagacatccagatacaaaaagctccaagaatcccaaataaattcgactcaaaaatgtctttttcaaggaacattagagtcagactgttaaaagttaaagacaaacagaattctaaaaacagtaagagaaaagtgtcatgtcatatataaagctatccccatcagacaaacagcagatttcacagcagaaaccttacaggcaagagagaataggatgatatagagtgctgaatgaaaaaacatgctaggaaagaatattctaccaacaaagctatctttcaaaaagaaaggagaaattaagtctttcccagacacaaacagaaggaattcatcaccactagacaagtcttatgagaaatgctcaaggaaattctacatctggaaggaaaaggacaatatgtaccatcacgaaaacacacaaaagtgcaaaactcaatggtagagcagacacacaaaggagaaatgaaggactcaaatgctactattacagaaaaccaccaaaccacaatgataaacaacaaaagggaaagaaggaacaaagcatatgcgaaacaaccagaaacaactaataaaatgatggaaataagtctttactcattaataataacttcaaatgtaaatggattaatttcccccataaaagataataaatggctaaatgaattttaaaaaatggcccaactggccaggcgtggtggctcatgcctgtaatctcagcactttgggaggccgaggcgggcgggtcacctgaggtcacgagtttgagaccagcctgcccaacacagtgaaagtccatctctactaaacatacaaaaaattagcctggagtggtggtgggtacctgtgatcccagctactcaggaggctgaggcaggagagttgcttgaacccaggaggtggagcttgcagtgagccaagagcacaccactgcactcagcctgggtgatgagagtgaaactccgtctcaaaaaacaaaacaaaacaaagcaacaacaaaaaaatggcccaactatatgatgcctacaagaaaaacacttcacctataaaaacacataaagatgacagtgaaaggatagaaaaagtcattccatacaaataaaaaccaaaagtggacaatagtagctatacttacatcagataaaacagattacaagtcaaaaaatctaaaaagagacaaagaaggctgggcacggtagctcacgcctgtaatcccagcacttgggaggccaaggagggcagaagtcttgaggtcaagagttcgagaccaacctggccaacatggtgaaaccccatctctactaaaaatacaaaaattagttgagtggggtggtggcgcacctgtaatcccagctactaggggggctgaggcatgagaactgcttgaacctgggaagcagaggtttaagtgaactgagatcgagccacagcactccagcctgggcaaaagagtgagattctgtctttaaaaaagagagagagagacaaagaagatcatcatataatgaaacatgtatcaattcagcaaaaggatgtaacaattctaaatatatgtgtacccaatagcagagcacccagatatattttttaaaaaattatagattgaaagggagagatagaccctgatacaacagttgggggcttcaatgcccctatttcagcactggatagatctatgagatagaaaataaagaaacactggatttaaattgcacttatgaccaaatggaattaacagacttctacagaacatattattaagctgcagaatacactttcttctcatcggcacatggaacactctctagaatagatcatatattaggacataaaagaagtctcaagaaatttgttaaaatcaaaatcatatcagatattaatatcttttcagacaacaacagaataaaactagaaatgatagcaagagaaactttgggaactgtacaaatacacggaaatttaacaacatgctcctgaatgaccattaggtcaaggaagaaactaagaagaaaaccaaaaaatttcttgagagaattaaaaatggaaatgtaatatattaaaacccgtgaaatacagcaaaagtactgctaagagaaaagtttatagcaataaacacctacatcaaaaaagtagaaagacttcaaattaacaacctaacaatgtaccttaaagaactagaaaagaaaggacaaaggaaacccaaagttagtagaaggaaagaaataataaagaccagagtggaactaaatgagatagagacaagaaaaatgtaaaaaggattacaacaataacaacttggtttttgaaaaagataaaaatcacaaactactagttagaataaccaagaaaaaagatagaagactcaaataaaaaaagcatacacgaataggagacattaccactagcaccacagaaatacaaagaatcattagagactattataaacaactacatgccaacaaattggaaaatctagaggaaatatataaaccttggacacatacaacctaccaagaatgaagtaggaagaaagaaaacctaagcagacccataatgagtagtgagattaaagcagtaattaaaagtcccccaacaaggaaaggtccaggacaagacggattaactgcagaattctatcaaatttatatagaaaagctaaaagcaattcttaaactatttcaaaaaggtgaagaggaagagattcttcctaatgcattctacgtggccagcattacattgataccaaaaccagataaggatacaagaacaaaagaaaggaataggccaagatcactgtcttagtcgatttgtcttgctatattggaacacctgagactggataatttataaagaacaggggtttatttgacttacggttctgcaagctgtaaaagaagcactgagccagcacctgcttctggtgaagggctcaggctgcttccaaccacagcagaaggcaaaggagaaacagcatgtgcagagatcatgtgacatgacagaaggcaagagagcaggtgaaggtgccaggctcttttttaaacaaccagctttcatgagaactaatacagccccttacctgagacagggcattaatctattcatgaggaactgctcccatgacccaaacacctcccactaggccctacctctaacattggtgatgaaatttcaacataagatttgggtggtcaaatatccaaactatagcaacccgttatgaacatcaatgcaaaaatcctcaacaaaatagcatatcatgatcaagtgagatttttctcagggatgtaagaatggttgaacataaacagatcaataaatgtgatacatcacatcaagataatgaaggacatatagaagcatggtgtgcagaaaaaaaaaaaagaaagtgaaggacaaaacccatataatcatctgaatagatgtagaaaaagctttcgacaaaattcaacattccttcatgataaaacatcaacaaactaggcatagaaggaacatacctaatggggaaaaggtgaacgtctatcctctaaaggactgaaacatgactaggatgcccactctcactactccaattcaacatagtactgaaagtactagccaagtcaatcaggtacaagaaagaaaagtcatccaaactggaaaaaagaaagtcaagttgtccctctttgcagacaacatgatcttatatacagaaaaacctagactccaccaaaaaactcttagaactaataaatacagtaaagttggaggacacaaaatcaacatgcaaaaatcaatagtgtttctctataccaataacaaactaattgaaaaaaaaataaagaaagcaatcccatttacaatagctaccaaaaaatctacttaggaataaatttaaccaaggaggtagaagacctttgcaaggaaaactacaaaacactgatgaaagaaattgaagatgacacaaaccaatggaaagacatgccctgctcattgaccgaattaatattgttaaaatgactgctcaatgcaatccctatcaaaataacaatatcattcttcatagaaatagaaaaaaaaaaaacagtcctaaaatatgtatggaaccacaaaagaccctgagtagccaaagcaatcctgggcaaaagaacaaagctggaggcatcacactacctgatttcaaaatattctgcaaagctatagtaaccaaaacagtagggtactggtataaaaacatacacatagagcaatggaacaaaatagtgaacccagaaatcaattagtgtatttacagccaaccatcttcaacaaaggtaacaatgacaaacattggagaaaggacactacaataaaaagtgctaggcaagatgtatacaagaagaatgaaactagacccttatctctcactatatgcaaaaatcaaggcagaatgacttaaacataaaaccccaaagtatagaactactagaagaaaacaaggaaaacattcaggacattggtctaggcaaagatttttatggccatgagctcaaaagcacaggcaataaaaagtacataaatgggactatattaagcaaaaatgcttctgtgcagcaaaggaaacaatcaacagaaacaacctgtagaatgggagaaaatatctccaaactattcattcaacaagggactaatacccagaatacacaaggaactcaaaaaactcaaaagcaaaaatacaaataaacccatcaaaaagtgagcaaaaggttagaatggacacttctcaaaagaagacatacaaatggccaacaggtatatgaaaaaaaattaaatattactaatcatcaaggaaatgcaagtccaaacagcaataagatatcatcttacctcagtatggctattatcaaaaagacacaaaataacaaatgttggtgagaatgtggagaaaaggcaactcttatacactgttgtaacctgtaaattagtacagccattctggaaaacagtatgcaggcatctccaaaaactaaaagcacaaggtggcttacgcctgtaatcccagcactttgggaggctgaggtgggaagactgcttgagtccaggagtttgagacaagtctgggcaacataccaagaccccattttcacaaaaaattaaaaaatccccaaaattagagctaccatatgatccaataatcccatgactaggtatttatccaaaggaaggaaatcagcatatcaaagggatacctgtacccccatgtttattgtagcacaataggtcaagatatggagtcaacctgtgtaaatccaacagataaatggataaagaaaacgtggtgtgtacacacacacacacacacatacacacgagtactaatcagccacaaaaagggtgaaatcctatgcttgcagaaacctggatgaactagaagtcattatgttaagcaaaataagccaggcactggacaaatacctttccaaagtcaaaggtgaacattaatcccattctggttactggacctttattgaactgacccaaataaaaggttcctatatgtttcttcaagccagcagtatctacatactttactttaaaccccgcttattttctttttggctgatttgccaaaatgtggttgactgatccatcaaaaataatactgtaatctctaatggtattccaaatttactgaaattaatttgcgtctttattttccccaatttttagctcctcttaatcaaatttacatgtaactggtataagtaatttcagctaattaaatgaagaatagcagactctctatttgttataaatttaatagttacgttaacatgtattgctatttcaatacttttatatttacatagataacaacactattcagcattagttagtatatgtgaagggaacagtataagtatgaaaaacagcctacccccaaaatatatttttagatacaggagaagtttatgattaagttgtacaattttctaggggaaaaacgttttattttttttttaaattaacatggagaaagcacctaaatcatcatgcttcaaaaggaaatcacgctgaaaacaacccaaccacttacatgtgccccttgacattggactcatatcagcgggtagctagctcacaactgaaatgacccataaatcttgcaaacctagtctacctctatacacataaaagagcaagcttcaattgcgttctcgaatgacaataagtatgtacaatgaaatacgtaataaactgagatctaggtggctagcacattcgacgcaacgtgctctattccatagacaattccattctacttcttggtgcattaaatgaagttattttccttatatacatagatctgtatactcattaaatatagtgacttctgcgaaaaaatttatttctaccctgcagtggaagcctaggaaaacattaattttatgttactgagaggtacaaactacaaccttctccttagaacaggaggtataaaaatcagcctcctggggttctgttgctaattcctctggacggctgggaacttgatctaagccattccacataactggacatcatttacaacttgtgggttttgtgcagtgtctctgtgccttcctacatggggactcaatcacataagcaagaaatttcttttccccagtcacctaactcagtaccagccagctagatggcatctctcaaggcactgtggtagaggcatggtggctgttactcatattacacttttccaatcagttgggtcaatctgtctactcagaacatactaagtgatatcaggcacctgctattctgtggtgactgtgaaatactcttcctcactctacatgtacaaatctagtttcttttcagaaaaccagcagttagtgatagaaacaccattcccaaaccaaaatacatgagggtaaactcaagttggacagagttatcaatattttttagctgcaaacattcctttcatcaccaacacctggtgctcaatgaatgtatcattacttggctggttatatataagcccatctgtgcaaaaatggccaaaagccctctcgtagttggctggacctgtgtcctaaaatacaggagccaggtaatgacgagctttgatgaccttcataaccatgggaaagacagctgacagaaatggtttatatggcaataatgtggaaataaagaaccacatatactgcaaaatatattaaaaaacataaaacatatattatatggttattatatagcccttttaaatacaatagtcatcttttctttatagggatttttgggaagtatgagatttcccatctaagatttagtgaggaagcagtaactatatcacttttggatagtctatgaatatgagaataatgagttgactattttcagcccatttatcagccttaactcctcaaacacacaaagtagatacactgtcataaatctttattcgtgctatgatggttgccaagaaacgcttcatttctcagtaaatcatagttggcatgaagtcatgtgttgctaaatattttataacctcctcttatgaacctggaaacaatctattaactacacatatgaaaacccccatatatttgcatgtaaataaatatttatttgttttgtccaatttccatctttatctgacaaagataaaatgagtgtaacctcagcaggcaattcacatgtggccagggctccatccagttatcctagttacagctttctactctggtagcaggtagctactgtttcattagctacagtttgtatatcaggcttagactgccattcctaaaaaacaacaacatttatttacactttcaataagaggaagtttcagcgaattgcctgggctccaggaaagtcttgagagaataaaagatagtgtaagagaaatccaatcccgttatacatacttgcagtgtaaatttgtcatcgggtcaatttccagtatatttcctaacccccaaaatgcctcaatataaatgggatcttcagggaaatcatactgtggaaataagtaatttatggtgtcagtttgtttccaaagatgagtagtgtgaactgagtatgtgtgtttaggtaattttcctcacaatcccataatcattttctagtcttttgagaatgaaaaacattctactttattttgtcctcttaacacacaaaaacatttgatagaaagataagtagattctcagtagatttaggaaagggtgaagaaggatttctaacaaccgcaacacagaattatacacagcttgcctccaccacaagcgattctcctataaacccctcttcacacctctcagaatcattgccacagtgagctatcaagtctcagcaataacaacgaacaaaatcagtgtcaactgcttagagaagaggcagtctggataaatgtaaaattgacaacctgcttggggtggggcggaggagatgtcactgcaattgatttcaggaagtgaactcctcttgtgcccatctggacactggactttactggtgactgttgctgtaacagcatcatgaaaaagagtgactgtccctacctcggaattgctccacaattcctgaaaaataaaaacgtgtcttgtagtgaaaaggtgaaagcacaagcagtgaatccccatctatgcatgagcaaatatttcatggcacgtccatttatgcaatggcattcattttgcattttctatgtgctaagcaatgtgcgaggtccaagagtcacacgaaataaagcacaatgcccgagccaagaaggtggcaagaggtgaggagtgattgcactatggtgattgttagctgcagtggtaggcacagataggaatgatgaaatggaactacttttgttaccaagactaatgcaccaaaacatgaatgtgggaaaacaggacactttggtcagctaatttccgcaaacaagctttagaggacttttttacttgatgcatatggatgccagattttagattccacagaccaaaataataatagcaataacaataataataaatgatgaactgagttactagcaacttgaaaaatactgataattatatttcaaagaaatactaatagtaacaagatgcttatattaatggtaaaattaactatgcgtgagttctttagaacaaaattttgttttaaagacttacatttaaagacttgttatatttttccatccatctactgaaggacatcttggctgcttccaagttttggcaattatgaataaagtcgctataaatatccatgtgcagtcttttgtgtggacataaacttttaattcatttgggtaaacagcaagcagttaaattgctggatcgtatggtaagactatgtttagttttgtaaaaaactgccagactgtcttccaaagtgatgagaccatattgcgttcccatcagtaatgaataagagtttttcttgattcccatactccccagcatttggtggtgtcagtgtcctggattttggccattgtaatagatgtgtactggtatctcattgtttgtttgtttttttaaattttaatttccctaacatggtaagacgttgagcatcttcttatatgcttacttgccatgtttatatcttccttgagaagtatctgttcaggtcttttgcccatttttaatcaggttgtctgtttttgtattgttgagtttttaaagttctttgtatattttggatggtagtttttcattagagatgtctatttaaattttttctcccagtctatggcttgtttcattctcttgacagctgcttttcaaagagctgaggttttgtattgtaataaaatccagcttatcaattatttctttcatggattatgcacttggtatcgtatctaaaaagttattactatacctaaggtcatctatgttttttccagtgttactttctcggagtcttatagttctgcactttaacagtgaggactatgaaagttttaattttgtaaggagtacaagatctgtttccagatttttttgtttttgcatgtttgcatccagttgttccaataccatttgctgaaagactacactttctccattgtatattctttgcttctttgttaaagatcatttgactatgtatgggtctacttttaggctgtctattgtgttccattgatcgatttgtctattcttttactattaccacactgttttgattactgtagttttgtatagttaagccttaaaattggatagtgtcagtcctctgactttatacttctatttcaatactgcaatggctagtctgggtcttttgcctcttcatataaacttttgaatcagtttgttgatattcacaagttaacatgctggactttttattgtgattgcattgactctagataaaattgggaagaattaacattctgacaatattgagtcctcctatccatgaacacgggctatttctccatttatttagttaatttctttcatcacagttttgtaattttcctcatacagatcttggacagttttgttagtttacctaaatatttcatttttagaggagctaataatatttttagaggagctaatatgttattgcgttcttaatccgaaattccacttgtacattgctggtacagagggaagcaattgacgtttgcacattaaacctgtatcctgcaaccttgctataattactaactagtttgggggatttttttggtcaattcttttgtattctccacatatataatgatgtcatctgctaccaatgatagttttatttcttccttcccaattttatatgttttgttccattttcttttgttcttgcattagttaggccttccagtaaaatgctgaaaaggagtggtaagaaatgacattcttgcattgttcttgatcttaatggcaaagagtctagcttctcaccattgagtatgatgcccactgtaggttttttgtagatattccttatcaagtttagaaagttcccctgtatctctagtttgcaaatagcttttttttttttttttttttaaatcatgaatgggtgtttgattttgtcgaatgctttttctgcatctactgatatggtcatttgatctttcttctttagcctgctgatatgatggattatattaattgattttcaaatgttgaacacccttgtagatctgtcatagatctcagttggctgcatgttataatttttcaatacattgatttgctcatattttattgaggaattttgcatctatacgcatgcaagatcttggtctgtagttttcttttcttgcaatatctttctctgttgtttgtagtagggtaatgctggcttcatagagggaattagaaagaatttctgcagtttcatccttctgaaagagattgtatagaactggtaaaatttcttccttaaatgttttgtggaattcactagtgaacctaactggagctggtgctttctctttggaaggttattaattcctgattcaatttttaagataggtaccattcttttcagactgtctatttcttctactgtgaattttactagctgtgcctttcagggaatttcagctacattatcagattgtaaatatagatttgttcataatattcctttataagcctttcattgttcatgagatctattgtgatgttcttttatttccaatgttagtaatttgtgtttcctttcttacttaacatggatagtcttattgattttttaatcttttcaaataaccatttttttttttgcttcattcatttttctctattgatttcgtattttcaatttcattgattttttgctctaaatttaatacttctcttccacctttggatttaatttgctcttctttttctacttttctaacatagaaactgagatgatttattttaggtctttttctcttctaatatattcattcaatgctgtagatttctcaaaacactgctttcactgtatccacacattttaataagttatattttcattttcatctgatttcaaatactcttgtgatttattatttgactcatgtgttactgagaagtttgtgtttaatttccacgtcttttgggattttccatctgtctttctgtcattatagtgtaattccactgtagtcgagagcaaatattctatgatttctattcttttaaatttgtaaaggtggctgttttatggcccagaatgttctgtgtcctggtgaatgtttcatgatagcttgagaagaatatgtattctgttgttgttggtggtggaagtggtctatagaggtcaattatatccagttgatcaatggctgcaatgagaaaatcccagaatcatacagaaaaaccttcccccaaattgggaggttgttgacaaaaaaaaaaaaaaaaaaaatttggacatgtccagtttggcgagtagatgggttataaggacttatatatgaggacctcctggatggcagcaggacagctttagagctccacaccacctcttgttcttaaactacttttaagcgaattttctgaatttttgtatattgtgtttaagtgctgagactatttttcttgctaggttctcagacactttctaggatgcttaggttctcaggaacacctgctacttggctgagccccatagccttggctcactgcctggtcttcaaggtttaggtggtagacatatacccttggctaatgggtgggagactcatcatgctacaatggtgctgctgagttcaactatgtccttactgattatttacatgctgaaactgtccatttctgaaagagggtattcgttcatttttattgcagtttactatatcactgtataaatataccataacttgtttatgcattgacctgttaaagatcaattggaacacctcataatatagcctaccatggtaaatatgcctggtgtacttgtaaagaatatgtattctgctgttttgcacaatattttataaaagtcaattaggtcctgttgattggtaatacagtttaaatcttccatatccttaatgattttctacctatgtgttctattattgaaagagatgtattggaatctgaaacttgaattatggatttgtctttttatcttgcaacttcaacgtattctcactgcagcaacttgtttctaggcctgaaacacttaaagccttggtctcgtcacacagataaattaggagttgatctgaaaaagctgggatttggtttggatctgtatccccacccaaatctcatattgaattgtaatccccagtgttggaggtggggcctggtgggaggtcaccggatcatgtggttgaatttatcatgaatgacttagcactatcccacttggtactgtcctagtgaatagaaagtgagtgagttctcacaagctctggttgtttaaaagtttgtagcaccagctgcttcacccgctcttgctcctgctcctgctgtgtgagacacctcactttccctttgtcttctgccatgattagaacttcttgaggccttccccaaagcagaagtcactatgcttcctgtacagcctgcagaaccatgagccaattaaacctcttttcttataaatccaattaactctcttttctatatttctttatagcagagcaagaatgcactaatacaggccaccatagacctctgaccagcagttcatatttggtgcttactgcttaattatttgcttgaagataatgagcatttattgttgcagtagcaattagcaaactcctcaacaccagcgtaggtaatataaacataatgatagcactgaaagttttctgaagatgtctgttgcaaaattgtagcttcagaaagaaactaatgaactcatagaactgggagcacttggaatccacatggaaactcatttaccacactgcagatggtatgtctcccctgtgatgagcaacagcttttgcaaactggctgttgatcaggttcacttcctaagtggctcctcaggctcacatatgattacgaatggaaagaaaatttcaaggaaatagtgttgatgttgggctcagtgggataaattgtatttaagaaaaatgttgaagataatgctctatttgaattggcattattttgcaaaatactaaacatatacatttttctttccataggaaaatattaattaattgtctgtagggacacaaaggaagacttgcctgtaaaggcacttaaattaaaatgaaatgaatctcagagtaatagcttttgaaatctgaagatatgcctgaaaaagaaagctaatataaaaatcgagctaacgtttaatattaaataagttagtacaattaagtaagaaaaagggaaatgacaacatatttcaagcatgtgcttcttccaggataaagtctcaaactttggggacttttagtttggtgtgcatttgactctttattggtaataaaagaaataaagtataggacaatatagaataccaggaaagttgttcacattgggaattttgtaagaaatatgtccaaaaataaaaacaaagactgttgactcataatatatgctacatggtaagacattttatcatatcactaaaaattaagtcgacctcttcactttgattaagcaggagaaatgctgtagtggaaaagattcaactcaactctcaatccacctctgactcttgcacatgcttgctctctctctctgtctctgcaggactattaaattggtagaaaaaaaaaaaggaatgaaactcttgagcccttatttgtgttcttgcttgagtgttgacagcccgaatctattgccctgccgagaatgcctcgggctagagagaaaaaagccttcattcatgataaaagctccttaggctcagtttacttttccaagttagctttaaagtagttgagatacagaactgcagggtctttgctaatatatcaaatctaaccttttttggggggaaaaaagttaactttagaaaaccggtgctagatgtcagggttggaagatgggaaggagaaaggttgtgtattatttctattatctaaatctatttaatcctataatctgagtccaacacttgtagaattttatagccatttgtgaatttaatataaaaggatagtgtatatatatatatatctactcacattttatgatgatggtgacattgctaaatttaaaaaagcatactaaaaattgctatcttatttgaacaatattaagtaaatctgcatttcttagaattactataaagtacacgagagctttgaaacatttaaaatgaagttatatatgtgtgtgattttattttgtctaatgacttgtttgttccatctttgtttcccatcactcagcactgttcctagcacccagcagttgcttggcgtttgttgattaaacgactgacaattcctgggactttaaaagagttccaattcaatttccattcaatttaaacactgaatggaaaaattctcacaccactaattgatgcttttgccccatattcttcccacagcaaaatgagtctttcaacaatgtcaaccagattccacattcaacattgtgcactcaatttaacattccacattgtaaaccagattccacattcaacactgtaaaccagatcatattcttcccctactgactatcctctagtgttccattccacttggaaaacacaatccagatttcttgccatggtctacaagaccaacgtgagttggcccagtctgcactccactcctgtctgccctcttcaaagcactgtcctcctttcagctcttcagataggccaagctctttctctgcttacgatgccttgcactagctgtctcattagccgagagagctctgccccctggtcctttgcacatctggctcaatcttgccatttggggctgagttcagcatcctaaagcagcctcccacccttctcttattgtttgcatgatgacatcccatactgatctccatcatggcacttattggtacctagtattaactaagaaatttatttctcttgacatactgcgcccaatgaaccccagaatataagctccataagtccagtggccccctcctttttacaactgtactctagaacttagaagagcgccagcacattgtatggcttcattatctatatatacagttaaaaaattatatatacaagtaaacaaatgaaccatgaataactgaatggataaatgaatgggaaatatactatcagccaatatccaaaaattatacatatttagaagaacgatggaaaatgagcatttaaaaaaacagttttaattttgcctgaaaaagcaaggttgctattagtcatttttcaatatttaatgaagggctgtgcatttaaagaaatgtcactgctctcaggatacagtgcagtgagtggtcatgttgaaataacacacagtaaaagatgtctcatagaaatttgactatatgacgttttaaaaaggccatggggttcattctttcatgctaagaatttagagaaatattcactaacaacaacaatgcaagtataatagcagacacatttcaggcaagaaatcaaaactgttgaaaaaacttcaccgtcccagagtataatgtgatagtatgacacatgtttcttgagctagggataggggaagttttgtgaatatacttctgaaaatgaaaaaccaagcttaatgggcaagagttttgcagggtctccaagtctaaactttaataggtaccacttaaaccgttgatggcagaatcatcaattaagttttatagcagagctgagtaagaaatcaatcaacaaaatattagtaatccatctgctcatcacaacaaattctggcagacaacattattaccttaatgatatgatattggaaggaaaaaaaataaggaaaacggcttagcatctcccaaaggcatgcaatatggttccaaatcaattcgaatttatagctatcctgagttctctataataacttcattccacaaacactaaattttgaacacctttttaaaaagccagaatcaatatacatccaaaacaaccaggtgctctatttacatgtcattccaatacagcagaatgaaaagctttcatattcaacccaagtttgaaaattatagctgtggatatattttcagatgtcgctaggggagcatttataagataccacacacttaagcaagatactaaaataataaatgaagttcaactgaaaaaactgcaaagggataagaggcataactggattacctaagaccaaaaaattgaattcctcctgagggtatccaggaaagctgagctgcaaagtttactatgaaaattcctgtaaactctcaggagactatagaagtcaagaaattagagaaagatgcacatatatgtgtatgaacatttggcaccagatagtgagacacggagacgtgtgcttggaggcagaatgcctgctatttgtctcttcagccccatttcccaccattctccacctgcttcgtgccccgggggccccaggacgctaccctacatgggctacatgagcttcttactgattttggtcaattggtagcagctacaaaagaaaatggagaaagaggtaattattcctcaggcctcactaagtactcaagccaaggctgagaagagaacagtgtatcgaaatgcatcatgttcagtgttgttacacaatcatttaccaccagatagaagctgcagcaggaacttgaacaaagtctggtggttaatgaaccccaggagaatctggaaaagctaagggtatcacacctcagttatcagtcttccttggatttaaaacaaaattctgtatggaacacttcccaatttaaaataaaaggaaatagaccatgagaatagaaaaatacatcctgagaacttattatatgagaaaaagacaccatggccccagtgaattagatcctggcattagaataggaatattatttatttagccttacaatatttgaaggggattttaacaggaaagataaaggaatatgactacagtagagaaaaatttaacagtctttgagaaccaaaggaatctggctggatacccttgtaagagttatgtgggttcaggagcaaaataaactatgtaaaaaggatcataaacaggtgaggtgtggccaagcgcagtggctcacgcctgtaatcccagcactttgggaggctgaggcgggcggatcacgaggtcaggagttcaagaccatcctggccaacacggtgaaaccccgtctttactaaaaatacaaaaattagccgggtgtggtggtgtgaccctgtaatcccagctacttgggaggctgaggcaggagaactgcttgaacccgggaggtggaggttgcagtgagctgagatcacgccactgcactctagcctgggtgacagagcaagactctgtcttggagaacaaagcaaagaaagaggtgagatactacattgtctagattcaaccttggaaggtaagtggaaattttgacataaaaattgggaaaaatggaaatcaaagcaatgaattcccagaacactgtacagaaattatcaaactgcataagctaatgaaacacctacatgacaatttcagcaaaatgaaaaaacaaacccacaaaccacaaccgtcagaatcactattcttcaataacttatggcaaaaaaggaggtaaaaagatgtcatttttccacaaagaagaaaagctgaagctcaaacacagactcggaggttttttgtaacctttgcacactaaatataaaaattgcccttcacaggcacacaggatgcatgcagtgaaataaaagtcctctcgcggctgggcatggtggctcatgcctgtaatcccagcactttgggaagctgaggcaggtagatcacttgaagtcaggagtgtgaaacgagcatggccaacatagcaaaaccccatctctactaaaaatacaaaaattagctgggcatggtggcaggcacctgtaatcccagctactctggaggctgaggcatgataatcatttgaacctcagaggtggaggttgcagtgagccaagatcccaccactgcactccagcctgggtgacagagcaagactctgcgtcaaaaaaaaataaagtcttctggttcataactaggtgtacttgtaaaagttgtttataacttcaacatctgcatgctaacttcacctacgcttggagttactatttaatgaaacaaacaacaatcttttagaggaagcaatggaacattttagaaatgggaacaatgtctcttgtttgcctttgctgcagatgtcacttcctctggctcgtgttagcacagggagacccctcgcagaatcaatcaatttgctttggaacaaatttctgatatatatattatatatacataatatatattttatatatttattatacataatatatattttatatatattatgtatgataaatatattttatatatttattatatatattttatatatttataatatataatatataaataatatacatttattatatgtaatatacatttataatatataatatataaataatatacatttattatatgtaatatacatttataatatgtaatatttatgatatataatgtatttataatatatattatataatgtatttataatatatattatataatatattatattatatattatataatatattatataatgtattatattatatattatataatatattatataatgtattatattatatataatataatatatattatataatatattatattatatataatatattatataatatattatataatatattatatataatatactatatattatataatatattatattatatatattatattatatataatacatattatataatatatattatataatatacaatatataatatattatataatatattatataatatattatataatatatattatataatgtataatatatacaatatattatataatacataatattaatatatataatatattataaaatatattatataatatattatatatactataatatattaaatatataatatataatataatatataatatataatatataattaatataaataatataaaatatataatatatatttataacataatatatttataatatatattataatatataattataatatatatttataatatatattataatatataatatatttataatatatattataatatataatatatttataatatataatatatttataatatataattataatatatattataatatatactatattatatataatatagtatattttataatatatactatattatatataatatagtatatatttataatatataatttataatatatataatatagtatatatttataatatatatttataaaatatgtaatatagtatatatttatgatatatttttataatatatataatatattatatattataatatatatttataatatatataatatattatatatttataatatatattataaatatataatatattatattttataatatatatgttatatatttataatatataatatatatattataatatataatatattataatatatataatatatatttattatatatatattatatatatatataaaactttccagactgactttaagattggtttgatatttttattttctattttactttgttttgcagtgctatgaataattgacagatgactaaaataaccatctttattgttacagcaaaaaccttgatagcggtgtttgttccatagtgcatatttaaaaggctgtatttcagagggtcactctgggctaatgacctttcttcagattaaatatatatttttaaattttacaaagttctgggtattctaaccataagaaataactgaaagtgcataaacctttacaaaatagcaactatcaaattattttacttctacatataaaattagttttattgactaggaaaattgtactataaatgctgtgagaactttggagaaataattgatggatagcagagatttaggtagatatatatttagatagctagctagctagaggatagatatagacaatactacactacactgtgctatgtcatattttaataatgacacgcaaaatgctttccatgcattgttaaatacagggtcttcaacaactctaccatgtgggtactttcctttgatcacgtcatcctgcggagatgagaaatcgtttaaccatgatgtcagccttagtctgatgccaaagcccatatttgatttctttgggaattataaattttaaaacaacttcagatatatagaacagttgcaaaaattgtacaaagaactcttacatattcttcatccagcctcctcaaatactggtatttttttcacgtttagtttatcttcttctctcaatctttctctatgtacattatatagagaaagtaagttaaaaaagaaagtaaactaaaacaagtaaatgcaaagtaaatatatgcatatatacatatttaactatatataatgtacattattatatatctttatgtatgtaattactttttctaaaccatttgaaagtaactttcagataggatgtccctttacccctaaacacttcacttgggatttcctgagaataaaaacattcatttacataaatttttacacaatacttttctcaaaatcagaaaatactgatagaatgctgttaccttattgagcaaatctgatccttacttgtaaattgaaccaattatatctgtaacacccaagccccccaaattgaaccgaggaccacctgctgcattgagttttcatgtactttcagtcccctctgatctggaacagtccctcaatctctctctcatagccttgacattttctgttgagtgtaggccagtttttgtgtagaatgttcctcaatctgggtttgtctgatgtttatattaggagacacatgctatcgtttgtcccaatatttcagctttgatcatttggttcaggtggttcctgccaggtttctccactgttaaggttcctgatttttatttttatgttgaataagtgttttctggggcgacaaggctatgcaaatattctgctgttaatcaaacctctacttaccagttttagtatccattgataatccctgcttgaatcaattattagtatgatggttgccaaactgcagtttttctaaatgaatcaatccttctacatgtggaattttacagagaggaagagacttctaacatttatttatgtatgtatttatttggttatatcatacagacccatggattcctattttttactgggttaacatctattggtcataatatcattatttattttgatactcaattcccctagagtagccaatgggagccctctgaagctaaatcccttgtcttttggatacgtcctcactgttacatgcatccttctttcttttctggtgtaagaaaaatgttccagcctcctattatacttttccggctccaaccccagaatcaaccatttctatgaggagccctagtatttttagtggagaaaatgttcagaaactgagtgccaggtgtattcattcctagtgggatgtcattgcttccagatattctcaaagacgaagctaggaaatgtgtgtgttatacacaaaaatatctttatgacaaccccaagtgcatagtgataactgtgattccaatcaagcatcacagtgtttattcgagactcttctttttcaatatctgtagcttccttctgtgacactgataaatctgactctggttatctcaatatttgttgtttatcaaatttagaatacacaggagttatagaaatgacaactcagaacaaaaacaaaactacttattaaattcatttttatattgagttctgactttatgctaaaagtatgtagtaaataattcagtgggtaaagttatttggaaatttccttttccctttcactgtgccatattatctatttgaaatactattaagttcatttgtttgcatttataattggttttagtttgttttattctgtgtccttgctgatttttttaaacataatacattaacaaggttccaaaggtcaaagctatacaaaaagattcagagaagggtcactgtcctaacctgggccctggctgggcactgctaccccctcgtacctcccattcagttcctactcaccccccatcgggaaatttatctcacttgtttctggtttattcttcccatttctttgataaaaatcagcagacatgcatactttcagtgtggggcctggttaaaaacccacgtgtgacatttcaggcggagcatgggcagttgagcaaagctgccctcccacatgggattcagagcacagccagagccctgcacagtcaaggtttcagagcccccggccagtcaggcttttttacgtactcacactgctacatacctaggtctctagctgaggccctgggcaaggccctcttcaggcgcctctgcagaggcctccttccaggaggaggggaaaccttgaagacatgcttcctcactgtgactcagtccactttgagctctcttcacctggccacagggtccataaaactgctggagccttttgttgggtcacgcatgtccgcacggatccacctgacccttgaccagtgcaccattccatggaggaaacaggaacggaagcgagctggtgcttcctccctataccactccctatacactgcagtgagtgatgaaaggtttaactcattaagggcttgttgctttaaatggctactctgacacctggctctctctcccagctgaggggagctccttactccactccactcagtccccttcactcctgcaaataagataacacaatacagatcacctttcgtattttttttttcactcagcaaggtagtccttaaattactccacctcagtgtgtagaggtctttctcatgcctttttcccagctgcatagtactctattgaatggttgtactctcccggtttaggcaacccctaggttgtttctggtatttttcaataacaattactttttgtataatatcatattgttgaaagacaacatgttcacgttgtagaaaacatgaaatttaaaacatattatcttgagtaaacttgcagcatgattttaagaacagcaacttttgcgattgatccttttgaaaattggaagccaaccgttcaaatttattgtcaagtgtttcctctagtgaagtggtggggaaggtttctttgactgtgagttctgaaatgttaggctaacaaatcgctaaactgtggcagtggagaaaaggaactcacacaagtacaccgctgagcttcattcttctgggagaaaaaaggcttctttgagattatatgattggtttcttttccctcaattgcagtaacaagtatatgggctaaggatgatgatcagaaactagagaaaaaaagagctatgtatcaaaggtaactgcaaagggaaaagtagtatggcaatcccagctttcaggcagaagcgcagaaccaactcaattcagggctgtaatattctcccgttcaaggtccagtttcagccacagcctaattttcaacaggaatggcatttgtaagctggagattgtcagctacgctcttgctgctgaatcctgttttcaatgcatccctcctcccttcctttctcccctgtcaccttccactgctcacccttctactctctgaaattgaagcaaattacaatgtactctatagcattccagctagaagaatgaaagagttattcagatataaagaacataatacaggaaagtccttcagtgagaaaatggtaagccgagaactttcaaatttcaagactgaaagtatgaatgcttatatgttacaatcaatatataaggctgaggtcagaaatcaaatgtaaatgacatattcatggaaagtatctactcgcagggtaggatattcttagagatggaaatcaatttgttgtaaattgactgaagttcatttacacgaaacagaacctttgtacaatagagcataaactgacaagataagtattcattctgagactctaaaatggaaaagaacagttcaaaactgccaagatgaaggtctccatctggcatttcaaatttgctgatattttatgaaagtcagttttatgttatagggcaattttctgccaaagaaataaaaggtgggactaattcttgtttaaaataataataaaaaaaaactgaatccatagcaaaggcgacacatctgttgttgttccaatttattttctgtaagccacattaattatacatatgaatcacatacatgaatttaattcaaattaataatagactcttgaaaatacaggccgattagaaaattactgagcattttttccatcactcactttccatacacaaaatgtaacttgccttggaacccctgcagactgccccttggacaaaatatcctctttgaaaggggataaaatgctcctcctgtctttcttcttgtcttgataggtggaaagtgcacaggactcctgaggtcctctgactgtcccttgccaactttcatctcccatcacgaggagggagaaggttcttatgatggacaacatttgattccttagttgggccatgtctattgctagcagggccaactagaagtagggtattagatccatgcaagttaccctggaacactctcctcgtggctgacccatccccactggtcactcaatagtaacaaccctgagatcacaatttatatatggtgagagcctgaaggttgtcttcggtctcaagcccaagcatgccatggagtcctacctcgcctttaccagggagatgtcatggagctttaggcacaggatcctggcgataaagcagccctcactgctcatctcacagtagtcccttctgcatctgatgctttcaggatcatgcagtaacaagaggggatgggcaggatggatgcctacccaacacgccaactccaccttccgaaacctcacacacgcggctctgaaattcacacacttccactcagtcaactgtgtgtgtgcaactcaaacatccgcctctctcccgggcctgctcaaatggccccttattaacaaagagtttgtcttaaatatctaagatcatagcatgtggattaattttttgtgttttacattttgtgaagctcatttcattattttgtgtggcttcatgaaaatgttgtaaatagctatttttagaacttccatagggagatatatcttatggagtcagctccctagggtggttaagagtctgtacttgggaatccatcagaactggtttgaaattcaggtctgggaatcgctagttatgtagcattaaatgtttgctaatctaggcctagtttacatgcatgtacatgttacaatgaggaaaatgacccttaccacatagaaactatgagggttaaatgggatccaatatgtgtatagaaggcatgtggcatggtgcctgacaatattaagtgccccataaatcatatccattatgttcatgtcataaatattgtagaaaaatctaattctgactaaatgatagaaaatcaccacattcaatgtaacactgaaaattttaaccattgtaactataactaaatatttcaagaatgtttgaaaaaccatggtttaacatttcatgcgatcattcttcacgacaaatatagtttttctcatcagaggctcaacagtatgggcttttgtatctaattaattcagatattttctccattacagtaaaagatccccttgggaaaatcacatccatcatcttctgaaacgttgcctgtcacagcaagggactatatataggcttcaaaatttcatacttaaccttttctgtcacttagcgtttctatttcttttttgatttctataagacaagctgcattcatcttaaaataaaccaataccaagcatgaaaaaagaaaccccgagagagcctctgttgttcctatgtgtcttgctgaggtagctggctgtctatgtgcaatgagcaccatgaccctgcgggaaagatctggaacagagatgaagaacacaggccataataacttttatttttatttttattttttttgagacggagtcttgctctgtcacccaggctggagtgcagtgacatgatctccgctcactgcaagctccacctcctgggttcacgccattctcctccctcagcctcccaagtagctgagactacaggcgcccatcgccatgcccggctaattttttgtgtttttagtagagatggggtttcatcgtgttagccaggatggtctcaatctcctgacctcgtgatccacctgcctcggcctcccaaagtgctgggattacaggcgtgagccaccgcgcccggcccataataacttttagacagacaaagtcaaagtcttgaggctcaatagctggtttaaaacaaatgcacatgtgctcatatcccattcttgggagatgtggttaaaataagaaaaactaatgatgagaggagccatttttgaattacttggagtctaaattatcaaatattttgcaagaaaagcatgtttttattattttcagtcttttatggtaatacgaattaagctctcataatcttgacagatgtgttttaggacctgctttaaaacagcaacaggaatgatttacaattagtatagaaaattgtaatgtgcgaactgatcatttcaaagtgatttctcagtgtgctcagctttttataataatctctaattgtatttatatacttaggatgcttttttgtcctcccaagagccaaaacctatcttgagtatagctctctaccattaaataaatcctacatgagtgggctctgcaataatgagattactatgtaatgactttatgttatctgaaactctaagttaaatataaaatctagagcactacacttagcaagtcacctgtttttatattattattttctcataatttagccttggtgcactagctgaatatcacatcattctttgcctattatatcactacattaaaatatcacaaattcttcttatgtaaagcatcacatgcttccttctagaactttggtgatcaaccatacttagatggtttactgactcatacaacatttcaggaagagctaccaaggtattttctttctactatcagaatgaaacactagggctaaaattctataatcaaatttacatttttatggagaaaaacatgaggtacacagagaccaacaaggttattcatgacttaagcattaagtgccaagtctctccctaaatatcttcctcattcacctttccattgggccctgcatgcctgtgtgttgaataagtaaataataagtgctatagctgttagagtgtcattagaatctccagaaccatgtaagacatgggctaaggagctgaaagaatactttgaggggcactgaagtgtttccaactctggcatgcctcggtgcaccctcaagctcagagatggattgaaaggcaccgttcaaaacaagtctcccagcagcctgctatctacagatcattgaaatgatatactgcaataacttcccctggaacgcttatggcttattgcgctgatgtgtaattaatctgctgagcagtgacaggacccagctgaagagtgcttctggagcttttaagatctggcatgccaaagaacacttggggagtccttggtccacgctttgttagcacaacagactacaacgagcctttaatctgtgattgcacatatgctagataactttatgtattaaaaatcatggctgggtatggtggtcacgcctgtaatcccagcactttgggaggccaaggtgggtggatcacctgaggtcaggagctcgagaccagcctggccaacatggtgaaaccctgtctctactaaaaatacaaaaattagcctggtgtggtggcgggcgcctgtaatcccagctactcaggaggctggggcaggagaattgcttgaaactggaaggcagagatttcagtgagccaagattgtgacattgcactccagcctgggcgacaagagcaaaactccgtctcaaaggaaaaaaaaaaaatatcacaaagtggttttgctcagccttggtctaatgtcagcagcacctgtaagtgcatgtgcatttgtaacctgtgctcaaagttgagaggatggagggacagcagactcttcctgcggagaacaactgtgtttttgtggcttggtcaggcttagagagctcattaggctccagccctgcaaatctgtgactgcagtgcacttctgacttgcagtaaacatggatagaatatagggagagcttggatggaactggaattgtcagtgacagaatgctgactaagtgaccaatgaatcaaaaaaaaaaaaaaaaaaaaaaaaaacagataaaaacaaagaaacatacaaatgatgtctgaaaagagcaaaatcctatttaaagatatgaatgtttttctagatattcttttgtacatgatactgaaaatattttcatttgaatatcaaaaagtggttgatgaagttggatgtagctgataggctaaacatacatatcttggttctttcacaatttcaaagcagttggtaagggacagatatatatgtaggtaaacaaaaaagttcaagcttatcagcatctactaactcgagaaaagcatttcaaaaaacatcttaaatgttgaaattggggagttaacagttaatatgtagtggaattcagaaattgatttttttctcacatataggactaataaagattctccccatatttctacattttaaaatttaggaatgccatgacaaacaagaatagctctctttgaattttctgttaaaatatgtaatgggcccggcgcggtggctcatgcctgtaatcccagcactttgggaagccaaggcgggcagactgtgaagtcaggacttcgagatcagcctggccaacatggtgaaacctcatctctacaaaaaatacaaaaattagccgggcatggtggtgcgcacctgtaatcccagctactcaggaggctgaggcaggagaattgcttgaatccgggaggtggaagttgcagtgagtcgagatcataccactgcactccagcctgggtgacagaacgagactctgtctcaaaaaaaaaacaaaaacatatatatatatatatatatatatatatatatatatatatatatataaaatatatgtgtatatatattatatatataatatatataatatataacatctatatacatcaaatatatatataatgtacttaattgataagaaaacagataattaaactatcatataaaaccacacttaaatgactaaaaatctgatgctttttaacaaaggctttcaaataattggtcagtacaaattcaaggtcatccaatccctttatgctttatgaagactagaatctgttcctctcatactttttgatgtcccggcattacagggaatatatatatatatatatatatattttttttttttttttccttaagctcttttttaaaataatcttttaatttcgtttccatgaacattttgaagtcccttcctccgtgactaaaatatccccacatgctcagataagaaacatattactcatccgaagtttctaggatattactgtgcgtacaaatcacctgatgatcctgctaatatgcagattttgattccctacttctgggatgggttgagatcctgcatttcttctttttaaattttaaatccaggtggtacatgtgcagttttgtacatgggtatatcgtgtgatgttggggtttgggctaccattgaatccatcacccaaatagtgaacatagtgcccaataggtagtttttcaacccttgcccccttctttccctccctactttagaattctccagtgtctattgtacccgtctttatgtccatgtgtacccatcgtttagttcccacttataagtgagaacatgcaattatttgattttttgtttctgcattaattcccctaggattatggcctgtaactgcatccacgtcgctgcaaaggacaggattttgatctttttttttggctgcatagtattctatggtgtatatgtaccacattttctttatccaatctaccattgatgggcatttaagttgatttcattactttgctattgtgaataatgttgcaataaacatatgagtttttgatagaatgatttcttttcctttgggtagttacctagcactgggattgcagggttgaatgggagttctatttttagttctctgagaaatctccataatgttttccatagaggttgtgctaatttacacgcccaccaacagtgtataagcactcccttttctctacatctgcgccaatatatgttattttttgacaatagccattctgactggtatgagctggtatctcatgtggttttcatttgcatttctctgatgattagatgttgaacatttttaaatatgtttgttggctgcctatatgtcttcttttgagaagtgtctgttcatgtcctttgtccccttttaaccggtctttattgttgttgttgttgatttaagtttcttatagattctagatattagtcttttatccaatgcatactttgcaaatattttctctcattctgtaagttgtcagtttactctgttgattgtttcttttgctgtgcagaagctctttagcttgtcaatttttgtttttgttgcatttgcttttgaggatttagtaataaattacttacctaggtcagtgtccagatgagtttttcctaggttttcttctaggattttaataaatcagtgccttacacataagtctttaatccatcttgagttaatttttgcatacggtgagaggaagcgttccagtttcacttatctgcatatgcctagccagtttcccagcaccaattattcaatagggtgtattttccccattgttgatttttatcaacttaccaaaggtcagttgcttgtaggtatgaggctttatttctgggttctctactctgctccattgatatatgtgtccatttttgtaccagtattgaaatgggaaaggttcccttgtccccctagcagggcatgcggtgggggtgtggcttgcttcttcagagccctgctgctccaacctctaggtgaacatacagacgggcaggctgtggggctcccaccccacagcagtgtctcggggtgactgtttacagctcctaaagccccagtgggcgtgtgttacagggtgttctcttagtttgcctacgggcaccttgtgttaatcaactcaattagagcgtctaccttgttacaaggacagagggctttctgtatccccagtttcttgccttggtgtaccagaagaatcagatcacacgttggcttggcgaatgggtgcaaagttttactgagtggaagtatctctcagctgatggggcagcaagaaggaagacggtttttccctggagtcgggctgcttcggggccagggctctcctccgaccgccccagccaaactccacgtggttctgctggtcgcctgccggtgtttgtcggtgtgctcttctcctagcctgctcctctcctcgccctctccacgactagcggcttgcatcttcttccgccgatgtgctcctctccatgtctggccgtctgtgtgtctgcctgctagggtatcgggtttttagagacccaggatgggggtgtggcggaccagggtggtcttagaaaatgcaacatttgggcccgaaagcaggactacctgtcttcacctaggtccatgggggtggagccgtagccagggaccacgccctcctttacccagcacttcccttccctccctatcatttagaaggaccatactcttccctttccagtactcctgtattagcatcatgctgttttggttactataaccttgtagtatagtttgaaatcatgtaatgtaatgcctctggctttgttctttttgcttaggatttctttggctatttggactcttttttggttccatatcaattttagaattgctttttctagttctgtgaaaaatggcattggtatattgataggaatgacattgaatctgtagattgttttgggcagtatggtcattttaatgatattgattcttccatccctgaacacaggatgttttccagtttgtttgtgtcaggtacgagtccctcccttcctccctccctcccccaaccctttttttttttttttttttttttgacagagtttcactctgttgcccaggctagagtgcaatagcacaatcttggttcactgcaacctctgcctcccaggttcaagcaattctcctgcttcagcccccaggtagctgggggtaattgcatgtgccaacatgcccagctaatttttgtatttttagtagagacagggttttgctatgttggtcaggctggtctcaaactcctgacttcaggtgatccaccggcctcggcctctcaaagtgctgggattataggcgtgagccacagcgcccagcccacttatttctattttaaatttttacatttaccacttttttgttaaaaattaaaacagagttttgtagttctccttaaagagatctttcatctccttgattaaatgtattcccaggaatattactttttgtgtgtaaggctcttgtaaagcgaattgttgtcactatagtgaacaatttttagactcaggaacttctaaaaccacatagatgcttcagttctgaactctagtgaccttggtgcagtcccaaacaaagatctaacttttacacctaagaatgaattttgagttcatcgaagacctgaagtatttgcaaaaacaaagagaaagcagtcttataaattagactaaactgtaagcatctcaaaaataagtccagtgtttcattcctttgttgtttatagtcagcacgtgcaccaaataagtctttttttatattatgaaacatttattacatatttttatatatgtatataacttctatacgtttctatgttgtgttcatgtccagattgtatttttttttttttttttttgagacggagtctcgctctgtcgcccagcctggagtgcagtggcgcaatctcggctcactgcaagctccacctcctgggtccacgccattctcctgcctcagcctcccgagtagctgggactacaggcacctgccaccacgcctggctaattttttgtatttttagtagagacggggtttcaccgtggtctcgatcttctgaccttgtgatccgaccgcctcggcctccgaaagtgctgggattacaggcgtgagccaccgcacccagtctgtatttttaaattatgtattatttataaataatttcagaagattagtatactctcatttgaccatcaaatctgcaaaggtacttttgttttcttccttcctgtgcagtacagaaagtgagccttttctaatccgtgtcatgtctctccctatatactgtccaattcattccatctttttagtgacttccttctattgactaccctttcttgcagtgtcaactttttaaggaaaccttgtcagtgaattctgtgatctcccagtggccatatccatggtgctttttttttttttttttttttttttgagacggagtcactctgttgcccaggctggagtacagtgccacgatctcagctcactgcaacctccgcctcccaggttcaagcgattcttctgcctcagcctcctgagtagctgggaccacaggcatgtccacacctggctaattttttttcatatttttagtagagatggggtttcaccatgttggccaggctggtgttgaactcctgacctcaagtgatccacccgcctcagcctcccaaagtgctgagattacagacatgaggcactgcccccgggccatggtgtgtttaatgtgcttttaaatacaggagcaatcaaggcttggtagatagggagatgagggccaaacaagcagttgcaaaccactattgcagtcaaggaaaggttaacaatcctttcttagcagaacagacatgggctcgcaggtcctgtcaaatgaaattacttgtcagcatagctacatgcagaatagttcaacagcctggaagccagaaatctgagcttcttcatttcttagttctttcagtgaattgctttgaaatatgttgacatctgtgtaactttgtggactatcacttccgcaactccgtgaagacagagaactcttatatgtattcgcgtattcatagacacatgacaaatggaaggcaagttggctttccctaaaatgcggaggcacacgtgtgatgccttctgctaacactgcaattatgtactcataatctctcattgtaaatagaggcagatgaagccactccagctctacgtcaactctcctggaaagaaccagaatgtaggtcctgtaacctactgagttttcattggcttcatgaacacgtatgtcctgcaatcttgtggacctgtaagctcttcatgcattaagacacattcactttcagccacctcaactttcctaaaagagatgcttttgctgtaaatattctaaagctatttcagtcaagatgttctgaagctatattacttagaaaaatgcttttagtagggaaagtggagctccctaaaggcatcttaatatgtacttatctgctttgcttttttttccccccacaaatggcattcatcaaaataagttaaatagtaatggcttgaaacgtaattgtgctgttgtacgttctccaactgtgtacattcaacaaaccttggaaaatttcagatcacatgaagagcaaattattggtatgttgttggcaatcaggattaagttgccagagtcatgttgcttaatagcttgcttttcataaaataatgatggtgagaagttaatatttattgagtctaccgtatgtgtaatggactgtacttcaggcattttctcatttaatcatgataacaaacctataaactagaaaccactttgaattcctagttaatagataatgaaactaaaaaagagagataagcaattttgcctgtggtcacgtggtatgctgcggtctagagctgggattcaaatctgggcttctaacttcagaaccctcacttatgacctctctacaaattctgctctccccaaaacccatgtcaatcgttagtgtttcaagactctaagcattattctttctatatcaagaaattgactgtatttttagtctccatacttcataggaattcatcttatgattcctatgtttttggatatcctcctctgtatgtttaaccatgatattaatcttgacatgtttcaatgttataatcacagaacaccctaagttgatgttttgcaccatcctcataaagtaaccatgtttgtggtccctctgggcatctatcctgtcagagaattgctctgatttccacttattttcagttcctgcgagtgcgacaaacctctgtatattcttgtgtagaaaaaccagtcctcaggcaaaagtagaataagtaagcaatacctttatcctgttacaaaactaaagaaatatcagcaatttcttcaagagcaagctcatgtcacttcatctgttaatccttcctgactatgccaggtgaagttaaccacgcccaaatttgtgtttccagatatgccatataacactgtaagtgattatactctgcaatgttttaatacatctgcctttctcataagacaataaatacttgctggggggtgggaaggggcatgcttatttctatattcacagatcttagcacagttgctgaggttgcctccgtgcttaatacatggttgtggaaagtagggagaaagtggagaggaggaagaaggggcagaaaaggagagagggagggaagaaggaaggtggggaaggaggaatagattaattacattaacttggagtgtggtttatattcatactagatgttttgatttttccataatttcccatattgccaggataaaaaaaaatcacataagaaatatactccgaatactgcctctgacccagattccaaagaacagaaagaaagatggtcagaaacactgagaactgtcatgtcattaggctttccaggagaattctgtacagcttcaactgtgctcttttagaaaagccaggtgttataaaaacttggttgtttattgacgtattttatctaaaacatggttttaaagtgtgtgcgtgtttttaacctgataggtagaagctagaacagctgccatttaaacattgccatcagttttctatcttctataatgtggaggcttaaattcccctttggaacaagtatgtcaatgttttcagtgaaccatctaaatggacattttagttaacacaaagtgaaagcaaagtctgtgctctgaaacggagaggtttggggcgaggcaggggaagacaagctgcaggtgcatctttgctggttctatctccattgatgacggagccctgggccggctgctgtgtgctcctgtggaggtgtgcgtggaaacttccgggcacggaaatctttctttaggaaataagcagtaggcaagagatggaagaagctgcttcctttgagagactctgaggagctacgggcacaagcattattgctttagggagctggctacaaaatggagcagtgaatggagggaaggacgctgtccaaagccacacagagcccagcatgtctgggcacccacaggcattggcttgggaatattgggagctactaacctggaagtggatattggtgttttcacatgggggacccgtagcaaagccaagagggtggcgtttgactggcttcagggtgacagcaaacagtggacatcgcccaggaggagagctcaggaatgaaacatggcacaagccatgtggaaaccaaagagaagagggtgctgtgaacgcacatttcctgagctctttggagagtcccataaattattactgtggtgatgtttagaatgataggatggaatgtaccagaaattcaggtggaacaaacatatgtcattggaagtttagcatcaaccattaaagtgactgtatttgtgcccaaatacaatcagaactcctgtggcaggccagttatttgccctgcccttactagtagctcccagttctccctgcacttcagaatcacccaaggagctctgcagaaacaaacccacccacctccacccccacacatgatacagagaaattcagtcactgggtctgacatttctattttttaaaaaagaaaactttccaggtaattctgtcttacagatacttttattaaaaattgggttaaagtttgcagaaatcaattggggatacgcaacatcaaatatttaccatgaaggacctttcttcaaggttgtattttatgtctctcaatcattagtaaggcaagttcctgaagttaagggatgtggctttcacatccttgtatttcccacaggaggtaatgtgtggggaaatgaaatgcgtacttgtgctgctgaaatggcctatttgctcatcccagtttcctcgatggcaccgtgcaccgcactctagttcatccatgccagcgctctttgctctgctgagcaaagttgttcatgaggtttggctccctctctgctgggattttgcctcatcctttattctcaaccttgaccctgtccaatttgttcccactaaacgccataactttgtatttgcttaattgtcctggattatcttgggcattatttttgttgttgttatcattggaaggtgttaacaactccttcctagtatacaccataatataaaaacacattaattatgacatctcagtaatttatgaaaatagcaaatgctagtcccatgctttgtgacaggatcttgctctgtcacccaggtgggagtgcagtggtattatcatagctcactgtaatctcagactcctgagctcaagccaaccttctgctttagcctcctgagtagctgttactacaggtacacgctatcacacccagctaattaaaacaaaaaatcgtagagatgggctctctctatgttgcctatgctgtgctaaaacacctggcttcaggcaatcttctcacctcagcctctgaaagtgctgagattacaggcgagaaccaccgtgcccagccgctgcacctttctgttccatgtttttctcagaaccccccaaatttcccagacagctggctgaaacttttaatacatccctacaactaataatgccactttcttcccactccttgacaaatgatgttgcctcccatgttactgcagctccccgttatctgcccatctccactgatgaaatcactgctgggaattagaggtactctgaatgtaaaacggccccagttactggaaagatctcagaaactgtcattagtcatggctgcctcatgctctcatctggctggtcttcttaatgtcactgtaacatgtcacagtgatttgcatctttgcacctttgcaggaagccccttcctttcctggaatcaagccttctttttacccttgtacagttacaagccttcctccaaccttcatggtttaaggcctttccagcacttgccaaaacccttccctgcacactccctgttctaagtgcaactttttctgctgtctcagaatttgggcagaggctctgagtctgagaatcattgttcctaggcagttacagagaatgaaatgagagacctgagaccctgggctcacaccctgaagacaagggagcaaggtgctttaagaggaccgcagagagagagctctaggtactggaatttgtggatgtacaggtgatggacaccctcctggagaattaacgaaacatctctatcaagagcagattcttcaagagtgcagtctatgaatactgttcctgatcattacctctcctcagctcactccagcccctccaccctaattctggaggagccacgaaaggagtaaatggggaaggaagaatgagagaacaaagaaattaaaaagaaactatagcgcatttcctcctctaagataagactgagtggtgagagaggaagaagttgacattacataagtaacactttgatgttggccaacttgacattttgataatggaaaataaacaatgcagctgagatgtccagctcggatgtcctccaaggcctgagaaggacaattctagagtgatctaggaatggtgagaaagcctttggcttctttctgcacacacctttccaagggcacctattttttttttttaatgataacaaatggtgacaagaatatatgttatcattcaaattagactgcatgtttgaaataattgcccagagtgtccatctgctgctgtgggtatggaaggtactcgatcattattggttgagccccatcctccacatccctctcaacatctaatccttttttttatctctcataggcaagagcagcatttatagtcaaagcttatttacaaatattatgatgcaaaagtaagattatattcaaaaggctgccaaaagagtcacttttctttttcttttctttttcttttttttttttttgagatagcatttcactcttgttgtccaggctgctgtacaatcatgcaatctcagctcactgtaacctccacctccaaggttcaagcgattcttcttgcctcctgagtagctgggattccaggcacgtgccaccatgcccaactaattttgtatttttagtagacacaaggtctcaccatgttggctaggctggtctcgaactcctgacctcaggtgatccaccccactcaacctcccaaagtgctgggattagagttgtgagccatggtgcccaactaagagtcacttttttgtggatcgttgcatgtcctgaggatatatgaagtcaggcaacagaaagaaataccatgtcaagataattcagaacccagttagctgaaagcttgttctactaactacatgtgaagtaatgttctagttatttcagctgtaattccaaattcaaaattgtttacaccctctggttgcctttgtactcatggataaaacataactgtgtcatcaatattatctggctcataacagcttgctactaatgctgcaaggttttcaaacagctttagccgacagcacaagcagcgcagagtttcttaagggttaatttaaatgtttatatttaagaagcatattcatctccccttacaatatccatcagccatcttgcataaatgtatttctgctgctgtcataccactctttggagaattttatttttaacaatgaaaataataatattttaaaaccaccaagcaaaaacaaggcaaatatgatcataagattacctagtcatatacttttctctaaaaaccatacctattttgttctgtagaaaaggaattctaaggcagagatgggagtgaaggagagaacattttaaaatcaggagacaacagaaaacatgtctgaatcttgaggcaaagtgggggccactttgcagcctaggccagtttgtctgtcaaccacctctagagaggacaaaataatttcatgtttactagctactatctgctggttatcttacgtatataacctcattccttctccttgaaaatactgcatgattatcgcttcatatcgatgaaaaaagcgaagctgagagaggttaaagtaaaatgccaaggttctgcagtatagctaacggtcactgctcttggctcctttttcagagaaagcatggctagaagatcttgaaagttacagaaagccccatgagacaatgactcatctctgatgtgtggcagaatgagaaaccacacttacagtggtatcctcatcactcttccattgaaatgaacccaatgctcccacatgcaatccaacgagagataaatatgacaaaacaaagaaagctgcatgtttgaagtgctttccaagatgtcttaccacactcctgattgggactgtaatatccaagaagcttgacccaatttctctgagatcctggctttcccctaacctgacactcttgttttattcttggtttagagaattcttgcccaatctttctgcctcttttattccagacactggctcctctctcagctgtctcacatgttatgaatgatctcgcctccatcacttttcacagctctttacaagtgctgaccatggatcatattcgagtgtatcagggtctaggacaatgtgtttacattacagaaatatgactggctttcacccttctgaaacatctctttttatggaagacattcattgataccttcagtcttaaaaacttgttggcatagaagaacaggaaactggaagaggagttttttacttttatacttttatttgctaaatgtgttaaacccttaaatgtgctacatatgtactataaggaatgcacaccattggtcaactatcataatttatgctctgtaattcacaatgcatactttatatatatgtgccttagttataactaatatgcttctttttttctttaaaaataatatagatcaatgatatttaatgtttaaaggaattttaaagatcatctagccccaaaatatcatttcgtaggggaatttggtcaatatctctttaaagaggtagaatggaaagccaggttcctgagttctaatcattcccagaggttctcttgtagttaaagcatgattttttaattaattagctttcatcttagaaatcgttttttatcataaagctaattttcagacatttggaaaactgtgtgagttatcaacagatgaaattatgctgttcactcatttaactgttcattgtgtgttttccttccatcttttctatcttgtttatttattaatctccagaatttagaattatgccttgaaaacaaatatttgtagaatgcatgaatcaatatgcaaagtataagaaaggtctctctttgaattctgacatagccctatgaaatattataacatggaagctgccctttgatgtaactggtcctaattaaatcaattcagataatgtagtataaacgatctttgggaatacagtatcataatgtttgaaagttatgaaaaataaaggggagcagcaaatatgcatttttaaaagctatacacaaaattggcctcgctcacagggtcattcaattgtgtgtgtgtgtgtgtgtacacatacatatatatatatatatatagagagagagagagagagagagagagagagagagtgtctactacatgtcaggtactatattagttactttatatatttagcacctcagagcttgctgaaaacaacccttatggaagatgctattattattccctatgttaaaagtgcagaaactgttttcaaggtcactcaaaaagtagtgctggtaaaacagctagaaactgggtgtttcttgctccaatgcctttaaggctatactgtgctgtcttcataaattgatccacaataggtagagacaagtagaaacaagcatatttcctgcagtttattcatttccttcctatctgtttttgcataaagtttcacttataaaaattacacaaaacttgaaaggtgaacaggagatattaggcttagaagaattccttatgatgaagaacactttggtactgattttgttaacacacttttccaagtagccttataaatcaaatagaaataataattttaaaaaccctaatgactcaacatacttcattccaattgaaacctactggatacatgtaattcagagaacagattcttctcagttaactttatccaagactctaactttttcagtcaggaaaaatatagcccatatggaatgttaaccttttatcacggaattatgatttcatagcttcaaattgctggtccatgaggaataacagccgagagcttacatatggaggtaacaaaatgttaatgtcttagtccttttgcattgctataaaggcatatccgaggctgggtaatttaaaagaaaagaggtttagttcgctcacggttctgaaggctgtacaagaagcatgtcaccagcacctgcttctcttaagagcctcaggaagcttccactcatgatggaaggtgaaggggagtctacatatagagaccacatggcaggaagagaaagacagacagagagaaagagaggaaaggggcccaggccagagagagatatatatatatatagagagaggctaggctctttttaacaatcagttcttgcaagaactcatcaagtgagaattcactcattaccttgaggaggcaccaagccattcacaaagggtctgtccccatgactcgaacatctcccaccaggccccacctccaacactggggattaaatttcaacaaaagacttaaaggggacaaatatccaaactgtatcaactaaagaattaattttgggggtgctaggttttctcagaaactaaaaaatgagatataacttgccattatatgatctgtgtttaaagtacattctctctcgtccatatttctccaggatgatatgcttaacttaggtgttaaaaataagtccatctgatttattttcaaacttcataaaaaattatagatcatgtagaaaaattaatctgtgtgactagtaaaagaaaatgtgacagcaatttggagaatttactatagcagatattaaatatgttacaatgtattaaatgttagagggatcaaaataatacagttttcagggcagaatgagcagaggaatggaatagaacagactcgagagataagaccctcaaggttaatataataaaaagatgagatttatttcaagtcaatggggaaacatgttttattcaataaatgatgcataaaaagtaatttgtagatttttggtgagaaataagtaacattagattcatagaaacccttcacactaaaataaaatctgtatgaatcaaatatttaaatgttttaaaaagtgaaactgtaactagaaaagattttcattaaatatctccaagtgtagagaagatcctcctaataatgataacaaagacataacgccataaagaaaacaatacggccgggcgcggtggctcacgcctgtaatcccagcactttgggaggccgaggcgggcggatcacgaggtcaggagatagagacgatcctggctaacacagtgaaaccccgtctctactaaatatacaaaaaattagccgggcgtggtggcgggcgcctgtagtcccagctactcgggaggctgcggcaggagaatggcgtgaacccgggaggcggagcttgcagtgagccgagatcacgccactgcactccagcctgggcaacagagcgagaccccgtctcaaaacaaaacaaaacaaaataaagaaagaaaacaataattacatcaaaattatagtttaaataattttgttttgagatagagtttcactcttgttgcccagggtggagtgcaacggcaggatctcggctcactgcaacctctgcctcccaggttcaagcgattctcctgcctcaccctcccgagtagctgggattacaggcacctgccaccacgctcggctaattttttgtatttttagtagagacagggtttcaccatgttggcctgacttctctggagcttctgacctccagtgatccccctgcctgggcctcccaaagtgctgggattacaggcgtgagccaccacgcctggccatctgaaataattttgaaacgccttaaaaagacctgaaaattaaattacttactggtaaacatattttcaacatgtatgacaagaaatggtttcatacaagaatatatgaaatggtcataagaaacaaactataagaaataatttcttatacttactgtaagaaacttttatctataccgtgcaattataataaaagaaaataaccataatagtaagcaataaataatgaaaatgtattcaagcttcctagtaattggagaaaggcaattttacatgagatgtcatgtttcacctaaataattggaaaaattaaaaagaataaaagcacccagtgttagaggatgcaaagtaaccatactgacatgtagtttgggggaaagtggaaattgatggaaactttccagggtaccttttggaactaaggactctaacacattacatgtaaaatattttgccctttgcaactctactcccaaaattatatttcaaaaatgtgactagacaaattactagagatgtgtctaaggaagatcactaatgtgctgtttttataatgaaatgtagagcagcctataaacttatcaatgcaagactcttcaacaaaataaatgggatgcatcaccaaatgtgctcatagagacctgtatctcttgatatggataatgagcacattatatgaagtaaaagatgcaagttataaaataatacgtgagacacaaaaacaggtgtatgtgtatgtgtccgtgtgttttcatgtgtacacacacacacacgcacatggaaaacagacttggaagaatatgcacccagtgttaatagtgattatctccaggcggtttgattcaagaggttttaccctctgctttttttttttttttggttttgagacggagtcttgctctgtcaccaggctggagtgcagtggcgtgatctcggctcactgcaacccctgcctcctgggttcaagcaattctcctgcctcagcctcctgagtagctgggactacaggcacacgccaccacacccagctagcttttgtatttttagtagagacagggtttcaccatgttggccaggatggtctcaatctcttgacctcgtgatccacccgcctcagcctcccaaagtgctgggattacaggcatgagccactacatccggccttaccctcctctttaggtgaaagtacgttggctaatttttttttcagccaacattatgtttttataatcagaaaatgcaacatttattatgaaaataattcaatgaaaatgaggtataatagttttaaattacacatctagtatgacatttaaaaatgtgtggtattctggtaataatcatactggcacacagttctgaaaaaaaaaatagaaaccaataataaaacttttcctaagccattatgaccatgttattttttcctccagatcaactggtatagattattatctatgtcataataatctgttatataaaatgcaaattaagtacatttttatttaagaaaattacaaatgttacagtttggtacaaagttattgtcagagccacttaatttgaatacatgttatttgtagaaacggcaattgactgtgtaggaattatggcaaattgattgtagtctttgtggaaaaggctggagaatgccaccttctgaaatcaaacctagtaaaagtcaacacattataacaactatggtcataataactacaatttattgatcccttacaatgacaggctctgaagtaagcactttataccctttatcagataatgcttaaaacagctgtgtataatagtcacctatacatctgtatcaaaatatggaagctcctagggttgcaaaggtttcatctggggccaccagcctgtaagtatcataacaaaagttcaaatcaagtttctctactgtctgagctattgtctactaggctacatactaagcttcgtctcttttagaggaaaactacagaaaaataaaccatcagataaaatcatttgtaaatatgtcactgatgttgacttgaaaaatatgtacttagaaacctaagagaccagggtataacctcaggtagacatgataggatcacatttgatagatatataacttcatttcaatgccttgggcatgaccaagttgtgcaattagtaaccagcaagaggtggagttgacttgaaagtccttgctggccgggcgcggtggttcacgcctgtaatcccaacactttgggaggctgaggcgggtggatcatgaggtcaggagatcgagaccatcctggctaacagtgtgaaaccccgtctctactaaaaaaatacaaaaaatgagccaggcgtggtggcggacgcctgtagtcccagcgactctggaggctgaggcaggagaatggcgtgaacccaggaggcgcagcttgcagtgagcagagatcgcgccactgcactccagcctgggcgacagagcgagactccatctcacaaaaaaaaaaaaaagtgcttgctactgtttgtctgacaccattcaatgcaaagatatactttaaatatagaaataattctagccctgcctgaatgaactctctttcaagatcacataactctacttcggatgctttgatcattgctatggtttggatatggttcattcggccccaccaagtcttctgttgaattagatccccattgttggaggtggggtctggtgggacgtgtttggatcctgagggcagctccctcatgaatggcttagtgccattctcaagggagtgaatgacttctcattgttggttctcctgagaactggttgttgaaaggagcctggcacctccttctctctctcttgtttcccctttccccatgggacctctgcccagaagactcctcttcaccttccaccatgagtggcagcggcctcaggccctcccccagaagcagatgccagcgccatgcttcttgtactgcctgcaggactgtgaactagataagcctcttttccttataaagtaagtactcaaccttaggtattcctttatagcaacacagactaaacaattatcattgtctgttgctaatttgagccccctttcaataaaactatgacgtacacacacatatgcacacaaacagacagacagacagatgtatatatcaaagtgtgtatagtcttctgtataacagcatgatcacagagaacactgtggaaggtatgcccgtcatctactgctattcaacaaaccaccccaaatgttagtggattaaatattttttagttcttaaaaattaattttactggtaaatttaaacaggattaaattaaagcagcatttggtgggcactgcttgcctctgctctgcttgacaacagctgaggaggtttaaaagctgggaggtggaattgtctgaaagctcacttgttctcaaacacgatggttgtcgatgcaaagactcaaactgctgggagctggtacacctgggttccttagccatctctctccatttccatgtgcctttccctctggtctctccagcacagaagcggtaggaaacctgggcatttacaatgttgtttgggggctgctagtgtacaggtcaacaaaagaggaagttagatgctactttgccttttatgatttagcttcagaagtaacagcataagttctactgttttctgttcttagaaacaagtcactaagtctgacctaggtctgtggggagggaaattagaaccacttttttttttttttttgaaatggagtttctttcttgttgtccaggctggagtgcaatggcacggtcttggctcactgccacctctgcctctcaggttcaagcgattcttgtgcctcagactcccaagtaactgggatatacaggcgcccaccaccatgcccggctatttttttttttttttttttgtatttttttgtagagacggggtttcaccatgttggccaggctggtcttgaactcctgacctcaggtgccacccacctcggcctctcaaagtgctgggattacaggggtgagccaccatgcctggcctagaaccacatttttgatgtatttatgaacctgcagacatatttttaaagaaccacgcaaggatgaatagcttggtaacattgagggaggtcaagttagtggggagctgcccaaggagaacagtagtgaggaagaaaaacaacaagaatcagacagggacagagtggagggcaggagggaaagtcatgcagctgagagggaagatatgaataccatggaacgttgggaagccgaggtgggtagatcacctgaggtcaggagttcaagaccagcctggccaacatggtgaaatcccatctctactaaaaatacaaaaattaacccagcatgatggtatgcgcctgtagtcccagctactcgggaggctgaggcaggagaatcacttgaacctaggaggcaggggttgcgaccagctgagatcgcaccactgccctccagcctaggtgacagagtgagactctgtctcaaaaaaataaaaaataaaaatgaataccatggaattggagctgttcccagagtataaaccaataaatgaacatcatggttcatagtctactgtgtattagatagctcatgagttcgtctctttaagaactgagttgctaaaatttagttcctgaacctgtaaacatttggactcatggcaattcttaccacttggtggccattctcttcaacatgtctttagccacaaagcactatttgatggagagagtaaagacattccatttcttcagctcctcttaaagctccaaatgcctccaggccccacccattcccccacctctctctctttctaaacagagattggttctcaccatttcaaagggtttaggttgttactgtggtttagtttagctttgctttgttttttgaggtccacctgtcgtatctgtgacagaatttgcaggaggtactccagttgtgatcactgggaagaaaatgcggtgaaatcagactaacccatagttctcagtatatcattgcatggcttctaaggaaccacaatttaaacagtgcatgataaccagtattaatggattatagcccctaaattgtaacaattgtgactttgtagactcctaagtatcttctggtttgggtaacctttctattatttgctttcttgggatctgtcagttacagtgtgcatttagtcccgtacgtgtggctgacatatcctatcctagagtggccacttgtttagaacagttctattgatcctgcatgttccctaggaggaaacacaaggccttgctgagaaggctctcaagcttcactcccatgcagtatagtttacatttctagttttgtgatttagttctcatggagccataggccataattactcagctgtaatgaacctcacaatgcatcaatgcattcttctccatttatatttgcttttatttgaatgaaataaattcattcaaataaaagcaaatataaatggagaatacattcacaagatgttcacaagaattataataacataaatgaaacaaacatttattttattgaaataaaagcaaacataaatggagaaaaatgcactgactatggttcatgactgaaccatagtccttatttatgagacacagtcttgctctgttacccaggctggagtgcagtggccaatctcagcccactgcaaactccacctccggggctaaagcaatcctcccacctcagcctcccaaatagctgagattacaggcatgtacccagctaattttttttttttatttttcatagagatggggtctcataatgttgcctaggctggtctcaaactcctgggctcaaacaatactactgccttggcctcccaaaatggtggggttataggcatggtccactgtgcctggctgaaccatagcccttttaagcattgaatgcatttaaaatattttcattgttctatcaataaaatatccacatttaaatgcaggccttataataattaatactactcactattaaataccaaattagaattgattctctaaagtgtcttcatatattgtacattgtgctaggtaatatgagttttaattgcttaatataaaattacttaatggcacttataattcttgtgaacatcagtataagttttaataaaatggtagaagcacatggagaaatggttctttgattgttaaaatagttcatttttataaggcaggtaagaaattagtaagttagataactacattagtccatttgcatgctgctgaaaaagacatacccaaaaacaggaagaaaaagaggcttcattggacttacagttccacatgactggggaggcctcataatcatggcgggaggtgaaaagcacttcttacatggcagtggcaagagaaaaatgaggaagaagcaaaagcagaaacccctgataaacccatcagatctcgtgagacttattcactgtcatgagaatagcatgggaaagaccagccaacatgattcaatgacctccttctgggtccctccagcaacacatgggaattttgggagacacaattcaagctgagatttgggtggggatatagccaaaccatatcaataaccctgaggaaaaaatcacaatgctgggatccagaaaaatatagatgtttttgaataaggtttttgaataagaaaaatctccatatatacacagttagataaacccaacagaacatccttcagttttgaaagccaaggaagcttcattgaatcctgtgtctgcataaatgatcagtgaaatttcaaaattcactgatgtgcagtcttgcttcacaaatggacaaatggagatgaacagaggccaatggccatggacatagaaggagaaggagttacagacagaatcccaaactctcaatccagtttctcaaactgtccagcatgtagttgctattgactcaattgtcctttggaaaggatgaagtctcagatagtctcaaagttcactttacatagtaacccattttgtctcccctctaatattttgaaaaggtaacggcaacagaaaagggtcctcagttttctaggaagattgacaagaaggaagcagcaggaagagaaaggcaggaaaatcttcatactggatcatccatttctagcgattatagataacagagttgctgataaagatagaatttcagtcaaccactaagcagattcccactgaggaacaccctggagaaacacgaacagtcaagacagaagaccaccagatggctgatcttaataacccaataaatacaagaaaagagtggcacttctacccagttctaaacgaacatctcatttgtatgttgtgttctgagttttagggaagacaaaaatgccaattctaatttacctttattcacactttgccagggattcaaggaaggcagaaaaaattgtacaaaataatcttttgtttttgttcccttcaagattctcttttactctttttgttccttatgccatcactccaccacaaccatactacagacttcgcaactgctgtctcagcctttgaaacacctaaacttcaacatgctgagattacgcctattacgctaatgaacttctacaggaacgaacaaacgaaaaggaagtaatgcaccacctcctgtttctcagccatcaccacctcccaggtgcttcccagagcagttccctgctgccacggggctcctgcaggagctcctccctgctaggcatgtcctcaacccctagtcatcaagtctagctcagcctctgcatttcagctcaacgtctaatttcccagcgtagattccaggcagccgccctgtttcatgtcctcttaacatcctctgcttttctatctcatcttccttcttgacaagttcaaagtcatgaggactggatagagctccatcaaagcagggaatgttgattttatacactggagctgagtgggcagtctggcacagagcaagtggccagtaggattacggaatgcatgaaccttaattttctattcctttattcctgtcatttcctgtacctcacaaaatgttcccaaccatgccaacatcaccacctgtgaaaatcccaccactcttcccttgggcctcacctccatgaagtcctctttgatcacctttgtgttttctgaactccataagcactttctatgcgtgtttcacatcactcatgatatactaacttgtgttatttcctctgccctattcacagagggaagtccttgcatggtccttcacatccaatcttattagcatttaggtcatggcataaaaatcatcgtttgcctacacgtctcactccatccccaatttttcccaaactatgaaagcagtgaattcaatactcgtttttctatcttagtgcttggcacagaagagatgcttggtaagctttttacttgctctgcggaatctgaattgcagccatttttgtgaagtcttctctactcggctagattcctacatcctgaaagtcagtctttgttttctgcatagtgactagcacaacaaatcaatgtgttataaaagttatctacatttctttcaatggaaagatgcaaattttaaaaacgatcttttgcttttccactcttgaaacataaacattttctctgtaccttgtaaataatacttgcgtaagatgatcaccactgaagttattttcccaaaccctgagtattaaggggaatgatgactgcctacttgaggaagctcagatgatccgaagatcccaaactatgttcctttctccaagaaacattagtggaagggagtgtttcaccacatgtgggtcaacagtacgtgacatcgtctcagttgtgatttgattctccatatgcttataatttccattctaaatctcaagtttggtaaactggctttaagggatttttgccacatatatcttaaaaactaaattttactgtggctcttgataactttttgagagctagcttgacctgagtaagacagatgatagctccttaatgaccgccatcaaggcatgatgaagtgcgggtccctgggagccatcaatcacctgctggaaggactaggagggctgtttcccggccgagaagcaggcctcaatctcttggcccattactctcacgtcttccttctattcttctcactccattaggctcctgtgtatctgcactgaggctatctcagagtgacctcccatctctaatccttgatatttccatttgggtctaatgtaccatctcgattgaaacatttgggaaagcttacagcggtatttaatctttctttgctctagttctcagaatctcatttataaatctatttgaaattatcttttttgtatctattactatcttttccagtagatcgatatgtactctctcctaatctaaaacctagtggtctagaagcacacctctttctgagtaattgtgataaagtgctttgttgtttctttgttttcagggcctttgtctaaacctgcaatgcaaccatcaacacagcctcggactgacacgtttggcttttgaatcattctatggaaaggcaaaaaacgaagtaagacttttgaagcctctggggtttataaaccggtataaaattcctcatatttgaatatgttgtagtaatatgcatgattttgttctactgcacataaagtgcgatacaaactatagaacagaagatcgcagatcatcaagtgtaaaaaacagctgacattcaccttgactaggagtttcctagaacagggaagcaagaagtatgtattttggaagctgcatattgctggaaagatggcgtcatagactaaaccaaggtcatgttctgtgatagcagtgtgaacactgttatttcacacgtgcagattctctgctacagccgcactggttctggcacctggttttcttcctctggagattattttttcatgtagcagtttacaaggaatctttaacactaccatgaagaagatggctgttaattcaattttccaccaggttataaaagagccctgatgaaaaagaagttatgtcatggttatctcacagaaaaaggagaattaaattaagcttagggttcataccatcattgacacttttttccatgggaaactaatgcgttttcatatacaaacgaaattttgattcaaatttgcaaaatttaagctaattctgtaataaaaatctatcttctaattttaaccttaacaattaaaaaaaaaaacaagaaattttttgttatcaagtattcaaaacttggtttagaaataagctgtccttgagtctgaatgctggattgggtttttgaaaaatgttctaagaaaactttctagtttgtcaccccaaattgcatgtcagacaacagagaacactttgtcacgcttagacaccattcaatcataatctgagtttgacttcaaagttttcacaattcaattttgtttagaattaagaaaacatgactgtggggaccaacgtaagggcaggcagagcatttctcttcagccaaacaccagggcagaaggaaaaggggagtgaatgagtccatttgtcctttacctctgttttcattttccactctctacatttaagtgtccagctgctctttgaccacagtgggacccctcaaagccacaaaggctggaattgcttaaatatatatttggagatgcttgtgctgatagttattgtacagtgcagacgagcatgggcaacacaagaatatggagcccacggctctcatgctgtgcaaatgaagaccgtcatttgtgactatctcagggacacttttcaatccaagagcatttcttaaaaacaaaagcaaaccaaccttttattgttattagacaccagaaaaaaaaaaacccaaaacatacagttcacacatgaaaccatcctgagaaattctgagtctcattttctgtgattctaatgaagtctaaaacaacaataaaaacagacaaaagaaatacagattccttggaggatagtaatttgatcaaactaaaacattattaagaaactttttggacataaaatacggaaatgacttctgacataaatcacaattgctcagtattaggagacttatttgctattaattttgtttcagtcaacatctctcaacaacatgaaatcagaggtgcagaccatgaatattaactttcattcaaactaacgttccagttggcatatactgagcctaagagggggaaagtgtgaaaaatagattgcatgttgagtaagatgaaaacactctatttattatactgagtttaatagttacattatttattatagttcaggggatagttttaagtatctaatttcatttgaaataaatcttggagttattgtaagaggtgttacgctacttgttctgataagaaaaaaaatgtttgatgtataagagttgaactccagtcaaaatcaaataatctaaaaaagaaaatgttattttacataacacttcaggtaaattctgcctctcaaaaatagatgatatataaaaaatattatagcttgtgtaataggaaatcaacacccctcaataagaatttctttaaaatgaccttggtcatttattactttaaagagatcacttaaattttctttcttttttatttgagtaaatacccccatcctaaaccctactgtgtgactgtcaggtgtgagggaacaggcaaggttcttgcagttggctaaggggcacctcattaccagaaaagcaccactgaaaccacaggtctcggaggggagcgttggatgacagtggacctcagtgttacgagttaggattcggaactcagaaataatgctcaggcactaggacttcagggttttccttagcctatgtgtgcccaagtaagagaaacacacatcccccagtacacatacaaacacaaattattgttttaagtttttaaggccagtgtgtccaatcttttggcttccctgggccacataggaagaagaataattgtcttgggccacacatataatacactagcaccaaaaatagctgatgaactaaaaaaaaaaaaaaaatctcataagagagtttacaaatttgtgttgggccacattcaaagctatcctgggctgcatacggtgccgtgggttgaacaagcttggtttaaggtatcataggtaaattataaaatgaagatcgacacagaataactaaagtcttatgccatatccaaagttgagttaatttcactaacggagaaaatcctaattgatttcatcccctttttaatctcaagcatatatcctttgagctgaccggaattctttttataaaaaggtaagaactaatagtatgctccctcctaaaataacagcgattagcataaagctgaattaggttcaggtttctctgtctaaaggagagttagggtcaagtttgtatttgtactcttaaaaaccaagggtaaactttactgctatttaaaactatctactaagattatctttaagggtataaatattaattaattaagaatatattaggaacactgctattttaagttctaagtacatggatattttgtctaagtgatagaaattcaaaattttaataaacttaaaatatataaaataaattatatatagggtccaaaatactgtcaaaaccttgactttagaaaatacaggagtcagagtttatatttagctgcattgtgaaaatgcaatccagaaaaatggttttaagagagagtgaaagagttgagctcacactgaacacttaacttgagctagctattgtcatggttagtgctcaaaccttcagtcccttcacttaacaggcatttagttggtgtttattaaatacagaagaaaaaatatagttggatatgatgcttccttttcctaccttgataagaatatctttgggtatttatgatccttaattccctgttcaaatacaaatttagctacactccaaatatctgctatgtggtaccctttcattgttgtttgttcccttatttccatttagatcttaacattgactcagtgatttgaatgtccacgtgtaacagatttttagagttatatttttgctattgatagttaaatttcttaatgtcctaaaacacgaccagttgttgatatcctccagttgccgagtgactctctcctgatgtcgtgggctcactggtggtacgaatcggacgcgtccttcctaagcttgtactgcaggagccctcaactccacagagagctgtgttactctctctcccaccatggtgttaaatttatccacatattttgttaattctgacaatgtttccttagtacattttgaatccgtgttactaagatcataccattttaaactgctttatcttcctgcgttactaaacctttctaatcctcaaaacctcaaaagtctccttttcctgggatgctgaacatatttttcctcaaaacctcgcatgtctccttttttagtaatgtttccaccctctcctgaaaatctattttatgtgcaattaaaatggtatcaacagcattcttgagttaatacttgcctggattattactttccattcttttactttcgatgtttttctgctcacatgttttaggtatgtcttttgtaacctgcataaagccagattctgttcctttaacccagtctaagagtcattgtctttcacatttcagttagtgcatttccatttcttttcatttctgttacatgaggttttacttgtgccatttttgtgtgcactacttaagttgtcccattttcctatatttcaccccctctctttttttttcatctctcaatttggcattttgtatttcagttctatcccttgaatggttatactagacaatgtaggttcacctctaactttgagggtttaatgttgacaatgactagactgaccaagtgactggtccaggaattgcttcccaggaggtcccaagcctgaggttccaataagggcggggaagataatgaccttggcacagggaccatgacctttgaggacatgactggctgtctctcctggagaaggggcttcctaccaggcccagaggagcgtggtccatgcggagcactgaagacctttgaactcgagccctcgctgggacttgaggccactcccacctccccccaatcaccgtggccacacagctggagttgatgagaagccagggtactgaacagcaaggactcgaatccagccaagacagggaggcccagctctgaacctataaacacatggtgttcggaaaggcctggagaagcagcagccattatttactgccagaaaattcacgaggcaagtcccatatgtgttaggagtgtgaggaaccacacacgtcctacaagtgctgcaatgacaagaaagcatccaaaattccccccatttggcaccaggatctcctatgcaaagaaaggtcttttcagtgcagggaagatgaggaaacctggagccaaagctgtcgcctccttcagaattccaaagtccacactgcagaagggatttgttggggaagccaggctgagaaagttcccactcactcagcacggagaattcacacccaggagaggccgtctatgcgagattcttcagccacgctcaggccttaagcatcccgaatgctcacactggagagatgcccggtgagtgtaatgtgtgaagaagcttcatttgtcacccggaacttcacaggctaacgggcctcatgagcaaagccagcgtgggggactttccgccgcaggtacaccctcgggagtgcacatcagagatggtcttagggctgctgtgcacgcgcctccgcatcctcgttcaggaacaatgtgttcctgcctgagaggcgagcaggagcgtggcctttgtgagaaaggcttcggtcatgatgcaaccccatgtccagagcacccatgccaagggccacagagttgtgaggccttcgggggcgatgatggactttctgaccttccctggaacccagggtgagttgtcacccccagggctgatgggaagaagccttccttcctctccatcctggtggggcagctgccgcccccacatgatcaaagaacgcagcctctagtgtcacccacactaccctggagcaaatccagactgtcctgtgcacagaactggcctaatctggacaaggggacccaaggggtgtcagctggaagcttctgggcaaggcttccttgtcccatggattttaaagtctctatgtgacagctgtgatggcttcaaacagcctatgagtccccttatttgtggactgtggtatccaaagtgggcagaagttgccctagaacaaatcccccaaagataccaggaatgactgtgttattagatgagatcgggcacgttcagggtggtatggccgtagacaggaatgactgtattatcaaactctatcctccatgttttttaagttctcttttattttttaaatctattatgttctggctgcatttaggataatttttttcaggtcaaatttcagatctaagttctattttctctttttacctatgtcttatctgctgttcagcccatttagtaaactttgtgtcaattattataatttatatataattctagaatttcaggtgtgtgtgtgcttgtttaatttgactggatatttccaatcgttttgttttgtttttttaatcttttattttttaaacatattaagcatccttatactctatccttgatgatttcaatttctatgttctttactgttttgaattctgctcactcttattcaccatggcttgtttccacatatatgttgtgatttttctgattgttaatttatgttccttgaaacactgagaaaattatttcaggactcctttgaaagtacagggctcctagaggatttgggctactctcagcccagtacccaggactacaactcatgactgactacattaaacaacattctagacccaggactttctgtgccgcacaggaagagtgaatattggccccaaactcaggtttgagttatagatataactctaacattatacacataatgttgtatatatgtataccatatacatacatagaatgttgaccctaaaaacttgtaagcataaacccatcggtttgtacttacaagtttataggggcaagattctatgtatgtatatatgtataacacatatgtatatatggaaacatagatgtatatataattatattattagatgcaattatatctacatattatgtatgctataatatatacatattacatttgtatacatgtaaacgtatgtaattacacttaagaattctgccctatgaaatacgcactctaatttcatcctggtaggaaactggcaagactgtgtgatacctcaaaaatctgtgagtgacatacaagtcattatctttcttcaggatttggatgaataaaaatctgttcgtagtccctagccctaggctggtggagagtgactgtttattgttgcccactgccatcctggtatccttccgatcagccagcagattggcaagagaaagctcctctcatgattctcgctcaaacgctgtacctgttgctgttgacagactctgttcctgagagaaggtattaactgccagctggctctgacagtttgggaactaaggctgacatttgtgctggcagcataacagtatttacaactcaggaaatgtatacagttagattacgacggagccagcgagttttgaggttaaaaaaatacaacaatatacatgtgaagcatgaccataataacaaaattaacttaaaaataaattcagagcttaggggttctttcaggaaatatctgcggtctatgaaacatatggcatatatgtgcaaagagagaaaggattacaaagaacagaggatggtaattcaattacatcgccggccacccatactatattttgtaatagtccactatgtcagaaaattactaaagaaaggtagaagtagataaagcagaaaaaaaaatcaattttgaatgatggggaatataaatataaaatatcactggagcaggagagaaggtgaatctcatgcttctgtaatttttcttttggaggctctgcactggctctccttttctcacctctccttttccttctatggatataactttgcaatgagtttaaattggcacatttccacacggtccccccaaatgattaagtcactaggaaagtgaccctgaaaggcaggggcacaggttggaattttggtgaatgtaattaacctatttaaatatcataacacttttggcaaacattattagatggaagaacagtcagttgacattttgtctctaatttcctggcaaacagtgaagatgtcatcattttcttgcaataagaggaatgaatgtgaccaggtacttactgcactagtcccagggcagtgtggggattggcattcaccactcatccggtttggaattaaaacatcatcccagcaagatggaccctttgggaaaaaacaacaatatatgcttatatgagttataatagaaatgtactccttaagacatgtttccacttatgttataaaataatagtgaaattagtgtgtagtccaatgattttcaaagtgtggtctgcagactctgggggtccccgtgaccctttcaagggatgtgctaggtcaaaactatgttcatcaacatacaaagacgatatttgacattttgctccaaacctgttcgttttccacttatagcctccccctacggctgaggttaaatgcaccttactagaaaggccatccctgactttgctccacttctgtgtctgccctttcaggcttcctttgcttcataataattattactaccatccccacccaaccccaccatgcagtggcccagcacagagcaagggctgtctgtccctagtcaccacagctacacaaaagccaacttggtctgctctgttccctgaggcatcccagcacctagaggagggcctggcatcgagggggtgcgcagcaagcttccctaggcatcaaagaaataaaaattcaataaaagcaacacttcttttaaattagagaagatcatttaaaatgaaatatcagtgtcaattattgcattcctcttggaaagcaaaccagtaaaaagcatcacaagcattcaactggttcataactttttgactaaattttaagaaatcgggctgtgcacggtggctcattcctataatcccagcactttgggaggttgaagggggcggatcacctgaggtcaggagttcaagaccagtctgactaacatggcgaaaccctgtctgtactaaaaatacaaaaattagctgggtgtggtggcacgcgcctgtaatcacaactactcaggaggccaaggtaggagaatcgcttgaatgcaggaggcagaggtggcagtgagccgagattgtgccactgcactccagtctgggtgacatagcaagactccatctcaaaaaacaaacaaataaagaaacaaaaaatcaaaagcaaaaggcagataggggagagggcacaggggatcaggagcagcaaatttccagatcctcaaatcttctaaacagaaagttcagaccatctacttggaaacaaaaatcaaaatagaatgtttaacttgcagcaataccttcaatttcaacctaaaattctgtgcctgacctaattatcaattaaatgggagaatgggaaaaagtggcttggggagatgcaagttggaaagttggcttgtatgtctgtgagggctcagggttcaggaaatgatcagatgcctgaggaaagccccaggtggcagcctggacctcctcaccgtgggtggagcagtgaggtggccacgggaggggcggagtaagaggtgggttgtctccccagctgtgacacagaaaggaggaggagggagggtggcatcaagggctggaggggattgacagagcttccaggagacgtggtatgaggccactgcccagtgcaaggcagaaggttaggactcaggggcagaggctgtggtgattttactaccgacgacgtttggacccagctagtgtttaagttgtaggagctaaatcggtcatcacaaggcccatctctgcttcaggaaccagtgtagagccgccctggcactttgtagcagatgctgaggaaaatgccgtgggaggtgggcaggggttcacagccacccctgccagtctgcaggagtgctccctccctccctcctttaccattacatgtgtgcacacacacatgcatgccacacactcacatatacatgcacataccacacacactcaggcatgcacgcacacaggcatgcacgcacacagcatgccacacaccacacatgcataaacacaccacatacatacacgtgcacacacatcccacacacctcacacaccccacacacatatacccacatgcatgcacgcacaccaagacacaccacacacgcacgcacaccaaaacacaccacacatgcataaacacaccacatatgtacatgtgcacatgtatccctcacaccccacacgcctaacacaccccacacacatacatccaaacacatacatgcacaccaagacacaccacacatgcataaacacaccacgcacacacgcacacacacacaataccacacagcacacaggcatacacatactacatacactcacacactcatgcatgcacacacgcactattctagagaaaagtcggggacgcagagcagttctccaggcctgagccgtacctgaaagagactgagccttttgacggaggctctttaccccagacttcaaaaggagctgcatctgggatccaccgatcattaatccaaaggccaccgcttaatatggaggtaaatttgcagaagagttctagcaggactgaagctgcgatggtttgaaaagcctgctttcaagcttggcccttggctggcatctgggaatgtgaattttggaagcgtccacatcattcccttactgctacgggtggtgtgcagagcctgaactgtctgcacaaaccatggctatgcacaacatcttctcaccctcggcaaggctggaattttgataagccccaggcagaggtgtctgcatgaccagttcccactaaaatcgctgggcactgactctccattgagcttcctggcagacaacacttcacacgcgttgtcacaactgagtgcctctcgagtgaccactgggggaggactcagagccttgcctgcggtttcctctaaactcctccccctgggccttttcccctcgcttcatatccttttgttgtagtgaatcttagctatgtgtgtgacaggacagcaagtcctgcaggctctcctggtgaatcactgaatctggaggggggaggtggtcttgggggcccaggacatgacgacataggattggtgatcaaggcaatgttctcccaggcacataggagggtcggggctcatcattaatatcacaccagtcacaaagaacaagccgtttcattttctttgcacatcccactgtgttcacgataatggaagcacttatgtgattttcaactttagagtaacactgttaaaactgaacagaggatgttaattatgattatgtaaccaaatatatatgttattcagcttggacaatataaaagcaaaaacagaaatgtgaggacttggaaggcagaagtgaggctggagagaaaacagaaaagtgctgatgaattccctgacctgccaagctgtttttattagaaggttgtctgcacctttgatttttaaacatgagcatatattcactcgataaaagttacaaatgtatagaaataaaagagaggaaaagaaatgatacctacgaccttgatcacgttcatcagcctcatttttctggcttaaagtgagaaattcagtggagataaatgtggctagaatgcagtctgctacaatgaatacactttttaacgtgaggacctttcttactcctatacaaaaactttgaactatagttgctttagccatgcaacttctggaacactgtgtacgacgattaggcaatttaggttttatattttctaaaatatgacaggagcaaagttaaacgtgctttgtaatggcatagattcactgggacatttgtttctattttctggatagtcataacattcatactaatagtgtgagtagtgtggataaattagcatgtctattttattatattgaattcccatattcaacagaggattttaattatgattattaaatatatatgtaatgtacaaattacatggcaaattgcaaatcctttgaggggaacccagagggcacatcttgcccctttgtttgttttaatgtctgtttctctgtaggttgtgatttgttctacctttacggacactacaaatcagatttctctcttttttagacaattaggaaaactttagagtcaaatttgtggaccagctcttgcaattttacataaatcataatacacacttcgtttaccaaaattacccttggcttcatattactttcctttgatccctttcctcatctaatttaatttttcctggttttcatctgcatgtatccctgcaaggttgtcacatcattctgaaacgagtcaggggataattaggtaattgtcgggccttgtgatgtaacctgactgacagctctaacaggagccgtgctccctgggatggtaggtcatctcgcctccagggacaaggtgatctctggccagatgcctgtgccaagctctggctctcatactgtggctggtggcaattcccagtgaaccacactgtgcttgaggcaccgaaaagtccctgcgtttaaaagaaatccatttcgctgtggttaaccattaactaaatgggacaacattgcttctcttctctggaagttttttctgactgactcatgacacatgcaatggtcaataacacacctacgtggcaacagccaagaaggagcactaataggccgggcatggtggctcatgcctggaatcccagcactttgggtggctgaggaggatggatcacctaaggtcaggagttcaagaccaccctggccaacatggtgaaaccttgtctttaataaaacacaaaaattagctgggcatggtggcgggtgcctgtaatctcagctacttgggaggctgagggaggagaatcgcttgagccagggaggcagagattgcagtgggccgagatcacaccactgcactccagcctgggcgacagagtgagactctgcctcaacaagaaaaaaaaaaaaaaaaaaaagaagtagcaccaataattaaatgcaggaattagggcccagttatattttgcttcacagagtaagacttcttacctcaaagtctagaattcagtgagacttttctgtgcatatcacagatgtttattttttcatatttaaatttttactgccctaatagcaactaaaatatttatggaacaattcccgtaattgccacatcaggtactatgttatctgacaaattcgtgttctacagagacattatagaaaactcattcacacattcttcttgatttcaaaccataacacaatggtgtaagtagtaaaactgaatggaattcttttgaatctgggactttaacacagtaaaatagatgttagtttatgcagctgctcacactaatagtgtgaatgctatggctatcctgaaagcagaaacaactgtccaagtgaatttatacccttacaaagcagatttaactgtgctcctgtcaaattttggaaaacataaaactttaattgcctaatcattgaacacagtgttttaagagttgcatggccaaaacaattatagttaatagtttttaaatagtagcaagaaaggtcttcagattaaaaaggactgcaaaaatgcatggcagtagaagggagctatggatgataatacgtcaattagagaagcaaaaccactatttcatccctcaaatctaccgaattagagaaagatatctgaataaaatgtcacatagtctaataggaaaaatttggctggtttttagagaacgttctctttttttttgcctagtaatgacgataaccaagaaaaatatataaattattttagcaacactagcagggtgaggaaaccatgggctgctggccaaatcccaccttatacagactctgtgctaagaaatgttttcatgtttgttaatagttgaaaagcacaaaaagaagaatgtttcgtgacacatgaaaactatgagaaatttaaaattcattgtccataaagttttattggcatatagccacataaagcatggttgcttgtatgctacaatgagctgttgcaacacagacctcatgaaccacacagcctatcacgtttactgtcgggccctttatagaaaaaacttgccaacccctgatctacagcaaattaaattttccaaactcatactgaaaagtactcttttatttttaatattgtggcagcactttggctaacatataatcgcatatgtttgtatgagtaggtatgtcctgggtctcaagtgagaaattacaatgaaaaccttagtgctgttgacctgagaattccgagaagacggtgatagagaagcagcaattgaatcctgggattcatcaaattgtttgcatcagtaagtggaaaatgacaactagagatggcatttgaggactggtcctgactaatgttactgtctatagaaaagcgtgaagcaaatattacctaaacacgtctatatgatgcatgtaaatcagaaatacagaaaaatgaccccacagagggaaagcattgataaaatctgtaacatgtgggttttaaaatttattttcaaaagttctagaactcataatctgaaagccattttggctatgtctttcaatgcccagaaaagtggaaaattgaagtatgtaactgactatttcatatccaaatattattcagacacagtccagactgacaaaacaaaataactatttttcttgagttatctaaataaatgctataatctgctcatcatatgtgagtatatgcattgatgcttaaaataaattgctaattctattttccaaaatgttaatagaaaaccatggcatttacagtttttgaaaaatgttatttaatagtaattttacttaaactatacttaccctattatctcatcttgtcatcgaatatgaaggatttcaaatattctcttgaataatccacaaacatttaagccacataattaagtgtcagggactaaaataattttgtaaatcatactaaggacataatacaacaacagcaaaactatcttgaaaaagctgtacccagaagcttgagtcctcccttgatgtttttctatctgtgtctgcaacaaaatgatacaaagaaggagctttgaagttcacaaacctgttgtatttcatttctaccaatgactagctatatgttcccgagctagttgcatggacccattccaaacttagtactcttcatctgaaaagtaaggaattaaatacctacttcacagagtgtgcatgaagattaaatgaaacaacacaaatacaaacaacactgtgcaaaggcaacacaacaaacgcctttacacagttgctggcacatagagagttaaaaaaatggcaactgttacaagtattatttcttatttctcaaaatagaactgcctgaagagggttatttttggtttagtaaaaactgagcagtaagaagccctttccaagggacctggacccacggcccagtgggtttctgaatttatcctttttctcaatttccctattatccagccctccccaggatcatgtcactttctacagcatgctgtttataactcttctaaagcatgtatcgccctctgtcatatagtagacactgacactgttctgagcatccatcttccttcatttgatttaaagatcctacactgtcacaaagccaagcacagtgccgtggttagagcagcagcataataaatgcaatcattaaatagtaaccaggaaaaagaacgaaaaaaattcgttaaaccaaaatattcatccacttaccaagtatttattgttgctcttaaaccctgagactgcagttataaaaaagggagaataatcgcttttcttgtagactttctatagtagctacaaaaaaatggtattacaaatgaaccaatcacatccattaaaatgagtaagatttttgaaaatgcccatgtaaaagacaggcaagttggaagacaactggaatatacacactgttggtgcaaatggaaaatagtatagtcactgctgaaatctactaggcattctttttttaaagtaaacataaaagtaacatatgactcagttattctactcttaggtagtcatgtgagataaatgaaaatatatccacacagaatgttgcaggcaagtgctcctaacaattttattcatagcaaatgtaaactggagggcacccacatatctatgaaatatttcatctgactggatagacaagatgtagtatgactattcagtggatgaccactcaagaataagcagtgtcctgttacctataaatgcaacaacattaacaattctcaaaatcagcctgagtgaaagaagccaaacatggaatatgtggcatgattccatgtatatgaaatgcagaggtcgcttggggctgggagcacagagtgggaacaagccacataaacacataagggttattttgggggttatgggctgaactgcatcccctcaaaatttatgtttaagtactaacccccagttcctcagaatgtgaatgcatttggagataggtcttgacagaggaaattaagttaaaatgaggtcattagggtgagtcccaatccaatatgactgatgtccttaaaagcagacgaaaggccatgtgaaaatatggggagaaggtggccatctgcaagccaaggacaggggccttggaaaacaccaagcctgctgacacacgttgatctcgacttctagctgccagaaatgtgagaaaatacatttctattgtttacgctttccagtctggggtattttgtcatggcagtcctagcagacaaatatagagggtatggaaatgttctttatcatgactgtgctggtggctttacgttgttatgtacttgtcagaactcctcaaattgtacccttcaaatagagaaagtctatttacacaaattattctcaataaagtgggtaaggaaaacaatgaactgagcaattgacaaggaaactcaataagagacagaggctctctgtagcaaatgttgcttgaaaaactgaatataaatatctcactcaatacagaaagcaaatgggaacttctttataaccttggaacaggtagaacttccttcttgtaaggacacagaaggctctaatcccacataaaggaatgtataaattgaatttcaatgaacattagagctcatcaaaaacactaaaatatgactatgcaagccacagacttgggaaaatattagtaatacatataattgtaaaataagtaatctcagagcttataaagagctaatataaaggacacattaataatacagacataaacacaccagttaaatataagcaaaaaccttgaacaggctattcacaaaacaagacgtataagtggccaataattatataaaacgatggtcaacatcattaataacagggaaaatacaagttaaaatcacaagatacaatttcacttgatttcacattttagccactatgataatactaaatgtcggtgaggataaagattaacaaacgctctcatatatcattggtggaaatataaaacaaccactttgaaaacggttttggaatttctttctttttttttttgatacagagtttcactcggtcgctcaggctggagtgcagtggtgcgatctccgctcactgcaaactctgcctcccaggttcaagtgatactcctgcttcagccttccaagtagctaggattacaggcatttgccaccacacccggctaatttttgaatttttagtagagacagagtctcaccatgttggccaggctggtctgcaactcctgacctcaaaagatccgcctgccttggcctcccgtagttccgggattacaggcaagagccgcagcgcgcagccctggaatttcttattacgttaaacatatagttaaactatgactcagcactttcactccaaggtgttggtccaagaaaaatgaaaatacacacacacacacagagcaacatagactcgtacaagcatctaacatcacagccttactcatgttaacccaaacctggaaacaagcaaatgtcctttgacagtgactagaataaaccatggggtctcacatagtggcagactcagaaatgaaaagagagctactgagtcacacaaccacatggatgagtctcgaaacaaaacaccatatttaccaaaaggagctggccatagaaaagtatgtattatatgattccatttatatgaaatccagcaaaaagaaagattaatctatggtgataaaaatcagaagaggttatctttggaatggggaggtactgactagaaaaagagataagggaactttctggaaatgttctacattttggttggggtagtagttacatgagtgtatgtaactgtcgaagcttttagaattgacacagtgcattttgtagagtgtaaattgttctataatttaaaataatagactgaatctcctatcccatccttcagtgatttcctcttagcttttggaaacaatagtctgtgatttctgttataagataatccaagtcactgccaatcaacacaaaagactaaccagtcctagggctttgaactggttactaaccttcatcatcaggctacaaaactcttaaagtcaaggactgtgtcctacatatatctatgtgctttgctgtgaatagataaatgttttacctaaacatagtgaatacacaagaataattaagtcagactttaattttctcatctgtaaaataatgaaaactgaaaaatctgtattttcaaagttacattttcttttaagcagggtactttcattacatgaaattgtctatagtaaccaaatacataaaacaaataaagctgacccaatgtggttgaagaagaaggacgagtccccagaattctcattaatggcctcttttctctttgtcccatgtgatgcccttaagggccctccccacagaaaacaatttgaaatcctaaaagtctcttacaataatacaccatgggtatgctcagagaaaagtccacagtggtaaagaatctggcagaatatggttgaatcaaattgtattagggttcttcagaggggcagaactaataggatctatgtgtatatgaaagggagtttattagggagaattggctcacatgatcacaagatgaagtccaaggataggccgtgtgcaggctgaggaagaaagaagccagtagtggcacagtccgagtccaaaagcctcaaaagtagggaagccaacagtgcaggcttcagtctgtggctgaagacctgagagcccctggcaaaccactggtgtaaatctaagagtccaaaggctgaagaacctggagtctgatgtccaagggcaggaggaatgaaaacatccagcatgaaagaaagatggaagccagaagactcagcaagccagtttatcccaatttctttggtttgctttgttctagccatgggggcagcagactggatggtgcctacccacattgaggatgggtcttcttcacccagtccactgactcgaatttcaatatcctctggcaacaccctcacagacatgccttgaaacaattcttttctttttcttttttttttttggtcaatttttaaaaaaattatatgttaagttctagggtacacgtgcacaacgtgcaggtttgttacatatgcatacaggtgacatgttggtttgcttcccccatcaactcgtcatttacatcaggtatttctcctaatgccatccctcccccagccctccaccccatggcaggccccagtatgtgatgttccctgccctgtgtccaagtcatctcattgttcaattcccacctatgagtgagaacacgcggtgtttgattttctgtccttgtgatattttgctgagaatgatggtttccagcttcgtccatgtctctgcaaaggacatgaacacatccttttttatgactgcatagaattccatggtgtatatgtgccacattttcttattccagtctatcattgatggacatttgggttggttccaagtctttgctattgtgaatagtgctgtaataaacatacgtgtgcatgtgtcttgatagtagcatgatttataatcctttgggtatatacccagtaatgggattgctgggtcaaatggtgtttctagttctagatccttgaggaatcgccacactgtcttccacaatggttgaactaatttacactcccactaacactgtaaaagtgttcctatttctccacatcctctccagcatctgttgtgcctggaaacaattctttaccagctatctaggcatccttcaatcgaatcaagtcaacacctaatactaaccatcacacaaatccttaaaaggccatcctttattttctctctctctcttttaaggaaacacatattagctgtggctaacatatatgttcattagaacacatatattatgctctttgctatggtctagatatgtcccctaaaattcatgtgttggaaactgagttcctaatgcaacagtgttaggaggggggcctaatggaaagcgtttaagtcacaagggctccacctgcatgaatggatcaatacccctaagaaaggagcttgcaggagtgggttctctttctactgctcttcgaccatgtgaggacacactgttcctccctactggagcacatagaattcaaggtgctatcttagaagcaaagagaccaggccttgacctgctggggccttgatccagaattgtgagaaatagatttctgttctttttaagttactcagacccaggaattctaatatagcagcacaaaaagaactaagacattcttaaaatacttaattgaatcactgatacagatcacatgacattatccaggtgaaacagacatttgtctttatgttgtggcagaagctttcagttgtctcctctcttcttttatggtaacagaatttctgatttatagctgagcatatgactccctggaaaaatgactctacctcccagcttcccttgcctgactggccatgtaagtgatgaccaacgggatataacagaggtgtcctgtggaaacttctacttgtccttttcttcatccatttttttttctctcctgtttgtaatatacatagtgcatcttgaaccacaagttcaaggttatacaacgtagagcaacaatatagaaagagtctgggttcctgtcatcatgaagtgccacagcagccttgaaccacctatctaaacttttacatgagagaaaaactgaactctcacattacataagtcactgttactttgaatttttaagatattcactgtcaaatccaatggtcattattattacaattaaattaactttgttttgatagaaaaatcaatggagcacacaaaacagtagcaatattctatgatctaagaaaccaacaagaattttcttttacatacatgaggatgttgacataggaagataaataagtcttttggaagacaaaagtaaaatattacttataatacatcagggaataagaccttatttatgagttcatgagtttttacaattacagaagttgaccataaaacccaaacttttaaaaaagcattgatcattttgatgaaaatctttaccaaatgtgttctatagtccatccttatttcagcagattacacgcgacatgcacatgatgacttagctttctaaaaagagcaatggtgtaacgaatatatgccacttgccagaagccatagttaataccatatgtacacctcatccctagtgacctataaacaaaacaaggtgggcagtgccacagccttttttacagatggagagactgaggcttggagatgctgagatatgtccaaggctacaagtttacaaagtaacaaagtccatttatcataaaagtatttgttgttttgttcacttttcagacacagttttaaaaaatacatgtcaaataaataagcattttttatttactgttttaccatgaactacagtgaaatccttgctaactgtatctctttccttcagaggccgatgtcggacagatgtcaccgtcatgtcaggatggtggacattttcctatctggtgggtaggaaatcagtaactacatttactaattatgaaaacaccaccaagttaagattttgttacaagaaatgtgtacggacatacatttttagaatatatgtcaatatctttatactcctttggcctctttgctgataacctgcttttcatttagttatttcctgagttttgtaggtgtttttcttttaaagtctttattatcgacaggtttttccaggtacattacttcatttatctcagaaatcatatgagacattatacttggcatttcttttctattgctgtgtaacaaataaccacaattttgttgcttaaaacaacatgcttttatgatctcacagtttctgtggggcaggcctggtgtgacttctgctcagagtcccatgaggcccagtcaagatgtcggctgggctgctctcttccctggagactccattacagcaaaactagcttctaagctctctcaggctgttggcagaattaacttccttgcagctgtcattacaagggcctcggctttctgctgcctgttggctggaggcctcctgccgttccttgccatgtgagcttcctcaccttggcagttcacttcatcaagtcaacaaggagagggtctgctccagtctccactgaatccatcataagtaatatcgtcaggggaagtcttagataacataattggcacggtcagggaaatcaaatcacttttgctgtattttcttggttagagaaagcaatttcacatgagcatgtacaggaggtggtgggaggtcactgggccgggggggtgggggtcatcttcatgtctgtccatgccccgtttaacaaattaggagaaggagctttcataaaattaaagtttcagaaatggtaactcaatatataacattagttgtcaagtactcaggctatttttcaaaaatataaacacatgtttcagtttaggtacgtgaatatttgaacacttccttggagtcctccttttaaaatttcaaataagtcattttatagcttgggagatgatatggtttggctgtgtccccacccaaatctcaacttgaattgtatctcccagaattcccacgtgttgtgggaggcacctagaaggaggtaatagaatcatgggggctggtctctctcgtgctattctcatgatagtgaataagtctcatgaaatctgatgggtgtatcaggggtttccacttttgcttcttcctcattttctcttgccaccaccatgtaagaagtgcctttcacctcacgccatgattctgaggcctccccagtcatgtggaactgtaagtccaattaaacctctttttgttcccagactcaggtatgtctttatcagcagtgtgaaaattgactaatacaggagatattaagaaataaataccagatgtaaccagaaactgagtttctgtttattctggcatgttaaactttacaagattagaatatgttacacaaacagaaacatgtcttgctttaatgagtgtatatattcctttctaacttgaatttattccctatgatttcttagagcaagaacgtattatagaagcagttaactaaaaggctcactacggttaattctgcagaaagaaatagaagtttacagaagttaattctgcagaaagaaatagaaaggattaattgttcctaagtaagccaagttatctctacaaattgtttaaaacaaatattagaaggaaaacaataattaagagaagatcttaagaagacacctaatctagttcttattaatatttttcatttctgattttgatattatatgaataatgaaaaatccctcatttgaaaaaactttatatggtatacaggacgcaagagaggcaaaaatgatttttgtaaattccagccagtctccaagagactatgatcataataaaagcaatggcaatggcatcaccttgcattagtataaaacaggtttgtctacaaatcgctttcacatgtcccaagccaaccttgatttccagtgaaaatctgttaatgctgtgttctatagagctctgagccacacatggattacttggtcatgtgttgataatttgttcatgtgtaactgcagaactgtttcccaacaaaaccctggccccaagcccaagtattcactgggttctcacatgtaactacttgggtatatcttgatgattacatcatgcattttcataagagtatccattttatctaacgatttgttaatcatcaaaacaaggatcttccctcattttgtaatagaacaactgaagtccatgcttttcttggaaaatatagtcatattttagtaaaagtgtgatcacaaggctgggcagagttagctgggtaagtttgactctgctctatgtggggtcagctcggatggttcagtgggactgaatggtttcttttcaacgtggctcttttgcatggccgagtggatgctgaatataagctgaggtcagtgggctggtgttcttagttcttcttaacaagggggtgccctagagcagtggcccccaatctttttagttgtctgtcattgtcaacatgcacaggtttgacggaagacagtttttccagggacccagtgggatggtttcaggataaaactgttccacctcacatcatcaagcattagattctcataaggagcgtgcaacctagatcccccacatgcacagttcacaatagagttcttgctcctaggagaatctcatgctgccactgatttgacaggaggtggagctcgggctgtaatgctcgctcgcctactgcttatctcctgctgagtggcctggttcctaacaggccacccctgctggcccagggcttgggcaccgctgccctagggcacagtaggtgctttctaaaggtgactaccctaagagagaggaagtagaaacttccagtttcttaaggcctgagcctggaaatgggcagagtgtcatttctaacatgttctattagtgaagcagtcacagagctcagatgtgctaaaagaggttggtatttaaagaaaataattctaacagcacatcgtgtcacgttttcatctggcatttcactggacggtattcgacatttgcagtttaatattttgtgcccttgagcactgccacccttaggaaggtgtttggtgctgtccatgccctcatctgtgaaatgggggcagagacagcaccaaacaccttcctagtagatcagctcttcttagcctcatctcttgtcactctattcccagcattttccccactttctgacaatgtggcccattttgattttcctttattgttattcaaagtaccttagtaatatatgctttattaaaggcctttagataatttaaatatcatgaaacagtaatgtatctcatggaatatagtttacagacacctaaacaatacaacagcactaattcttctggttctccaaaagttccaataggatccctcttaaatttccatcaggtcatgggcatgggcagacagtatctgtgaacttatcagtggattccaattattttactgaatttaattttttttttttttttgagatggagtctcgagctgtagcccaggctggagtgcagtactgcgatcctggcaaactgcaacctctgcctgccgggttcaagtgattcttgtgccacagcctccgagtagctgggattacaggcacatggcaccacacccactaatttttgtattttttcagtagagatggggttttaccatgttggccagcctggtctcgaactcctgacttcaagtgatccacctatgtcggcctcccaaagtactaggattacaggcttgagccaccgcacccaacctattttacttaattactctagtttctcaaagacactcttcatttctcctagtgtttggaatcactaccaaacactatcataaagttctgaaaaagcattcattgttgctaattttaagtcattgattttttaattcctttaacaaataatgagcatctaaaaagtgacacacattttgccagattgtggggatggaatactgaaagagacttttgcacgtcaggaggataaaagtgattacacaggctgggcgcggtggctcacgcctgtaatcccagttgcttgggaggctgaggtaggggaatcacctgaaccagggaggcagaggttgcagtgacccaagatcacgccactgcactccagcccgggtgacagagcgagactccgtccaaaaaaaaatattaaacaggcaattaatactgagactctttgagggtatattggagggatgagagacctcgacttctgagagagctgggttttaagctgagagcagaggaatgagtagcagcagtaggttttgcgggaagaagtagtattctgagcatggagaacagaagaaaattccacaagccctgagcctgattcttggaatatcgatcccaaacaagatgatttctcagatactgacaattaatccataaataatccatttttattcgtgcaatttcctaaatatctccatccataccactagtcttgataacacaattcaattgtaatatacatgtaactgtaatgtacacaagttcctgatttcaaagcaatgaggatgtcaagatgataaacagtggttttgtgctttggtatcagaatgactgggtttcgaatctaatggccactaccagccaagtcaggatgggggtgtttctgaacatcaattttatgatatgtaatgtggaaataacaattgcacgtaacaaacaggactgatagttaaatgagataaagtagttagcaaaataccacacgcatagtgaatattcgataaacgttagtgggtactgctgaataaccacagtagaacaatatcatcatggaaagaactcagtagagaaagactcagaagatctaagttcaggatgcaatttcacttgagtatcacctcatcgatttaacatcctcatgcttcactatcttatctgtaaagtgtgggtacaggccaaaagagctcagggtcaaataagataacaaatgagctaattaatgtgaaaaccattgaagctacagcaaacaggtcacacagatagtagtaaatgaatgaatggagcaaggggtagtcttgaaaccgtctgataggagagagaattgtactcacgcttactcactttataacaaccccaaacctgggaccactttcaagtaaaagtgaacttaaaacacaatgctgcagctgctgttggcctcagcgttaaccagagcaagtgtctattcctgtatttattactcagtactgccaagttaactcaatggctgcctaaacagaacatctcagctggtcttgaaaattttcccaagtactacctctatagctttgggtttttttgttgttgttttttgtgtgtctgttttctgagacagggtctcgctctgtcacccaggcttgagtgcagtggcacgatatggctcactgcagccaaaacctcctgggctcaagcgatcctcccacctcagccccctaagtagctgggactccagacgtgcatcaccacacccggttaatttttatactttttgtagagacaaggtttcgccatgttggccagactggtgtggaactcccgggctcaagcaacctgcctgccttggcctcccaaagtgctgggattacaggcttgatgccctgccctcagccctctacagcttttaaaacataatttggcagataattcacttccaatacaaaaacgtgtttggtatcataaaaagcaagcatttcataatctaatactcaataccataatttacccactctgagaaaattatcacaagaaaaaagtcacatggagaaatgcaaatcaaaatcacaatgagataccatctcacaccagttagaatggcaatcattaaaaagtcaggaaacaacaggtgctggagaggatgtggagaaataggaacacttttacactgttggtgggattgtaaactagttcaaccattgtggaagtcagtgtggcgattcctcaaggatctagaactggaaataccatttgacccagccatcccattactgggtatatacccaaaggactataaatcatgctgctataaagacacatgcacacgtatgtttattgccgcattattcacaatagcaaagacttggaaccaacccaaatgtccaacaatgatagactggatgaagaaaatgtggcacatatacaccatggaatactatgcagccataaaaatgatgagttcatgtcctttgtagggacatggatgaaattggaaatcatcattctcagtaaactatcgcaagaacaaaaaaccaaacaccacatattctcactcataggtgggaattgaacaatgagatcacatggacacaggaaggggaatatcacactctggggactgttgtgtggtggggggagggggagggatagcattgggagatatacctaatgctagatgacgagttagtgggtgcagcacaccagcatggcacatgtatacgtatgtaactaacctgcacaatgtgcacatgtaccctaaaacttaaagtatatatataaaaaaaagtcacatttcttaagaataattctcattagtgtaagtgaagtgactcgtcctccacgaaaatgcagctccgctgggttttgacacagtcaatcaccatcattacttaccgagtccctccatgcagggtgtacctatgttaaaccaatgaaatgccaacaacgcgtttcccccttcacaacttccagtcaccaaactattcctgaaccacaagatgccttcagttatattactatgtgttgacagctttgctgtaggtacatcacagggatagcagaattgaaacagcagtgattttttttgttgttccgtttcatagaatttaaacaatggagacaataaagccttacagatctggtgattcacatgaacgcactcttaacggatttaatttaggagaaccatatgattatcttcgtctgttcaagcttcctttactaaaaatagtctggctgttgcatggaggaaagtttgctgtagctcagattagaggcagtttcaggcagcaaaatatgtttctagctgttgagatggtagcactcatttcaattcatggcatgtaaatctatttgaataatatttatcatcatataaagattcatagttacctcagctggctttatgatcttgataattatgactggaactcaactatgcttattaaataagaagtttattagatttctagtgaatgctcagataccatcatcatcatagaaatattattatttagttctcaaaattaagctttatgaataacacatcacattttggtgtgtagtatagtactctaactccccacataaaacttaacttgatcgcctgcatttatttttaagaaagggaaaggtacaaatcacatcggattatggttaaaattataaaaagtccacattgtatttaattttctattgcttctatataatgtactgcccgtgaatatgtatcatcaatctgggctgactatcttgaccactggtcaacaactatcttgaccactccaacaacgttttggagtggtggaggtgagaaaggcatgtatcactgaagtaagaagctggctagataaggacttagcaaggactataaggaaaagtgcttttcaagggtcctaaagggcaacagaacttaggccccccagtgaaacattaaacacgtatgtaacgagcaggcttccaatcatctgagagctaatgatgctaccatgtatttataaggtacatttatccccatcttttcactgaaccgtacacattgtgggcaggggttcctattcttgccccttactgtcctggggtttgtagacatgaaaaaagaaaggcttgcttttttttttttttttttttttaagacagagtctcactctgtcacccaggctggagaacagtggcatgacctcggcttactgcaaccttcatctcctggcttcaagtgattctcctgcctcaacctccctagtagctgggattataggcatgtgcccccacacccagctaatttttgtatttttagtagagatggggtttcaccatgttggccagactggtctcgaactcctgacctcaagtgatcccccagcattggcctcccaaagtgctgggattacaggttgcaagccacctggcccagccaaggaaggccttcttaatccaaaaaaaaccaaataagatttggccaaaagaagagtcactttgtccttggacaagtatgttggcaaagacatacatattttttaatttgttttaacatggtctggtttaatacacattgtatagatgttctagtctataaatttccctctgagccttttcacttcaagatattccgatgcctctttcttgtttcctctcttctatctttcccccgattgtgttataatcaaagtccaatcacctctaaaaatcattcaggcctgtttctttatgatctaatcagagagaagaggaagtcttaattttaggtgaaaactaactaaatttgtagtcatctgggcattcttagcactgatttaaaccagctacagtttattctgaaacgttttaagtttctcacaggtttccgcaagaatttccccaaattattattttatcatttatcctccttttagatcgatgtttttgacttaataaaccaacttttcttaaaatttgctcttgcaatgtacatggatttcatcaaatgaagtggaaaagattgttgctgaagaacaaataagctcttgattataaatcattgactttcttaactttttgacataataatattttcaggggaacaattttcttcccccacatgcctgtcattgctcagagaactgcaactcccatcttcttcactcactcatccacaacgccgtccacacactctctgcatgatgagtgtgtcacttcagtcagagggaagagagtgggcaggctgttgggactgcaaacccgtgctcagattccccagactaccttcaccaggaacgtggcagacatggaggctggtgacccaacatccatttccctcttggttcaaaagatggaaggatacagttcattgaaaattgttcaaatgcacaaataattaccactgtattactgttacctacagcattcaatatagtaacatgttgtccatgtttacagcctcagagcaataggctgacctattctcttgctctgaaagcctaggtgtctggtaggctacagcatctagctgtgtctaaacacatgctatgatgttcgcacaatgacaaaatcacctaacaacacattgttagaacctatcccaccacagttcagcaatgcatgactgcacttctactgccccatgcacgtttgccactttatggctgtttattttgttgatggagaaaaattagtgcaagtaaaatagagggacctggaggaggtctcttataaattgcttgtgattattagctgagtattctttcaaaatagcccatcccaccactcccactactaattttatctattccatgaatgattaatttttaacaaaaatgaaaaatccaggatggtttaggtaaggaaaaaattaagagttttctttaaaatgtttattttttattcatggctgggcgctgtggctcaggtctgtaatcccagaactttgagaggccgaggcgggtggatcacctgagatcagaagttcaagaccagcctggccaatgtggtgaaaccctgtctctactaaaaatacaaaaattagtcagtcatggtgacatttgcctgtaatcccagctaactcagtagggtgaggcaggataatcacttgaactcaggaggcggaggttgcagtgagccaagatcacaccactgcacagcagcctgggcaacagagagagactctctctctaaaaaaaaaaaaaaaaaaaaaattattttttattcacaatactagcatacacctacatttcaactgattatagcatatgggataagttgaaatttgatattccataaacctttgggtcttttatgttaacagctcaaactggcttcattaaaaaaatgtatggtatcagccaacagatcatgggttctcagcatctgaagaaattcaacgttctctcatttttcacggttttaacttctcatgactttagtgcatggatacacttgttcagttgtatcccatggcttctaacatctgactatgcttcttgagatcagtctgaaagctgaggcatgttcatacttgatcttgaaacatgccatattaatacatttattcatagaagtattagtaattgtgatattattcaggaatcaaaaaacaaagggaaacacagagcttgcttgttatcccaaattatgctctggtttaaggaaatctttccccgaaatcatgttacttaattttagctaatttagatgacatttaccattctcttacctaaggccaagaaaacagttatattttaattagaacttagtgtcaaacatttttaagtttgataaaaaagccacttttctgggcaattttgcagggcctcattttgattccctgttacctcaaaatgactaagcaaaggagagctgtattgggtatttatcaagaaaactataaataatgtattgggaataaatgcgtgtgccacaaaccataaacttgtaaaggctttctgttctcctggtgtgaataagatagggacatcacaactcggagccattaaatgaaaagaatagggttactaagcaagattattaatacttaataattaatacttaataattaataaatactttaaaaaagattaggtaagatttaatttaatagatcagaccctcctttacagtctgtcttcacacaaaatcacaaagtcttacgtgactcaaatttcttttgaagtcatcagaggttgccattctggaactcataagcggtgacagctgatagcctcacagtcatgaaggaggtagaaaagttaacatgaaattcccaaagctcagcactcgagccttttcagaagctggatggaaatcgctgttcacagctccacagcccctgacagcatcattctatgagaacaaggtcaagtggaaggtgtagcggaacacgaatttgtagtctgagatctcaaggaaatgaagcaatctatttggaaaagcaaggacgatagttgggaaccattagcaacactacagacagaataggcagatactccgttgcccaactcaaaagggaattcatattctccaaatcctgacctctagctagctgttgttcttgtaatttgtaaatcggtgtcctcttttctatacccaaagccagcatcttattttgatacatcatactcccttttggatgactgcagtaacttgtcaactaattttgtgctgtccttctcagttctctcaaatgtattcacatacctgccggaggaatatttccaaagaaaaacaaaaccctgcccatcccctgtttaaacccctctcatggttcccccttatttcaggacagtttatgctccctggtccctaacacagctcagggagtcttttctcatctgcccacttccctccttccccacctctctccacccaccttattgtcaccctctacatagaaatccacaggcacacctataaggaaacatagagttatgcgtgattttgaatcttcctggaaactttctctgcttagaaaatttttttactttctagggtctttcaatcagaaggtctcaggaatgtttaatgagagtaatgcatttacagttagtataatgctgcatttaggttatgtttattggaaaaatgaattctcaactttctcaaatattcctcacctgctctgtgctattgcctactacaagcacatatatcttaaggtccaggttgacacattttgctttcctgctggacattttctggtgactgcatttccctaggattcttccccagcaactgagactgatggaaacaagtttctcagtttcaaatgaagattcagaataatgactatcatcctgtgtgtttattagaacccggtgaatcgagatgatttctaaagagagagtgcaatagaaaaatacagaatttagaagaaaagtacctaagttcaagattcattatttatatatgaaattgtacccttgggcaagtaatttcaattctacaatgctcaggtttgtctaggtgtaaaataagaaatagtatcagctctcgatatcctgtaagattttggtgaggataaaacaaacaaaacacatgaaaagttcttttccgccctaaaacactgtaatgttagttacaggcataagttggagatactgtgggttcagttacagatcactgcaataaagcagatatcacaataaagcaagtcacacaaagctgaggtttctcagtgcacacaaaaagtatgcttgcactatactgtagtttgttaagtatgcaatagtcttatgtctaaaacgagaatggacatgtcttaattaaaaaatacttcattgctaaaaaatgttaactctcatctgaaccttcaagtcataaccttttttgctagtggcaggtcttgcgtcgatgctgatggctgcagactgttcagggtgatggctgctgaaagctggggtggatgtggcaatgtcttaaaataagacaacaatgaagtttgccgcactgatggactcttcatttcataaaagatttctctgtagcatgtcattctgtctgacagcagcagaaccttcaaaactggagtcagtcctctcaaaccctgtggctgcttgatcatctaagtttatttcatgtctgaaatcctgtgttatcatttcaacaatgttcacagcactttcatcaggagtaggtttcatcttaagaaaccactttgttcttccataagaagcaactcctcatccgttcatattttattatgagattgcagaaattgagtcatgtcttcagcctccacttctaattctactgttcttgctattttcacctcatcttcagttacctgctccactgaagtcttgaatcccttaaagtcatccatgagggttagaatcgacttcttccaactcctattaatcttcatattttgacctccactcatgaatcatgaagttcttaatggcatctagaatggtgaatcgtttccagaaagttttcagtttactttccccagatccatcagagaaatgtaatgatctttagtgatctatgagagctatagcatcatgaaatttttttaaaatagtaagtcttgaaagtcaaaattactcattgatccatggactgcagaatttaggtgttgttttagcaggcatgaagactacattcacttccctatacatttccaccagagttcctgggtgaccaggtgcactggcattgagaagtaatattgtgaaaggaatgttttttcccgagcagtgggtctcaacagtgaccttaaaatatccagtaaaccgtgctgtaaacaggtgtgctgtcatctaggctttgttgttccatttatagagcacaggcacagtaaacttagcataatcttaagggacctaggattttcaaaatggtaaatgagtattgtcttcaacttaaagtcacccactgcattacccctaacaagagagtcagcctgttctttgaagcattaaagccaggtattgacttctctctagctaagaaagtcctagatagcatcttgttccaatagacggctgtgtcatctacactgaaaatctgtagtttactgtggccaccttcatcattgaccgtagctaggtcttctacataacttgaggcagcttctccatcagcactcaccctgaacttgaactgtgatggagatggcttctttccttaaacctcatgaatctacctctgccagctgaacaacttttcttgtgcagcttcctcacctctctcagccttcatagaattgaagagggtacaggtctttgatctggtttggctgtgtccccacccaaatctcatcttgaattgtaactcctacaatttccaagtgttgtgggaggaacctggttgggggttgttgaatcatgggggtaggtctttcccatgatattctcttgaaagtgaatgagcctcaaagattggatggttttataaggggaactttccctgcacaagctctcttctcgtcgggcaccatgtgagatgtgccttcaccttctgccatgattatgaggcctccccagccacgtggaactgtaagtgcattcaacctctttcttttttaaattgcctagtctcaggtatatctttatcagcaacgtgagaacagactaatacagccttcctctggattaggtttttggcttaaggaaatgtagctggtttcaacatctgtctggactactaaaatttccttcatatcagcaataaagctgtttttctttctaatcatttttgtctacactggagtagcacttttaatttccttcaaggaattttcctttgcattctccacttagctaaatgttttccacaagaggcctagcatttggtctatattggctttcaacatgccttcctcactgagctcaatcatctctagctttgatttaagtgagagacgtgccattcctcctttcacttgaacacttagagcccatcataggactaattggcccaattttcatgttatgttgtctgaggaaatagggaggcccaaggagagggagagagatgtggggatggttggtcactggagcagtcagaacacacacaatatttaccaatttcatttaccatctcatatgggtgtggttcatggtattctaaaactattataattgtaacactaaagatcactgatcataccctaaaattattagaataaatttcattcttttaaaaaaattattctgttttgtattgctcaggctggatgcagtggcgcgatgtcagctcactgcaacctctgcctcccaggttcaagggattctcctgcctcagcctcccaagtagcttggattacaggtgcctgccaacacgcccacccagttttgggacttttaatagagacggggtttttccatattggccaggctggtctcgaactcctgacctcaggtgatccacccgccatatacttttgaaagacaaagtctgaactattaactgaaaacaaagatccccaatcactctaacagattaataataatgcaaaggtttaaaacattgtgagaatttccaaaatgtgatactgagacatgaagtgggcacatactgttggaaaaatggtgctgctgatagacttgccgctcaataccgggtttccacaaaccttcaatttgtaaaaaatacaataccagagaagggcaatgaagtgacatgcaataaagtgaggtgcgcctgtactgttttcattttcatcaagccaaaccataagaatcttgcacaacatctgtattattagagtagcatgaataatgctttttattgtaattttgtttttacttccaaaaagagaaataatttttttttctgattatgaactaaacaggtcctcctgtctagtaatagaacatcaaatcatcaccatagagattcaacttctctttttaggaattaaaaatagtcacaatccacttatcaattacacagttaataacttgatgccagaaggattttgacaaaacacagtacccttcattctcttttaccttagaaatgatttacatttcaggttaaagaaattctgacactcaactaaaaatacctgcagacagatatctgtaacccatatatgaattgacagcattttaaaaatagaaaagttggtatttcttcatttttcaaagatttaatgttaagaaggaatggttactagaattaatatttttccagggacactaataatttgattataattgaaaattaaaaaataattttagaaagaattgaaatacacatagcattctcataaaaatagaaattataattataatgttgatttagtttttgacagaggtaaaaactattaaatgcattagatacatattattgaaaatatttgaaggggtaggtcatagtttctctttccaaacataaaatataatattaggttggtgcaaaagatttttaccattaaaagcaatagcaaaacctgcgattacttttgcaccaaaccaatgtgtactgtaaagccaaatcctgtaatctctttaaatttgacttaacatttgcgacctacatccactcatgcattgaaaaggcagctccgtggagtcaacatctgtacatgaagcccgtgaagacgctgcctccatgggaccagaacaagttaaagaattcaggttgctggtttctttcaataaagttgtgggaagtaagtttcactatatgtagaacattctgaggaattgtagttttggtatcatttagtattatttggatattaagaacaggacttataggagtcttcaaaaataatcataatacatttatgaatgtaatgaaataattgtgttatactgttgctatagctatgcagattatctgagagatacctgagttatttatgtttctacaaacataagttacactactgctatattcaatgaaagtatacattagtaaattttcctatactctgtgttactaagagtgtactgtagttacaggaactgtggcatctctatagtgtgtatttaaaaaatactcaagcaaacttcagttataaggcaattatgatccaagcaaagttcaattataaaataggtaatgataatatagaaggcacaattaggacaaaatattcctgtctctgtactgtcagatagcctggaattacaatcagtaacctgaacttcatttagtgtgaaggcagagtctccaaaatccaattcaaacaaaaaaggttaaagtgacatgttattccattatcactcattgctatattgatacagactagttgatcagtgtcctaccacaaacacacacacaaagagagagactcactcctcatgcagtgagacagtggaaatagggaaacagatgtcttaagaggaaaaacccaaatgggacatacgagataggctttttaaaaaaccctacataggcctgcacaaagaaatggatgtaattctagacaaatcccaccatgttgtataaatggaggtgaaagataaggaattacccctacccctaaaaacaactgagttgaaattaaaagtatgattatattatggattgtctaacttcacaagtattatcaacttactaatttatattaatgaatagctttcaatctagatatgatttcaaataagcaatacatatttgactattcagttattgaaatgattttcatgcatctactgtgtgttaaactttgtattaaatgttagaaatcaaacacgagtgagattcaggactatattctattattctataatttaatggaggacataaagagcagatatttgacaaagaaatgcataacatactaagggagttcatttaatggcaagaccaattataattttgtttccaacttggtatgaactatgcttaccaactgtgagagaggggagttaagatactattcatgtattctcaaattagtcaattccaagaatttgttgagtgttactcttttcaaatcaggtgggtggttggctcaatcagcgctggcaggttacattcccatcttactgttctcaccaccacccactgcagtgaaaaacacttttatgacagaaatttacctgttttaaaagtacttttgttctcagaactgagagattttattgttaaataaaagtgacaggggaagcaacataaagtatcaaagatggttctgatcaagtcatgtaacagtgcctatgagaaagatttgccattctactctatccatcctattagtccccctaatatttccttcttaaggctttgaaatctccccatagaactccttatgttacttcgagaattttaatagtcatacggcaaataagcagagagcagctcacaattaatgtactaatgcccttttcttttaataaaaattatactctttcattatcctattaacaaatgattctttagggagcatttctttaatgttcacagtgctggcaccctagttggcactcaactatcttaaatttttaatgaattcagaattagtctgggcatctctcaaaacttagagtctctgagtgcatgagtggactctttatgttatcagatttattgttttgaaagcaaagaagactaggaatataagcaaaagaggaaacaagcaggtagtttgagagtgtagaaaactccatggcacacaagcacattgtaaggtaacacctttttcaccaatggagagaaaagagaggaagagatggaggagcaaaacgactcgctgttaccatactagcagtgtcagcactacaaaatacaacatttaaaaatgtgttaagatgtttttctgtatttatcaacagataaacccacagccagcccaaatcaggtactggagattaaaactaaatccctggacaaagattagcatctcaaggagaggctgtacaacattagagaaaaatgtggttgagcaggttgaaaaggacaccttcacagacacatctgggagaatgctagcagctcttcaaatacttctccttagtagcatttatctccatcttaactacatcactgatgcattaattataggacatttttctctctggttagaatgtaagttccttgagagaacagaccttttttgtctgaattccagtgactagtctactgccatgcaggctcacagttcgtatttgtggaatgaaattgctgaagaattaattatacatgaaggaaattcaagcgtaaattgagccattaatacaaatatgaaaatacaaggaaatatgaactttagaaagcaaataatatgccacagaggttcccaattgcatacttcactggactcacttcatttagggacctcattttctaaggtcccccagctgtccagtgctcaggtcatcactgacatgggctcagaaaatacagatacatccccaaggcagagccagtgtttgttttatttttgttttaatgtaagcaccacttacctttttcacctatgggtagactctctcattccatgatattagaaaatgtttcaaatgaaaatgcccctggttgtaatataatgactaaaattacattaagatatcaatataaagagtatcaaaaactttcctaaaaatcagttttaataaaagagttgagaacatgagaatgcccttaaggaaagggtagtagaaagaaaaatcaaatatacatttgaagttcatcaaaatagatttggagttggcacagattagaattttattatttttttaaaaattgggccagaaacgagcacctactttacgctaggcactgtgcttccctatgaaaggaagcatggtttctgcttcaagtgggtgagtggagggcctacaggtgcttagagaataatttctttttttttttttttttttttctgagacggagtctcgctccgtcaccaggctggagtgcagtggcgcgatctcggctcactgcaagctccgcttcccaggttcaagcaattctcctgcctcagcctcctgagtagctgggattacaggcacacgccaccacgcccagctaatttttctatttttagtagagacggggtttcaccatgttggtcaggctggtctcgatctcgtgacctcgtgatccacccgcctcagcctcccaaagtgctgggattacaggcatgagtcactgcgcccggccaataatttctaaacaatagtaatgcaaatagagtatgcacagcgtggacattccagcttcctaaacgcaggagcactaacgctcctctggcttgagagagagtcatcagaatgcaaagatagaaagagatagacaaattaggggatgcaagggatgcaatccagtacaggctccaatttctaaccctgtcccacatcaatgaggacctttagagagggcacaatattatccacagtctcataattcaacagggaattgggcaaagaaacaaaaatagtgactatggactaaattgattctgaacccatattatgattcagtaagataaatgtccctgaaagtttctgaagattcttagggcaccctgatgaccaaaggggtgagagctagggtcatcacgtgacctcattatccttattatctctcagcagttaccgagttaatggggagctagaaaaaattgtttttctcaatcactggaaaacagtaaatgaataacagatagctagttttaaaatttactggatattttgtcaattttctaagctacttgttatatctttctaatccttaagataattgcatttattagaaaaaattaaattggcttagtaaaattttagtcaaaattttgtgtatttgtttaggaaatgaacaaagagattacaatctggatcctgatagttcactggtaaaagataagattataccaacaaatagataacttacacgaaacgggtaaattccaagaaagacacaacctaccagaactcactgaagacgacatatcaaatctgaatagacccataacaagtaaagacattgcgttactaattttaaaactgccaagaagaaaagtccaggtccaggggataccttggtaagttcaaccaaatatttgattcgttttcaacagggtaacaagatgattcaatggggaaaaataatcccctcaataaacggcatatgcaaaagaatgaagctgagttcctacatcacattacatataaaaattaagtcaaaatggataagaggcctaatgcaagggatacaactataacagtctcagaagaaaatttaggagtaaacctttgtgaccttgggtttggaaaaggtacttagatctggcaccaaaaacatgagcgaacaaagacaacatatacacactgaactacaacttttgttcttcaaagaacatcatcactacagtaaaatgacaacccaccaaaaggaaggaaataaatgcaaatcacatatgtcataaaaaacctctgtccagaatatataaagaacatttacaacttaacaaggagaagacaaataacccaattaaaaaatgggcaaagaatctgaatagacatttttccaaggaagttatacaaatggcccaataaactcttgaaaagaagatcagcatcattagtcgttagggaaatataaatcaaaattatgagatgtcccttcacacctacaaatattgctaaaatttaaaacaaacaagaaaagaataacgggtgctgtcaagaacataggtaaattgtaaatctcattcattattggcagaaagggaaattggtacagccacttttaaagagtggcataccttaaaatagtgttaccatatctccagcaacttcccttctaggtatatatccaaaagaaaagaaaatgtatgtccatataaaaactcgtacatgatcagtaacagcagcatttttctaatagcaaggaagtagaaacaacccagatgcccatcaattgatgaatacataaacaaaatgcagtatattcatacaatggaatattatttggcaataaaaaggaatgaggtaccacaagtcgcaaatatggatgaacttttaaacgtcataagcgaaagcaggcagtcacagaagaccacgtattacatgtttccatttaaataaatctcccaattaggcaaattcatagagacaaagtcaatttgtggtagccaggtactcggggaagagggaagtgagcaggggcatggggtgtgactgctactgtgtacaggctttccttttgggaattatggcagtgttctaaaatttgatggtgttgatgattacacaactctatgaatacactactaaactgtacacgtaaagatggtcaatttaatgttaggaaaattaagtcaatcaactgttatttttttgaaaggcagataaggtggtatcttagattccataagccagcctaaaagtgctgaggaaccacgcagtatttgtgtgtgtgtgtgtgtctgtgtacaggtgtgtgtgtgtgtatcagatcattataaggaaggatgtatgtctagagaagtcgtgttaggcttcacatacttttaatacattgttaccctaatgttataaaaacttatagtggatttatattttagacacaagtaacatatagttggccagttgaagtttatttctggaaaacttctgtttacattttattttaaaatagttatccctcaatcagcatgccctacattttcctagtggcagaaagtagtgaccagaataaaaaagcaattaaattaggcaataacattactgaagaggtcactggttctgcttacatttcacttgttttgcctatatatattatccattgaactaaatacagagaagccacattttctcttaatattctcttatggtctagtgattttctttcttttttacatatggaaaattacaaaagctctagctacacaacgacatcaaatatacaagtgtctaattgcaatacaccgggatattttgactaaagagccgtgataactttgcaatgatgtaggacgatgtttcagacaaaatatgaagccaaaaaaggcagaatataatctgaactgacatttcctatctagaatgacagaaatgtaaatgtgtttttctctagtgctgaaggtttggaaaatgctagaccctaagatttaccatggaatttgatgattcatagtgaacatgaagagacagacgccacagtctgagttctatttggtaattcgtggccacaaaagtgcacccctcattgctttccagctatttacacttgccagtataatacaagattcttaattagcaaccatgtggcttcactttaaatagccttgctagctcccttgggacctcttgaaatatcattcatattagtagaaataccatcccattttgttacagatttatttatttctcttgctatcctttttttttttttctgttaaggcatattactgttacatgattataagcattttttaaagttatgggcagggccatgatctaactatactttgtagttacatgacatctaaaaatgtgctatctgattaaaggatgcattttagtaataaagatgatagctatttacatccgataactgcctacaaaaagacagaaatgagctgaaaaatggaagaagatggaataaatacagtttactaatagagcttatacttctcccatttggtttaaagaggcttttaaacacttaagctgagatttactatgaaaatcagacttacaaacatcaccatcaacacagaattattaaaatgtagaaagtgtggatatgtctaggattgcgatcccattatgcagggacctacgacctactagaaatgctttgcaattcttactgaactattttttcatgtaaatgaacatcacaaggacaggtgaactctctgcaggcaccgatcgtctggttttctaaaagtatacagggcagacagggtattcaccttgattggaaacagagaatccaggtatatttgaatcttctgcctccaccatattgtgtagcactatgttttgtttaattttatcagtagaaagaaaaaggccagacaaatgccgtgactcaatcctgtaatcccagcatgttgggaggctgaggtgggcggaccacttgggcccaggaattcaaaactagcttgggcaacaaagtgagagccgattctacaaaaattacaaatattagccgggcatggtggcacatgcctgtagttcaagctagttgggaggctgaggtgggaggatccattgagcccaggaggtcaaggctgtagtaagctgtgattgggccactgcactccagcctgggcaacagaaagagattctgtctcaaagaaaagaaaaaggtcatacaagtttaccactaataggccaggtgcagtggctcactcctgtaatccagcactttgggaggcagaggcgggcagatcacctgaggtcaggagtttgagaccagattgccaacatggcgaaaccccggctctactaaaaataccaaaaattagcctggcatgttggcgagcgcctatagtcccagctactcgggaggctgaggcaggagaatcactgaacctgggaggcggaagttgcagtgagctgatattgcgtcattgcgctccagcgtgggtgacagagtgagtctaatgaaaaaataaaaaataaaaaaatgaaaaaaaagtttaccactaacagttgaagcaataaattttgttttgacgaagtaacatttatagtcggtgattattataaaaaattttgttttaaatcattcacaattgagttcccatcctattgtaagtctactgctaatctattaattgcatgcattattatgttggtcttatgatactacctagtaaataaatatacatatgtgggtcatactccataagtctgaaatacacagtttaaggggctaataaggtatatgtaactaagaaatacactagtatcatcattatctgctgttttatgttttaataacttctatttctgatatttcaaagtgatataaacgagcaagttctatacaaagctacctcatagattctaaaatcactggcctttcaaacatgtttatgggttctttttaaaaaataaacattcggatgctgacgaagtagaaaattagtcttctggagacatattatgatggagccttaagatggatgaaaagtataaactgcatcatccagggctggatttcctgtgcacactgcagaaacgtccttgatgttactgatgtctgcctcacgcttagctctcagagccgaagctccatcaggacagattggaactgccacccagaggcatttcacaatttgaaccaaaaggttttcaggcttgcgttctagctaattctgtcgcttctaattccagccagacttaaactcttatctttggatgccaggcctacagatagggctatcacagtagccccaattcccagaaaatacgcaactccatgacccaggtgagattaaatccttccagatagcctaaataaatggtctataacttgttcctgtcactcccactaatgcctttgtactgtgaaacagactaggaaaggtgtaaatatcttcaaattattagctgcacttcctcttccttgcctctaccaggaactctagcatcacgctcctcatggggcaaaggaaacccagaggcggcagttcctgcactttcttctcctgtagttattaaccaatttgcagatctccgtgtattactggtaatagaggcacactcatatcttttctctttaacaccttgccagtaaaattctcccgcactaacctgtctgcccctctctctctaagaaagatacagacccaattatacaatttagcccattactttggttcaaacagatttcacctcaaaacagatgtacttgaatgtaaaaggaccttcttgtcagtgcgtggggtagctgtgctctcctgtaccccctaaacatttatgtgaagtagtcacatctgaagaacacacacatatataatgggaagtatctcttaagcagcaccgcaggcatttgctttaaaccccccgtaactcataacggcttgactgtgcatccatgcttctcagcagctaggggttccctgaaagcagggacaaagccgtggtcttccttgtttcctctgcacctcacctcgtgctgagcacatgcagactcagaatagatgttcactgaataaaagaaaggatggacacatgaatacattaaatgaacctcaaacgttatctactatgctctgtgcagaatcagtcagaagacaaggtgtctcgggaatgcaaaacgggacaaagaaaacccagctcaagcaagataagcactgggcagtggttccatttgtctgagcgaggcagcacgtcgagatgagacgaaaacacagacactgactgagtaggtagagcaaggggtggaaatcaagaaccaacaagcagcccagtgcccatctgtgagctggggctgcaggaagaaaagttggaaaggtggctgggtgtggtggttcatgcctataagtccaacacgttgggagcctgaggtgggaggactgcatgagcccaggagttcaagacaagcctgggcaacaaagcgagagcccatctctactaaaaaagtgagccgggtgtggtggcacgcatctgtggtctcagcgacatgggaggctgaggcaggaggattgcttgggcccaggaggttggggctgcaggcagctgtgtttgtgccactgcactccagcctgggtgacagaggaagaccctgtcttaggaaataaacaaataaagtaattaattaattaattaatttaatttaatttggaaaggcaaggctatgttgggagggccctgacatagtgagaggaagtatcattatttgaaggactttgaatgtttctcatgtgactggaaagactattcatattcttaccacagcaagatctgaatttgtgaattgtcaagctctctcggtaacattgtttcattttccattattagttttaagtcactttaaaacaaattgtggtaaaattcaactcctgtcccacgacttagtttgcccacatttaaaactattcctgaaataaactatgtaaatttaggagggaaattttaatctgttaaatgtatttagacatttcctattcagagaaacattatgaagccttctattttgtgtatagtctagatttttaactatgaatatgtgtgtgtattcatgcaaatagtattgatggagatgtatagatagatagatgataggtagatagatgccagatgggtacatggacagtcacacagatggagagatggtaggtggacagactgacactatgaagaaaaacaaagaaggctgaagatggctggggtgaagccatctttctactgggtcttcaggggaaggcttttcgacaaggtggctttagaattactacaagtgaattctatccatacaggaattttgacttttctggagttagagatgatcaaatatattttgaaagaaataaggtcctggtcacaaatatgccactacagagataggttagtcctcacgaggcctacacctccccgactctaaaaatgaacaagatgagcagattgtggaactctgggtttcattcttattgccctttgaggggaaggtgcttagaggtaaatgttggcttggagctgactagaatgaactggttagctttgaatttggtatgcagcacaccatatatgttgagaggttatttaaatgtttttatagtttacatggagagattaattattttatttttatgtaaaaattgctgagatttcagcagttacgatcgctgacctattaatttaagtaataatgtaatgaattttatatttttacatctgcagaataactcacaatcctgtgcaatgtttctgatacctgcctaaatatctgtatttactcattttgcatttcttttcaaaggctctcatgatttcaggaggtatactgatgcaaacttaatatccagaaagaattctggtgcaggaatggtttggtatcaagaacgtgggctccagaggtggacaggtgtgtgtctccaggctaccttgtatcctgcatagctttgagatcttggacaatttatttctctcagagggccacagtttcctcatctgtaaaataaggacagcgatactaagttcagagtgtcatcgagaggataaagttaaagaagatcctggacacacacccacagtgcctaacagcattccatctgcagaagaggtcttggttatttgatgggattgagtgcacagagtgaaaaatgtgtccatacagggaacgtacttactcctttggagcacttatttcatatgtggatcagacaagttagcaagatggtaggtatgctgccaactataacgacagagatatctacacatgtgtagattgtaagattggtgcttctggagcattaataacagatcagaacccgaggatttgttttaccacagattaggatgcaccccaaacaccttctagaatgtccaggctgcttctcactctgttccctaaactctaagaattagctataaattagctattaatcctccattcacatccaattttgtgtagttttaaaagtacaagcatataaaaatagataagccaacctgttccattagccctttaatcaatattttagagaagatgaaaatttgactcacattgtatgtttcacttacaaagcactcctatttcaaggactaaccgtactatagctggtgatatggtttggctgtgcctctacccaaatctcatcctgaattgtagctcccataattcccacatgttgtgggaggcacctggcagaagataactgaatcatgggggtggtttatcccacactgttcccctggtagtgaataagtctcacacgatctgatggttgtataaggggtttcccctttcgcttggttctcattctcttttgcctgccgccatgtaagatgtgcctttgcctttcaccttctgccatgattgggaggcctcccagccatgcagaactatgagtccatttaacctcttttttttttataaattgcccagtcttgggtatgtctttatcagagtgtgagaatggactcatacagctggaatttttttttttttttttttttttttttttttgagatggagtctcgttttgctctgtcacccaggctggagtgcactggcaggatcttggctcagtgcaacctctgcctcccgggttcaagccattctcctgcctcagcctccctcagcctcctgagtagctgggattacaggcacatgccaccaggcccagctaattatttgtgtttttagtagagacagagtttcaccatgttggtcaggctggtcttgaactcctgacctcgtgatctgcccgccttggcctcccacagtgctgggactacaggcgtgagccactgtacctggccaaaaattattatttaacatgaaaagagcacgtatagtatgattttttttaggaaaaaagttaaaactgtctgtcaaaatatagctaatgtgtaccatttagataaatgcaatttaagagaatattatgctggaacacatattatgtgtcttgtgttcaagcacatcacatacatcatccacatgagctgtcccaaagtctgtaagagcagagtcacacactcatttgacaaatggatgaccgaaggcttagaaagttgaggtaattttcccaaatacatacacagcaagtggtggagacaggattcaaatgtgagtcaatgcaacttggagaatttccgtaatggtggttaaggaaataaattttgcctgctgaatagttgtaatgttcattccttcacctctaggctaaccatttcacttctctgcctaaaatctccagtggttccaccttgcatggttgtttccacgtgtgattgactaggcatacttactagtaaaaaatgtgagcacacagcccccaaagcatcttgtttattcacaaattttatatgcattactctactaagagattaagtacaccataaaatacacactgcttagaatttaagaacagatccaaatgagagaattacaatgttgacacgtggttatttgtttttcactattgagtaggaaaccaacgaaaagcttccaatggtactctaatgctggtgaaattttttaattaccgatgacttcaccaaagtttgtcttcaagttttaggtgatttcttggtaagagcgttgaccatggtctcagcctcacactgttagcagtcagcatcacattgcacaacactccctgaggacaaggctcatggttaatagtggtggatatgaattcttatttcaaatagtgcttaactcttgtcagatctgataaaaccatctttttcttttctttttttgcttgttaatgtggctggtgaagtgccttagtatagtcttcaatactatttcattttgtaagagttgctttagtttaaacgaggatcatgtcaactgcaaaacactattatgtgctacaggagacaaatcaatgctggcacacaggaatgtccgcttttcccaaatgttacctgtgaccatcagaaatattcaggcaactgggagtgggcataccatgagcaaagtgaggggtttttcctatttgctttgattaaaaattaatataaatgaaagtcctagtattttattcctgcacactgatggtatgtttcgcatccgttgggatgcatcaactgattttggagcccaggaaaagtctaagctatttggacactaagctgctacttaggactcccagaaaccccatgcctatgctcgcagctacatctctcaatatcttcatcaacatttatttgtagtttactgtgcttacgtacaacctttcaggtcatggctgcactcaagctgagttccctacctagaaaatccttccttcctatattttactcttaatctaaaatttctacattattcctacttatcctgtaaaagtcagattcggagtgattggaagacatttcttccatgtacttgtgagaattaagggttaacttgtccagtactcattcctcagtacgttggcttgaaaaggacttagccttgcaggctcaggaaagagaatggtgtttccctatcaggaactctaaagcagcaagtgaagaggggtggatggatgtggaatgagatgtggacttgtcactctgccaccaggacgaatatacaaaatctggagtccgttacacttgacattttcacacacagaagccatgcatttttcaaggtactatagcttttaataaaagctctttgtgctttgaagagggtgttggataacagtacatatacatacttgttttaaaaaaagaagaaaattaattgaggccagcatacatttttccatgccatttccaactttaacaccgttgaaattcctttaaattcagcttgaggttcccatggaatcacctctggccacgggccgtcaggtacaatcttgggattaagagctctctgtgaagacctggtgaccttgaccattcagggcatttcagattattctaaggcatatttttaaaagtagggttttttcctacatgactagttttgttaaacttgtaatttctttttaacataaatttcatactgaaacaagttaaactgttttttactgaaagtcagcttttgacagaagcgtacccctccctggagaaacagttcttcagaacctatgaatatgtaacaccaatgacttctagcacttttaattttacaaattcccttctaacggctttaattgtaattcctggcataaaagaggcaacaggataatactttgttgaaatgtttaattgaagtataatacatgtatgtcttttatgaaacaacctcaaacttagcattgcaagcacagtacaaataactatttttaaatcaacaaaaatgatatctatttattgtatataatgttgttttgaaatatgtatgtgttgtggaacagctaaattgagacaatatgtgcattacctcatatacttattttttgtggtgacaacaccgaatatctagtcattagtgattttcaagaatgtaatacattgttattaactacagtcaccatattgtgcaatactgtgcaatacatcactttttcctcctgactcactgaaagtttgcttcctgtgaccaacacctccccgcccacacacagccccaacttccagcccctggcaaccagcattttaccctctacttctcagatttcagtgtttttagattccacgtatacgtgaaaccgtgcaatatttgtttttctgtgcctggctcattttatgtaacatcatgtccttcaggttcatccatgttgtcacagatgacagggtattgttcttttaaaaggtcctatggtatcttattgtgtttataaatataacacattttctttattcattcatcagtcaatggacacttaggtaggtccctacctgggctattgtgaatagtgcggcaaaggacatgggagtgcagacatcccttgacatgctggtttgtttcctttggatacgtacccagaagtgagaccactgggtcatatgacagttctatttttaacttttgagctgttttccataatggctgtaccaatttacattcccaccaacagtgtacaaggctttccttttctccacgtccttgccagcgcttatcacttattatctcttgtctttcttgtcttttttttttttttaagatagatgtcgctttgtcacccaggctggagtgcaatctcatctcactgcaacctctccctcctgagttcaagcgattctcctgcctgagcctcctgagtagctggcattacaggcacccaccaccacacctagataacttttgtatttttagtacagagagggttttgccattttggccaggctgctctcaaactcctgacctcagatgatctgtccccttcagcctcccaaagtgctgggattacaggcatgagccaccgtgcccggccatctcttgtctttttgataacagccatcctaacaggtatgaggtaatatctcattgtggttttaatgataattttttccctgataatttatgatgtggagtattttttcatatacctgttggccatttgtatgacttcttttgagaaaagtttattctgtttctttaccccatttttaaattgggttacttattttctaactattgagtttttgagttccttatctattttgaatattaacctcttatcaaatgtatggttggcaaatattttctgccatttcataggttgtctcttcactctgctgattgttgcgtggctgatacagaagttctttagtttgatgcattcccacctattttcccttttgttgcttgtgcttttggagtcatatccaaaaaataactggccatatcaataccacgcagcttttcctctgtgttttcttctgtgagctttacagattcagttcttacatttacagctttaatccactttgggttgatttttgtatatgaggtcagataagggtctcatttccttcttctgcttgtggatatccagttgttccaacaccacttatggaagagacagtactttccccgttatgtattcttggcgtctttgtcaaaaaccaattgactgggccaggcgcggtggctcacgcctgtaatcccagcactttgggaggccgagtcgggcggaacacgaggtcaggagatcgagaccatcctggctaacgtggagaaaccctgtctctactaaaaaaaaaatacaaaaattagccgggcgtggtggcgggcgcctgcagtcccagctacttgggaggctgaggcaggagaatggcgtaaacccgggaggtggagcttgcagtgagccgagatcgtgccactgcactccagcctaggcaacagagcgagactccgtctctaaaaaaaaaaaccaattgactgtatatgtgtggatttatatctgagatctagagatactataactctctatatctctagagatactctaactatgtggtatatattttaaggcaggtagtgtgatgcctccagctttatttacataactacttttgggagtaagttgctgccatgatgctccatcatccctgaaaactttactgtgtatttcctaaaaacaagacattcttctacacaattggtccattcaccaaaatcaggaactcacattgatacactattagcatttaatccacaggcctgatgtaagttgtctcaattatgttctttcttaccatgtttttcatttttctaattttctcttttttaattttaagttccagggtccatgtacaggacgtgcaggtttgttacataggtaaacgtgtgccacggtggtttgctgccccatcaacccatcccctaggtattaaacccagcttgcatttgttattattcccaatactctccgtccccccacccatcccccagtaggccccagtgtgtgttgttcccctccctgtgtccctgtgttctcactgttcagctcccacttataagtgagaaggtgcggtgtctggttttctgttcctgcattagttatgcaccagctaagactatgccttgcatttaggtgccatgtctcttttggtcctggctacatttgcatataggaaaacaataacaattaatggcaatcatcaatactttcctctatctagttaggttaatctagacatggtgtataaaaacaattacattattaatcttaaaagataagtaaagcgctcatgaaaacggggaaactgatacataaatattttcttcgactgctcatgctgcattctggagacgaccttcactattttttgcacaaatatttgaaaaacatacgcaggtattttatctaaaagatccatgccttcttaaagcatgaaagttggaaaagtggttgtgggtccaccaaactacaaagcccaatttctagaagaaatagagggcatggcacactgctgatgaagaacacacagggcagaaatacataacttgcccgggcgcggtggctcacgcctgtaatcccagcactttgggaggccgaggcaggcggatcacgaggtcaggagatcgagaccatcctggctaacacggtgaaaccccgtctctactgaaaatacaaaaaattagccaggcgtggtggcgggcacctgtaatcccagctacttgggaggctgaggcaggagaatggcgtgaacccgggaggcagagcttgcagtgagcagagatcgcgccactgcactccagcctgggcgaaagagcgagactctgtctcaaaaaaaaaaaaaaaaagaaaaaaagaaatacataacttgaatgaaaatgtgtattagctaaaataaaatggttttaaaaaaaacaggatcagagggttttataagtgagttccactaaactctcaagtaacattccaattccttcatgtttaaaaaaaagaaaaagaaaaaaagctgttcagttttgtttaaattaatttctaaataaaacaggagcaataaaagaaaatgaggatgaaattccatttcacttgtaagtatacatatgaaacagaatccaaataatatcccatcatcaagatttatctcaagaatgtgaggatggtttatcatctgaaaaatccccatcaatgtaatttaaaataggaagaaactgaaaggtaaagcacttattatctcttataatacggacgcaatgacttaataatagtccataactttactattaaagcaaacagaaaagaacaacagagtaaaccaggaatggaacagaagtctctaacttgataagggcaatatatcaaacattgcaaaaatatttaaatttctgggagaactcttagctacattttaacttctgaaaaaaaaaaaatagaggatgatatcagcaaacaaaacaaactccagagatgagaaattgaaactagcactcagaggaacgccagggcagtgggccttctgagcccagaaaggcccggattcacaatgaagggacctagcctcagacggcagatgagagtggcagtgtttagcactgtcccttaggagatgctcagtaaaatgcctctgccagctgcctcctcttcctcacctgtatgtagctgtgaaatcctgggcactgttctcgaaagagcataagatgctccgagagggtcggccttatacgatttaagctgggccaagagggcaagtggagtctcaggggatggcagcctgtgctgtggaggtgagggccacagagcaaagcccctccatgaagggctcaaagcaaaggagaggccttctgcagtgcggccattaagatcatggtctgggaagccaggctgcctgggtttcaatctcagctctaccacttactgcatgactcagtttgtttgtcttgtgccctgcactcctcatctccatgaagagctaatggcagcacctacttcaaggttggttggaaggggtgaatgagttaatccaggtaaaacatgagaacagtctctgttcttcctcaagggaagcctcctgacgcctgaacacacacattccactggtgtatttccagcacaagattctggtgtgcatatgcctccaaaatgcaatagggaatctatgtaaccttccaatactaattaacatattgtttggccacacatattaataaacaagcaggaatcatctgattttggaggtaagtaaataacatgaaaaagaaatgccaagatgcacaaagacaacaactaatcatattaataggactgtttaatggaaggtacatgaaagaagaagaaatcaaagaaccggtgcttctcagactctgacgtgcaagtggattaccaggagatttgttattaataaataaataagaatgaaatgcagcctgcatcagcaggccaggcgtggactctgggattcagcatttctcaacaagcccaccgtgtaacaccaattgttgctggtccacgttccacacttttaggggtggggatcaaaaagataaagtcaagaaatgtttcaggagtaggaggaaaacgacaaaaatatacaaagaaagagatatttttaaagtaaatgcaaaattaagaagtaaaataattctaataggcatccttaaagaagatggcagaaatcagagaggggagaatataattttaaaaataaggatattttcctgggcaataaggataaaaggactagttctccatgctggctacatgctctgattttgggtggcatcaaagaataccaattgtttggccataatctatggaggcatagcttacgtatctgtggtttttaaaatcatagtgaagtgagaagcactcatcacgcattagagtaaaacagcccaaagggtatgcagcgaaaagaagacagaacccaccttgacatattttatggctctaaacggggatagaaaatctgagaggttttacaagaaatataacacctgaaacctacatatgaaacaaatgcccgaattgaattcaccttctcaatagtagtgccaagttttagaagagcagtgccttcaaattgggagagaaatgctataaacacagccaaaccacatcaaaataaagaatggaactaacaaataatgccttcaaggagaaaggagattatatgacaacaaattctacaaatataaataaaatattcattttttaaagatggagtctcactcttattacccagcctagagtgcaatggcgcgatttcggctcactgcaacctccacttcctgggttcgagcaattctcctgcctcagcctccgaagtagctgggactacaggcgtgtgccaccacctggctaatttttgtatttttagtagagatggggtttcaccaccttggccaggcgggtctcaaactcctgacctcacgtgatccacctgccttggtctcccaaagtgctgggattacaggcatgagccactgcacccggcccagatattcttaactataacataaaggcatatgtttcttccaccaataagaaaaataaaaatcaatttctctgagaacaatagagcagtaaaagaaaggcataaatctgaaccaaatatgaaacaaactaaaatatgataagatttttagtaactgatatctcctataaactctgaggtttggaacattattaatgattagtacaggctgagaaacattcaaatatcatttctttctcatggatccaatcgtcatacatacttgcccggccacataatacaatcttataaaccttgtcaatgtaactgtattactacatctgacagaatttaggaggagacaaaaaagtggtgaaaaatgtggatagaaaatgattggttgataagttccatcaaagtttgttgaatacatcagagttaaagtatgtcgttcaaagtaacaatgcacttgatgattacagctcccgtaagtacgggaagaggatggatagattaacaatgggaacaggctgggagaagagatgtggggcaaagaatgccaaattattaggttttcaaggtggggggtgaatgtgcatattttaatgttgataaatcaatagctccgcgatgatgataatccccaaaagaactaagtggagaaacacgtacaagtggctaactctggggaacagaactgaggacatgagagagtgaattccttttttttttttttcattttatgaagaaagcaggaaagcatgtattacatccataattaaagatattttaaatggtaatacaaccaagcagttgaaataacctaaacatttcaacttcattaatatctatttttaaaagcattttgaatcatctgtttctcttagatacttcttcattttacttaggaggagagcagcattctatcgtcatttcttctgggactttgcacaaatcagaagatttgcacaaggcaatactgtggcagcacagaacaactttaacaagttcacggaaaggaaaaccattcacattcgaaatagagctccatgcctctaaccaataccttcccctggcatatgtctgaccttgtcctggggactgaactagagtcatttcctgtgttactcaggacacaagtgtcacgatgttgtatgcactccagtcttgactgactagcccagaagggcaaaaaggcaatgtgaggggcttagtcttgctgcccagccctcactgttcactttccagaattcttatggtaggaaaatttctcagttcaaaagcttcaggttacctgtgcatttgctctttcaatacacatgaggagctcggtgtcactcaacctatccgtattccccatgctccaagagtctcactcagaggtgagcgtagggttagaagaaaaaaatgggaacagttatcatttaaacagtttctcacaacccccatcaggtacaactcttgagtgagtaccaagattccttgcttaaaaataaaaggttgaaggccgggctcaatggttcaggcctataatcccagcactttgggaggccaaagggggcgcatcacttgaggtcaggagttcgagaccagcctggccaacatggcgaaaccctgtctctactaaaaatacaaaaattagccgggcatggcggcaggcgcctgtaatcccagctactcaggaggctgaggcaggagtatcgcatgaacgcaggaggtggaggttgcagtgagccgagatcgcacctctgtactccagcctgggcgacagagcgagactctgtctcaaaataaataaatgaataaaaagttgtaccaagtagtggctaatttataaagcaaataactaatcttttaaatgagagagaacagaagagtttctcattttggagattaaagcatggcccagtcagcaactttataacactgaccaggagaggtacatgcctttgttaaccctggctgttgttactgttatatcactagggtgtctcctcaacaacactgttcctttttctcttttcctgttgctgtgaactaggcatcaggcatagttgtgtatgaagttatcaggaaaatcacaaagatgtgtctaccagggcaggcaaaccccagatcctaaggtttctgtccagcttttccataaacttttcctatttcttactcccaagtttgtcaaaaaacaccagtctttgactttttctctaaatgaaaaccccatagaatctaagttccaagcccaaaatttatttgcaaaagaaaggaggaaggaatgaaggaagaaggaaggaaatacatattatgtctatttaatatacactatgcacttctttaatatattacttattacatatggatgcatttttatctgttcattcaagaaaggatatgtcaaatgcctttgcttgggaacacctacgttcagtttgctccaaacatgtacctggttttcaaacgtcccacactcctgcttcacagggaaagatttgccattatgcttagtggtgggaatctatgcaaatggttccacatgccaatgccaagccaaaagagaaagacaagcctttgttccagaagacacagccctttacagccctttgaatccattcctctgggagcttccccatgggaggactgcttctttctgtgacccagcctcactaaatgcactaggaatcagcgcacttcactaaatattacatctagatcatgtgtgtatttactataattatgcatatttcatctgaactaattttcagaaaccctttccttagcaaatcgcacattttacgaaatgtcagtgtttcctaccaaccaccatgaaaacaacaacaaaagctgaaacatagcaggaactcaaatcgcagagtatttcaaatagataattagactgaattctaaagttctctaactaccatatatgtaatattaaaaaggtcattaaattgttggtgtgacagggttagttaaacataggcctagcagccagtaaagatgctgagtgcagtgacaaagaacggtgaacggaggacctgtttgtgaaggatgaggattttcctgcattcaccgttgagaagtcagtcttcataggatggtgctgagtaggactagatagatttaatcaccatcacaggaacaaactcactaattatagtagcagtgacacaggacaggtgagacccacaactggggcttagctgaggagggttcttgactttgcccaggaaggaactgaggggtaagtcagtggtgttaaaaagcaatgtttactgaagtggcggtgtacagcagcagcagcgctgccccgtaggcagtgtgccagggcagcagctcagaggcagcattgcatccatatttatacccacttttaatttcatggggtggattatgaagaaatttctagaaaagggtcaccaagttgttgtcgtgaaaaggggcagtaactcccaagtgttgccatggcaatgggaaactgacacagcaccctggtgggtgtgtcatatggaaagctgcttccagcccagccctattttagctagtcctcaatttggtccagtgcctgagccccacctccagagttgacttccaccttctacatcagtaagacaaagaaagtcgcaaagttggaagaatatacagagagagataaaagctgtattcaggaagtagatcctttataaaatccactagaaaatacaactgacttagtaatagccaatgacaaaacactgcatgtgcagaaattcaggactttatacaagtaataatgagtgaggacgcaaggcagccctggccaggacgatgaggggcagagatgatacagggaccagctatggctcttcggaccctgaccaaggaaggaaagctacagatgagtaaacagagttgactccatgagctcagcagaaatagggtgtttgtttatgtgtttgcagttttcaccagttcttagtgagaagttaggagttacagtgtgcactcctctgctatttatagtctgatatattaatacaggagctgtcttggccaagctcttcctctctacagatgctgtcccttaaacactttccaacatccaatgagcacttatacaaagattgctttttatttcatttaccgccttctcagctgtttatgagtcaaactgtttcctggtactgttgctgtaggtgtatattggacattactcaggatctgaagcatatacaatatccccaagcttaaattagtcattgtttcacttgtcaaattcaattaacatcatatgccaattgcataccatgaatcatttagtaaacactgtctagaaatattaacataaatcctgtgttttacttaacactatgttgaattctgttcataagtttgttgtttgcaacagtttaagttttagtcaatttcaaaattcttttgaatgtactatgtgtgtgtactatgggataaaagaaataaattaatatattgatgtttacggtaatgtgggttctcactatgggaaaaggtagatatgaatactgaaaggggaaaggcaatagataattctatggtattcctgaagttatatgaatgaactcattaatgcacacagacacacatacacatattctaccatatagtaaaatggtctagaagcaaaaacattggtagcaacgtttatgtctaaatgtaacagccagatcctagggtttggtaaatagaagatgaacctggaacttctgtgccaaaaagcaaggactcaaagaccaatgtggacatatcaaaactatgtaggagctgatttaaaggggttcatttttctcaaactgttctttaaagaagaatgctaaatggcaaatgtaaacaaacaatataattataaatctttctggttttttggaaaccacaaatgcaattatttatttgggcagaaatagaaatgaatccttaaaaagaccgttgaagaatagcatcttgacatggtctgaaagcagtatcccacatcttgtctactaattgcataagaaaaaggcaaccttgaaacaggggcgatgtccttttgagtatgaaactcacaagggagagactttatcagatcagatgctagtggggatcacaaacgccaccagatgagctggcgttctgtgttgctgatgggatgtaatgtaaagtacacaccctctaggaaacggtcttgccacacatgcttcacctgaacataccatgaggaaaacggcaggacaaatccagattctgagacatcccaaaaaaggactggcctgacgtctttaagtatgtcagagttgagacagacaaaaagtggcaggaagttgtggctgacatgaccagaccgccaaatgcaacgtgtgggcttcacctcaaccgggagaagaaaaacagatgtccacagaagacgttcggagatggatgggaagatgtgcacaagggctgcccatgaaataatatcactgagtcaacgtacaggcatggtgatggaacaggatgactttgcatttaagagatgcacgctggctggacacagtagatcacgcctttaatcccagcactttgggaggccaaggtgggcagatcacgaggtcaggagatcgagaccatcccggctaacacagtgaaaccccgtctctactaaaaatacaaaaaattacccgagtgttgtggcatgcatctgtagtcccagctactcgggaggctgaggcaggagaatggtgtgaacctgggaggcagagcttgcagtgagccgagactgcaccactgtgctccagcctgggcaacagagtgagactctgtctaaaaaaaaagagatgcacactacaactttcaaacaaatccaccaacacacacgcacacacggacgtgcacactcacatacatacacacatgtatcatgttttgtgtgagtgcggggtgtgtgtagcatgggtatttgtgtgtgagaaggaaggcaagtgggtcaaaagataaagaaatggtgcatagagtaaatcactgcggtactgtactagtctttcaagttttctacagtctcacaattaaaaaaaaaaaggtggagaaaaattttcctggagagagaaactaaacaaccagaagtttctgatgattgaattaaatcgtttttcagtatgccaagcctctgagcagctggattttccacactttagtttgttgccctggggcctcccagtcttgcttccataactcaacagaattctaccaccaattgttgaatccaaagtttcgttccaaagtctctgaaagcagaaactgtgttccagatacagagaatcaaaatgcgctactgaagtcatccagaatatcagtagccaagacatgatcagagagacctatgaatctaagccagttttctgatttttaagccaaattgtttatctccattcaacactctcaatacttgtatctacaaacatattggactaatgcagagagcacatttccacactggaacagttgaatagggatgtgaaaactcgaatatctttgcaaccttcaaacaacacttgacattaaaaatccatttacaaatccagctttatgctaaatattgtggtaacattcttaaagaccagacctcttcatgtggaaaatgatgtcccagtctaaagttttttgaaaggatttgctatgaaactgataataattttataggtattcatgtctatacaattactaggactttttttacacagaatacctaagtttctcctaccttattgaagattcttattaaaataccacatattaaaaaagataaagtaacacaaaaagtcacaaaagaattgaagtttacttttttgctttatttggcccaacacagtgtcttctagaagtccttgtcatcacaaaaatataaagcttcctttggatatgcactccccaacctgaattgtaagcactttgaagacagtaattaggtcttccatcacactttagataatgtcctaggccgggcgcagtggctcatgtgtataatcccagcactttgggagtctaagacaggaggatcacttgagctaagacaggaggatcacttgagccccggagttcaagatcagcttcagaaacatagtgagacccccatctttacaaaattaaaaaaaaaaaagctgagtatcgtggtttacacctgtggtgccagctactcgggaggctgaggtagggaggtcaaggcggcagtgagccatggtcgcgccactgcactccaccctgcacaacagagcaagagcctgtctcaaagaaaagaaaacacaccatgacgtcctgcatatatctgcctctcagagaactgattcaccgatttcatcgtttaaaaccaatgcaatactttcattttcatgaaaatggaagcaggctttcatgaaaacagtcttcaagttcatgttacacaaatcctacagaaattgtggacaaatgatctgacatcctcctataaaaggatgagaagaagctgtgcctcatgtaactgatcatttctatgtattaagccatatgaaatatcatgtctttgctgagcagaggctacaattagaaaagacccgatctaaaagaatgctcaaaggtcatcaagcatgattacattctgctgcacactgtaaaatgcatccaagtgtaaaggattattcaacaaattatgaatgattcattcatggcagatttttcattagaaggtaatgtctcctttcccataaagtcaacattatgatccaggatgccatttattagaacttatgctattaaacaagatatgaaaagagaatcttcttaagtgtctcacatcagttaaattaccctccacctgttggaaataagcactgtggtcaatgaagggagagggatatgtagtacatgtgttacaggatttgcaagagttatgcttatgtatatgtatacatgtacacaattttcattactgatctttcacttatgtctgaaagtcaaatacttactccttttgcttaaaattttggactctaaattatcccaggatcggtagttaccccaggacagcgtagtagttattaaaaagtcaattagatcccatttgtcaattttggcttttgttgccattgtttttggtgttttagacatgaagtccttgccctgcctatgtcctgaatagtaatgcctaggttttcttctagggtttttatggttttaggtctaacgtttaagtctttaatccatcttgaattgatttttgtataaggtgtaaggaagggatccagtttcagctttctacatatggctaaccagttttcccagcaccatttattaaatagggaatcctttccccattgcttgtttttctcaggtttgtcaaagatcagatagttgtagatatgtggcattatttctgagggctctgttctgttccattgatctatatctctgttttggtaccagtaccatgctgttttggttactgtagccttgtagtatagtttgaagtcaggtagcgtgatgcctccagctttgttcttttggctcaggattgacttggcgatgcgggctcttttttggttccatatgaactttaaagtattgttttccaattctgtgaagaaagtcattggtagcttgatggggatggcattgaatctgtaaattaccttgggcagtatggccattttcacgatattgattcttcctacccatgagcatggaatgttcttccatttgtttgtatcctcttttatttccttgagcagtggtttgtagttctcctcgaagaggtccttcacatcccttgtaagttggattcctaggtattttattctctttgaagcaattgtgaatgggagttcactcatgatttggctctctgtttgtctgttgttggtgtataagaatgcttgtgatttttgtacattgattttgtatcctgaatattttcacaacctactcgtctgaaaaagggctaatatccagaatctacaatgaactcaaacaaatttacaagaaaaaaacaaacaaccctatcaaaaagtgggcgaaggacatgaacagacacttctcaaaagaagacatttatgcagccaaaaaacacatgaaaaaatgctcaccatcactggccatcagagaaatgcaaatcaaaaccacaatgagataccatctcacaccagttagaacggcaatcattaaaaagtcaagaaacaacaggtgctggagaggatgtggagaaataggaacacttttacactgttggtgggattgtaaactagttcaaccattgtggaagtcagtgtggcgattcctcagggatctagaactagaaataccatttgacccaggcatcccattactgggtatatacccaaaggactataaatcatgctgctataaagacacatgcacacgtatgtttattgcggcattattcacaatagcaaaaacttggaaccaacccaaatgtccaacaatgatagactggattaaggaaatgtggcacatatacaccatggaatactatgcagccataaaaaatgatgagttcatgtcctttgtagggacatggatgaaactggaaatcatcattctcagtaaactatcgcaagaacaaaaaaccaaacaccgcatattcttactcataggtgggaattgaataatgagaacacatggacacaggaaggggaacatcacactctggggactgttgtggggtggggggaggcgggagggatagcactgggaaatatacctaatgctagatgacgagttagtgggtgcagcgcaccagcaaggcacatgtatacatatgtaactaacctgcacattgtgcacatgtaccctaaaacttaaagtataataataataaataaatacattaaaataaataaataaataaaaatttgacatgtttccaaagaaaaaaaaaaaaagtcaaatgagattttaaaatatttcccaagtgttatctgagagatcactttgagagaaggaaagcaagcggtgtttgtcatgagcttcgtccaaatcagaggccttgagtgttcggaggatcatctaaacccatgaaaaaaatcagctggcaggagcccatatgggtcaagatggcttctggagatagataaaagcggatgtctgaagtagactccctacttcccagctgtaactggcagtagagtaatcttgctaggaccaaatatcctttggtactgcatacatcaatagcactagctaaaaagattgatctgagttatccatttattttagagtttaaaatacactctccacagcatcttttttccactgggaatccagagatgttttacttcccgtctctataaaaagccgcctcacaatttacagggccactgcccactcttcatactttaaaagatatagataggaattcagaagaataagaatccctccttatttgcagatcaaatttacccttcagcaaacttcatgggctgacacattacccttgagcagggggtatagatatacaatcattaagaataatcaccaaatatttcaatttacttgatttaacaagcttttaaaatccattgcaagggggtaaaatttgattaataaactgcaggccacataaggatcttgtacaaggtgacttatttaactgactccacagaaaagtcaacaagcaatccattgatcacaacatgcaaacaattcctacttgagtgtcccactggcttagcggcagatttgggtctcaattgctgatcaatttctgcattatgattctggcatgaaacagctctctaggaaagggacgacatcataaagatgtgtataagagaaagaagatggctgagccctggcctcacggactttttgtcacgcccttttcaatcagctagaatccaatctgataatcatttactgtgtcttaagggacgagagcacgtgtgtacattagatcctgtatacgtttacgctgcacatttagattgagtgtgtactgtgtgcctgtcactaccataagtcactatgggttcagagataaaacaaatagctctatgtaaggtgctcacagtctagacaggcagagaataggaaatatagaacagcaatacactgaaataagtgaaattgcagagatatgcacaggcgtgaaagtcatttagagggtggagaacataggggagttttgagttgactgatggagctgaaatatgggcaaatgttggaaaggaatactttgcaccagactgcaaagatcaaataataacaaattcagggatgtgtgttttagtctgcttatattgcagagggactgaaggatttttaactgaatgacagcatccattccaaacttcatcagacaacaggatagaaggcagagtttcagctcagtgaagtatgttttatcaaactgtccaggatggtttctgagtaacacataaaaatgtaaatcactgtgggaaagcagctgtaattcacgatgacataaaaaccactttaaatcataaacacaaagcagggaaagaaaaagcttcttaaagtgggaagggagagaaagtggggcttaaaatagataatgaagaatgattttaaatcttgttatgctggcacgtaaatggttttgcatcagacaattctagagaaaggtatgtgattccaagtgggagtcatgttcaggatgagatacccaagcagtctgacatatgcttgcagtctactaggcgtaggctttcgccgaagggcctaagcctaggggaggcttaatcacagatcccacgctgtggccctttccctgcatcctggccatgtgaactatagtaaaagtgaaattgtatgagactgcgagaaagacctatgcatttccaagccaagtctccctcagcaggtggggaaaattggggggaaggtacagaccatgtccctgtaaaggctgctcagtaactcctatgctctgaccagctcttgagatggtgtcagaacctgttgatttccttctccactgcagcttgattcatccacactaatgcagttctgcacgaacaacagcctcaagatggaatcccaacacaggttccaggctccatcctttctggagtcaggtttgaggacaagccttttacctctatgcacagagagaaacatctgagtgaatgcaactgatggaaatcaaatatttaaaagtaaacatttttgggccgatgtggtggctcatgcctataatcccagcactttgggaggctgagatgggtggattgcctgaggtcaggagttcaggaccagcctggccaacgtggggaaaccttgtctctactaaaaatacaaaattagccaggcatgatggcacacacctgtaatcccagctaattgggaggctgaggcaggagaattgcttgaacctgggagacagagcttgcagtgagccaagatcacgctgttgcactccagtctgggcgacaagagtgaaacattttcattaacatttcaaattttaaaaatgagtatgattgggccgggcgcagtggctcacgcctgtaatgccagcactttgggaggccgaggcgggtggatcatgaggtcaggagatcaagaccatcctggctaacatggtgaaaccctgtctccactaaaaaaaattagccaggcgtggtggccagcgccagttgtcccagctacttgggaggctgagacaggagaatggttgtgaagccgggaggtggagcttgcagtgagccgagaacgcgccactgcactccagcctgggctacagagcgagactccatctcaaaaaaaaaaagagtatgatcacattaaaaagaagtaaacatttcagcttagagcatactacatttttaaaattaaatgcttcccctagttttcaatattatacatgaatgtatttgcttcatttttacaaacacatggcaggtatacatgaagctgtggctgctcagtcaatgccaagcaaaaggcctgaagtcctaaccttgaaatgcccaatgatgagttaataaagtcagcaacattaacatgtgctcttttacagccaaataaccaaccacaaccaaaagagtatttaatatttgctttcatttataaggtaaccagtgcattacaaaaaagttaaaaagcctacgattctctgaataacttggaactcctataagcaacacttgacaaattagcaacatgggcgtggaggtgtcctggcctttgaacacgaagatgatgatgtcttccttgtcatgctgccagtctagagcacacatagacttgcgtttctaattatgataataactcatctggccacatccacagatcatcccattgcatttgtgaccaacagcacacacgttcaaaatagctggttgaaatgaggtatgcctattggttatggaataagcacagggaagtgaactaatcagatagatattatagtagtaagtgagggtgaatttctacttcagaatagataccttcaaagatttcctttaacaagttcttgtggatcctggtagacccaaagaaaaagcacactttttcttcttagaaaggaagtgaagataccttattagttatgagaaaatatgacagactttgttccaaagcactgcaggaagtgctcggtaatcctgcaattggcacaaagtctacagggctttaaatcaaggggcctcgggatgatcagggaaaggactgtgaataagctgccaacctgtgttttgccttgaaggctgggcagggctgtcaggtactcagacattttctctcacctccaaactcttccacactctgctctggatgctatagacacaactgtgccaactacttttcccaaaatgttttgccagctggatttggtgagctgtcaacaggaggcaggaattcacaatgcaggagaagaggcaagggaacttccttattcctgtctgcttgcggtttgtgtcagcaaaatcacatgagctcaagttccccagcagtggcgcgctgtcccagaagcagctgttttttcccctcctctggcttcttttgccacttccaagaacagtttatcttgcccctctaaggagccagtggcaagcgggtctttaggtaagaagccttgaaggaagggagaagggctgctttctctgggaggggagaatcagagagatttggaaattcaaaatcagctttgtctgaatctatttagatgactccagtctcagggtccaatatcttgccaatcactctgactttcacacacaaggctgtttgaaggttcttgaacttaattgtaattctgtaacattttggatgttattttctgcaactcagccctatgactaagaggggagaaagttatcattatctttttagttcttcaggccaaaatagaagttctctgttttgttgttgttgttcttgttgttatttcaggtagggtcttgctctgtcatccagactggagctcagtggcgagactgtggctcactgcagcctcaacttctcaggctccagtgatcctcccacatcgacgagtaactgggaccacaagcacacccagctaatttttatatttttttgcagagacaaggtttcaccctgttgctaaggctggtatggaactcctgggctcaagcaattctcctgcttcatcctcccaaagcattgggattataggcgtgagccactgtgcttggcccatttattttttataaaaagtatcccgagtttatgatttcctatcactagacttctagccatttaaccccatagtccttgtcatcatcatttctatcatcacaggtaggtattgcaaggactttcacctaataggacaaccatgagctggagtaagggaaacatacatttctgctcaggattatcagctctgaactgcaaccaattcatggtaactaaaactccatgttggtcaccaaagtggaggcttttggtggtaaggtgataaatggatgaggcccacgtctattttacggagattgcagaaggttcagaaatgcatcacttggttatttttctagttcctgaatatgtaattagaacagacatttgcagcaactggcagaattcctgcatgtctctctgccccctggtgtgagcgatattaaaccagagccaggaggcttctaaaatatgaccttcctaccagaggatgttaatattgctgggggaagggcaacgattaatatctctgtcaaagatttgaaaaaggcaagtctcatctacttactccatactcatttaactcacctgtttggcccatgcacaaagcagttggacttagagaataattgtgaattaccataaatttacttagcttgtgattgcaattgcagctgctcttccagatatgatattttcactggaacaaataaacacagctcctggcatctggcagtttacaccttttgatcaggcaaattaattcatagcaactttcaaggatcaccaaaagccatttgcttttgcttggtcgggtccacatagcacctgcacttttctctgggtgatgtcaactctcctgctctttgtcctgactacatttgcagaaatgttgatcatgcttacctcaaactaactatactgacaacatgtaccacacagaccagatgaacagaaaatagcaaataccttaaatgtctgaataagatgtatgccaacccgtggaaaataaagcccatgaaaatgtaggcaccatcattttagtgaagttcttgggggttgaatgcttccgagcatgtgaggatataccctccaagttaaaaggtgagtttctggaaattgcaatgtgcttaccactaaaaaagaaggacagtacttgatgggcctccttgggcttatatgtcacttgtactgctttcacccatttatcaagaaatgtgtaaggctaccagttttgattggagtcttgggcaagagaggactgctgcagattcagatggcagtgcaagctgctttgccttatgacaagggccttatgatccaacagatacaattatatgtcaatgtctatgacaaacagaggttctgttgtggttagctgctgggtcctgatacagactaaacacctcattctatgaacataaagaaaccatgtggggtggccatgatgaaggggatgagagctggcctgctgcatctctgctggctcagctcatacctgtggactcctaggagagagaattttgaccaaatcacataggaatgaaaaacctcaggccttatttacagatgagcagtacaatatactgtcactaaaacactggttgatgcagcatgtggttatttacttggtcaagattgagacagaagtataggaaacagtgattatttggtgatcattaggggtctggttggaaggtaaggggcttggaaagaatgggattagaaggctgaaaacaaattgttcttactgaatcctcaaaactgagtctccagtgtgaagatatctgcactccatagaaatgctctctcaagggggttcactgcagaggaggctgtcagtaatcgggccaacaagacgacatgccctgtgaatgtcatggagcctctttcctcagcctctcctatttaccagatgaatcctgtggcaaagacagagctatgcttgggcagcatacaacctcctctcgccaaggctgatctgctaccaacactcctgtgtgctcatctcctgcagcagtgagtgctcagcatggaacagggcacagttctcccagaaggggcctcttaggagtgggttgattactttggacccttacattatgcaggaggcagcaaacggtcctcgctggaaaaggcatttattttgggtatggattcatcattcctgtctgccttgtttctagaaaaatcattgtccacaggtttatagaatatcctagtcacgatatggcactcacacacatgcttcagaacaatgaactcattttgctgcaaaggaagtatggcaatgggatcatgtctgttgatttttctcatattatcaagtctcccagaagcagctgggctgatggactgctgactgacctagaaaagccttagtggtggtgtcagtaggtgacaacatttggatagcctggggctcaatctgttctatctatctatctatctatctatctatctatctatctatctctgatatatatttgaattcttatatatgcgctgacccagcaaccaatatatggtgctgcttctctcactgccagaaaacacacctgcagaatcaactggatgatgtgggagtggctgctttcactactatatctaataacccattcacagaatgtttcattcgtgtcttctcagctctgggctctgctggtttaaatgtcttcgtacccaagagggcaaggtttccaccaggagaaacaaaaatagttaaaaaaaaaaaaaaaagttgagactggtacttgcccattttgagttccttaaacactgaagtaacaagaaaaaacgggggatactatgttgcctgggatgctggtcacaatttctagggaaaaactgaattgctactacacagtagtgagggagagaaatggatctcatttacaggggaattcctgtggcagctcatggtatttccatgtccaaaagtacaagttaatgaaaactatggcaaccaataaagattaaactgttgggtatttagagctttcaggaatgaagatttgggtcacattatacaatgggaaaaaaaggcaacctccaaacagattatggctgaaggaaaaggtaatagaagaggaactgtagaaaagagatgttataaacaaatataaacttatcagttatatgaatacagtgtaaatataggtatgtatatggtaactaatatttcatttcttctttaccgccactagttacttatatgtttgtaattttgtggttaactttatcatttaagttattctttaggttataagattctgttgcaagtaagaagaaactacaagagaaattaacatcttttagacaaggatagtatgatggttggaaattgtgtcttccattgctcaggagaggccaagagagtgtttgaacgaatagttattttttattaggtatacccatggagtatttactgttatgaaaaggaagtttgagtatgtgcaaagcagtatatgttctgaaaagatatggtcagtgtggacccaaagggttggtcaatatgaattacttaactattgtttctaacatcaaaaccctccatttgtattctattctctaatgttttgacattaaattactcaaaactcttaacagctagtttcttgttagactataccgagaggaggcactagagggagactggaaaacaagaggaagggagaaggggcttttcttcttcctgttgagttgattgccctgtaagtatcactctggcagcagcacacaacccgagcaacaattgcttctcccagaagcagcacttagtccaagcaccagctgttgtttccagcctctagttagttttaagcaaggagaactagcctcatcatgccattttgatgatccaaacccagctccgagaaaagtcccatctgtgagctttcagattctgacaaacctactctcttccacttcctttcaccaacaccagggctggtgggagcttcttactgttagcatgtctcaattcccttaatatttcatttttgcttttcagttttctaactctgtgtaatgaattctctacttaaaatttcctctgcaaaaaaccagtgggatctgtctttccctcgctgggaaagggacagagcagggttttaatcagtgaggttgggagttcactacactacattaagtacaaagttgtaaagagcctaagccagggatgaataacagcagacattaagcaagaaaagcccattgagctggaatctgatttgaaatgcaattgaaaagggagaaaatcaaagataaccgcaggctctgtggctgggtgaatggagtatgaacgttgaggttgtgggtgtggctgggagacattgaatttgaggtgtctggggagcataaagatgaacattttcacaagcaagtgagaactgtctaacatccaagaaaatgccacgggattaaaaataaagacttgaggagaatctgcagataagtctatttcactctgagggagtataagacagctggataggagagttttgagaaggaaaaggcagacgccaagaagtaaccttcgggaccatccatgtttcgggtgctgaggagcatggcaagtcagccagaacaattaatcagggttagtcatggaagaatgactaagaaggaatgaaatccctcagtcaagtgtcaaagaagtcagggaagtcttagaaagtgggagcctggagaggaagtcagggtcagtggtgccaaatgcttgcataggaagctctgccggcatcaagtacgattattatagaaagtgaggaattctctcaaatgccaccttccaacctgccagctgtcctgtgggaatgtgacacgtagtcctcagttctgatttaataagaatgacactaacagttagcaaacatagaaacgggaaaaacgctgccaacatcgtgtagcacatccctaaatacagcccatagggactgtctccacatgcttcagaatccagccccggagctccacgaataactgcatgtgagtccacgggcggcaccacacctcagagggagaaacacagccccccttacattctcaaggaggcgctgcttttgatcttttattttcctttgagttcttcactggcgcagaactttgttctatttgattgcaacatgtaaatattatcatcatgtcttcctttattagggacaatatttttttccctacaaaagacttgagctgaaagacataaaacactgtttcagtttcaggaattctagggaggattagaagaaagggttagaacacgattacccctgtggaaatctagggaaaagatcccatacctattttcttgtctttacccacccaactactcacaacccgtcacttatacacaaacaaatagtcactgtgcaacacatcttctatttctggtaacgtaccatggccaaagtcataaaagggtcaattattgaacctggtagagctggtggcaattttcaaacagaggcacaactcacatttaaagatgatacatggcaggtactcaataagtatttgttgaatgaaggtgtaaatggctgtttgatggctaagacatgtcttgtctaggtttgtgactccgttacagttggagggtgaattgctgtatttaaaacgggtagagaactgtcagagatattacctgctacgaagatcgtcagatctattagatatggatgatgtttcattgccagaaacagcttcacctaaaaattagcagccacagaagcagggcttctgtagattatgatgtctaacagatcaactccatatatgatacatggttgcaaatttgagcaacataataatatttttgggtgcctattaactgttttaacactgtgaaaaagcacagtgggagataaaggaagaaacaatggctgtgctatatgcatgcttatcactgcagaaacaaagaccgagacacagagttctcattctcattcccaatgggaagcagcactaaacacagagttctgcatgtggacgtgctatcagggcttagccagtggtacctggtcatttctgaactcatgaaatagatgatgcattaatatactgaaatttgtttttctaaagccctcaaggattgttacttatcctttaaccgtggctgcctaaaactggcttaattggtttcgattgatttaacaacccttcttcacttagtttatcgttatttaggaaaaggtcaaattatgtggtcattgttgccatggttcattttggaatagcaaagtcacacattttcacaagttttctcattgacaaattaaataaatgtccatttttagcaaggtttctcattgtgaggagcccctcctctcctctaggctccaaaccacatttaatcctcctgcagaccagctaccaaatgtttatttctcctgagcttttgcagctactcttggtccaccttgagttaaaattagaatttctctggatctatcaagaaatatctctcttctatgccccagtgtctgttcaaccaacagtctcctcttttactctaattcattttcctgtttgtttgtttgtttgtttgtttgcttttccctaggaagtatgagcattcccttgtttaatattttcctcatgttacattttacactttcccatgttctctcactgaactgcactttgcatttattcagttaaatgtagattgcttccagtacatactgtgacataacatgtttaataactgaaatccagaacagatattatctgcaccaatgtagtgtcacattcaattacaagctcccagttcttttcctttttacattattgatttctaaaccaataaaatggatacttattcaaagccagaaggatttcaagaaatatattgaaataactgtcagataatcttggtgaactttgtaacaaaatcaattatacaatgttcgtaccaagttgcaaaggcaaggcacgctgccgctgtgactacctgcctaatgcactcaatgccaaatgacttttctcccagacacaacatgaaaagcctgttactcaaaaggtgctagtctaccaactcaacttttgctttccaaatataatgcttttcattgctgtctagcaaaaaggagctaaagagtgagaaagatgagttaaaaatgcaaaccaaaggaaacttaaagacccaaaggttcaaaaatcagtaggcatactaaaataacattatttctcttctttgctatgtttctctagaagtagtgaaataagtgagtaccttataccataatttcacatcccaggaatcaatggccaagtatagccatagaaagagttgcggtgaaaaaactgaggaatcaaatgagaaaagaaacattgtaataaaatgtgcatcgttgagtcatagggaaaatctgccttcaaaacttttcctagaaattataaaaactgcccattactttgaataacacattgtaattttaaaatacttcactacataaaaaggcaaattaaaagaatcctttgattgttccatccctatggagccttatgaatcccataatccttgagaggtatctttactggcatacttataaatacacaattaaaatatacaatgaaaatccagtaggtattcatcccttcacttgcgggactccagctatggcagtatgagagctctgtactcctcacctcttcacactatttcttctgcatgatacaactcttctacttcagccctacttctcttgttaagaatgtttactcaactgagaggtcacatcctcagtgagacttcttattgccaaaaaactccactgggctcccttatgcttatttcctccagaactttctgctttccttccctcagctttactgcagtaactactgaatgtcttcagtgctagagtgtgggcctcctgagggcaagagccatgtctcttctgttcacaacagcattgccagtaccttactcaatgcctatcacataacagaaaatatgtagatgtcaaattagtaaatgaaagtgtgaagtggatggtaaaaagtcatcatagtaaatcactaaaggggttcctttacctgttttgcatatatttgtgtttttaaggggtcatacagcctgaagatacactatatatatttgactacagataatgcatcaaagcattggatttttatggtagaagaacaacatctagatcatagtatgtggcaaaaagtgagagagatgggaaagaggccaaacgtagacagcatctgtaagccatagcaccagccgactgtacaatctcacaccttactataggagagaaagcaagtccacattatcttttcagtagtgcatttatactacaagtatcctgataagaaaagttgtcttgggccctgttattttctgaatgtatgtatacctcccaaaatttatatatggaaacctaatccccaatgtgatagcattaagggtgggggcctttgggaagtgattaggtcacaagggcagagccctcatggatgggattagggcccttataaaagaggccccagagagctgcctcgcctcttccaccataagaggttgcataaagaaggtgcccatctatgagaaactcctcagaagacacctaatctgctggacaccttgatcttgaagttccagcctccagaactttgagaaagaattgctgctgtttctaagccacccaatttgtgacattcttttattagcagtctgaggtgactaacaagccctaattcacttaaatggtaaatgaatgctttaaaatgtacactcaaccaacattttgagaatcatctaaaggataacatcatatagggactgatcaaagggttttatgatcctaatgaatgtgaaaccacaggctacaaaaattctcaagagcaaaaattcctgatcagattttatcagaatttactgggtagctttatattaagtacttcatcatcattaatataccttaggtttcttaaatgagctttaattttatttacaatagataacattttgttggcatctacaaattctgggaaatattagagaaagtaacatgaatacagctttaattaaataaagattcaaatataaataagtgtttgcaactggtataaaatgtcatctttgtggaagcattttatcagcttaacattttgctgctactaacatagatgaggcagaactaatatggccagaagcaaggagaaacatgcatggaataagtgctgtaaatttttttctagagctatatattccttagtcagcatgcaaggaaaatggtaaacaaacaaggatgctaaataagaaaaacttggaacgttcctcaatgtaccaaacagagtgtgaatatgccacttcattagagggtggagcattctaattttataaaataaagttaaatatactaatttcattttcaaatatttaacactttactataaaatacttttcctgatgtgaggactgattcacagaactgcataaggttatttataatgttttataaatattatttgaaatgatatataatggcctacttcttaaattatagagtaaatatatacagtaagtccaaaactatttttacaacatctgagaaacaaattttcccctgtagagtgtttacactgaggaaaaaacagctagattatagaagttaaaaatatacgaaaataggaaataatatgtactaattaaagtaagaaaaaaatgagccttacagtctcagaggctttagaattgaggagtagagaatgaagcttgcttctcaattagctttggaaaaataataaagaacaaaacagctctccaacacaaggctccatcttattgtacagaccctaccaaacgaagaatgatctttctggcccccaaatacaggaatctaccactctgcagcctgtcctcacttctcttctgccccactgccccacaaacacctttcgaatgcccacaaatgcctctcacctcagaaatccttttttgtcttgatactgcttcttaaatagaaatatcttgttttagtcaaacccattcatttcatctatcacacaacagaaggtttctatttttagaggtcaaaaatctcagtgataacccaataaaatcaaacctcttcacgggtaacaactgtatacacacacacacacacggacacgtaattttgcatgcatttcaaggtttacagagcaggtccaggtctgatgttaaatcaatgtgcatcagaatggctcgaatgccagtaaaatatggccagggtccattttgattggctgtagtgtgcattcacattgggaggtgcccaggaacaaccagttgataaatatttagaatagcactctctctggggacatggatcccaacctagatagtagcagtaggaaatcaatgcactgctacatctatggtgactatccatcatacaggaagctatgtatgatacatactgaatgcaatttatattttgcagccaggaagagtctcacttctaggtttaccactcacttgctgtgtgatacaaggacatttatttcttcctaaacttaaattttcttatctgtaaaatggagataaataatatttttgtcacaggattagataaagaataatatgaaaagtatctagtgtctggtaaaaaatggatcctcaccaaatagatgatataatgacaaggacaacaatgctgaaatgtttatcatttagataatcttaacagctcaaccctcccttttgctctacgatgcccgagttcaaaatacttttcttaaaatttatatttcattcacaatcatttctatttcaaaatccttcctttccctgaaaatcacagcttcatggcattcattaatgatgaggcaattcccaccaccatgacagccttggtcatgaactacttgcagattcagcttaataatgactgactgagaatgcatcagatgctaggcattatatacacagaaattttaggagatcacatgatgacaccctctaaacaggagcctgaggaacagcagcttcaagtgagaaacttttcacagggcaaataacatctaaaataccaaccagaatacacagtaatgcaataatggccaaatgaattttagttgtataatgttctctcttttcacattgttttcatagcacacatttccaggtttctataaaaatcagccaatgatgaaaagcaacatttgttatcttagtttatattagtaactcgatttcccctaggactgctatagatgtggaaggggtttgggactgaattaatgaagctatttggataacagctgaaataagatccaggaatgaaataatgtatctataaatctttttctgtgtctttagattctgcaatcccttgagctactttcttggtacctggaggagaaaatgattattttaattttaaaaagccagtaggtgtaaatatatgctgagccttagaaacaagccttaaatttttccaaagatacttcatatatttcagatacaaaaatgtaagattttttgcactgccaatcttctaataaagacttaaagaaaagagaacatttaaaaatgtttattcatcatccatttcttcagcaaatgtaaaggtagagtctacaatctataggatcctatatggggtggggttggcaagtgcttcagtcatggtctgtgccttcaaggacatcacgggctgggcatggagtgtggacttgcacaccaacaccgccgacgtgtggtgatggttaactgatcacttacagataacatgccatgacagctcataggataaagcattacatagagctgggttttgttaccgaagaatgaggtttgagttgacccctgaagatgggaaggagtggacacagagaggagaaagaacatcatatgcagtgggaacaaacatttctgaaggtaacaaattctgctgagaagtgactgatgtgaaactttgggaagtagtcgtgaaaaggcagattggtgttggattgcagattcatactctgggtcatgacggctgggctctatttaagaaaccctcattgtttttacagtgcctgacatatgctacctgctgaataaaaatgtgaggaatgaaatggccagagcttcacctcgaccacggacaggccataccagaggcagcaaggcacacaatagaatactctgcattcagagtctcctcctaataattagcatgaccttgggtatatgcagtatcttgtctgagaaggaatatttcaatctacacgatggacataataactatcttatctaacggggtgtttgtgaggttcaaatgcaatcatcactgttgaaatgtactggaataataacgacgttgtaactagcacagaagagaccagtatgacatctattaattattccaataagaggtggtgaccacctgaagtggaaatggggaggcagggtctggtgtcaggggtaaaggacagttcaaagttgaaggcaacagggccaggactccagggcatctctatctctgaaatctactctgataagtgctgtggacaaaaatcaagcagagcggtgggatggcgggttataagagggtgggcagagaaaccatcttagaggagacggcttagagctgagatttaaaggaatgaacgccttccaggcagaaagaacagaatgtacaaaggtcctgatgcaggagctcagtaacgatactgagtgaacagtctagaagctcatttggccacagcaccgtggccattgtcggggcagcagaacatgtgcttggagagatggccacaatcacatcaggacagtcccatgggcacagtggacttagggttttactgtgaatgtgatgggcaggcagatggtttgtgtctgaaaaatgttagaaggatcactctggctgctgtgtgagaatcagctgagaacattctagacattgaagactgataggaataggactgggcaggaggctgctgcctggaggcaccatgagggatgatggtgtttgaacaagagaatagaagtgagggatctgtgaagtgatcggattcaaggtctagctggaggtagcgtcagcaacgctgctgatggattagatgggggcctgtataagaaagacaggagtcagataggacttgaagatatttgtccttagcaactgagagagcagtggtgctgtgctctggggtaatggtctcttcagggaagggcaggtttggcaggaagtatttagagttctatttgggacatgtaatatttgagatgctagttccccatcctactatccaatgggtagctgaatatacaaggatggagaaagggagagaaatagggctggaaatatcaattttgtagtcatccatgtataatatcacagaaagccatgggcacgaatgacaataatttaaaaggtataataatagagaagagttttaaaatgagatatgggtgctcagttcttgggttgctgggaagatgaggaagagtcgtcagggcagccaaagagaagtggcccatgtggccggtgtgcattcggcggactctgatgtcccagaagtcatgaaagaaaatgaccatgtcatttggggatgtgaggattcttggagtcgttttgaagagtggtaggaggaaatgacaggctagagtgggaggtgagcatggagagatgctgagcctagatattttttgaggcatttttagtagaaaaagaaagagagaatttgggtagtagatggtaagtgtgaagaaatatggaaggttatttacgaaataatgtaacttgggagatgctacaacaagattctgtctgatacgaatgaattacccagtatacgtcctcttattaaatatttacaaaactctatatggtaggtgttatcactattttagggatgagaaaatggatttgcaagggagacacatggtccaagacagcatgggaactggtggagctgagaaggaattccagctcaactgaacactacagtggaagcttgagtacatatacaatgtcaccaccagagtacatttacaatgtcaataaaatcattttttaactcacatctgggaagcaagatagcaccagactttgggttaaaggaaaaatctccaaatctcttattagttgaaaaaccttgctttcctttgttttgtttgtttatttggttgtttgcttgttttataagttactgatggaagagaacatcaaatattcgccagatacatgtgcagaacatttcagagctagggaggtggccaggagaagtttcagaagggagagtgaagtgaatgggcccagacacttcaaggacatggaatttatttaactagaatgtctgagtaggaataaatgaaggcagaagaaagttgaaaaattttggatgatctagttaaaggctttgaagcaaagagtgaggatttggacctgcttctctttagagtgaaagctactctgagatcaaagccataggtgaaaagaaaggttgacagcagcatggagaattgattggaaaaaggttttgatggaggcagagagtgccaaaaagaaagagtggatgtcagctcattcttctggtaagtaattacaataatgaccctatgctagcactgttgaaaactaaagattagagtccattattacaatagagctatttttacacgagaaaaaatcccaaggtttaatcgaaactgttcatactgaaactatgacaagccaattgttcctagtacttttaataagaaatatacatgttataacaaaacctatcactacaactgggaataacacagagcatcccaccttactgatggcatatcagtagcatcaccttttacataaagaaattctgtctaattcacaaaatatactatttttagggaataataaaatattagttttgttgttgttgtttggcttttacagactgggtcttcccctgtctcccaggctggagtgcagtggcctgatcatagctcactgtagtctctaacccctaggctcaagagatcttcctgtctcagcctcccaaagtgctgagattacaggtttgagccaccaggactagctaaaacaccgcgattaaaggcacagaaaacatttttacttttattcccgattagttgtcctaactgaaattttaaaagaagtcattgaatatggaatctgagaaattagaacaacagtaaattagatcctagctcttcagtgggttggaaggtgcatacttcattcacctattaagctgacatttatttatacctacagactgactgaggcaacagaaagagaaaaagtgctttttgataatacactgaggctcaaaattttaaatcagagttgaaatcatcacttcacaaagtctgctggagtgctgaggccatctgtctccttgccctgactcttgtctccacgtcagtgacagtgtgtgtagctgactgtggatctgcagatgagagggtctttgcaatgggctggtcagagaaggtagaaggtgaaaggtgaaaggtgaaaggctgaaggaatgggggaggggaggggccattttcagtctccttttctgacattactgatcatttctgatcacaaaagtaagggactccttgggattgcaaaccactttatttaaagaacaaaataaaagtcatattaggatgaactaagtaatatatttacattctacaaaagcgctcaaaatacagtctttattcaaaagcccaagtcagatggattttctcactgaagccttgctgagtccctcaactggagttcaccctcagccctgagtcccccagaatacattgtacatatattttaggaaagaaacatgttctactttctaaatttctgttaaaacataatgtatttatgtatatataaatatatataaataaatatatttttataaattgtagataatctacagaatttctataatatagaaattgtataggtataattttatatatattgtgtgttcatatatacatgcatatctcacacaggaacaggaaaaggaacatccaggaaaaacttcttcccctttagtaggattcacttaaggagaactcaacgatttgatgcatttcagctgtttgaatataacttagctactcagtaatacatatgcaagtattttaattctttttgaatcagcccaagtaagccttaggttctgaattctgccttgtgtaaatgtcacctcatttatttactaggtgcaaataatacactgctaagcgatatgtgttggcttccaagccatcagttatgggtttaaatttggaatctagaatttaccaggtatgtaatttggagtaagttaatttaatttcctaggcataagttgcctcatttcttaaaatggggtctatgcctccttggattgttgagaaaatgacatgggatgatatttggcaagtgttcattaaatggtagcctttgttttcagcatcatcactgtgatcagctgaattgctgattttcactttaactacaggaaacttgagtggaaaagtctgagtcatttatgtactcattacttcagcggatcaattccaagtaacaaagctagggcctctgcttattgtttattgtcagttgcctgaaagggaaatgtagaggaggccacttcatgtaacaacacagataactccaaaataaaggaattttatttatttatccacatttattaaaatatttactttgtaagtataaaaatatttaaaaataattaaatataattttatttatgaagtgggcagatgtataaagaggaatgtgtgaaaatgtatagaaaaaggatttatcttataagtacctcatttttaatgagactctaaaagaaacactcaatctattctaagaaaaatatagtaacatgactatcaaagaatcatttattaaaagccttcagcttcaagtgggttactttttaaaataaatgattttatttccaattaatttggaggtctggctgggaatataaaagaatattattgtgttgcacaggcttagaaatcaaacaagtctggactgaaatcatgacttgctatttaccagctactcaaactttcttggggtcagtgtccttatttataaaatggaggcaatattagtatatatttaagcaaatgtctgtagagattacaggaagcaggtgaggtacctaaaactacctgagacacctagttcttcactttaagggttatctgctttgctaatttctctcacactataagcagctagaaaaatagagaaacaactgttttctgactgtctcagtctgttttgtgctgctataacagaactcctgacactgggtaaattaggaacagaaatgtattggctcacagctctggggactgggaggtccagtatcaaggtgctggcatctggcaaggtctttgtgttgtgtcatgacatagtgaaatgcatcacatggcagaatggcaagagagagcaaagggggctgaacttgccctttcataatgggtccactcctgagataacaaacttactctaggacatgaatccactcatgagggcagagccccgatggcttatcgcctcttaaaggtcccatctcttcacactgttacaatggcaattaaatttcaacatgagttttggaagggacaaacattcaaaccatagtggatatatagaagttatatatataaaatacatatgattggactgaggtaatgcgggactgtgatcccgacgtgaaggaaacctacaaagatttggccttgttagctatagcagaggaagggagacaccaaacaaagcctagaagtctcggtgaactggggaaccacaaatcgaagtttagggaggttaaggaaactagaattttcaggacacaatacctaaaagaagtgacttgcacagagagagttctggaaatttgcggatagactaccttgaatctctggctgaatattatttttccgtacatgcatggggttaacaattctcaaagctcacacggaggtgggatattttgcattcccaccagacagagtggagagaccttatggtacttgaggcatctggtagagttgccagaagactactgtcatcatggtggggctaaattacccatagcattatggctcttctggatgccccagcaaagcataaaagcaagtctcaaaaggaattgatgtcgactagctcaactgttgcctgcataaagacaaactttttttaaacagaatgctacaaaatccaccacctaatgtacaatgtctggaatctagtaaatcactatgaatcgtgcaaagaaacataaaaataggaaccacaaccaggagaaaaatcaatcaattaaaaaagatccagaaatgacagagataatgaaattcatagtcaagaatatttagctactattacaaacatgctccatatgtccaaggaagtagagggaaagaggatcatgatgaggagaaaagtgagtgttgaaagtctcaaatgtaatatatggagagaaaaaaataccatattttcaataaagatacactagagagattaacaattgattagataatgcagaagggaaaaaggcagtgaatgtgaagaaatagcaagagaacccattcataactcatctcaccaagaaaatagggccagagtatcagtgacctatgaagcaataccaagtggtccaacacaggagaaattggtgctgcccatccaagcaaggaaataacaaggggagataaagcaaagcttgagaatttttagaagttggaaggtaactaagagaaagcaagagtgggggctaagaatgatggaagacatgatcgatgccttcagtccttccttgatacccagagatgggccattacctccttaaaaagaagtttaaagtaatgaaactcaatttgacacaatactgaaaaatggagttgtattcatgcatatattgtacattttgctgtcactattttaggggatggtggcagaaaccaaaggaggctcttaatgcctttggcatcaacaatggtgtttccttggcatctacactaacacgccttaattaacctatcaccatcttaagtccttgtagattaaaattgggtgaaaatttttagaataagtatctacaaaaatataaagccttcccttgaagagcggacaactgtggaaatatacaaagaatggaaaaatccactaacaagtgacgtgacacagaaagacgaatacaggcacagggaagagacaatttgaacagaggcttatgaggacgtcgggtgtgggaagggcccactgcagggtaaagagaatcagcatggcagtatgatggaaacacacccatagcactctccacagcatcacagtcatctccatgtatgggccatggtggtcagtttgcctaaaactagcactgggaatgacagcttgttctcagcttagctgtggactcacactgagagattaggtttcataaagcagaaacgtacatcagcctcagaggacatgagtaaaaagtataaaaacagacccgcacctatacataggaataaaatgaagtatctgtaggtaccagttgatctgaaatggcccactccaacgaacagaaggtgcctgcctgcaagcctactttgagttgttttaaacattatgaacctgacagagcgagactccatctcaaaaaaaaaaaaaaattatgaacctgccaggatactgaataaatgctacttagtacaaatgtccaaatataggaaagtccattatatttttggaaacttaatgtcaccaatgacttcatttattaaaaaggcactctgcatgtgagataaagttgggtatttgaatgattttaagtcactaaatagttctgtgaaaacagttcagcagaattagctattagaataaaagcattgtccttgataatatgattctgaacattcaattggggattgcattatgattcagttttcgcactctaaaatccaacttcccttttagtttcctgtttaaaattataatttctaagactaagagccacaattgcccttctagccttttgcttttcatgataatttagaaaaaaaagaaattgagaaacatatggcaggtaatcatttgcaaacacacgactctttcaatgcctgccatgttcaacttcattttatagcatctatcttggcaatataaattgtgtttggctgcagaggtatgcagtgcagtacaatgaagaaaagcaatcgtgacaactgaaaaataaacaacaaatgtgtgtttgtgagggagagaatgtgtgtgtgtatatgtgtgtgtggtttagacggcaccagctctctgcttttccggctttcttccaaaggggaatggtgttattttcgttggtttccttgttcccttttacagcaaagcaatgccactggaggaaagacaattgccacatctcagagggttgccaaatgacctcaaaccagttcaaaaggagcgccctcaccagttccacaaatgaaagcaatttaatgcaggtggattgggtcaggaatatttactattataaaggccatgttttttgaaacaagagcctacattatattaatttttaaaagtggtagcacaggaagactgtaagattatttatgatggccgggtgcagtggctcacgcctgtaatcccagctctttgggaggccgaggcgggcagatcacaacatcaggagatcgagaccatcctggctaacacggtgaaaccccgtctctactaaaaaacacacaaaaagtagccaggcgttgtggcgggcgcttatagtcccagctacttcggaggctgaggcaggagaatggcgtgaacccgggaggcggagcttgcagtgagccgagatcgcgccactgcactccagcctgggcgacagagtgagaccctgtcaccaaaataaataaataaataaataaaaataaaaataaaaaagattatttatgatatagtgactattcagaatgaaacatgctagcatactcacgtttttgtaaactttgactttcatgcaacttccccaaaattctctcaaaagtaagttttctgggtttttaataaaaattatcaaaagtatctaagattcaaaactttgaaagtatataactaagccttcaaaatcaaatcaaatttacctaatgctttatttttcaatgggttttgataaaccaagttaaatatatttggaatacttcaactgtgcaatctacagtttaatgtattcagagacattctagctcaaataagtgcagtcacttgtcttactgttcaattaacattcaaattaaccatttaaatttcaacatattttgctttattgattatgtattttaagacaacataaaaatgaaagaaaacatgcttgatttggaggcaatacatgcaaattacccatggcagtcaatattggtaatagagaaacttaaaaagcatccagttgatttcaaataaatgtagaatactgctatatagtatactttgcataagtggtatatactgttgggaagtagggggagcaaaagaagcttatgtacatggagttaacacacacgaagagcaggtataaagaaatagctgcccattgtcccatttgatggaagtagcctttttccctagagaagaagcattaaaggagagtcagtctaaccaggattatttgtgtgttatctgttctgaaaatagcgcactcaggcaagatgatcaccaaaacctttccataaatatagtctgcaatgcaccattgtaagctgtcccgtttactattttgactcatattaaatgccaagagtatgtaaacacatgatcacttatattaatatccatgcataagctgcttaaaagattttagttcacaaaactcagatacgaaactgcaataagtctgaaaagcagtaaggcaggagagaaggagagtagccaattaagaaatggatagaaaaaaaatgaaaatgcatagtgagaaggggtattatactggctaaatgtacaaccccaggtcatggggttacctgcaccagagaattccagatgctagccctggctcatgcagcacagatggcagcccagtggtgaagagcctgcatccggcagtcagacttcctggctccacatcctgtctctgccaggtacttgatgtatggctttggtcaagtaagttaaactctctctgcctcagtttcctcatttgaataatggagatgagcatcgttcctccattataggcttgttatggagactaaagcagttaatgatcataaaggtcttagaactgtggtgggaacatagtaagcgctatgtgtctcctagccgaatgaccatcctgaccccctggattttttatttatgcaataaagataacaacacagacctcaaaaggcacttataatcaaattatttgagttaatatttgtacagcattgcccacagtgaccaaaatagagtaaacaaacagtaaacagtaacagaatcagtattgctttagtgaagaaacagctaagatttaataaacacctaccatgctgagcactttacattattaattcattttatccgctaacaaccatgtttgaggtagattttatcatcatctctactacaaagatgggaaattggaaacaggtaaataataatgataaatactactagtctgaggaaagctactagaattgaataaaaaattacttataaaccaaggcaatcaacctaattaattagcctttggactttttctcagttaattcccaattttgtgactgaattggtcaagatgatttgcagtgttggcacgtaatacatggccaattgttctaggagatgttctttatttatttatacatgtgagaattactgaacaccttggcagaggccactagctagttgtcttggtgatacatatttttctccttcttccttgttgagtaatgagatatttaaggtggtaaaatggccacccacaacactagatttccaagtctcccttgcagctagaagtatcattgactaatttctggctaatgaaatgttggcagaaggttaaaattattccttaaatgcaaagaatgaagctggctggtacgagtctttatcagcaattctcctttcttcttcttgcttgcactatggacttgatggctgatgtgccatagaatgtcttggaccaagaggtgaccttgggaaaatagccatgcactataagggcaatgaggcagagatcctggttctcagtggtgatacatggcggctttagactacctatgaccagacttctactacagagaaaaatgtacacttctgtcagctttaaaatcactggaatttttggactttgttcctagcaggtgaatacaattcatgctgatatgagcagccatatgaactgaacatcaagggcaaacaagatacatttgaagaaaataagaatgcaaataattaaatgcaataaagcattgcacatattaggtaataaatagcacagggtataatgagattgcccaggagaaaagtgtttattctgtctgcatgggtttcttagaggtgatgaagcttgaattgagtcttgaaaaatgagaaggcatttgattcaagaagacaggagtgaagcgacgggctgcagccattccaggcacagagaactcatggggaaaaagtcacagagagatatgagtaattagatatttctgaatcaaactgttattagtcattagggtcaaaaatatataatttcatacagaacggatggcatatttgattgaataagacattataaaaattatctggctcatttaaagaaatctacatattcttctccatgtaatatgcttaaaagtggttgacacttaagaaggcaaagaaaggggctggtgatgcggcttgctatcacaggctctctctcaaaatgtaggtgctcactaccccagcttgaccctgttaccgcgcacacttggttgaggttaacaaagcgcacttggagagaactttaaaggcaacctttagaaaagcacaaatctccaataaattaatattctcccatcatgataaaaacacataaaatatgcaagatggattttaatattcatgactcacatctttcaaaagattggtgagatatcaaatgtgatacgataacaaaaaagcactttgtagaggtgctcaaagtactttcagcattaatgaattcttataatacccttgtaagaaagaatggaggcagagattattcaccataacttacagatgagatcgaggtggaaggatgctgtcagaagatcagctggtgtaggtttatggtgctccgagccttcctgggagctggcttccctacaatgtctgcagtaggtgcacacgaactgtaggacctatggtcacaggcccacccccaggtcaacctttggttgtagcttcaccactgcagagggggcataatgacagcttacatagttgatttcaggaacttttggtagttctaattgactgctgagaattgcaccaatttttagcttggcatgagcaaaaagcaaacagcttgcttgggttgctaaccctgactgtaaagcttcggcacagtggaaagtctcacactgacaggccttggtgagagaaccacatttgctccttatctagtaacatttaaggctacggtggagtgaaacgacgaggatgaacgtaaaaggcctagtacattaagggatgaggagcatagcaccaactcatcatttttagttcccagaacttaatcaaggattcaggctttcacacagaactcccattggtcatttctttttaatcactaattataagagagatcacagattaaatttccaaagaggaaaaatccctgatgacttcctgtagtcaaggtattcacttcaacgcaatttattacggaaattgaactcttctgatgatgatgggtaaaaataaccttcaatttcccttttaggtgtgtagacatacaagcaatccccacttttctcagctttgaattttgttgctctcagggtttagctgtttaataaagacctggatgtcaacagttcgtaccagtgttcaaacagataaagacaatacattcagaataaggatatgtagaataaaacacagggatttccccaaatggtgatttgggtggtctggggaaattgttcttttcctgtaagtaaggaccatctcattattttgtgctaagcataatgtcaggcccactgtgcctgggaatatttacacattggggggaattattgttgctagtggagagtcttgcctgcaagttgtccaggttcttggtattttgaacaaagaattagacaaatgcacagcaaagcaaggaacaaatgaagcaaagaaagcagagatttattgaaagcaaaagtacactccacagtgtgggagtgggtgaagcagcagctcaagggccccagataacagaatctttttgggtccaaatacccccagaggtttcccattggccacttggtggacatctcatgtaaatacagtgttggcccgcaatcagcatccaggtcagcttggctgcagaaagcaaccaatcaggctgaagtgaagttacaaaggtcatactcctaaacaaacatctgatgggcggcgaaaagcaaccaatcagaggctaaagttacaaagttgcacttctatgcaaatgaagacttggcctgtaatcagtctgactggttgcagacagcaccaatcagaggctgaagtgaagatacaaagtgacactactatgcaaacgtactttcaatttcccatctgccacacagaaaaggttggggtttgcaaagggagtagcctatggtccttttgttactcaggtgtggaatgttggggtttttgtttcaatttagttctaggaagtcagtgtgaaacggccttaggatccctgcctccagaccctattctcccaactgattatctctttttctatatagcacccacgtagccatccagcaaacatatgctaaagatagtagactagagatggacagtctggcccatgacgatgtcattgaacaatttagttatccaactccaaagcctctctacctctgaactcagtttataatcttttgcatttttgggggtaatatccaggtttgttcaagtgtgctgtaaattttatgttaacaaaacctaccttccctttggaaatcatgtaagaaaactaaaaataaatgtttagtaaatatatatatatatcgatagatagatagatatactaaacatatatatatacgtatgtatatatacacattatatatatataaattttttttttctgagaccgtcttgctcagtcacgcaagcaggaatgcagttgcaccatctcagctcactgcaagttccacctcccaggttcaagtgattctcccatctcagcctcccaagtagctgggactacaggcatgcaccatcatgcctggctaatttttgtgtttttagtagatacgaggtttcaccatgttggccaggttggtctcgaactcctgacctcaggtgatccgcccaccttggcctcccaaagtgctggggttacaggtgtgccaccacacctggcctacattctttttattcctcctgggctcaagtgattctcttgactcagcctcccgagtagctgagattacaggcatgggccaccacttctggctaatttctgtatttttagtagagacagggtttcacagtattggtcaggctggtttcaaactcctgacctcaggtgatccaccggcctcggcctcccaaagtgctgggattacaggcctgagctaccgtgcccggcctttttttattttgtctaaaaagatgcagggctgggtccggtagctcaggcctgtaatcccagcactttgggaggctgaggtgggaggatcacttgaggccaggagttcaagacaaggctggccaatatggtgaaacctcatctctactaaaaacacaaaaattacccactggcgtggtggcatatgcctgtagtcccaactactagggaggctaaggtgggagaatcatttgaacctgggaggtggaggctgcagtgagccaagattgtgccactgtattcaaccctgggtgacagaggaagactctgtctcagaaaaaaaaaaaaaaaaaaaaaaaagatacaggatcataccacgtctatgttggctacttccaatctctttctttagttgattttgtattgatgttgcaacctcaagggaacaaacacaggacattctcatgacatctgacacaggaaagggattagcaatgaatgtgacaatgtgaatatcatcttaaagcagatccagcctagtgagttcttctcagcattctggacaccctactaaatatgatttcatgataccttacagatttatattttttctttataaaatagaaagtaaactttttaagactgaatggacttttcattttaaggtgcagttagtatataaaggtaagggaagggtacttccaaacacaattttaaagtcatactcttaaaaacgatattagcaataaccaaagagatcatttgtgaacatctcgtatacagctatgataaattgacactcacagaggcattacagggttataattttaaccacaaaacattcaatcaaggtaattatattctacttgtccacagaaataacttatcaataaagaagtaatgtagacagtcatgaacagcataaaagagaattccaaggagacaaaaattacgcaatatttctatgcgaaaaaattacccagagatgtcctcagccccaagtcgacaaccagcatggaggaccctataatgacctgtctcagtcagctacatcagggcaccatagttctggtaacatcactgcttaacataatccagttgactagccttgtagattctgtgcctataaaacaaccattggataacaattgagctatccaaaaaaatttatctataagtagagaatgtgctgatgagtaaacattagtatcttctccctttgttagttttggttcttattctactttaaccaaccagtattccaccttttaaacagagttatctgatgagtttgaccctcgtgattcagctctgcaaaggctgatgacttctgaattcaccagcgtttgggtttccacgcctaagagcttgaaaaaaaaagactttagaacatggggaccattctgtcaccagtgagaaaactaaactatcaagattaagtcatggagattttgaggtccctgtcacagcagcataacttgtagcctaattcacatatactacctcattcaatccttaaaaggtcctatgcaggtagcacaaaaacaaaaaaatagtaaagtccaaggtgatataagccagattgaaacaaacaaacaaacaaacaaacagtgaccacatatttaaaatgtggaaaaaagcctaaaataaaggaataacatctaagcaaaggcctgaaagaaaaccataatatgaaatatatttttagtcttccctgcaaagagccaaagagctttgggcagtagaattctgagatgggccagcagtcaggaaattaggaagttctcagatacaagacaaaaagttcaaggatgggtagaaattgaaagggaaagaaaagttataataaagcctccttttatactttctgacaagacaaaaattgacattcttttttagacaattgcaggttcaagtgtgtttacaagtatggttgctcatatgtgtggccagggtgggggtacttacgggacaaacagattcttctcattcattcatacttaagatatggatttcttggcacaaatagggtagtgagaagtgaaatattactacaaccctgtgtctgcgtctgaccatttctgcggctgtcaccatctcccagtaggacaattcattgttactttgcaccttcaaggtcgtattagagaagaggcaatagccaggaaggctagctaggccttaaaatattgatttattttatttataaaataaaatataagactttactttcttttttcttcataatttttttaagacagggtctcactctgtcacccaggctggagtgcagtggcacaatctctgctcattgcaatctctgcctccctggttcaagtgattctcatgcctcgccctccctagtagctgggactacaggtgtgcactaccacacccagttaagttttgcatttttagtagagacagattgcactgtgttcgccaggctggtctcaaattcctgacctcaaatgatccgcctcttccagcctcccaaagtgcagggattataggcacgaaccaccatgcccagccaagactgtacatttttcaaagtaaaatcaagtcaagatggaaaccaggaaggttgccatcctgtactgttaagagcaaaatgaaggtcttgaggccaaaaagtgagtgcagacactctaagactccaaagtctccagggtctggtagtttcactatcaggggccagaaatgcagaaataacccgatccttgggctaggaatgcgcaactgtctagtgccatggtgagggactgcagccgtcagtgtcactaacgtggaagggcgaaggcagtcaagagacggaaagagggtcttcaggaaatgatactgatgaagcaagaacagggggccaggattctagaggtgcagcaggatccaagtttcctgataaataaacccccatgaatgaatgttttgtcttggaaagcactgtatggtataaagactctacattcctgcattttgtcacaggcctctaaatccccaacctagagcacctggacagatctcacttcttcacatgcagattcctgaattcagtaaaaaagccaataggaatttaatgacctcatttcgtagtaatattcccaataccaaacacatccactaccatcgccgtgtctttttaagaaaataaatatgtgagtaaatacagaaacagatggatattttaaaaatacctgacggacaacaacagtgaaaaggatcggtcacagcaataacttaagtgtgggctaatctgtaatggacatatgtatcctaagaagacagtggcaaaatgtttctgatgtgaatttaaagtgtctgagtttgggggccttctctgtttctgctcctgatttatatgctgtctccagagcatgagggtacaaatgatttcttgagggcagaatcttcctctgctcccgcacacaaggctttgttaccgcagggctgctctagagcacagagcccctggcaggattcgtctcaggtgaaaagaacatcaaagctgttactttgaaaaagacgcactccagaaaacgcagcacagtatggattttgcaacagatctcacaccggggaaaaataaatccagctcaattatatttgggtcctgcctttacaaaggctcattaacctctaaatcattcaaaagatgtaaaggaagagcaaaacgaactacagctttccctgccagcttttttcaaggtgaaatattcttggtgtttgggtacctggaaaggaagaaatgtttaaggaactctggttctctgatattgacacagacaggaaattggatgtatttatctattttaaggaaactgtccagtgttatttattctcccccaccaccccacatcctatgaggtgagtcaagcaattattgaacctcaattcatggtcgttgaatactatgaaaaaatgctcaaatgtcacctgagactgtgggctatataatacaattgagtttctaataaaagtaaaagagaaattggcaaagcataggaaagccactagtgaagatctatatgaggcaataaagacagcagggacgatcctaaattaagaagagaaaaaagggaagaaaatcagaggccgtccacaatactgaagaatgtaagaactgaagatgattcagcagatgacctgaaatttcctctgtcttgaattttcaagaaacagaatgtgctctccacactcgtaagtgggtcagagggtgttcccactgcatggatgggcaagctggctggccgagagtttgtctcaaggtttggctccatcagacaaacaggtgcaccagcatttccctccaccattcccaagggcaccttcttagaaaatgaaatttcatgctcagtcaaactttagaaacatatgatttaaacatatgccagtctctttctacatatttgcagcttcgcaattcttcacctcccagtccctttcttaaaatagcttgtggttgaagctaaaatgtttagttgaatagtcatcttttcctcttcttatctagcctatagaaatctctcatgaggaaactgagcagccacaagaaaactgagttagtgacgatttataatgtgatattttgatgcctgagactattttcagaattacaagaaaattttccttttccaaacacacagtcttccagaaaaaaatctaccatggaccataaccaatgaacactggctgattcacgtcttgccagtcccactttaagaaaaagaaagagagacagggtatgtgaaaaagttataaagataaaaatatcttcggaggacataaggtaataatcaatttttttattcacatagggtaagaaatcttttctataaggtgaaaagtgtaagagacataaactgcccagagttacaggataattaatttacactgattattttactaaaacacaaacatagaaagtgcttgtgaaaaacattatttagcaaaaaaaatcaaataattataatgctttatgtacccttaaattagcagcaatccattacaaacaacagattttatattaagggtcccacatgagcttctaataacaaaggtcactttttactaagacataacttgtggctgctcaacagtagaattggaaagaaaggctcttctctgattttaccttcccaaactgatgcatgccaatgaaataaaacgttatcctgccaaatgcaagcaaccctgggggagcttttcattgattaagtaaggtcttattgtgattggctcacatcgtttcctagtatttcacaatgtgtgtctcccaaattttccaaatccttcctaattttcatccaaagtcacctcaagcttctagaaccagtggaactactgttctccatgacacccttcctgaatagcctacctcaagctcaccaggcccactcagccacatcataacttccatctaactggcccgctatcatttctctataggtaagccctatctcctcaatcaaggtcattgaaattaagtgaaaatgattgaaatgaccaaggcatcaggaacagtagtttacagttcttccacatgcatactgcaggaacacaatataaatttcatgataacaagtgatcctcttgggaggaaggaagacttggtatctgccaggaatatgagtggtatcagccccagaagaataacaaggtgacggtgaggacacacaagaccaatttcccaatattgtcaaggagagtgtggtctacaaatgaatagaaagcagcattttaaaaatgatatagactcaactaggaaatatcagattgtatctcatagaaagagtaaattgtttgctgaaatctttgtttcagctacatatatgtgtgtgctggatcatgatgtgaaatctatttcttactctgggacaaggtcagagaggtttaaaatgcactgctttaatttgtctcaaaatgtgttccacaaaaaagcagttccaccaatgtgacctgcagaaaagggctccaaagtcgatgatgttcaaaaatagtagattaaaccaaattaaacagatattttaaatgcctgaattaccagggcttttaaaacgttaatatgatcacaagtgttcaaggctagaaaatagtattgatgcaggatattttcttgaccccttcacaggacctgtgacagagctgtcccgtttactcagcccaccatgctaaacccctcacaggagggagcgtgcaagtgagtgcaggaacaagcctgctccttcggcaccagcaggaacaaactccaattactcacttgggcctgctgtggcgcaccccttgcgggaaggaacgtgtagggaagtgagtgcaagaaatggtcagctgctttagccccagcaggagcaaatcatgtgtaggccctgtggcagcatccaggtggggctgactgtgacccaaaggcctcagagggcatgttacaatgctctcttaggtctgctgtcagcagacaacagtgtgttatcagttcagcgggccctttgcctcatggagtgcagtggcttccctctgccagtgagggcaaaggggcattataacagccttttggggtacccgcacttgttgggtcctgaattcttgtctggtacactggaagaataaggttacctagacaaatggaaggatgattaatgcggacaattttattgagtgatgaaagaggccctcagcagagggggagctggaaaggggatgggaggggaaggtcactgtcccccgaagtcaggttgtctctcttcctttctcctccgaggccaggttgcctctctatgacattcagcagtggctcagaagccaattcacctctccccaatgtccagccatttcccctctctaccagctgagcctggggtctttataggcacaggatgggggtgaggcgagccataagtagtttggaaagggcagcattcaattggtaaaaagacattattcagaaagaagtactcgggagagagcgggtaagcaggggtagaagctctcactttgggccatgggttcaggctttttggcttaaaggtggggctttgccagggacctgccttgtctgccaagagtttctctgcctcctgtctccatcagcataaagctcattctaactatatggccatgaaacctagggcaggtcgaggaactagcctctctcccaccacactctgaaaaacagtggtcaaagccagtgctgctgaagacacccgcatcgcctctgcatttcctgtctgatttcccctctgacatatgaccgccctgcacagcaaagcccattctagattacaggggagtgctcagtaagcaagaaaaacactgagaacatctgggagaaaaaaataataagaaaatgcctgaaaatttggtttcatgttataaggaatggaaaattcatttcaattcagtccccaaatctaatataggtttctcaggggaccatttgtgaagtagatgtgttacaataaaaaatgttagtagatcaagaaaatactgaatggcctacactctagtgacactagtacaaaaggagaaaaaaaaaaaaaaggaaaagaaatgagatgaagtgtgtttaaatggcacttgcccaggtctggttattatcctcagcatctgttagttctgctgaactgcatttgccttggtactagtcactaccattaaatttagacagtctaaaataattgttatatgaaatacaaggtagataatttgttatttaagcatcagaaagtaaaagagcatcaggtagtaaaaataatcaaaacaattcataatattttctttatgaactcatgtactctttcttaataggaagccatgatttttattttttatatgaatgaaaacttgatacacatatattttctttctttgatagatattctctctcaccagtataaaaggaaatagcttaattgaaaaatcaggttaccaaaatgaaggacattaattcaactctggatttcaggtgatgcaaaaaaaaaaacaaaaaaattcaaaaaaagcacaaaaaggactctgaagataatttatgtacttttcagcaaaacacccacaacatgacttctagactctatggtaaatcaaagatggaaaaaaaataaaacctaaaaaaaaaaacaacaaaatgacttactcagctgtttccattgaaaaattacttcccattaggagatgaacaaaatgcagcatttggttaatccctggcagtggcttaccattctcttaatactttcttctgcatctacacagttcttagtcagcacatatctgatattttgccatattgctattttaattacaaaaagctaatcaagtgaaaactaatttaaataatcaagtaagtcaagggcaaattaatcctgattcgtctaatacaagtttattacatcaaaatccctatctactctcatcagagaatttgggattgtagttgaattttctttttaagcagcactatgagactaccaggaatacagacagaactactactgaatttcaacatcagagacagcaagcagaatatcatagatacagacagaactaacactgaatttcagcgtcagagacagcaagcataatatcatagttttataaaagtgatctcagaacattcatagtaaagtccatcaagcggaaaagaacagaacagaatggtctcaaagaattaaaatgttgactattaatctcaatgcccagaaaaacttgccttcatccaattctaaggagccacttttgaagtccatcataaaagccacattctgtaaatcttgacactggctcagtgctcagaaactttcagttaagaaaaaaaaaaaaaagagtcaagggaaacacaaatttggctaaagaaggaactaaaaccaaaacgtgataagtgattataaaaccattttcaataagatgcatagaataaggtacaatgtctaaagaatgcaaaaggatggaggagcccagggcaacttgcttctttaaaaccatttgatttcttccaaacagacaaaattcagggaaggaatagtggaaatgaggaaaatgagtcataaatatatgccttcacccacatctcatgtttccttggttagactaaaatattttaatatttacatccctatgtactgtatatatatttttgctatgccatcataatcaaaacaactaacacagcaatattggataccaatgacagtcaaaggccactgaataggccactgaataatggaattgtatccaatcgtccaaaagtaacattacttgatgtgttagtcagggttccctgaagggacagaactaataggattgatgtatatatgaaggggagcttatcaggagaactgactcacacgatcacaaggtgaaatcccacaataggccatctgcaagctgaggagcaaggaagtcagtctgactcctaaaacctcaaaagtagggaagctgacagtgcagccttcagtctgtagctgaaggcccaagagcccctggcaaatcacagatgtaagagtccaaaagttgaagaacttggagtctgatgttcaagggcaggaagcatccagcacgggagaaagatggaggccggaagactcagccagcctgctctttcattttctgctgctgctttattatggccacattggcagctgattagattgtgcccacccagattgagggtgagtctacctctcctagtccactgacttaaaagttaatctcttttggcaaccccctcacagacacacccaggaacaatactttgcatccttcaatccagttaagtcgacactcaatattaaccatcacccttgattagcagacaatgttctccccctttgcacacaggtggaacagagatggacatcacccatttggggtttgtaaagactccagaccatgtggccctatctgggagcctgatttgtctaagcatccccttgacgttaggcactcaggtcatctcaagcatttccccattgcaaatcacattttatgaatacctgtatacatcaatctttccatttctagttatttcttcatggaagaagtggaataaagaactgagttaacaggaatatttttaatcctcttgatacattttaatctggttaattaaaaaaaaactactggcaagccacattttgccagtattttgtttttcctaatctcggattaccttcctactctttttagtctattctcttctcctctgcctcttccccaccacacccctgtaccctgtgctccagctccaagaacccttcctgcacagaaaagacaggatggcactttgcccttccatgctagctcctggctttgtttcattttcacatgtagtgccttcatgcccttctcctcttgctctctaactctcctgattacccccaccgagaatggctcacttcctcatcaaggttactaagtgttctgttcatgcctcatttgtagcaagcacaatttacattttctagaaatataaatttgccaaaaagctgctccagctgaaagatggtctctaaaagtactgacaaaaatgcaactggtactgcaagaccagagcttagaaaatgcttctgcacataaaaggcactctaaaggaaatgcaattaatacaggggaaattcaaaagacatcttaaatggcctcaattatactctttcaggataatttataatctgctaatgataaaatgcagatggcggactatattaatttcaaaatgctctaccgcagttttactagatatttctgggactataatgcaaaaccaacccaagacacattcagaaagacttctcattccctccaactacagccaagttgaattccttactcttgttaggcatgcatactgtggatctcaggttttaatgttctctgtattttatcaacagcttgtcttccataataataatactttcagtcctctggtctcaacattttgttgcaactttgttgaaacttcttaatttaatatctgaattcatattaaagccttctatgtttctttgagattatttttttgctgggagtctgctgttttcagccacctatcagaaggtaactcatgaaatagagtataattgtcagggtgcgataagtttttggcatattttctatgtaactgataggaaatataatacaaggctgttaaataatgaaaattttaaaaaggaataccattaggaaggttttctgtttgggtgatggatgtgatctatcatatagttctaaataataaattcagttttctgtctcaacggttgttctcttctttctcctcaggaaatgttacacgctgagcctctgtctcccagaacagtgctcctgaatattgaaaacatgctgcccagatctttctttcttctttgacaaaggctacttatcttgtagagtgtaaaagaccaaagctttttgtttgtttgtttgcgtttttttttttttttttcttttggtttgtttttgagatggaatcccactctgtcgcccaggctggagagcagcggcacaaacttggctcactgcaatctccgcctcccgggtttaagcaattctcctgcctcatcctccagagtagctgggactacacttgtgcaccagcacgcctggctaattttttatttttagtagagacggggtttcaccatgttggccagtctggtcttgaactcctggcctgaaatgatccgcccgccttggccttccaaagggctgggattacaggtgtaagccaccgcgtccagctgcttgttcctcttctgccttcttcctattcctttctttcctcctcccgccttcatccaacacggtttgtggtccatgttacttgggactattataggcttcaaacgagtctcgtatgagcagtctctagtccatattccacccctgtagctagtgcgcccatgttaaagctctatagtgttcacattactcccctgttcatgaatgctcattagccttccactaactaccatattaaatcccatctccaccttggcattcagggccatccacataacgctaaccctaagcctagtcagagcccatttacttgtgtttgtacctcctattgtcctcccacactcacccttagagcccctctggaccaggctctgtgtcaaaaacaccaggtgatttgcttacctttaggcctttgccttgcctatctctatctattaaattctgccgatcttcttatcgtaaatactgttttctattgactaattatctatgagaatcacacagatactcatacgtgagcattgcttttctaggatgcaacagaacttaatgtttcttatagacctggccatatttttcttttttagtaagcttttctatatattagcaacacacacttggcaatttaattttaaaaataacatttgcaatacaatcaaaatctgatctacttagggacaagacctatagactgaaaactagaaagcactgctgagagaaattttcagaaagtcctaaataaaatggtaagcatgtcttttacaagtatctgaaaattcaatattgttcagatctccccaaacagatctatagttttaatgtaatttaaatgaacatctcaaaaggcagatttctttgtagaaattgacaagaaagttctaaatttcataagggaataaaaaggacctaaactagccaatataactttgaaaaagaaaacaaagttggagaacttctgctacttttctttgagttttattataagttacagtcatcaagaaagtgtggtattagcatcaggacagaggaagagatcaatggaacaggacaaacagtgcagaaacagacaaatactaatctgctaatttttggcaaaatgtaagtgtaattcagtggagaatggacaatattttcaacaagtggctctggatcaattaaattgatctgatctatggcttgtaccttgtaacatttttcatagtcctaaatatgaaggtctagaaggaaaccaagaagatttttgtgaccttgaactaggcaaatatttcttgaatgtaacaccaaaagaatgatccacaaaagaaacattgtataaattggactttatcaaaatttaaaacttctgctctttgaaagacatgtttagggaatgcaaagacaagcatgcacagactaagagaacatatttgaaaattataaatctgatgaagaacttgcatctagactctataaatacttttcaaaactcaataataagaaattaagctacccaataaaaaacaggcaaaagattcaagcagactaaattttaacaaataaaatatatggatggcaaataacaacaatcactgatggtcaatagtattagtcattcagaaaatgcttattaaaattctagcaaagcaaattatagtgacataaaaccaagctgtgtttgcctacaaatgatgggactagaggagtgaaaggaagggatggctgaatggcagtcggagactttcctggttctggacatgttcattatgatagcagtgatagtttcacaggtatttacagatatcaaaatatataaaagcatatacacttatagcactgtgtcaaactatacctcagtaaagctataaaaataatcatgctagcaatgatctccatttttcaagttagtaaaataattttcagaaaaggaaacgtctgcatgtgtgagagagaaaaaaagaccacattagcctaaaaacaaacaaacaaacaaaaaccctgcctaaatcagatggctgtcctgggactcaaggaactgtgctttaagaggggactttctcctgtagtcccagctactcgggaggctgaggcaggagaatggcgtgaacccgggaggtggagcttgcagtgagcctagatcgcgccactgtactccagcctgggcaacacagagagactccgtctcaaaaaaaaaaaaaaaaaaaaaaaaaaagaaaaagaggggactttctatcaggcagagataataaaaagcactagtcaaaggaagaggcaccttatgcagaaatcactgtcataatccttcctgtctataggcaaggatggctctggaccaccaccaccccctgcattctaatttgagagtagatacactactccaacccttagggtctttcttgggttctaagaacactggatgagaaaatctagctaggatcaggcacatctatagcaaagctcacaggtttatccacaaaggccagccatgggctgaccacgtgagcattctagggatgcgatccccagaaatctaggtcacagacaatcctctggaaggtacaaagaggacactggagcaggagatgtggtgtccagcccagtaccccctaggaaggccatgtatgtcactaaaggatgctcacttaatacaggcagaatctcatcttctcagaggtatagcagccctcccttatctgcggttttactttccacagtttcagttacctgcagtaaattgcggactgaaaatataaaatgaaaaatttacagaaataagcaatacataagtttggaagtgtgcagcactctgagtagcatgatgaaatctcacgccaccttgctctgtcctgcctatgatgggaatcatctttgtccggcgtatccaccctgtttctgcagcctgccattgttcattgacattgtctgctcctgacattgaaacttgaacatgctcacggctggatgatccagaatcacctgacgcagataatcctccttctgacctaacactacgtcacaatgcctgggccgttcaccttgctcaatccaatcaggtaggcattttatcaacgcaacataacaagaagtgcaggtatggtaaaataagatactttgctagagagaccacattaacataacttttattatccaacatattgttataattattctattttatgattattgttgttaatctcttaccgtgcctaattcataaattaagctttgtcataggtatgcatgtataggaaaaaacagtacagtttgtgctctgtatccacagattcaaccaaaagaaacaaaatgataaaaaagtaataaaacaattgaaaactacaagttgaagaaccaacacagtataaaaactatttgcattttatttatttattcattttgagacagagtctcactctgtcgcccaagctggagtgcagtggtgcaatgttagctcacagcaacctccacctcccaggttcaagcaattctccctgcctcagcctcctgactagctgggattacaggcacatgccaccatacctggctaatttcaccgcacctgaccttacatagcatttaaattgtattaggtaatccagagatgatgtaaaatatacggaaggatatgcgtaggttatgtaaaaatactgtaccaatttacatcaggaacttgagcatcagcagattttggtatcggtgaggagtcctggaaccagccacccgacagacactgaggcacgactgtttgtattgggtttggtactgcccaaagtttcaggcatccactggggatcttggaacctatctcccattgacaagagggaactactgtaaccaagaaactttgattaacaagagaaaactgtatggaaaaattcactaattaaatgataaacataatttacaatataataccttcataagacttttctaactcatatgcaaatagtaaaaatacacaaaacaagcaagaatgcaaaaaattttccctaaatcttaccaatttgcattaaagaaaaatttctggccgggtgcggtggctcatgcctgtaatcccagcactttgggaggccgaggcaggcggatcacaaggtaaggagttcgagaccagcctggccaatatggtgaaaccccatctctactaaaaatacaaaaatcagtggggcgtgatggtgggcacctgtagtcccagctactcgggaggctgaggcagaagaatcacttgaacccgggaggcagaggttgcagtgagccgagatcgtgccactgtactccagcctgggcgacagagcgagattctgtctcaaaaaaataaataaataaaaagaaaaatttctcataggactacagttcccctgggatattactattcatttataatctatcattttgcaagctgaataccttcttaacaatttcttaaagtgctatgaatgcctagacttctaagacagtgatgccagtgtctctaacttcctgtatatgccacgctagtttctgtatagaataggttatcaattttacgtctgtgttaaggacaggaatcacaggacatctcacttattaaacggcatctatggaattatgccaaacacatttatctataaagaatgctggtcctcactatttttcattaatcaaatgcaatgtgtaaccagttacaaagcctgtagtattaatagaagcttctaatctgtatagcatgctgctttcttttagctgaaataacatttaaaattcataaatattggaggtaaaaagaagaaaaaagattataatgtgtgctctggcttgtagcccgaggagaacagaaacaggggaaaaacaggtaatgctttccagcgatgagtgatgaaaaagaagcacaacaattccagtgactgtatgagaacagccagaaatcattcttctaaaaaatagttttaagcagaacaatgatctagaaaaggatcacaacacattgcaccgccctgagcagtcccataaagcagtgtgatgcctctataaagcaaagttccgtccaacagggctgtcagaggggaacatgagtgaaagggagggagcgccttgcacatttatatccatgctgcaatgatccccacatctctcatggtgcccagcgcacgtctcctcctgcacccacaaccaggaattaggctccacgttcacctgctctgcagctacaggccttatcctctaattaaaccaaccccactgctctagaagaatagccctgctcggtgactcactaacatttaagaatacacacatgtgaaactaagatgaaaatgagggcggagatgatttatgtgaaaggacatttaaagatgaataggttttgtgaggttgaggaagcctgcccctctagagacagaggaggcatttgctcaagtgtggaataccagctgttgaaatgttaagtcaaatgaagtagaaatgtaatgttatttaacaatggccgaaaaggaactcgctaattagtatttagcaaaaaaaggttttgagtggtcaacctgtgtatttgtttatttgtttgcttttgtttggagacggtcttgctctgtcctctggagggcagtggcactatctcggctctgcaacccccatctccatctcctgcctcagcctcctgagtagctgggactacaggtctgcgctaccatgcccggctaatttttttgtattttagtagtgacggtgtgtttcaccatgttgcccaggttggtctcgaactgccgacctcaggcaaacctcccaccttggcctcccaaagtgctaagattacaggtgtgagccaccatgcctggcctaatctgtggactttttgtgtgtagagtgtgactgttacaaatgggaatgccctaatctatatgttactgtggaattttcctatataacaaaagaaacttctaagaactgctaccatttggaatccagtaattgtatttatattgaaatatttattataatgaagtatagcagaaaggctagtgagttacagaacaatatcagaagcctatgtgccatctaaaattttcttttattttttaaattaaaatgatctcaccaagcttaatcatctctaaatctaaaattttctaccaagtttactaggacactagaggcctatttctccagaaaaaatggtaatactaatttttacatatattagaaactaaacattttccaggaatgtacaattactctggaaattccaaatctttatgtcaaaaaacctagaaaatctgccaaatgtaccatgtctaaacctaagtgggtattgctactaatggtatctttactctgtctttatatagaaacaggcttatttggaatttagggctcagaaatagacctacacatacatgacatggtcatttgattttcaacaaatgtatcatagtcatccaaataaaaaagtaacaactgcatatccatatagatatccatacctcacactatcataaaatttacatatgttggatcctaaacctaaatgtgaatgccaaaactatggagcttctggaaaaaaaaataggagaatatttcatgagttgggattaggcaaaggtttctttgacaggttagagaccacaatatcattaaaaagtaataaacttagaaattaaaacatctgttcataaaaaatatgaagaaaatgaattaccaaactccagactataagaaaatagttccaaaacatacacctgataaagtactgatatgtaataaatagatcaaagcttccagaacaatatatacatttcctaatgaacctaatttgaaagtgaacaaaatacaagaagagacatcacgaaaagaaaaatatgaatcactaaccagcacgtaagaaagcacataacattgtcagtgagtctgaatggaatgccagtgcacaggcaccagaatgaaagcctgacagcatccgaggcggcggagccaccgtaatgctcatgaagagtcagaggtttgaccttttgctatcaatgttgttataaatgttaatgcacaactatctgtcagcccagcaattccactgcaggacatttactcaagagaagtgaggccgagtgtggtggctcatgcctgtaatctcagcactttgggaggccgaggcaggcggatccccttaggtcaggggttcaagaccagcctggccaacatggtgaaaccccttctctactaaaatacaaaaattagccgggtgtggtggtgggcacctgtagtctcagctactcaggaggctgaaacaggagaactgcttgaacccaggtggcaagggttgcagtgagccagggtcatgccactgcactccagcctgggcaacagagcgagactctatctcaaaaaaaaaaaaaaaaaaaaaaaagagaaataaaagcatctgtttaaaagtggtttacacaacaaatgtttaccttgttgtataaatgctctattcaagagagtcaaaacctggagacggcccaggtgtccctctacagtagacaaaaatacttctcagccataaaaggcatgaacggttgctccacacaacagcatggaaaaatcgccaacatattttgctgaatggaagaagccttacaccagagtagagaccacatgactctttatatgaccctttagaaggcagaaattgtggtggaaaaaaaatcagaagtgtttctgcccctgctgggtggagggcttggaactgaccaggaaggagcatgacatcattctctggggggtgataatgctctgcagcctgacaggggctgaggctgtaccactatatctttgccacaactcataacattccaccggatataaaatctatctgaaaaactgaactatgaacatgtattgaacttgtttgtcatggtgttcatgttgaagtatttcgaggtgaagtatactcatgtctccaactcactttaaaactcattttaaaattcttcaaaaatgagacgaattggtaagtggatggagaaggatagatagatatttagccaacaaaggaaatagagtaaaaagttaattgcagagctctatcaaaaagcaatccttacccaacagcatgaagagattagtagacagatgctctagcttcccattctctggaagcacaattctatgagacattctccatagctcctcagatgcccaatgagactgtgccctaattgtcccctgcactataaactcaactacccactctttgtcagctttgctttattttccatctgactttcccaactcctcaatgtacttcccaagattactcccaaatgaaccacctgcacctaaaacagagtctttggttctgcttttacaggaacccaacaaagatgataatatagggaatagcatgcatatgtccaactgtgtcagaaatgaggagccaagctgatgagtggatctacagtgatgttctaggaaatttaaaatgtagaattccattttcgcattgtcaaatgcaaggtgtacaattttgagaattttaaataattgaatatataaaatgaaggctctgaaatatctgttgcgatagaggtaagagatctgacagcttgtatgttggcatcacaaaactattgtcagttgttacataaatggatggtaaagctggaatgcctggattggagtctcggccctgacgtgtgcttgttaatccctcctgcctgggtttccttgatctcttaagcaaaatgttgaaagagcagctggatcatggtaaatgctattgaagtgtgctattgtttttattattgcctggcaaacactaaggaagtctatccaaggaattgtaacagaaggaaaatgagggatctgactattatagagaaaagtaattaatttccacgaaacagtcagtaacttggctaaagcgagctttggattatttgtcaattctgaaataacagggatttttttttttttttcaaaacaagtaaatttaggacaaataagatgacgtacttcacaaagtaatgaaaaatgtatgggagccattgttcctcagggatgggaaaaatttgaccagtgtttgtgcaaatttggggaaaaaaagtcatggactagcactaaaggaatgagatctacctagactttgaggtttgtaaagggtcttaatgaggcaaacaccaactgtgttctttcttgattctgttcattacctcatttaattttcaatggtcttgccgtgaatatttgcatgagatatagaatatttttaaagcaagaatattaataacagtttttcattttaggctcattaaataaaaacgtcattttttcactaattcacatgacatttattgagatgtattaaaaaataaaagaaagactttgaagacaaaattgctcaaaggttaggggcaatctgctcttcttggagtaaaattcaagggccattataagaagtataagtcaaattatagtaccaatcaaagaataaaatatttttgatggaactgatataaaaaagttgcgtatccttgtaagacgaatttctttctctccctatctctgagtagctgcataaaccactaagtttttctagaagcaagtgataatgctttatcataggtacaggcttaaagaatgattaggtacacttaaagttgggtactcctatcaaaatccaagacagtgcattgcttctttcctttccaaattttttttttcagtcttgtggcccctaactagtaattaagagaactaaattaaagttcatactggctacttgaaatcttacttttaatattctttgcattatgcatggaacttgtctatggttttaaaatccaaggggaattatgacatttgtaaggcaaacccaggctttcatccatcattctaatctgttttacaaaaaaaaaaaaaaaaaaaaaaaaaatcaaagcagcatttgggggacaaaatgagtgacagaaaaatggcaaaaatgtgtcaacaatagtgagatttcagagatccaggagactagctactaacctcagcatctcccgagatactccattatcgctatttatgttattacagatgatataaatcttacgtacaatcattgtacactgaaaagtagcagaaggaacagaggtttgtgaccagaatctatgacgcagggaaaattaaaaatgcatgaaccattccatataggagggaattgaaaattatatgcaaaagagtatatgtacacccacagacatgctatataaaaatgaacaaaatttaaaagcttattgttacccattgttctgatacgtatttctgttttcttggaaggttctttgctggccggccagattcctaaattttatatcctgctgcactagtgagatatgtaagaggattccaaacactcaagtgtccaaactgagctgtgctgaagacttcaggctctccttcccgtaagatgagaggtcatcaggaagatgatgctctgtgataacaggattgaggcagaaaagctatttgtcacattcccttgtttggattttggttttggactagaaagaacactggcttcaaagtcagaaatcaagaaccaaagcccagttctaacgtgttttattagctgagggacttcaggtaaatcatttagcatttctttccttcagtttcttcagatatttaatgaaagaattagaccaattgatttcaaggttctcattttgtttcaagattctacagttataaatcataaataaatcaccagtaagtttgcgtttgtcaaacaattcaagttactaccactttacaagggcacatattaattttcttaaaaatttatcacatgttatgtaaaaaaataagacttctgaaatacttagacaaaccataaatgtgcaaatattctatttcactacctcatagacaagttttagctgattagcatgccctgatgaaaatacacacgatatgcaggtgtaggagttggatgaatatttttaattgtgtatctcctctgtaggccaaaactgttcatctactaatacattagccttaaggcatgtgccacttttagtgactcagttgttaaaactgcgttacagctgcatttgctcccaaaaaatattaaagtcctgtaagatttctattaatgaatccttttgatcttctattttacatcaggtaaaaggtttcaggagcttctccattgttacaacatctccttgtatctaggaggatatgggggaaaatagcaataaaataggtggggatgacattctgatactagagagcagttaaacgtgatgggggaagaaagcgacgatccaacagaatatcctcgagtaggaaaatgattttatcgcatgactgcctacctcattacaaagtgaaattcaccactatacattttcgtgtgagctttcatctgctgtacaggagagtggctccctgggtttcctataacagctgttcccatgaatctaccagatattttgtttccacttttacctttcttactctctgtctccatacccttctgagggatgagggtctgttgcctaactctttcattagttatttatttatatctgctctgggaaagaagattgtggaaaatgtgagagcaattcacacatcaacgttttaagatcccgtgtacaaatgggattgctccggaaaagcttcttcccacaggcactaattaaaaagcaggaagttcacttgagcagcatttttcttccgtttattttcctttgtaatagacatgctactttttactttaatttgaacattatccctctctgtccaaaaaaatacaaaaacaaaaaccaaacaaaatacagtaaaggaaggcagagtataacattaacaatttagaaaagatattattttcccctaataaattctactgcattcttggaaagcattaaaagtataacaggtcacacatccttgaaatattagatgaaggaatttgtgaagacagactattggaacctctgagaaattagctgggcctctacttccgtggtcattctgaagcatttttagatgctggtcacgattaatgctggaaacaacgttagtgacagttcttctgtgcttatcacatgcctttagttcaggaccgaaagaaggaaggaaggaccacaaatggtacacgaatgggctgcacagggtggtttaaaaggtaagaaaccaaagtgattgcttgtgtctcatttaagttaaatttaccacaaagttcatattcaataaatttaataagaaaggtaaataaaaacaatcacagtaagaattacatatgaaaataactatccattcattctattaacaaactaataaattattgaacatacactatgagtgattctgtcctagatactggagattttcatgatatactaagtatgtttcctgcaagagttgaggatgtcagaaccactgggatactgcggttgaatagacaccattgcctcttggtggtctgaggctggtaaatacacaggcaggaactacgcattgcaacagaaatacctccaaaggtccttatgaggatggtgcacacagaaaaaaacgtagggtcatggagaaactggaaggaggaggatagaagaaataggtgaaacaggctaagatttatccaccccaagttgggagatggtattccagtgggaaaaatttcactgctaaaactaaactagactagcaattctgtaagatgtaagagtgtgagtgatgagctgagggacagcctgagtggttgaaacgctgcttttctgatgatttggctgatggagtggccctaagcaagtttcttcaccgctccgtttcagattcctcctctgtcaaaccgggaaaatactcgtatctacagtaagagttgaaggattcaatgaaggatttaatatatgcaatgctgagaaaggtctgtggtgttcagtaaaaaatcagggtcttttagtttctttcgtagggctgcacacgcctgacacaggggatgtgaaacacagacctctcatcctacaagtcccagctgcacctgaccccagcagcctaactgcccctggcccatgactctaccccagcccattatcttcttcataatcacaatttataacttggctattgctacattacatggtgcatttgcctatgtgtatacttgcttattttgcatttattttcctcatatatgagccctaggaggatacggacttgcctgtatttggggactggaacatataaggtgttcaatgagttttgttaaatcattactgatgatgctgatgatagcctgccactacatagctcttcctttgtgctactcttctaagcattttaaatacactaatattcttaattctcacagcaactccaagaggcctgcctcattaagtgggtcctgttactgttttatagctgaggatattgaagtgcacaggataaaaaagaaaaccacctaaggacacagagtaagtgatagaactgagtgctgagctagcagtaggctctcaaaacatattcttagccattaagctgcctggttctaagtaactaaatgacagatcggagcggggtgctgcctggggccctggctagccagtaggcagaaatggaccccaagctacccagggatgggagatggggcagatattaagagaaatgaggcacatcctgtactagacaattttcctagaagcccagtggctgagctgtttcatctgcagccaagagtgatgttccattgtttcgcatgcactctgtgagccgcctgctgcctgttgcctgagccttactccttcatccagcagagccaggccggcccacaccccacactcttaccacagatggactgggtttgaatcatggctgttaaatgcccttcaacactagtcaagtgattactttctttatttcttcacctgcaaaatggggattataaggtacctacctcataggtttgtggtgagaactaaatgagttaatacagagaccaatgcctgggacaaatgtagctcctctaattaacaatttgaattccctggtcccttggtttagtccctgtttgtcatgtactttacaaaagtgacaggttcctattcttggaaatgaatctgtctatactcagaatcagaaaaaccaaaggaacaaaataaaaatggaggcataccagccaatgggtgcctcggtggtatctccatgaaatctaacccatcagaggcagataagcacagagtccaaggccttcctctccagaagaaagaggaagaaggggggcgtgtgggagtgtagagtgcaaccccctgaggggctgaacccacagaaacagcctaggggtgagataaggggtcctggcccctgaagacaccctggggaattgaatggcttggggatggggaaggagaaactggggggcagaggtgaatacctccccatttctcaatgcctggcacctgccattctgctgttcctttctttccaagatcaaaacaggacattggccatcctcctgggttgtgcttccaaggctctctttgatcactctcagccctccagcttccagctgaaactgacctctagtggcctgtacactggtcttactacagtcattgcccccagattcagaactcccgtctcatgtcctgattgctgtgcagtcagcatctccacggaccagcactctagattatagcaccgagtacaagatggaaaaccaaggaatttcaccaccagttagtgttagacaattcattgttctttagtggcttgagatttaaagtggcaactccataaaaactgacgaagccttccttggtgttgacctttgacacttgtgagcagccacatgtggagtgcgtcctggacattttcaggtatctattttgatgcagcttttttttttttttttaaattaaacagactttctcactaaattgctttgtcatggcctcagggagaatctggcctacaacactgtttactatttcaagtcatgtgtgaatttgatgccctcatttcctcttcttcatgcttgtcttacaccaatcaataaaggaaggaactgggtcatagtctcctggggatgactcccagagttcaaattctggctctgcctagctgtgtctttggaccagttagtttcttcatctctataatggaattgcaatattactttatagggttattgtgaggaataaataagataatgggtataaagtgcttggctggagcaaatgttcattgggtgtcagctattctcatcgtcacgatcagtctatgagatggagtccactgtacttggtacttggaaataagacgtgtttatagatctgtgctgacatgtcagttttcaagagccaccatatatcctgctctatgcgtaatctttgtaatttagagtaaatgttaaggaagagagggcaggaaggaataaaatgtaatgagcaatcattggacaaataaattgcatccactttttaagtgcattttgtatacagtttaaaggtagaattcctgaagttatacgattttaaaatacacttgagaaaggtgatgggctgtccaaagcaatgattttcttctaagaaatacttacacatatagaaaatttgtatctttatatttgctgatgtgaggctgctctacactttgttcccttccatcagcacgcaggaaataaataaaatttgcccacacgctaaataaaagtcagctgaatcccaagtccttgccgtcccctcaaccacacaaactcatgcacccataaatatcttctttttggttctgagtgcacacagaaccaaaggaatttgtattgaaacgtttgatttcacttaacctgcatatttctatttctatatatcttaactctgaagttaaaatacaattcttccaatgatatgaaacacagtattttaaaggtatcacacatcttgggttgttagcaagaatttatataatcatttatccaaatcactatctattttggcttcacaccagacttctaatcaattctatatccttgttcaaggcatgtttcttatttttcaccactagtcaggtattcattcccttgtgctttgttcttgttcatttaacacacaactagtcccattcataggaaacacatcctaatccaattggtgttttacaaattgaatcttcccaacagaaagtcattgtgtccctcctagttcagaaatactaactgcatgcacttgaagttaaatcaaaggataattactggtctaatattttggatcatcttaaatatagaaccatattgtgctacagctggagaaattctgagagtttttagataacttggaaattacacagcctaccgaggtgtctttccccaccctgtgaggctctactaaagagacaagggggacttcacagaaagtttaattcaaacttaattacacttgagcctgaaagttgattaatcggttacatttgcaagcagcagaaaccaactctggctgtcttatacatcttgtacaccttgttgtcttatacaccttggtaggatgttagcctccaagtctccctccaggcaagctgtcccagaggtcatagagcaggaagacttggaccaaattaaaatgcttgaatcacgtaactttttaaaacatagtttgagaaacaaaagggaacagaaaagaaaagtgagccaggggagaaggtgatttttgtttattgccttttatatctattatattcccagcaccacctacaacactggtccggtacatagcaggtactttatgaagatgtcctgaatagctataggatataagtatgcaacccttttgtaattattataagacaatgtcttggaaatcatagctaaaaacaaatcaaacgaaagaaacttagtctcatattctattgtcaaaaattcttccatgatggtatatgcaatagaagctgtactggtggatttctcccatgtacaggttagcacacaggtaacatatgacctacagagctgcagaggatctgtctgcttagtgctgaaggccaccacttgatatagaaagtagaagtggggtgtcagggtggtagggccactggtccacgggacatactgctggaatagcaagacttggacccctgcttctgtttatcctaaggaagtgactggtgctcctctgatgatgcaatgcaaatgtcctgcagtctaagggctgttgtctgacatccagtctcagtaaatatctgtgctgccccatctccatgaattctccatataaaggctatttgagaagccaggctgtgagtgctctccaccatgtagccttcactgacagaaaatctgctcaatgttttaattttaaaggtagattatggattcttttataattagttgtagaaaagatcctctggcaatatggtagttagaacacatctttgccacccttcgctctcaattaaatattcaactcttacctgctaagcagggggagcttggggcacatgactaagccttaaagtcctataaaagtatcagcagaggggcctattaagatttggagaggggtggaattagatgaataatctaataaagaataaacatccctgaagagccaagaaaattatgtagaatttaagttggttgaggctaggctagtgttttaagttggttgaggctaatttaatttaagttggttgaggctaggctagtgaaagaactgtgcagtcactagactcaaataagtataaagagccacaccgtctcgtggataataccaaataatagaggacccataagtaaatctaggactatatggtacttcattttggccaggtgatatattgatatgttgggagaaaggattatttaataaatggtaatgtcacagaaggccatctattcaaagaaatgaatttgggccccttcatcacaccacatatgaaaggaaatttcaggccaattaaaagttttaaatgtagtaaactaaaaaaatagcagatacatctgacatctagaggctcggagaccttgataatcgacaggtgactacatgaaaatatttgtatatgatgataccataaataaaaaacagcagacagtggaaactgatagactagaacaatatacatgcgactcccacagtagagaaaaggttactatctgccataaatacggcttacactgtgatttgaaaaccctacctaatgtatgggagcagagagaaatgctcaataaacagatgaaacaaaatttaagttacaagaatattttgttttggctaatcagactctgaacacaatgaaattccttttttttttttttgggaaaaggagtcctttcataaaatgaaagcaaaagtgtgaattattacagcctgaaattaaggaaataagtataaggacatatattttactcacacacaaaaaaataaataaatgcatataaatatgtatacccctattcactggattgctgtatatagtcacacacacacatgcacaggcactcacaccaaaatctagaaatatcagtaacaaatcaataggcaaatgtttaaatcaaagccattgcagcagagcatagaatattatgcagtcataaaaaatttttaaaaatagaactataaaaattacctttgagagaatggctataaatgattaagagaaacaaattcagaagaaaaaagaaaaaacttatttctatgtgtgagtgtgaatgcatgccagagatatcagaaaggattttcactaaaatggttagcaatgcttgtatcagcggtttctacctcaccttttttatattggttaagtgttatataatgagagtgcattgcattatttgtcacataaaatttaatttgaaagctatttcattgctaaaaggcactggtataactataacttatttttctcatttaaaaatattctatcaaaataacatagtgcttccaccaggtgtgtgtcaaaaaaagaaaaacaacaattactaatgcctatcatttaaaaggactttgatataattaagcgaaaaaaaaaataaaagcaaagcacgttctctttgtgccttccaactacaccaagaatacaacaaagacggcagaagtttgtctgtacatttaataaagaaaacaaattaaagagagtgctttgcactgggacatttgaatccagtggcagctgccagattaaaaaaataaataaagagccatagatcaagctgcagctgcgtgcctccaactcactccgcagcacaggcccaaagccattgtcagtgcccccggatgtgtgggtgtccttcatttctctttgaatgtggccaggcctcttgaaggagaacactaggtggcatgcctaccaagctctgaaacaccattaaccaccaggaaaaaatgcgattaggattctatttggagatcatattttcccctgtaggctaaggaggcattctctaacactgacaggctctgagtctctttagccagaaaatcaaaaagtttctgtgaagccactaggtaggacttttagaaatagagtcgctacatcctctaggctcctgggaaagaacctgtagctgaattatttttgtgggtcatccgtaaaatgttaattgtggattgtcaaacccttactgcagagaggactttcacagaaacagttctatttctgataaatcaattttagcagaagagtctcttttgacatgcttaattcaatgagcaaattgtaatgggcctatcccttaagacactggtgtttgtgtgtttgggagtgttcgctcagcaatcttggccctgatgctgggggaatttgaacctgacaggcccagaggatggggccagcccctttccctggcctatggctccggtgctccagacacacacacctgagctacctcccttaaaggttggaggtcaattaaatccctcaagtacctactaccaagctatttgtttaaagactattttggccatttttttgatcagtaggatattgtcacgtgctgccaaagtgctgcaggtggacatgtttgtgtgttctgaaggacttacatcatcctgcaatggtcagctttatgacacaaagaatgagtgataactcagtcttctcagttttgtgtcgtttgtggttttgtttgtgtttatttctttccctatctggggtaaaagcctcagtccctgattcagcagctttctatctaggtgtctgatttactgaattgcatcatctcttcctcatcagtgttttcgcttgtttgcttgtttgttttgagtcaagggctctccgtctgtcactgaggctgagtgcaagtggtgcgatcacagctcgcagcagcctcaaactcctggcctcgagcgatcctcccacctttgcctcttgggtagcagggactacaggtgtgtgccaccacacctgatgcctggctaatttttaaaatttttttcgtagagacggagtctcactatttcccaggctggtctcaaacttctggcttcaagcaacgctcctgcctcggcctctcgaagtgctgggattacaggtatcagccactgtgcctggcctcccttcagtcgtaattgcattttgaaaactgggcctgcagctctgtggataccacacatgttctatttgagcctatatttctctgctggccgaatttcttaggaacctgtgccaattgtttttcatctttgatcatcagcccgaaccatgctgtgtccacctgaggggacggtccagcatctctgtgccatggcagatggactgccggggctccacctggttttggaacctgcagtttgcaccatggctctcctgactgcagagccaccggcagctgctgtgtttcctcatttcctctaaccccagtctgtggggccttccccttcagcctgctgcagaacccatccctctggtcagttgaaaaatgtgggtaactgagttggaggtggcatgaggggactttctggaaaaggtctaaaagtctgtctagaggagcgtatacatgtgtgtaggtaagaatggcatcaagttgcacactgaaggtttatgccccttactatatgtcaacaacaaccaagaaaagaatcacctgccaaagtcagtcaccacctacttagttccctagagttgccactggctcaattcatgagcttatgtatgtgccaaggggaaaggcttcctcctccactcaggttttgaacattgtaaacactaccaagcagcaaacagatagagcctgaacgtgtgaaacttaaatatctatttagtgtttgcctcctcttcccatttttttttcctttgacagaaaaattgtagtaaggggacagtgctttttgttatcttattactgtgtgtgtgtgtgtgtgtgtgtgtgtgtgtgtgtgtgtatgtgtgtagcaaagtctacatcctagaaatgtatgctgcatgccacagctgggggcctttgtgatacatgtgataggtgaaattcattgtaaaggcatatttgaggtgatttttccttattgtaattctctgtgaattgggagctgcactgaggaagtgacaaggatgaaatgatggttactatgatcagcctgttttccccaactaaacattttcacttggttgaaagctaccagagactacagtcaataataacttaatcgtacatttaaacttaaagagcgtaattgcattgtgtgtaactcaaagaaaaaatgcttgaggggatggatacctcattctgcatcctgtgcttatttcacattgcatgcctgaatcaaaacacatcatgtaccacagaaatatgaacacctcctatgtacccacaaaaattacaaatgaaaaaagaaagtcatcaggtctcgaatatactataaacatatgtgtttacagtctcttcaaacatataccaagaaccttatttaaatctcaccaaaaagaattgtcggctcacaggacaagcttaagagctgtccactgtgataatgtgacaatcccaaacgaatcttttctcctcctttttcatatttctcccttccccacattgactgaatgatatgttgtcggttccttttgttccaatcaggtagttttcaaaatttcatggcaggggaactgagttaaccaatatatacatagcctaattagctttcaagttggctttatggggcaaacaagcaagtgcgttatacaacagggaacagtgggctcccctccctcctgtatctcaatgactgggcacacaaatgcatccccatatattaactggacaacacaacagccccagctagaccagagatggtagacaccaaagaggacatcagggaacaggcaaaatccaaataacatgattctagtttaaactggattggcctcattctcaggtgaaaatgggtttacacaatgcatccctgcaacatttgtaagcttatttgttcctttacaccacgtttcattcagaaagaacgtgaaacagcccataacaatacaagcaagtgaagatatctgtggaggggagtgggctgaccgaggaacagaagggtaggaaatgttgacccagtcgggggtgacgttccagtcccaggtcagttcccgaagtttcatgtgcttgctagaggcaggacacctatttgtttctaagctttccagcaagcataggaaagggaagtgggattaattacataaatcacacaaaccatttgcatatttctttgctatttctggtactgaaaccaaagaatacaagtggatgcttggtgttaccaacatctgcacatgagctgaataaggatgatggtcatattggctctggaaccacttacagcttctacttcagatcatggatttccacacatagtaggtattaaatgctttttgaatttaacgggacaagggaaggtaatcagaaaatgaagaaagaaaaagagaaataaatgcataaagagggtcaggcttggacaaatattgatacagtgttgtacaagaaccatagaatccaacatggtacacctgagatacaaaataacaacagcaaccacaaagagaaacatggggagaatcagggaaagaaactaagaatcataagtaggaatcactaagtgggaatcaggtcctaagcaaattgctttatgtgcatttgattatttattccatcattgcttgtcagcttccaactatccctgcccaagagaaaagtgcacagacacactcagatttaggggtaggaaagaagttgagaataagaaaagaggttctgaaaggttaaggatcttgccaaaggtcacacatctaggaagaggaacttggttaccttatcaaaaacaggaaatccattctcagtttgataatgagtcagatattgtactgactcattatcccagaatacgtacaaacattctcagtgatctgagttcctggcgtattttcttttgtattgcaatctcacaaataatgtgtagagaaagaaaggaactgcatgcaaagtgtgttctttttacacacttactttgcatccaccagtttctaccctggacaaagacaggggttggagctgttatttgctgtattactgctgtactagtcccttcttgatggttccaaatacactacactctagtcattaaacacagatgttgcctggagatcaaacgctacacttaaaatcatgattcaatctgcgtttacatttagaatgggtgtaaacttgaggagaaatgctgtattcagagatattgaagacagacttataaaatataatagaattttatattacacgtagaagcgtctcagcctgaggacaagtggcactagctgtagttgccgtcaggctgaagcctgtctatggaactgggcggggtggatctaccgggagtctactgacatgggacagtgaagaaccacctgggaaaacatcactgtgtgtcaggagggtgtgcaggcacccaagcatcatgcaaatctaacacttcagtctgaaacatgggatggcaagttactaccactcagccagctcccatgggctcatcccaggatcctcgcaggagtacacgggaatttttctcttattaaaacatgtgtgggcatacctcattttattgcacttttactttattgtaatttgcagatattgccctttttacaaattgatgttctgtggcaagcctgcttagagcaagtctattggcaccatttttccaacagcatatgctcattttgtatctctttgtcacactgtcttaaatttaaccttcaactaaataactattgtattatttgaaacgttcaagtaaactaaagttttgtgaaaactgcttttcacctacttctaaaatgcattattattgggtcatttctgacacctttttttcttttttttggtgcttttctgccgatttgaagaaataatgataaaaaagaatttctataaatgtaaggatacttggttaatgtatatttgcatttcattgacaaaataacattttccataaccatgtggtctcaagcagataaattcctgtccagaagcacggtgctaccttcagcatttaaatgtcgggaggcccaatgtgttctcacattgagaaccacatgcattggaaggtggctgctattcagatagggaagatgtaagaggatggagaacaaatgaggtcctaaggagacatgtaaggcattgggagttcttctgctgcagaacccaggctgcagcccaaagggatctgagagacagctgctactgacagggaactcacacaggccacatggagctgtttccctgccatcatcatcttctggtgggtctccttgctgacccactctgaggataagaaggtgaaggagatgtccttgacagatggcagcctatgaagtaggtttctctgtgtaagaaagtcacctcccctcctgtcttggtatggggagggaaagactgtaagcctctctgtcttataaaaatcaaagatttgtggttccaaaattatatgccaaagtatacatcttggaaggaattcaatatggtgataaaactataagttgggaaactaacaaccttggtcctagtcccagatctgatctgtcactgctgactgcatgaccaaggcaaggcctgtctgatttctaagctttgggctcaatagccataaaactttactaacacttgaattgccgcagtatgccgcccctcgatccctaccatacaccccatttatgcaatagccaagtaacttttttccagctctttcttcctagttttagaaaaatacacttactagttctaaaaatccaaacaggtgcacctgactgccccagggagaatcccctgaactagtgctatctaagagaattttctgttgacaggaatgctctaaactacaatgaatgcagcagcctctagttgcaactgcccagtgagtccttgaaatgtggccactgtggctgataatctgactatttaattttctttaattttaattcatgaaaatttaaaaagtcatatgtgcctagtggctgacatattggacagtacagctctgtatcaacttttgctaattaatgtacatatccaggatcttgtactttatttgtccttttaatcaatcaaatccaatattcaataagcaaaaattactgattgcataataggaggcttcacaaaagggcagagtctagtgaagtaaaaaacatccactgtcctctctttctcttgattacttccaacatttacaaatttgggcttgccccgctgatatggtttggctgtgtccccacccaattattagttcccataatccccatgtttcacaggagggacctggtgggaggtaactgaatcatgtgggcgatttcacccatgctagtctcatgatagggattaagttctcatgagatctgatggttttataaggggcttctcccttcgtgcggttctcatttcttctctctcttgctgccctgtgtagaaggacatgttgcttccccttccaccatgatcgtaagtttcctgagacctccctagccatgcggaactgtgagtcagtcaaacctgttttctttattatgacccggtctccggtatttcttcatagcagcgtgagaacggactaatacatccagcctcctttgacttcccttttgctgatccccactgaagttaaagatgcacatttcacacgtgctttaaagattctgaaatctgcatgtttggagtaggccaggcaatattgagaagttttggtatataaacctttgagaaacttaaagtaaaccaattttctccactttttaacaatacgagtttctgtctcctaaatgaagcatttatttcaaaactcttatacacaaaactgtaatcttaaaataagggtgggggggtgctcctgactgccttggtcttctgttctgactaatcttaacaaagaaagcctcatctaataaagacaaaagtggcatcgttatgaaacttgtattgggctctgcttctgaacatatatactggcattttcctagatttgtgatattatttagtacatatttcacctaaactatgtattccacagcacattttccaatgttatggatattttttctaaactcatcttaattttccaagttcaatacaatgcatagccatttgaaaataaatgcccactaaatttcaagctgtacaaggtaaacttactttttccccccactaaatgataaacttgagtaatatatagaacctaacatttgtgccaattcactctcctgccaccccttcttcaaaatcataggtttccaaataaaggaaacaaaaacttacggctgaataccctgctccaaattaaacataaagtaatcaaagtcattattaaatgtttttcatgttgtcgaaggaaacaaaacaacaggaaggacaagagtttaggtcaagaggttccggtgttatctgcgtccttcattataagtgatttcaaaatctttttccctccaggaaaaactagtgagtaacagcttagtctaaatgacagcagctctgtggtacgaagggtccacatttcagctaattttcagctcttcttatcctgataccatgagatggaatttaatagatggctggaacatctataacatgacatttaccaaaggatgtgtcagcggcatccatggcctcaacaaagatggagccttcaaaacataaatcaaagaaaaatataagaacatcttagaagaaaaggatgacagtgatcctgcacatttaaaatattttaaatgccttagggactctacggagcaagtagtgttaaaaataatgatgtaccaactaaagatatttagctccctgttaagagaagaggctatgtagcagaaggagaaaatctttagattttttttttcaaaacatgtggtttgagagcccacctcacactgttcctttggtaattctcttattctctgtgaaccttgtatagttttcttgggtgtaaaatagtcacaggattcccaaccttacccaattcacatggttattaaatcaataaagacaatgtgtgtgaaaatactttttgagctgtaaaaggctctacatgaaaagcttatgtaatagaatattaaattggaggtttcaattaaagccagatacaagagatactataaaccaaaagaggtgctgattgcctatgtgaatttacaaatctaaacatcactgacataatttttttaacagactttttttttttttagcagttttaggctcaaagccaaatcaagcagaaagtacatccttttcttccaaacatgggctattttgaaacatctcatgaacatcatatttatagattggtttgttggagtgagtggagataatgtttgaaggtgagataatgtttgaaggtgatttctttgtggaagaaaagggcttctatggaaagactccactcagagagcttgatatggctcttctagagttaaggagaaacagtgatatgatttggatctgtgtccccacccaaatctcatgttcaattgtaatctccagtgttggaggtggggcatggtgggaggtggttggatcctgggagcagtttctcatgagtggcttagcgccatccctctggtgctgttcttgggatggtgagtgagctttcacaagatccgtttgtttaaaagtgcgtagcacctcctcctcactctggacaggtaaaacatctcacatctcctttgccttctgcggtgactggaagcttcctgaggtctctgtagaagcataagccactatgcttcctgtacaggctggagaaccatcagccaattaaactccttttctttgaaaattacccagtgtcaggtacttctttacagtaaggcaagaaaggactaatacagagagtgagttcaggtctgacccgagtcccacttgataatgttaaaggctagctactttgttggtatagttatattgggtttagtctgtgatcccagagtttgttaaaacaaaatatgtatgagaatgcccaatggaaaatgaaaaagagctgcactgaaaccactttagtttctacccaagatgtcctggaagaccaaggagactccaacagagaaaatcggggtggataacagtgaaaaaccagcagctgagaaagaagtgatcaccggaggaggaacatcagtatatgcttggaggtgaagcagacatttcctctggtgacctctaaacaacttgtacaggagccaatgagataaagtttgcttttcacacttcctacacttgacagcttaaacatatcccatgacagtgtcagctgagtgagaactttcctgtgccctcttgctaagctcctaaattgtgcttcaacactgaggtatcagaaacagaagagagcaaaatggcagtgcaggggagcaagttcaaggtggggaaggacggaggatgccccccaccccaatatacaccacccctccagcaagtgcccagcctaatgcaggcccagcaggagtacatggcaagctttttatttgtttagttggttgttttcaagagactggacactactatgtactgaaataaagctgtaattgaaacttaaagttatccatttggccctgggagaaaatctattaatataacatgacatttaccaaagaatgtgtcagcagcatccatggcctcaacaaaaatgctatctgccaggaggacatggaaactcctttagaggagacaaaagaatcctcagtaaaaggaaccaccaccagatacagcgtgatgggttgtgcagttgaagctacaaaaggtttgtcttggacattaatatggtttggctgtgtccccacccaaatctcatcttaaattgtaactcccacaattcccacgtcataagaggaacccagtgagaggtgcttgaactatgggggtgggtttttcctgcactgttctcatgatagtgaatgagtctcatgagatctgatcattttaaaaagaggagttccctgcaaactctctttttgcctgccaccatccatgtaagacatgacttgctccttcgtgcctctcaccttccaccagaagtgtgaggcctccccagccgtgtggaactgtaaatccaataaacctctttcttttgtaaattgctcagtctcgggtatgtctttatcagcagacatacagatataccgggagctgctttacaaaaatcaccagtaggcatgaaatttccagtggctcaacacgtcccactatgaccaaccctggtgataagctcagtgtctgacacagtggctgccacacctgctcgctctgaattgtcatttccaaccctgcctcttcattctccaacctgaacaccaacatcattccacaaagaaggccctgtgtacactctgccttttccttctctacagtcagtactggatcaatgtccacataggccctatccacaacccaacagcaatctcctggtcctacttaagagcacattcaccttctaatttcaggatcttctttcatagtcttgccatacctttcgtggctccaacgctgttctttgaaaagaaaacttctttgaggcaggagaatactctgtccctttttaatgcttgaatcgtaagtttaatacagaaggaaagccctaggaagtaaatcattgtagctgctttaaacatttgaagagcctacaggtggaacattccttagatttcgtttttttttttttttttaaataacaaaactagaagaatgggtggaaacatttaggtcagataactttctctcaagctctttaacaatgaaaacagttttgtgaaaagcaatgattattcctttactcaaagtgctctagcaaagtcagatgactacaaagcaagcatgtaagagtaattatcttctataggagggaattgagattagacgactgcaaagttgattcctattctaattatcttctataggagggaattgagattagacgactgcagagttgattcctactctaattaccttctataggagggaattgagattagacgactgcaaagttgattcctattctaattatcttctataggagggaattgagattagatgactgcaaagttgattcctattctaattatattctataggagggaattgagattagacaactgcaaagttgattcctattctaattatcttctataggagggaattgagattagacaactgcaaagttgattcctattctaagtatcttatatcggagggaattgagactagacaactgcaaagttgattcctattctaattatcttctataggagggaattgagattagatgactgcaaagttgattcctattctaagattatggataggccaaggtatacaatgactattatatcattcattatcatagtcattgtataccttggcctaccattaatttacttcatgaaacatcttaaacatcaaataataataatagtaataagaataaaaatatctactatgtggcaggcactatgctaagcaccaaagtatggtccctgccccaaggaaatgaatctaataagggagcccagaacagggggacccaaataatcaagacttaattttttggtcatactccatttatttcatgaactctgtttatgcaaagtttatatttttatgataacattgaacaatagacatattatgtcatattggtttatactgacctttacctaaagtactttaaataaaaatatcctattcagagacaaagacaaagagcatggttctcatttgtttgtagcacattatgggaggagtagagttcatttctccatgagatactactgctagctttaaattatggccatctctgagtgtacgcttattagcatggcattctaaattaatatgaaattctgtatgcacaactgaagattcataacacattaaaaaaaatagggtcattctgacactagacagaaatataattctttgaaactagccgtgggagaacccgtagttcaatcataccaacaaatgactgaagggttttaatcatactcagagattcaagtggaccatgcccagtgcatgccatagactctggcatcagtgagtatcgtgccctacaacaaacccacttggctaactagtcactttacaaatcatattctatgagcatttcccttttaattttcataatttcctttttcccagtacgcaatactcttccattttcttttcagcaagggaaaactccatgtttcacttctaatccagttctagaatcttaatccccactttagaaaacagagtccagtgaattttactcttttcagggaaagcctgcagagtaagtgtcaactctccctcaaccttataagaaaactaatgtgactcaatgtgagtgctttcagcaagaatctgagctcaagttccccagattaaactctcagtttggtttctttctcgccgggtgacccaagtaaagtcaattaacctctccgtttcccacccggctttactgatgcatttacgcaggtagctggatattcccagatggaagagcatgcacgcatacattcataatgcaaactcatatcacagtactggtctgtactggcttgcctcattctgaagcagtattttcagggagactcccctgccccgcacattttatcactgtaagataagatatttgtttcttataaagcatcaacaaaggatctactatgtaggaagaaaaggctactaaattctatttatgtttccccagtgagatttttgagccattcgcttcttaagcacataaattaacccactgccctacagatgtagtttttacttccacaagtcttgataaagctcctcagtgctcaaacggataatatgtcagtttcactctgcagagactcaggaaggtacatctatgtgtagaaacaggcactggagaaaagtagcatttcacacacaaaaacagtttcaaggctagccaagtctagtacaggcaaagtgatacaaatagggcatagaacagcagggtttccacgcaggaaagaaactgatgagttcaggaaagtgggctaaaacggtgatgcatttacaaatgtgatagtcgctgatcattgccaacccaacgtgcttctcaccctctgtccttgctcataggaatccgattttttttggagatggaatgggcccagactaggggataaaataggactggtctaagccaatcatggcaattctgtttccatgtggcaaacacttgcttttcaacatgcttcgttactatcactggccatatggcccagttataaatgatgagctgtaaggagaggcctattaggaggcttctaagaattatctttttccattttgtttatttttatgtatttatttatttttgagacggagcctcactctgtcacccaagctggagtgcaatagtgccatcttggctcactgaaacctctgcctcctgggttcaagtgattctcctgcctcagcctcctgagtagctgggattataggcacatgccaccacagccagctaatttttgtatttttagtagagacaggttttcaccatgttggtgaggctcgtctcgaactcctgacttcaagtgatccaccgacctcggcctcccaaagtgctgggattacaggtgtgagccaccgtgcccggccagaattatctgttttatatagaagagacaggcactgctgtgtccgttgttatcctgccttgcacacagaattgatgccttgatgctctgttctatgccatgaaggacagtggctagtaaagctagaaacagccccgtcagtgtgtgagtcaacaagaatgtcctgatgggtttatctgctgtgtgagtgcctgatccctgccaggagacagcatcacgaaccaataaacaaaccaaccaagtttttaaacatgatacatacatgtaactacaacgtaaaatgaaacaataagacatatgaaaaacgttctttagagaaccttattttttcttttatgctttgtaggtactttaggttgagttttctcaaacccttctatgtagtatcaagaaatatttctcttataaatattttaaaaatgtatcatcctgcacaatgaataagattgtagatcacttaaccaatttccaattatctaaattaatgactgcatgtcactactaactgacagactttgtaaaacttttaatatcttttacataaaaagtaagtaatactggcttggtgtacctcattgccataatgatatgcatatgtgaaattagaaaaagcactatacaaatatcataacaattaaatatttaggtaaagtctgagcttagctcatgatttatggtaagcattcaataaattatagggatttttttttttttttttttttttttttttagataaggtctcgctctgtcactcaggctggaatgtggtggcatgatcatggctcactgcacccttgactttccaggctcaatggatccacctgcctcggtctcccaagttgttgggcctacaggcacatgctaccacgcccagctaatttttttttttctattttttgtagaagcaggttctcactataatagtagtcactccttatagtatacatacaacaaaaccatgtactttggaagtaatgcaataagtaacatgttttaaaatatatacacatactttttcagagtaatatgcttttaacttcctgcccacaattttgagaatttcaaactagcagcatgggtcaagcgcatggctgggtatcaaaacaaaaacactgagacactctacacaacaaaatgcaaagcgacatctggtatgttcccatctctccagggtcctcatgatgctgagcttttgagcattctaaaggtacacttggggaacttgcgtctgcaagaccgacttctttttctgtctccctttttcttaaagagtagtgagtaaaatcattaccaaacaaacaaaaaacagttatcattacagagggatctctattaaagaagcaatgaaaggctagcactactgtgggctggatgaaaataaatagctggattgaaaagtcaatgaattaccaacattgacccacatttctctagactttaattaactgacatcatcccaatgaataacatatgataaataaaatcttaattctaaaatactaggcaaaggacaaaggctctcaacgtacgcatttctgtgatacagaagagtaacaacgaattggctaaaattgccggcagctcagctagataccattttacttatttcagatcaatgctgggtttctccctcttcgccaaagctgaatgtgcatcactctggcttttgcccaggtccccacatagactttgataaaatacttactcagtccaccttcggctatcactcctccctgaactcgtctatcccctccatcctcttcttctcttaactatgcctctgctccatgagaccctcagctaaacattggaggagtctttgagagccattcaaatgatctgatgttttcctaaaaattagtgtctttgaacaaatgaagcttttgtgacctatacatgtgtgtcctatggccatttgtaggagttggttctaggaaggctgctgaaaatccattcaccaaaggctgattcactggctggccaacttacctaatcgtttactcaaaagttctaaaatttgattatttatgaactgcacagtgtggtctttggtgtcctgagctcttcaggtcccctcctggcccctcagtgtacaactgcctggagctgttgcagaagggagcaggggcataaacaatgaacatccctaaaatgctcctaggaagagaagaggtgttcacctataacctgaaaagtcctggaaattcaatataaaatacagaagatcctaaaagctgattaaaagaaacatatttttggtaaaccaacaaacaaagaaaatgatttggaaaatgttttttaaatctggagtaacagaaaaacaactaaaatagagattagaaagaaatcggtataagccaagagttcccatatggaattttgaagtttaggttatatttataacaatagacgtacaagtatattaaagaagaaaacgttcttaagaagatgaattcacctgtatttcataactttcaacaaattgatcattcattaaaatctgctaagaaattattgaccattttgagaataatcaaatacagaatacaataaaaatacttgaataaattccaaaagaatgtttcaaaacaatattattccttatattagtaaatgtggtaaaaatcagcaaaatagtaagtgagaaaattcaatggtatccatatgaggtgtgtgttggtggaaaagaacatttacgggtttgaaacccaggcatgaattatcaaaatgagtctcaagaaaatggcagtagcagcatttacttacaattttaaattccttctactggctgatactgatgccctgaaatggtttcgatcaaccgtctttaaggagacccctttacatatatattgtatacagtatgcaaattctaaatgtaaactatcaagaataatacatgtataaaaaataaatcatcaaaattttaagttctttatggtaatccttttttatatgtttatttttatatgtttactatgttttttatatgtttatttttaccttaacctggctcttttggaagtattagctttggtaaaagggaaaaagaggaaaatattttaacctttctcacttctctatcgactggctctttgcgaggtgagtgtgcatcatttgtgtgtggatgagagcccgtgataaggaccaaggagaacacaagcaaagagagtgggcgtgaaaaggagatgaagtaagaagcgtccacaaggccaagagaaatctcgtggcagaacagatggtggcgtgaagggcgacagtgaacacgggggccaccctggctttggtagatgccagacatgcattgtgttctgcacactttccaccctggagcttatgaatccacacagaaaccagcttcgctgtagatttaacactgtaacgcgatgcaaaacagaatgcatggtggccggttccactctcactgtcgggacatccaaaacatgccctacaaatactgtcaataacataaaataatgcgtaatgcctcctccactgtgctttcaaagcactgaaacgcctgataaccaaatctacaataagcaaagaggggatatcacacacttaggcaaaaacaccccatgtgaaaactagaaagtaagcttaggtctattctaagacttgaatttcttacataaatgtgagagtaattttgataacaagagaggtaagaagactcctggccaacaattaatctgtaacaaatattaagcttaggaatgattttacatttagactgtatttcttaataaatttcctcacataaattgtgcctaatctataaactaattttaaacaaaatccatcatgccaggcactttacatcttactctatttattgcaccatttctcatcagaaaccttttagctttaatgctattccatggcagagtatctcattagagtggcaaagataaagttctttttgagataaagtaattacggtgattgtagcggggagggggtcacccaaagttcttggctacagtaatctcctggcttctgattcattttaagaccaataaactgagtacaaacaaaaagatgttaatggtggataactctggttacctagagtttgtcctggagggattagcaattcataaccttaatcagaactagagtcctggagaattttgctcccaggaaaatatttcaagaccagatgctgtatgtgctctcagctcacttctatgtcaattctatcttctaattattattaaagtcaatcaagtatttcactctataaaaagccttactatattttaagccaattttctgttccaaagactagtcagttacttcctatcccaggggctttgctttcttgaggaggcacaagtcagttgaaatatgggctatggccaagacaatgatagtagcaagggacaggactcctcagccatgatcagaaagagtactgttaggatttagtgagaagccttcaggggaaggaggaggcttggttttcaaatcatgccaagggacagacttaccattgccatggagtcaaattaaccttaccagcccagtcaaaataattaaaaattaatacagtctctgataaagtttgttgatataaattggtgctagggaaatatttcaaggaaacaatgacatgagttattttaaattattaatttcattggtcaggaacccaatcagaattaaatatgcacatataaaacaacctcccttgtgtgttcaactctgtctcatttctgcatggacctcagtggatgacttttgaagaagcagatgaaaagtgaatgcttgccaattagctattgttcaccgttttccagtaagcattcatatttctaaaggattatagtctagtccaaactctgatcaaggtcaccatgcaagaaagaggatattctgatatggagatgaagaaaatttgagtccgggttggttctcaacttacctatgaggtcaggtgaaaacttcagacatcagttccccatgcctaacatcaggacaaaattaactatccatttcctttacaatttgttagagtatcatattaaatgtgaaacatgattaaactggagcatcacatttgaaaagcaactcattattattacatgtaaattttaaatagcattcaggaaatgttagaattaagaacaaatcaccaataaaaactttagaagattaccatttagactcatgatatgagtggatctcgttgcaaactgatttttccaaatgagaaaaaatacaattatactttcaaaaataacccaggtggctaaccaggttccagttttcctccttaggtataaaaatcttgctgaagttcacataaaccacatgctgctcacctataactagtcagccacacaagatcctatattgtatttttgttcttgatcagagacaattatgtaagttatcgatccttataaagttctagaaaatgaaacctcagaattgcctattattcacacagcaatctttacacttggcaaagtttagcacctactccattattgcaaagcctaaatttgctggtgaatcagtagtgtgactggtcggctgatccacagaaatattatttgtaggtgttactgaatgtgtatttttgttattgaaaaattgaaacatctgatcttctcctatggactagctacactagatctagttactgtactaaaatatggattatataagttatctttgatttaattgtccctaaatccataagcatatttttttcaagagtatgtttcagttatattttaagtacaagggaagtagttagaaaatagaacactgattactagatttgtatagtgaggactatatcctagtaaaggccagggctatggaaaaatacaaagcagatttttcactcctggcttcgatatttatgaactgtgtaactttgggctcattacttaacctcatggagtctctttgtaaaaacactggatgagaattggagaaaaatagaaatacaagaatataaggataaggaaggaaatcagtacactgtagtgaagccatcataattgctatgcttcatttcattatatgatgccagacagaatttctaaagggtatgaattcatggagtcaacatagaaaatttcgaatacaaatgctatttattcagcattacttgattcgtgtctttctatggacaaggcactttgtgaggtgttaaacataaactagagacccaagctgaaagttatctgatcttataacaaggcttacaggctcttcgaacatagacaagtaaggacactttggtagaatgaagggcaggaagtgaatgatacctgcaatactggagttgacattttggcccctcaggtaggaaatgaagagaggagaggccaacagctctagaaaaacttcagagaagggtcaatgatatgcagagcagaaaacagtgcttggggaagaaacagcatgaatttaaatatcaaaggtggagcatctctgggaactgagaaaaatcccaggtggtcacatgactgggctttggagatagaggtggagccgagactacaaaacacagggattgaacatccctcccaggatgctgggcctggggagcagggtggcatgacatcatcacagagcctcagcctgagatggaaatgctcacagcctcttgatgcagagcagtagaggtaggggtggttttacttctctgaaatcagttagccaaagcctagattgatttcatacatgagtatatataaatatatatacatacatacataaaatagtaatattaatagaataacaataaagaattttacatttctaaatatttatgttctggctactgttctaagtactcttcgtaaatgagctaatctgcacaaaaggaaatagatactattgtaccattgaatagatattaccaagttggcataggtaagagcaaaggaagtcaggattctaatggggcagactggctctggctaactgatttcagagaagtaaaaccacccctacctctactgctctgcatcaagaggctgtgagcatttcttaggctcacaggtcatcacctctcagccaagccttactgttcctgaggattacgacatgtcaggctctggtaagtacctactattaatgtaccatttagtccccacaacactctattttggcttgttatgtttaggccaatgctacaggttggttttctttctgtttttctatttttttcccacacaaagcatattattaaatgagaaatcccatgtaaaattccagattgatgatttcttttgattaaaaagaaaacaatacagccatactgagtttccctctcacctcttgccagcaactggcagaagcgacttttcaacatgaattccacctcacccttccactactgtcctcaccgccccctactgcccacatctaacctaacttctcatcacctgagtgatcactgtggacatatgagtatgtgacatctatcgtaattatatctgtgtgttaaaaaaaaaaaaagctgaaaagctaaaggagttaaatgtttagattagacagtccaggttcaacctccaagtccacactcataagttcctcttttcttgggcaaatgccttaatctctttaagccttattatcctcacatctaaaatagggttactaataatgcttaactgagagtgttcttatgaaataattaaaccagataatgcctgaaaagaatttagcttggaattcaatattcatttttattgccatttttaccaagaataccaggaagttggtataaataggtcatatatgccacctaaagcaatcaggacttaggcacagattggggtagatgaggttgtgtcttgtgttgagaaagccagaggagaggagcaagtggaagcaacccctcttggggacattgggcctgcagcatgctgcccggcaggagagctgcccaagaactgtcccagaaagagccccgtgggcatcattcttgtgtggctttgactctataaatgaatttctctagacagctgaaatgttcatcaaagtgaaacactgaatcacagctttctgtaattccaccattttctcaggcctgagaagatggatccatgatttctcctttattaggtggatcttttgagttctttcacaggccccgtaacacccattctacagggctgccaccttgaccctggcccacagctcctcatctgcgaaccagatgaaatgcgccttaattagcctcttgtctttcacctgtccccatcttcaagtctaatggcaaactgtcctcagcatgaactgtcctcaatagcgtttgacacatcaccctggtttatacaattttgctgtggtttccgtcagcttgcagaatagaatctgaacatgccagtcatcactggggttcctggctggtgcctggggtatttacccacacttgcacacctgactgcccccagcactgtgtccttgacacccccgtgtctgtgttctctccaccgcggggactggacacgctcggcctgcatgccctctattgcaaccacatcacatccagccaaatcccttggagccaccgagccggaacctgacactttctatcggggtcagcaaacctgttctctaaagaaccagtgagtatgtattgcaggctttgtaggccacccagtctgtttcccagctactccactctgcacttaaagcaggaaaggagctgtaggcaacatgtacagaaatgggtggggctggctctccattaaactttatttatggacatgagaatgtaaatttcatgggtcacataatgttattcatcttttgatttttcccaaccatttaaagccataaaaaccaactttgcgtcaggggctgcacagaaacaagcagtggccacagcagacttcagttgactgacccttgctttatatgcatactgtttgctgatccatactctttttttactttttaaaattaaggtataacgtacatttggtgcaccaatcttaacgcaacagcccagtgaatgttgacttttgtatataaccatgctaccatcacacagatcaagatacaaaacatttttagcagcctaaggttcctaaatggtcccttctaatcacaccgtaacagaagcccaacctctttttgctgccaaagcactctccatacttcctttcataggcctggataaagtaatggggaaacaaccctgtgtaatctaaactttcacagagcagaaagaaatccagaagacaaaggcgcataaacgaaacttcggctatcattaactatcacaaccacagaagagaatgtcttttcttttcaaagacgggtgatacatcattagaaaaactgaaaggcaatgtgttagtacacattcattttcctggcagtctcatgctgacactgcatttccttacctgggtcaaggtgagcgttgcctgcctgcaggtgctgcactgtaccctgagttttcccggctgcactctttgacaggggcctttgcaatacacataaaagctgttgtagattgatctacctgctggagaagaaaaagcagaagaagtggctaataatgctgcatctaaattgagacaagaaactctttaaaagcttgttagaggcaaattttaaaactcagtcttcaggaacattttgaaacattactggaataaatattccaatgggaatacaacaatttaatttagaaaatctaactttatgctccaagagtgaaatcttttctctctcttgccaacagccctgtgacttactcagcaaagtaagcagcctactgccaagagaatcgggcaagtgtatctgcaacacagtaaaatcagaggcactctttgccgaggaagtttgaaaagatgacaggaattctttcaggatgctcctgaattctatctcgtgcttccagacacagttttgaagactgcagatttttcctcataatatctacagagaaaaaccagcccatttatcgtgatataaatgatatgatcacagtttgctgggcttctagggttgactttctaactcacagtcacacataaaataagaaaagaggccaacgctgaggaactttcagagaccaagcagctatgtgcagaaatggatggtttgcatttcatttatgatctctctacctaggcaaacaccattcaaataatacattttcaagagtaaaaggtgaacaaacaactaattcaatagttcaatctcagatcatttctctcaactgtcaccatatagggacactctgtaaactagggaaatttaatcaatttatacttccatatctgttaagaattaactttattcagaagcacttaccagaaatacaaccttcttcctgaatttctaaattttgaaaattactaaatagttttttcttttaatccttacctgggtggataatataacagatcatgacataaaagtttctttgaaattttactatgatcatcagaggcacctagagataatatatttttttttaacatttggaatgaaaatcttcagcctcacaaatgcatatgatctattaaaaacaactagaacaaaaataatgaaaaaaatgagattctaaagtcctttgcagcttcatttcccgaatttacaaaaagagcttttgcagacatattggattatcatttgtttagctatctttcctaatactgtaggtgacaatactttgcaaaatctgaagcacaacaaagatgtaaagtttcatggttttatcatttgtttgcaatatattttataattattactctataaagattaatatttagtttccagtgggaaatggaagataaaatgtaaatacatgtttatattgatgtgaaagtactattttctgacacttctgtgtaactttaatgccctaatgtacaacatattcaagtacataaatatgacattgctgttagcaaacataataatgacataaaatgtttcacatgtaatatacatgcagcatagaaccatgtattaatgttatagaaatatttgtaacaactgactgaaatatctgtaatatgtaagtaaatgttaatggaaatatttgtaacataaatatttgcaacatgcagagtatcaaaagatcacaagaactgtgacaattctgacgtgcactaagaagtgcatagaagaagaagtgcttagaagaagaacctttactgttaaaacctttatcagcaacaggaacaaatccaatttcacaatttttataaccttttgtaaaggtcaaacaataaaaagaaaaaaggaggaagaaaaggaacaggaaaagcaaaagctttgaaaggggagtcagggctgcaaatacgctagcattgttgaaagagcatattagcaagagttttacaatattaaaagaagcatctcagaaattgcaggaaactaagtgactcttctctctcccttaaggcaatagtgatgtttgcaatattgtttcagctaatgatatatcaacgcagaatctgaaagctaaggaacttttccacctccgaatgctactaccttcgctgaagtccttcagaagttattcagaaaatactgtatgccaatgtctgtgccctagaagcatacaagatgacatgcaatctattacacacactgctttccagacccagccacaagttggggattaacagccagtctaaggaagatcaaggtcaggccagtcgtggctgcagcgcttttcaagctgttggctccacttggtcaagcagctggggcatcaggtaaatcttgagagcccctccagaacggcttccctatttatttagctacataacacaattaaaagttggcaaggttttctgtgtcatgctgtgacctggacaggcatgaaaacaaataacaccccgacaatcttctgggcaaggttcccatcggcctggctgaagggcctaaagtagaaactcttgaatatggagtcataactcttagaggaatggcaaggcaattccaaaaatgacctgagaaacctttcttgtggtatgtagctgtctctagtcaatagcatgaatctcaccctttcacttgttcttggaccttaaaatcctttctctctcctaatcaactcttctgtatggcagcttcttgattatcccaataactaaagtagcttatgtttgtgttcataagagtttcctctttttgtatagtaagttttgaaacatagagagatatttcaaaaattgtacaaatcacatccttcattgtaattcatcacttgcagatatttcgccacgtttgggttccctgtgcgcgtgtgtgtgcatatagctgtgtacacatatactacatgtataaactatttggttgaaggatctgtaacacagtttctgacatcatgctacttcacctctaaattcttcaacatcctaaaactagggatgtttttcatataaaaccatttagctttttaagtgatttggttattttgtagttctattcatagactaatcaggtatattttaagtaggcattacagaaaatgacagtggtttgcaagctaataaaagatgacaataaaaaatattggggattctctcgtcaaaccaatttaggtggtgctaagtgaagccacattaaacaagtcccctgaccataccccttctcagagctgagtgactctgtaaaaatgaaaggatgaagcacaggacatctcaaacttctcctgaccatagatgccttcctggaatgctgcatcgtgtgacactgtacttctcagaaaaaaacaatttagaaaaaaatatcagatgaaggattcaatccacttgtagggcttgatttatagaaagtgaaactgctcatgtttataaacccagatttaccaaattctcctggatatctgcctacggccaagttctttcctccaacccaaaacatcaacgaactcatataattactttgtcatgtgccaggaggttaagtctacttatgtaatgattttgcaaataaagtatgttaattttattcagaagttttgttttttttttttcctgcagagaagttaaaaagaaaagtgtactgagttcagggcccttttaaagcgtgagtcaccgtggccattcagaggtccactggctttctaccattccttagcctaagaagtccatcttcttcttcttttttttttttcttttttcttttttgagatggagtctcgctgtgttgcccagactggagtggaatggtacaatctcggctcactgcaacttcctcctcttgggttcaagtgattctcctgcctcaacctcctgagtagctggaactacaggcgtgcaccaccacacccagctaattttggtatttttagtagagacagggtttcaccatgttggcctggatggtcttgatctcttgacctcatgatctgcccacctcagcctctcaaagtgctgggattacatgcatgagccaccacgcccggccaagtccatcttcttctttagttttctctcacgctttgcctaacagaaccctcagtcaaatcttctcttttcctttcttttcttggtcaaaaaagttgctgaaataacaatgtttacaacatattgaatagagccaatatttgaaaatagtatattttatttgcttgggattttttagaaaccagtataatctttacagttatcatttttcttttatgtattttagataataggcttaagggttgaagacaggatacttaggaagagtcgttctgattctaatggaaacttttcattaacctgagaagtttccatcactagttgtcactgagaatttaattgctgggataatttgttttctaggtggggagagagtaagatttaacatatttcttaccttggtaaaatactgttcagtatcaacatattgtaacagagcaaaacagcaggaacaggacggattttaagtgatatttatcacatgagctattaaaatattaagtagaacaatgtcacccaagagaactctctgcaatgatgaaaatgttctccatttgcactatctcatattaatatatacacacacagacacacacacacacgtacatagcatatgtagccattagctacaactacctatggagaacttgaaacttagtgaggaattactctctgagttttattaatttaaagtagtttcaatttaaatagctgtctgtgggtagcagctaccaaactagaaagcacagaagaagagaataaaaaccactggtgtggctggtcccctcttcaactgacaacgcggagactcactgggcagtgaaacagcttgttttaatctgtgctcatataaaaataatgttggcccgagagaaggagaaggaagaaggttttactcgtggcactggggtaggacagaaacaggggggacttccgtagtgctagaagcagagaaaaggttctcgccatcatgtgcccttatttcctacaccaaggggatctgttcttgagacgcacctggacagcaatggctccatctccatttccatcaccacctttgaaatctgacccatatgctcaaggtacagttagactggcacttcttgtatgatttctgcccttgatttccattatcatatgatatttccctaaaaatgacatctaagagaaggaaagtagccagtgcagtctcatcctcttcgaacagctggcttgcaccaacaccacagaaccagctactgataaggagctgctggcatgaggcgtcccccaagcctttgtccaaagccccccacattgccaagcctggctattggtggtttcagctccttccctctttcctccttctgactacagagttgtccttgtttcttacacatcaagaatgctgctgctggtgtcattagctctcatttttcagttacacctgccatattccctcagttcagccctgcgcctagtcatgcagggagtcacctcagttctggtggagccctggattctcctgtggaatagatgcatggccagagtttctggacccgggacagggatctggtcagaagtaacagcaggggcacagaaccttcttcctcatcatccatcaggattattgctactgtatttctgggtgctggccttcagcagggcttgaccacatttgctggaatacacgtctccacaaggacacaaccagtatgtaccaaatgaacagaatcagcaccacctctgatgtccagcaagcgcttctttacacattatggagagagaacccacttttcttcatgttgagtgaaggtattcattagttctagtttaaccaatatgtacagaaatagtccaaagtggttccacatgaaattcatttggactggacttcctgaatcacctcttctaaggacaccttgctttggagccttaaaaagatggggatcggcctgccgcagtgactcaagcctgtaatcccagcactttgggaggccgaggcaggcggatcacaaggtcaggagatccagaccatcctggctaacacgatgaaaccccttctctattaaaaatacaaaaaattagccggcttggtggccggacccctgtagtcccagctgctcgggaggctgaggcaggagaatcgcttgaacccaggagacggacgctgaagtgagctgagatcccatcactgcactccagcctgggtgacagagcgagactctgtccccccaaccaaaaaagaaaaagatggggataacgaccatttcaccattatgcaggttactgggggaaaagttgctaaactgggcaggtcaaacacggaggcttcattatctcactagaaatctccctctagggagccacagtcagcactctctggaaaggtcatgcagccaaccgattcacttgaccgtcctaacatcccactcagcgcatggccccgtgtctgcccatctttccgtctcactatgtgagtggaccactctcttcagttgaacgcttccttccctctccttctgaaggctcatgggacctcatgtgcacaccactggccctcaatgcgctcaccttgacctttctgtacctgtccaaacttttctatggatacaacctctctgtgtgtaacacttcactctatttcatatgctccaaatggctagtgaagttccctgaactcaataaacactcaataggtatttgctaggtcaataaattctcccatatttttaatggggtgaaaactgaagtgagcatggtggtgtcagggcaacaaatataaaatagaatgcagccatgatcattcaatatctagaacatctttcctaccaaccagacaccctttaaattgttgggatatcatatttgaaatcagtaaaattaaacattagaaaaattacttacataagaactaaaataaaaaaatgtttatataggacttggtgtaactgaatgttaaggagaaaaagtgaaattctaagtttaccaacaagtagaactattctaaaggaagacagttattacatgaacactcttcactccaaaccttgtccaataggttattacacccaactgaatcaaactgcctgttccatgcttttaacgagccataaacttaactcctgtggagtaaccaaggttatgctatattgtaaacagcttccaattacataaccatccatccagtgaatgtacttctaaaaaatacttctaaaacatgcttagcaatctctaaggagactctacacttaaaagttataacttaattctcaaatttttgctggggttttaaattaacgtatctgcacaataatttgacctactgaggcaaaaactgctgattaaatctaatacctttttctgattttttggttgttgttgccaatttattttttcatttttcattttgaaaataataatgaaatttcccataccaagacaaaactgtagagtgaagcaaaatttaagaattaggtttaaataaataacaaagtacaaagccaaaaagagtaaatgtagttgctttttctttcagaaatggatacgggccaggaaatgggcacagttaaggtggtgccaggaaagtcacagctttccaaaagttgaataaactccataatataaatgtagatggaagaaaccatcaatgctgcagataatgtgtccagtttcctcacaatgacatctctatagcctggggtatgtccatcttggcttaaagaggcagcacctatgggaaaactggctagccatatgtagaaagctgaaactggatcccttccttacaccttatacaaaaattaaatcaagatggattaaagactaaaatgtcagacctaaaaccataaaaaccctagaagaaaacctaggcaatgccattcaggacacaggcatgggcaaggacttcatgactgaaacaccaaaagcaatggcaacaaaagccaaaattgacaaatgggatctcattatactaaagagcttctgcacagcagaaactatcatcagagtgaacagacaacctacagaatgggagaaaatttttgcaatctacctatctgacagaaggctaatattcagaatctacaaagaactcaaacaaatttacatgaaaaaaacaagcaaccccatcaaaaagtgggcaaaggatatgaacagacacttctatgcatccatagaacagacagctatgcagccaacagacacatgaaaaaatgctcatcgtcactggtcatcagagaaatgtaaatcaaaaccacaatgagataccatctcatgccagatagaatggcaatcactaaaaagtcagaaaacaacagatgctggagacgatgtggagaaacaggaacgcttttacattgctggtgggagtgtaaattagttcaaccattgtggaagacagtgcagcgattcctcaaggatctagaactagaaataccatttgacccagccatgccattactgggtatatacacccaaaggattataaatcatgctgctaataaagacacacgcacatgtttgcttattgcagtactattcacactagcaaagacttggaaccaacccaaatatccatcaatgatagactggattaagaaaatgtggcacatatacaccgtggaatactatgcagccataaaaaagaatgagttcatgtcctttgtggggatgtggatgaagctggaaaccatcattctcagcaaactatcacaaggacagaaaaccaaacactgcatgttctcactcataggtgggaattgaacaatgagaacacttggatgcagggcggggaacatcacacactggggcctgttgtgggatggggagaggggggagggatagcattaggagaaatacctaatgtaaatgatgagttgatgggtgcagcaaaccaacatggcatatgtatatgtatcaaactggtatgttgtgcacatgcaccctataacttaaagtataataataaaaaataaaataaaataaaataaaataaagaggcagcacctctctggagccatgacctctttgtcaaaccctggcctggccttgtcacctttgggaaatcagctggccctcaatgcctgttctctcatctgcaattatatgtctactattattgtctcagtagacaataatagtatctaactcagtagactgtggtaaggattttaaaaataataatggaggtgaggcacttagaacaatgtctgctatacatggaatgttcagcacatgttgtttatttgtatttgctgccaaaaaaattctgaactcaagctcctcccacggattcttcaagctgtaggcatttacccctcctacttcctcaggtggctactttcctgtttaataaatgttgattcttagacagtatttccatcttaaatccactgcatttttgtaaatagaggaaatataaatcttaaataattctttttaaaattacttcattcccaaccaaatcctttacaattaaatatttaataatattatggaacacaaaccctgatggaaagtcccaaaattgattgaaatttttctagaatcatatttgtttctgtgaatcacttttttattatgaggtaagagatacaggggtggactgcagaaaagttaggaaggaaaataataaacaattacatgatctagtccagttgataaaattttcaagttggctaatatgctttaaaaaaaagtatttccaaaataaaagctttttttattgtatggttgtggaatggtactaaaggggattcaatatgtatttcaaaatttaatatgaatggcagacttgttaaatttgcatccactcttctttgaaaggtaggtacgattgtcagcatttcataacaaagaaaacacaagctaatgggttgaatggtgtccccaagacagcactcggggtcatcagagatttacaggtaagccttcctcattagaaagcacaagctttccttttaaccacatgataataaccttgagtcagacggtggactttacaaaatactgtaggggactgattccatggctcttgcaaagtggcacttacacacagatcggcaattatggacccaggccagcagtcacaaacaccactgcaggtgctggctcactacccccacatccctcatgcaatcagtgctaacagtttcatggaaattcccattaatgttttaaagcactggcattcagtaagaatgtgcaggtacagcaattaccaatgaggaaaattaagtctcattttcaaagattagcacatgttctacaaattgaatgttatcccaagaaatggaatccatggaatgacctgagaatcaatacaatttcttttttatttttacagaagtagtacttttcttgctatttaaaaaataatttaaaattttttaaaaaaacattctaagtgttagaaaaacctgttacgtaaatgaaccctcagaggaatggcattaattaagagagtagagcaacacggtgtgagcctccaaactcccacattctttgttcatcttcaatagccaatataattagttttgtataaatattttatttacatataatatttcctatcttcactgctaacataaaataaacctcttacaaatttcgatgctttaagcatcttatttcacctgtaacaaataagacaaaacattcaatgttaaaaaatttggatcatttctagtattgatttccaaaagcttttggtggtgattgagattcataaaatctctactacctcttaaaagaggagaagacatatttttctctagtaacatactgataagttagaaacacatggtgatgtcatcatgctggggggaaaacatagattatttttttcctttaatcaagactgataagactatgaattacatattgttctaaaagtctgcactggaataactccagctgaaacactcttcactggtactgtgggaccatgaaagtctttctatatcatgagtatctcagtcaaaaggtttccaggaatccatctaagacctcactcaggggccgcctctctcctaccctaaacactccttgctgtaagttcccttcaagttgaatgtctgtagcaggctgagctatcccatcttctgcagtgacttcacctgtttaagtcagcaatcccccgagatttgaagcttctcaagggcaagtttcatgtcagtggtctcacttctattccccacccccaccttcaaccaaaaagaatgttgtcccaggaagacattaaaccctgtgaatgatcaagtaattaagaaattggtgagattaagaaagctcgcttaaactcaacattttaaaaacacaggaaagttgctcggcctgtgctacagattacagtaatgtttctgtttacttttgatattgtctctgcctaaagaagaaaaacatcgggctttgagaatgctgcagagtcacaggccggcatgtattcttcattgcctctataaaaggtaaacttagagaaatctaaacatgcttatatacagtcaggcattgtttaacaacagggatatattctgagaaatgtgtccttagacgattgtggaattgtgcaaacatcagagtgtacttacacacacctagatggcatcacctagtacacagctgggccctatggtacagcctattgctcctaggctatgaacctgtagagcatgttactgtactgaatactgcaggcagtaactgtaacagtaactgtaacacaatggtaagtatttgtatacctaaacatatctaaacatagaaaaggtaatgtgacattatgagggctatgatatgactgggtgatagaaactttttagctcaattaaaatcttatggggccattgttatatatgtggtccatccttgactgtatgtctttatgtggtgcatgactatattagcagtcaataggaaaaaaaatgaagatataaattgataatttatcagtcagtatctagctttctaaatgtactttaatcttgtctgcaaaaaggattgggttgtttgggaaaagggagaatgatggttagaaagtggggtggtggtcctaaagaaacagaagaatattaaaaacctatcaagatgccatctatcaataatgttaacaataaatattgggggaaatctcatggactcaacactagtagtttgtgagaaaataatgaaacaatcaagacaagcctccctttaacagttttcaaatcctagaataacactgagatgtattccgaaacaccgtgaagggtatttcacaatgcatacacaactgggaaggagcctagcatgctcacaatagtaaaacgatgctgggcacagtggctcatgcctgtcatcccagcagtttgggaggctgagacaagttgagcttgagctcaggagttcgagatcagcctgggcagcacagtgagacttcatctctacaaaaaataaacaaaaaaatagctgaatatggtggcacatgcctgtacctccagctaggaatagctaggaggctgaggtgggagaattgcttgagcctgggaggtcaaggctgcagtgagctaacatggtgtcactgcacttcagcctgggctacagaatgacaccctgccttaaaaaaataaaaaaaatgtatattttgtagaattattactatagtaaaaatatttccaaaaaaaaaccatacacacacacacacacacacacacacacacacacacacacacacacacacacacatatgaatagtaagaagtaatagagtcttatattgaaagttctttgatgtcctattctggaattattctagcttcactttcccatgatcctgtgttctatccagatgcatccactcatacccttaggaggccagaaggcagccatgcaccctagatcaaaaggtgttggctcaatgctgttagggagtgaccccagacacatcccctatctctctggagcttggttcaggtctcagacgtacagcatacacacacgaacaccaaggtgccaggagacactgcaggaagaccttcaaaggggaacagatcaaacaaataggcacctgaaggaagggaagggaagtttagaggtggggccaattcaacacccagagttctatgacttccaattgcacgcactttgtttcagctgtaccatcttttctatctccagtatcctaggttttgagcagcagaatcgtggtttccctagagagtcaagacagaaaccacagcacagactgcctcctctcctttcttcagggttggatggttctctctgtgtagttggggatggcagccactggttacctgtggctctgagcacatgaaaggtggttcctgaaactaaggaattcatttttaaatcttatttacatttgtttaatttaaatttaaacagccagttctgtccagtggttatccaaatttgggcaacacaggtctaagggaatgaattccttcttaacacagattgaaggttccagggaagttacctgtatatttgcagacttttatccagtacatatgcaaataatttctgtccagtgaaacagataacacccaaaatgtgtggcctggcggaaatttcttagttgataaatagatagatagaaagatagatccctaatttctcaaggctctctgaattggtcatggtatcttatgatgtccctcattcattaaaagattaaataaaaatttttacatgtgttcactttatatttgctttataattttaccttttgtaaattatactttaggatcttatttttgaggagagagaagattgttaaggctccagcttggagttgtctctcaataagtaagcaataaatattcacctttcttcctcatcctttatccctgctaacagcatctaggaatccttatttcatcctacttccccatctgcaaccttattgggcccagaaataccacttcctctaggaagtcttacttaattcctccatttaatgtaaatcccctccccctaaatgcccactacatttgagttgcatcattcttaggggtcgtaagctacattctatctcacaatatcccatagataattttatctctcctaccaggctttagattcttttgaaggtgaaggctacattttattgcattctccctggtgttgatgaataaaaacggtaaatattatgtggaggaaccaaataactagacttgaaactaatggtgtggtataaaaaagtctttcagcttgcaaaagataaaatcacaatcaactggccttaaaataacttaatctctgtgacaatataatgaggaatgttcttccaggcccattaaaatgacatgcaatttgataattatttttacagtgtcaggattctaaactaaatgtttctcagcttctgttatctggtgatactaaatgaatgttgtcaaaagattaaatgtaaattggttataaatcttcatttaaccacatcatgcagggaaggttacattacagccaccatgttcgtgtcatcattaagaaatggagtcttattttaatagtattaagactattgaaattattgtttattctatctaattggctttggagttgaggatgaagcttttgatgggcatcactgaatacaggagcaaaactgaaataaaaatgaggggcaggccgggcggtggctcacacctgtgataccagcactttgggagggcaaggtgggtggatcatgaggtcaggagttcaagactagcttggccaacatggtgaaaccccatctctactaaaaatacaaaaattagctggcatggtggtgcatgcctgtaatcccagctacttgggagactgaggcaggagaattgcttgaaccgggacccgggaggcagaggtagcagtgagcaagatcgcaccactgcactccagcctgcgctacacagtgagactctgtcacaagaaaactgaagggcaatgaacttaaacccttctggaccccaaatggacaaatggacaggatggggaatagctgcagccactatctgcaggaaacactatcattgtctgaaaggccatcttcactttctaactagattttccaaactaattaaacaatctaatttcagtgaaaagtccttcttttaaaaacccagtttgcggccgggcgcggtggctcacgcctgtaatcccagcactttgggaggccgaggcgggtggatcatgaggtcaggagatcgagatcatcctggctaacaaggtgaaaccccgtctctactaaaaatacaaaaaattagccgggcgcggtggcgggcgcctgtagtcccagctactccggaggctgaggcaggagaatggcgtgaacccgggaagcggagcttgcagtgagccgagattgcgccactgcagtccgcagtccggcctgggcgacagagcgagactccgtctcaaaaaaaaaaaaaaaaaaaaaaaaaaaacccagtttgcctggctttttcaggaaatgacctatggtttgatcacctgtccaaaccatctggcggcaggaatgtgatctagttagactctcacagacggtgtctgggaagctccatcattgggctttaatgttaaagccacacggccacacagccaggacactttgatgaacagccactcacggacacagtgagcccatcatgagatgatgagaccaagttgcattacaatgattttgacagccagcaaaattatatttaaaaatgaaatctttcttttggttctgtatttgaagtaaggaaaatcactttgggggtaaaatcagggttttggaagaaactgatacttcttattaggtttaatttaactggcagtaataattaggacatgataattataccaggtgaagcctgcaatagacttagttctactttaatacttaattgatattgcaaacaccaagattttcggtgtacagacaaatatagtatccttgtataaatgtatatgctcaactaatgcagctattctacaatcgaagaatctctccttaatcaaggaaaatgattcatatcagaaaaactgtaaaaagcacctcttgacacattctccatgtgctacatgaaccaaggcccaatcatttgttcccctcagtctctctcctgatatgcatggtttccacatccctttctacagcctctgtgtgggggtaggaagaaggaagcagaaaaacaaacacacacatccacatgttccttctccttactgctctggcttctcagacttggtcccactacttacatttttttgtttgtttatttgtctgtttgtttgagacacagtctccctctgttgcccagcctggagtgcaatggtgctacctcagctcactgcaacccccacctcccggattcaagctattctcctgactctgcctccctcccaagtagctgggattacaggcgtgtgccaccacacccagctaattttttgtgtgtgtatttttagtagagatggggtttcaccatgttggtcaggctggtttcgaactcctgacctcaagtgatctgcccacctcgccctcccaaagttctaggattacaggcatgagccaccatgcccagttttaaatttttaaaagagtattaataaatacatcaatcagaggaatatgtaagattctactgagaagcacaattcctattagcgcaagggagacaaaaacactatcatggtattgttaaggctccagcttggggttgtctctcaataagtaagcaatattcacctttcttccctatcctttatccctgctaacagcatctaggaatccttaatctatccgacttctaagtaggaggtgagcaggggtgtgggaaaacattctggcaggatctctatgcaaaagaaacaggtggtttagggtgcgattgagaggtagacatgtcccacacagctccagcacagaactgcacgccggggtgacaggtctgcctttcagaggactaagctgctgtggcaacagccagccacagccctccagaggaaggaccacagttcataaactttagagtctctgggagcacttgctggggagcagcgtgatggaggtgctttccagaaggcggtgctgaccaggccgctccctgcggaagcccctctggggaaggacactgggcagcaggaatgatggtggtggctcagcaggggtggagaactcctgtgtgcagcctgtgttcctgctgagagaggccccaagccctggagtcatgacatcaggaggctgtcgtgactcgttcactaggtgtgggaagcccagcactgtgtagtacatgctgcagagggcagaaccctgaggtgtgtggcagcctagagtcctgctgagcatggcagccggggctggaaacagtgaggcctgttctggagtgcctctgtgcaaatccacctatctggggttggggattggacatgagttatttattcgtttattagttattaatttttaagtttaccagggaaattgcatgcatagcaaaatatggaaaccattcattaaaagattcatgagactaaggtatcagttcagtggacacaaaataagcattccaggagtagaaagcaccctactttgtggggtgacattgagacagtgctgggaacctaacagtgaagctccctatgtgaggacctggtgccacaaatggggtggtagataatgcacatgggcctccactcatgttcctccgtggcagcgaattaaagaacatccatcttcttacttcttttctgtttctcagttgccaaccatatgcctgtttagttacacacctcggcatggtggctcacacctgtgatcccagcactttgagaggccaagaaaggtggatcacttgagcccaggagtttgagaccagcccgggcaacatggagaaaccctgtctctacctacataaaaaataaaaattaataaataaattagctggtcatggtggcatgcacctgtactcccagctacttggcaggctgaggtgggagaaatcacttgaacccagtaggtcaaggctacggtgagccatgatcctgccactgtactccagcctgggtaacagagagagttcttgcccaaataaataactaaataaataaaataagaaatcagccaaagacttcacttgctctgacagaaactttcacaaaatctactagaacgcagtggattcagagatctgtcaaacacttctttatctaatactgcataggtgactccctgtctagaaaaattaataaaaactgacaagccacctgcactgtagctcttccgcttcctctactgttcattattggctttatttcatttctatattaaactgcatattacaaactcaggccagctggatctttgcatagatactatatcttgtttctgccagagatgatttttattcagaatgaacagtaaaaggcaacactacgtagaaaatgcacttgagttttaaaataaagatgaaaaaacttgtgcatcatccaatggtcctccgcagcatggaggaaaaaaaaaaaaacatacttcagggagataatatctttccttctccatttcacaaatgggtatcttcaattaaaacacttgtttagattcattagtgtttccttgatttgattcttcggtccatgagtaaatacattttagagattaaatgattagtttctttacatatgaaatagggctaatagtatttgcctttaatgatgttggagaatagtaaataaaataaaatacccttgccaggcatgtacagttgctcccttgtatacataaaggattggctccaagacctcctatggacagcaaaatccaacagtgctcaacacctttatataacatggtgtggtatttgcctataatctgtgtatatcctctcatatattaaaattgtttcatcagcaatggggaaaagactccctattcaataaatggtgctgggataacaggctatagatatacagaagaatgaaattcaagatggattaaagacaatccatcttggagttcatttttctgtatggtgattcctatacagaaaaatacctatcaccatacagaaaaatcaactcaagatggattaaagacttaatgtaagacttcaaactataaaaatcctagaagaaaacctagaaaatatccttcccattctaggccttggtaaagaatgtatgcttaagtcttcaaaaggaattgcaacaaaagcaaaaattgacaagagggacctaattaaacctgcataattaaagagcttcggcatagcaaaagaaacaaacaagggagtaaacaggcaactacagtctggaatcttcaggaatgagcccagcaaggccagagttcatgggggaaaaattttcaacataaacgtaaaagagtgactaaatcaatcaagggtaagaagtgaagattcaagtacaaagcagagggcagcaaaccaggtacaaaggaatctgtcacctatgcagtgagcataacccaacaggtagtttctcaaatcagagacccaaccagtaaccaaggtaaaagagggactaaatcaatcaacgaaaaaaaagtcaagatgcaagttcaaggcagaggtcaggaaacggaactccacatggacacagaatggtctactcatggcgcagccaaggggaggggcaggcagccgtcagggaaaagtactcaaaaaggcaacacttaccgaatgactgaaatttggagtcatggatttcagcagggatttgcagtgaaagaaacaggcatatagagactaagttcccaataaacgttacaattcatcctttcactctcctcttgaaatgggatgtattgtgaatgtattgagctaaattatcctgcatggctttggccagctatcccattctctggtgagtgtttattttcaaagagttagatgagtgaagagcggagaatggtaatgtaaccaatctgatgccttgttagaaaatcttccctcatgataccagaatgctttggtgtgaaagactggttcctgctggaatagtttcttttttaagactaatgcacaaaaatgcatattctgcctatgtttcttcccatgatgtgtattcatttagtgcgtaaggaattatttcttttcttccttgttcgcctcagtcctagtgcccagctcagtatcttgcatttgctgctagttgatgacactgaatttgcagcaaaatgaaatagaccttcttcaattggtctggtctgtttgtcactgagtatatgtgtcattgctgtgacagtaacctggctgatgaatgaaatttactggactatgaacagtaataagatattcctgaagccctggtttctcactttgctatcttaaaccaaagctattaaactcttcaaataagcatgctttattcagtaattcatagacttcaattaaatttggagcagcagagaactctgaacattcccattgatgccacagtggtatggccagagctaggctcaactgctccaaaatcgtcagccaaatacctcagtctcccaagccaaaatttgacatagactatgcttctccggccttatttcattactcaaaataagatgattgaaaaatgtatgaagcttacagtagaatactagtgggcacaagagaggagatgtaaatattcaggtaaaactcaataagttcagaaaaagattttcagcagatgcaaattaattggaaaaaatgtcagatgataaatctttgctttaccactttgcagtctgggtttgacaaggacataatctctaaaaaggaaggattttcaaaagaatcaacagaacattaaaggtatagagaattcagacactaattcaatcatacataatcttatctaacagttaatacactttctaagatgacgtaccagttggaggataagatgcaaaggatgaaaaagataaaagtagatttaatgcaatgttttacaggtaaaacattggttttggtttgaataacgaccttttactcttaccactttggacaacataggaggcagaattctatgataatccccaaaattccagccccctaatatacatgtcctatgtaagtaaccctctcgccttgagtgcaggtggcacctgtaaaaatgatcagatatcctcctattaggaggttatattaaataccaaagataaaggatttttgtagatgtgcaaaaggtcagaaatcggttgattttgaattaatccaaaaggagataccctgggtcggcctgacccaatcagagaagctcccatagaaaaacagtccagatcttgtggaaacgaagatacggagatagagcttccgaccgctttgaagatgtgaactatcatgctgagagtcccacgtgtcagggcattgcaggagcctcaaggagctgaaagcaaccatggctgacagccagcaagaaagctaggacttcagtcctacaacttcagggaatgaattctgccaacaatcatgtcagtgtgaaaaatgaatcccaaactgcagaaaggaacatggcccaattaatgcgttgatccatccttgtgagaccctgagtggaggatgcagttaagcactgctcacaatgtctgcgggtcagacctgaggaaatgcgggacctgactcacagaaattgtgagatcataaatgggtgtcgtttaaagccactgcactagtagtaatttattacacagcaaaaaatgactaatacgtgtggctggtttacttcacctcactgttagttttcttttttttaattttattttattattattatactttaagttttagggtacatgtgcacaatgtgcaggttagttacatatgtcatatgtatacatgtgccatgctggtgtgctgcacccattaactcatcatttagcattaggtatttctcctaatgctatccctcccccctccccccaccgcacaatagtccccagagtgtgatgttccccttcctgcgtccatgtgatctcattgttcaattcccacctatgagtgagaacatgcggtgtttggttttttgtccttgcgatagtttactgagaatgatgatttccaatttcatacatgtccctacaaaggacatgaactcatcattttttatggctgcacagtattccatggtgtatatgtgccacattttcttaatccagtctatcattgttggacatttgggttggttccaagtctttgatattgtgaatagaagaccataataggagggcactttaagaatttcatgtgattgacactcttggcatgtagctagcatgtaataaaagctcagtagaggcagttaatcataataatagtgctgctaatagcactattagtagcagcagtataaactgcagtaattgtgacaggctggaactcctagatatgcttgtaaacaaaattaaattgggatgaagaattctacaggctggtatttgactaaattaaatcaatgcttgattaaatctattgacatctatacgtatgtgtatattggcttattccaaatagacacgtgacacacacacacacacacacacacacacacacacacacacacacacacaaacataatgctccagaaacagcacagtatacctttctacaaatacactacacattttcctacctttgtatctctttcttatgtcctggtttttccccctgaaatgtcattcccacagctctacctgtaaaatttgttgacttttcattgcctacctaggatattgtgtattaacaatgttccaagagctgttgttgtcgttttgtaatatgagataggaatcatatgagataaatattactattattccaatgtatccctttttaaaggacagggaatgaaggactacaaagactgatttggctgtgttcgtggtgtggtgtcagcatctgaaattagtcactcaagctcctggttgtgccttccaccaccacaataagctttgagtcgatggcccctcatagatactcctccataccccaaaaagatttttttttccttttcttatctcttaacgatattttatttgacttagtagggtttaagctaagaccaagctgagctatatttggcatatagatacactgagtttacagaactgcctaacaatgttctggtcaacaatggactgcatatacagtggtagttttataacattacaatacggtatttttactgtactttttctatgtttagatacacaaaaacttgccaatgtcttataatttcctgtagtattcagtccattcacgtgctgtacaggtttgcagcctaagagcaacagctgtaccatgtagcctaggtgtgtgcgaggctataccatgcaggtctgtgtaagtccactccatgatgttcacacaatgccaagatcacctaacggtggactactcagaatgcatccccctcaaaaagtgacccaagactgaatttacatccactaatgtgcatgtggggaaggacaagttggagaaaaagcttgatgcgtgccgtcatttatactttcccagttggaggagagaagccaatcaaagggaattaacagagaggctgcaggccttctggaaggaatctatcttgagggaagtaggcctggggaattggatgctgctgcatcctctttctgggcacggacccaccctgacccagccactctagtattatacgccctagggagaaaatcatggcaaaaaattaaggttgttgctgcaatccccagggcccaagccatcttgctctgagctgctataagagttttacacagtgcaaagccattttctgatcaaattttataaaaaaccatactcatctgagatgccctgggttagtggtacccgaaactcctggtgttcttgggagagacaggcctgttgtcttggttcattttctgtggttataacagtatacctgagactgggtaatttatcaagaaaacatttatgtagctcacagttcttgaggctgggaagtccaagattgggcagccctgtctgggctgcatcataacatggtagacagcaacacgtggtgagagcacatctatgagtgagcaggtgcaaaagacaaaacacaaagagtgaccgaactttataacaacctgctctcatagtaactaatacagtccctcaaaagtaagaacccactcttgtcagatggcattaatccatccatgactgtaaataccttatgacccaagcacctcccgaagttcccaccacctttaaaccaacacacctacattggtgaccaagactcaacaggagcttctgtgagaagaaaccatattcaaaccatagcacctgttgaacttgagaaattcaggcttacatgttattgtggtctatttttaaagctgagagatcgggataccttctttcatctctttggtatcttcagaagtttgaaaagtatttctaagttaatctaaccttctttttcatactaacctgacactgatgtggccaaagagacctggagaacctgagatctctgctgtgcacatctccccaacactatgcaccttggagctcctcatctctgcaccctccatggagccaactccaatgctgtacacacagcagaggcttaataaatgtgctttgaccaaagattttgttgtatcaacccacagtaacaaaattgacagtagatgtagctgatgtgtttaacttcagaaaacatatatggggaaatctcatataaaaggacaatgtggatttacctgggaaatagttattaactaatgtaaactgctggctacagaaaatgactgctgttaatgtagggctgtatatatatatatatatatacttttgttatatatttatacttctattattttattattttatttcctaaacatatatgtttaggaaaccatatgtatatacaaatggaaagagttggaagcaatgatcccccaggggaatctattgcatacaggtagggagaaggcatcaataagtttaataataataataataataataataataataataaaattagatcaaactgggcaggttagaaagaacttaaggagaaagagtcagtgcttaccctaagaaagaaaagactcataaaaaaagagagactgagaaaagcagaaaaataagaatcagggctatgcgctttgagacagacaggcagacaagacagaggcagagacagatacagagagagagagagagacacgcaggcaccagaaaggagagagtgctcccctccaaggctgcgctgcaccccttcctgggtgctgtggataggggccctagggctcctccttccacaatggcactgtaatgggaaaggcccacaacaagcatgaaaccagtcctcacgagcagagccatgtgggtcaaattactgcaatttgggagaaattctgcaaagacatttgggagggatttgtgcaggaggaacaccaagaattttgtttgtttgtttgtttgtttgtagagagagccttgctctgttgccaggctggagtgcagtgctgcaatcttggcttactgcaatctccgcctcctgggttcaagcgattctcctgtcccagcctcccgagtagctgggactacaggcgcctgctaccacgcccagctattttttgtatttttagtagagacggggtttcaccgtgttggtcaggctgatctcaatcttttgaagtcgtgaactgcccgaagactccatgagtataacaagattaacttgagcctaagaattcctaggcatgggcagctcgctgcttcagccactggctcaggccaaatcagttcttcaaaatcagtcatggctccagtcccctccttggtatatgctgctacttatgaggaaatcctaatcctgagcacagaagttcattctcttgctgcgctaatgatccggccagaaagtgctgacagccggctggctgcctggctggctctcctgcaaatgcacagtcttcttgtcatacagcaggaggagcacaatggataaccagtgtatatatctacatttaactttacgtaactatcctagtatacgtatgggacttgcatacagtcttccgcatatgtacatctttacgtagttggtatgatttctctgtaataaagtccaaattttagtgtgtgtgttaattctcttaacatccacaccctttactcattgactattgcattcatttttagctatgcaacactttgaaaataagggtttttttcccccaccttaatgtaataaaccaaaccactgcaaattttatcttgcttttcattatctggaataatttagctactttttttttctctctctaccctttatatctatatccattagaacacagttcctgaaaatcatggtttttgaaaacccaaaacatatccaattatagtttaaatgtaagagactctctcaatgatcaataaatctgacacccacaaacacttgttttactttagaaatggcgcaaatatgtgagtcccaaattatgaaattatggtgttgattttcactttgtgcttgacctctacctgaaggtacaaagctgaggtctaatttgacattaattaatcttactctcttcccctcactcttaaacttgaaaaacatagtagggaaaaatgcactagccttctaccattcttatgccctatgtgacataaaaacaaaagtgaagttagctacttagtcaaagctggcaaatgcattctcaccatccctagtgtccatacagaaaacgtgcatgccttctggacagaaaacactaaggttgtgttcctctattgaaatttgggggaagtccaaaaagatggacaaaggatgttgtattttaaaaaccagtagttccattaaaaaaaaaaaaaaaacttaactacttagtgacctgagtgacatcaatgtgttcttgtgagggctattttctcatgtttggtggtgaatgtgcagacacaatgtttatcgtagagagaattctccaaatagaaggtgtagaaacctcactacgctgagctcattcaaggacctgggcataaagcaaattacaagagggattgaaccacgtaataagagagaagcctttagtctttatttctactgaagcaggtatgctttagagagacgtgtttcaactgaaatgcacaaaccacaaaatcactaaattcaaaattcaaaagagaaattcatcataagggctgtggaattgacttcttagagtatattttgtggaaaatagaaatctggagcactacattttagatgcaaagcataagtgggtccccgatgttacagttggtcaaccacacgtacagacagggactagagactcttctctccaccttcaaaaatgacaaatattggtaatgagagtcccagaactaatcctttcctgtataaatgtgaatgctcatttaaaatttgaaaaataaagttatgattcattaaaatgaaaaacaagaaatttaggggaaaaagttcttagtccattgatcactcatctcactttgctgaaagatcgttaaatggtttgaaattaatgtctgataaatatgtgagctgattgaagttataaatatcttcaaacagctattcaaagcttattaaaaatcttcactttaatgaggcgaaaacatgaaaattgactctacctaatgcctagcagagtccaatattgcactttacatattggtttacaaacattatttccaggtgtctttaaatagagctccaatcttgcactgttctgatttttcaaaatccttccagatatttggactcaagtaccatcactaagaatagaacccacagtaacatcagcctagccacaagcttccacatgcaccaccagtagctgctgctttgcggtgttgtatgctggatcttttgtacacctctaaatgatggaaggtaccacagcgcaatctatgggaccacttctgttttctatccaaactcgctgctcaagtgatcttctcagtcctatggcttacgtatctaccctttgctttttgctaaatttatgtttccagctttgagctgcagatttgtacagcaaattgtctccctgactcatctgccttgccatctctaaattactatgcccaaattagaatccctgattgttcttcaacaaaacctgcttctgcctagtctcccccatcccaacaaaaacacccccagtcacccaggtgttcaagtaactgtgattcatccttaatttctctatttccatcatattcagcttctaatccatcaacagatactgtaggttttatcatcaagatcactccagaatgagaccacctctcaccaccttcagaatgacacaagcgtcacccacgcaagcacctgctcttacctggaatccattacctgcatccatttcagcctgcctgagccatttctccaacagaggctgggcttttcttttagaaacatgaattagagcccattattcctttgctcagcacctgctgatggctacctatgcatattctttacacacatctgcccctgcccctctcccagatcaccagttcattcccagatccagccactctacatctacatacaccaaactcaatatctgccctcggccttggcacttgccattccctcttcctttccactgttcctctcaacattgcacagctagttccctcaatctatccagcactcgacttagagaagcctttcagaaatagtctgtttttgtacaaacgaccaatacctgtatcctttcgatctgtttgacatttctgtatggactcataactagctcaaattatatagcaaattaatttaattacttgcttactggccatctttcccactataaggtcagctccatgaggctaggaatcctgcctgttgttttcaccattacatctgagtacttagaaccactccgccacagagcctgcactccgtaaactttcctttattgaaggaaacataattgaatgtgcatcccttttcacagcctgggtaccagacaattcttatattctattattgtaaaggtaaactgaagtgcaaataaacataactttgaatagcaaggttgtaggttgaaatcaagtagtcattacatatgtatatatgcatgagcatatcttactgaagcaatttttatattattggcctatatggagccagtgaatactcaaattaactgtaagtgtgtctatctgttggcatgagccaagaagtatgacaacagtgacggttcacagagcaggatgtagctggctgcatttgctgtataccaagccagctccttggctagaagcaagtgggaagaagcacaccctctttgaaataatcctgcaagaggcaagctgggcttgaagtctgggaggatccaggggaagagtgaagaggaaggcactcagctgataaccaacttcctcacttgctccacttatatttagtgattgctctgatcacaatttgaataatgctcaccagagactgttagtcagaacaatgtgtcccctaggactgatctactgacttcaatttcatgttctaatacagaacagcatacataacttgaagataggaatctacacaactgtgaacaatagaggagggtcacagaaatctaataacagcctggagagaatcccattcttgctttgctgtcatgccaatgaattgcattctacaagaaactctgttaattgactgctcctatcttgcaccaggcaaaccaagtcacagtgaagagaaggtatccatggctctttaaagcagtactttataaaaattctatgcatgcccatctgaaaataacttaaaatctctgttgtagctttctgatcttctttctatctcataaaaaatatttcaaagtaacatcgtgggttcagacacctgtctccccaatgtgatgtaaattcattggactgatggttcctgtacgacaaatgctggaggtgctgaaggcattccatagatagcttatcagctttctcagaaattaagaggaaattcgctcctcactggaaacctcagataaatatgcctccctctctctctccttttcctttctccctctccttctctctctcctctaaactcagttagtttccaaagaaaatatttcagagagctgagagatcctccctaatacagaagccaaccctcctgatcaccctccatgtaaactgaaatactaacatttctcaatgtttataaagaaaatttactttctgaaagggaaaaccaaatttattgtcccagtgttataaatagtgtttgtaattacaaattgatttcagagaatgtgaagttcagttatgcctaaatagataagcatactttttaaatgggtaagaagtcattgggaaaaaatttaacagtggtgttccctaactccccaaaatctcttcagatgaggaactgcattttatttatactgagaactgcaacaaagtgataaggtgtgagagggaatcctggaaagacagagcagacagtatcagctgcctgctggatctgtatctaggacagtgaaatatcacaatttgatcatttgggaaaataacagccatacacatagcacggtcctaggaaaatcatacttgtgtggtaatcccattcaataggttaataccgaatatgctgaggttttggtattgtgaaattagagagttacctattcattcccaaatcaggaagcctaatttaaccacctgatccgctgtcccaaatgattaactacatcccagagagagaaaaatatatatgaattaaacaaggcaatctctcccagagaagacagaaggaaaactaaggaaatgcagtgctctgtaatttctctggccccacctcactaataagggcctggctgggttaaggctgctgtgtccacagtatcatagtgtcatcacctgtcacctagagatgggggtctgtcactgtgaccacttccataccccttaacctctcagggaggttaatttcacagcccttggaaagccaatttctaacatagtgtcagaataaggtatcactttcccagaacagggagagaggctttatctcaagattatgcgaaacgaggggtatgtagggtatgagcagccacatagggatttggctagcctgacaatttctgcatctcctgactcctattttctgagcctagctcacggcactgttgctgacctgcagtgcctgttgaaggctatgtgctcagggcctttgcagctcccctcccatgcctggctactgtccccttcttctgcaggggctgccttcctttcctttgcaggggtaaaaggatgatgaccaggagaaaggcgacctttcctcctcactccccaactcctgggggttcatccccatcttcctcactaaatatagctcagtttatcaaatggccagttgaatgtcagggaaaatggacccttttcctcagaagtggtggattaattgcttttcctttcacttttctgaggataggcatataatggagcagccgcttggtatgaaatcattgatttgcctcaaggttgagattaagccagtcacttcaaacattttaatattagcaaaaggctttgtgtgattttttcttctctctgctgtgactttattcaaggtctttagatcacaggggctttgacaagtttgtcagtgatcaggggctgccttaatcaagtaagaaaaaaaatcccgccaagacctcctatgcatttatatgttacaggactgtttaatgccagtatctgcacaaagcgtggtgtgtaaactacaggctttagaggatattaattaatacagattggagaatttctgatgcagctcattaacagagatcaatatttaaaacttatgtttgggtaaaaaaaaaagtcatggtaaataattgagtaaaagaggaaatacacaccagcataaaagtgtgtttatttattttgcacaaatatcaccatgagcactaatgaacaactatatttccttacagtaaaataataccacatggagacttctaaaagaaacccattgatagagtcctatagtcacccttgtgtacaaaaagtcatgtgaatactgcaaaaagaggcacatcttgtcatttcaatattaactctccaagaggtttttaaaacatctccaatatctatatgtaaaggttattcattaatattggctattatttggatgtgaatcctagaaaaaatatagacatttttaaagcaaagcatatgcaagtatttctatatgatacattaaggaatgtattgactgaaaatacaccaagataatgcatatctcgtaattcagattgaaggaacttattctaaggaaatgctatacaaatatgcacatacaagatgttcactgatgcagtgtcacaaatgcaaaaacctggattaaaaactaatagcctcagttatgttaatggaaagtgaaatactgtgaagccattaaaatgactctaatatctgaggagaaaaaacctcctcctcattttatagacaaagatggtcaattaaaaaataattaacgaaaaaattttccacttttggggaagccattttattgaatacactcacttatttaaacattcaagaaatactggacgtgtccgccagatttcatgtggttagaaacttcatccccaagctcatatattaattttaagtggggcatttgggaggtaactaggattagatgaggtcatcgcagaggggacaccctgataggactggtggtttcataggaagagaaggagatacgaatggacatgcatgctcttgtcctctaaccatgtgaggcagcaagaaggccctcaccagatgccggtggcatgctcttggactttccagcttctagaagcatgagcccaataaacttattttattaacagattatccagactgtggtattctattatagcaacagaaaatggactaagacatatactgaagagttgatgacaaaaataaatatgtgattttgacacattctatgaggaaaagaaaaagatgcagctcagaatcatagtattgaacctaacataggatgggggaaaaaagcagagaatgtgttgttaggatactatgggaaagtgagaacaggtacacgacaatttgcaactaagaatgttttggactcagagggagaatgcccctggcatcatgtcaaggctgggccacactgagttggggcagaggtggggagacagaactgaggaaaagtggagccaggccccagtgagctggctttaggattctgaattttgatttatttcagttcagtttatatactaaaaggtttgattcagttggttcattgaaaagatttaccagggaagaaatgacacaagtcatatgttttaatttagttatataacataatatagagttgtccctgaggatctgaggagggttggttccaggatgcccatggatacgacggtctgcagacactcaagtccttgatataaaatgacagagtatttgcatatagcctacacacatcctactgtatactttaaatcatctctagatgacttgtaatacctatgacaaggtaagagctgtgctaatacttttcatatttattttaaaatttgcattatgttttatatttattgttattttttactgcttttccaccaagtattttttatggattggttgaatctgcagatgcagaaccaagaatagagggcagactgtggtgacagacaccgtctgtgttatcacttgaagagctgtcctgtgggagaaatgacagcatgacaaacaggctatgtggacttcagcacatcggcacaatgtgcctccagttttttcatctggaaaaacaactggcagtgggtggtaagtgatattaatgtcccttccagttccaagtgcagtttagtgctttgggaatagtattcagagattctcttatggcagtgacatttttaccagtgttaggtgaataaaatataactttatgaaaaaaatggtataaaaggattagtatgttatttttcttatacaaaggaaactagctgaatgagaggcttaagggatatttgtcttttattatgtgaggtttttttgaaatttaaaatatgaagaaccaaaacttaccactaaatcctactgtccagattgcttttaaaagttctactgtgagaggtaaactgggaatctgagtgtgtttccagttgtgtaataattacattgccttattgttttttagccaggtaatattcttatctggaggcgatgtttaatattgtttgaatatctatgtgacttgcagcactatcataaatgagtcttacgacatgcctccgtcattctgatattgtggacaaatgatgttatagctatctacgaacattacatataaagaatgcatattgtcaagattgaattttacctgaggtctgagcccctggaaaacaatgaaaattaaagaaatactcctcatggccgggcgcagtggctgaagcctctaatcccagcactttgggaggccaaggcaggtggatcatgaggtcaggagttcgagactagcctggccaacatggcgaaaccctgtctctactaaaaaaatacaaaaactagcgcggtggctggtgcctgtaatcccagctactcggaaggctgaggcaggagaactgcttgaagccgggaggtggaggttgcagggagccgagattgcaccattgcactctagcctgggtgacagagcaagactctgtctcaaagaaagaaagaaagaaagagagagagagggagggaggaaaggagggaggaaagaaagaaaaagacggaaagaaagagagagaaagaaagaaagaaggaaaggaaggaaggaaggaaggaaggaaggaaggaaggaaggaaggaaggaagaaaggaagaaagaaagaaagaaagaaagaaagaaagaaagaaagaaagaaagaaagaaagaaagaaagaaactcctcacccttcagtgtgatcaaaaacagcttactgccaggtccccctttccccatatgaattagatgtgtcacctaacactggtaaaaatgtaactgctataagtgaatctctgaataatattctcaaagcactaaactgcacttggaactggaagggacattaatatcacttgtacccgttgactacataggacaaggccagacttccaattcctatcctttgcctcaacaatgattagctggattgcttgtccctactgatgaatcagaaatgcttattggttaaatttggtgaaggttctctctatcctcagaaccctgacctcaaccccagccagcagagagcctctcctgagaagaagctggccctagggtaaaaccctctctcatttactatcccatatgtctttcttccaccccactcctccacaccagttcttactagcttgtttattcccctgtataaaagaaagcccaagcttggtgtggtggctcacgcctgtatcctagcactttgggaggccgagatgggccgatcactggaggtcaggagtttgaaaccagcctggccaacatggtgaaactccatctctactaaaaatacaaaaaaaaaaaaaattaactgggcatgatggcacatgactgtaatcccagctactcaggaggctaaggcaggagcatcgcttgaacctgggacgcagaggttgcagtgagccgagattgcaccattgcactccgcctgggtgacaagagagaaactccatttcgaaaaaagaaagaaagagagagagagggacagagagagagagaaagaaaggagaggaaggaaggaaagagagagaaagaatgggagagagagagagagaaggagggaaggaaggaaggaaggagagagaaagaagaaagaaaagaaaagaaaagaaaagccccttttgcctaacccttgagatgcctgcagatcttatggtcagagcattcttctattgcacccatcctcctcccactattcgaatagcccatccctaagcccctgcaataatcctttctaataacgtctactcttactaaattgagatttattttttatttgacagggtttttaatgagaaatgctttttacgaggttagaatagttctggtggttgttccttagtctctcatcacatctcctttatgacttggaaagataaatttagcatggaaaaaaatgtgattattagaaaacaaaaagaattttaaatcatgaaagaaatttatgcaaacaatagggcaagacctagtacataaaaagagtcagtgaagcgaataaaaacaacaacaaaacagcaccaccaccaccacttaaccacaaagtgaaacaatttacataatgatttcttgcttttcttcttcatattattgaaagtttctttgttcatgttatctccagtggtctgttaaatgtttgcaatgcctcagtgctcctctgaacaactttgttaggaatgagaagtgctctacctatcaacaacaaaggcagccgaatggctagaaataagtttgttgaaaatacttcttgggttctgccttacctgtcaatcacaaaaagaaggtggagaaaggaggcatgcttatggcatcccagttttaaggaagaacattttagcaataagcaagcagtcaccaaaaggattcaaaaaggcagtgggtttagggtgctttgtttcactgtgaacatgaactgtcataaatgcatatctgatattttaatatcagatatttggttaaaaaaaaaaaagtgaggtaggagggtgcatttcattatctctcccagatacgtactggccatctggtgggaaagaaaacaggcagtctcagtccagggaccagaggatctcctttgtccctgtacatacacgcaagaacgcacatattacattatccaggtagagagcacgtggtaggttacaaagaagccatgaggaagaaataggaaacctgaattgtagttgcactcctctcaatatcctcatcagcaaaatgaatgagttgttaataattacaattgtaccaactgtcatactttgccatatggcttgtatatgtgtttggtattttaaatctataacatacagtcatgtgccccatctgcatcaatcatggcatgtgtatatggtggtattttgtattttaccctactttttaatgtttagatacaaaaatactctccattgtgttacagttgcctgcagtattcagtacagaaacatgctgcatgggtttgttgtctaggggcaataggctacaccgtacagcccaggtgtgcagtaggctataccatctagatttgtgtaagtatactctatgttgtttgcacaacaagaagattgtctaaccatgtgtttttcagaagtatgttgtcattaagtgacacgtgactatacataaatatgttaatagcttgtaatgaagacataagctctaattctgatcaagcctagacaaagcaacttacatacataattcttaaaataaaaacccaaggaagacgttagtattccttgtttctggaaaaggagccaagaccctgggagttaagtggccttctatgaggccagatgactgggccaggacccactacctggctgaccccaaagttcacccttttattcattctgctgcattggttgtgacctagaatattctgttgtttttctggtttagagaaacagaaagaagactcagagtagactctgaaatgtccactccccacacattgcccagagccactggaggtacaatgtgccaggcacagctgtgtgggcagcaaggcacgtggagcaggaagcaaaggatgatgccgaggcacgggccacgtgtgcagtgcccgaagggggtctcctctggtcgtggctgtgcaccagtgacagaagggtttacttactatgatactggagaccaccatgatcactgacatttccttaatgatgcacaaaatgaagcgcacaagtatccaacaaatgaccagagaaaacgctagcatacttctctgaatgtacacttcagagaaggagggaaatgcttaaatgtaatattttagataaatcactgaatacaattagtatagtaagtacactatggatttgatggtatgtagtaatacgtctctatggcaagctcatctcctggaaaactggaactacatttgtccacaagcctttctcactgagcaggaacacagcttgcaggttggccgactcatctccccagattttattttctattttatctatatttttcctggctctaatttgtttctgttttgttacattttatagattcctacaaacctctttaactattttgtaatgcaagatatttgagcataaatccctaaaagacatattattttatgatgtaaaggtttcattttttccattttatagatgattaaatagaggcccggcatggttaagcggcaagcccagagtcagccatccaacgcagcgcagagctgtgatacaacccacttccactcccacggcatctcggcttcgtgggagttgaggagcgtctcaactgcatgtcaggagaacccatgaaaaggaaagaacccagaacaaatgggtgagaaagttcaagactatgttcagcgtaagagcaaaagcctcctgagaattctgcttgcagcccattcccaggcattacagtgcaaagctaattagggagaatggcatgagtagaagaccaccaagaccaccagctgaaacgggtgttctcatggcctccagtgggctcgactatttttatatttttaatattttggtccaatcactactctatacaacttagctgtcttaaaacaataaagccaaaacaaaaataaaacaataacccaggcctcccagatgttggcttcagtctgtgttcacaagttatcttcctaatataacagcatgagtactacttccccatactgttctcatgagatctatggccaggtccaaggtcacatcatagtaaatctttatgaaggttaagaaatttataacatttgcatttgttcacgaatgtcaataatcccaaccggcaggttttacgctcaggtttgaatgacactttgctaaccaagccattaaggtttgtttcaaggagtcgggggaagctccccagcagctctgagcaaatgaggagccagagaaaaacaattaaaaattttttaaaataagatctttgaaagtatattattaattctatcatccaataagtgttttcgaagactatgcaaatgacatcttgcggtataaaagctgttacagaacagaccttccaacatttctcagtctccttctttccttcccacgcatgccctatgtgtggactggcagcaatgtttttacttttaagaggaatttcatcatttgggaaaaatttagagatattaacgaaaaattgctatgtgtctcatggctacctactgattagaagcaattaacttatttctattttgaaaaattaggctagcaaatgaagcctgtgggagaagcatatttaataaatatagaaatattaattgtaggaagtaacaataacaccatgcaaagttgtcctgtacattgaaaaatcatactgattgtttacctccttattcacagcaagggaatcaagaccatagaagtcaacctgtagctgtataattgcgtccaaatcccagtgaagagtaaatgctaaagcattagggtgaacccattaaaactgagaaaagagagggaaataaatcaatacttaagagtagagttacctaccaaagtaccattcagttcaacacatttggaggcctctttttcatatatgatgagttttcactcatatacactgataaaaaggtgaagcataaaacatctagaatgatgttttgaagaaggtgaaagaatcactgtggtgaagactatagaactgccctgcctccatctctcctaggcactttagccattttactctaaagcagatttggagttgactttttaaatttcctttcaatgttagaaatttaaattagaaaatgtatgttaaagttgattaaaacttaacaagttattctgacccattttcctcttctactgcaattctgtctaatgtcttttatgatgcctttacaattactgttatcatcatcattattattttagtctatcatgtaggaaaatataactggattttgatttccttaagaggttttctacattatttagatttgtgaaagaatgttattgtaagtaaatagcaccaaatcttaaggatacaatatataactgctaacgcaaacagtatttgagaaatgcatctagatattcattactttattaaaaaagacatagaattggcataataaattgctagataaagcaattgagtaaagtgtaatgagttcaagtagagataagatcattttatggagataaatgaattagagaggttgtgattgagaagtgagaagtggttaaagtgttttaagacaaattataatatctaggtcttatccctacttatattgataggcatgatttggtgggaaaaaaagaaacattgtcactttaagtatttccctatcctaaatgaaagctactttattcaagagtataagctaccctaagtttctttattttaaactttgaatgcttcatcacacaaatgtttatattttaatagaaatgtattatgtctgatgatatccaacatatatatacaggctattgaattctatatgtagtaataatcatgaaactcagtgttttctcaattatatcagcaaattctctaacacagatatgccaggttttcttcaactttgatgaagtcactttagttctagtaaagtagaattccttctagaaggaatttaaaagaagctgaatttcctggcttccccccacccccaacaagcacctatataatttatcagtccatatttcaaactactttatttattcaattacaacacattccatggataattctaaaataaactcccacatttaaaattaaggagccacaaaagacacttttaaaataagaaattgcataaagagagaagaaaaaataaaatttttcacaacctacaaattaccaccaagttttacattgagtttgacattcctggtattcagagcaaaatatggacacaaagactcatgcacacactgggtgacctcatttcactgttgtatgtgtgattcctcattctaagtatagaatccaggaggtgcgggtccctttgtccccaccaggaaaatgcagttttccacagtgttaaggttggttacctttttccaatggcagaaaatgcaggccagaaactgagaaagttgctcagttcatacagaaagcagactgcctaacatgaacctcttagtagtcagagcgacatatgctattgaagtaatgtgttcctttattttctaaatggatccttcccaagtaaaatgtacctaagtacataaaccatttagtgggaatacatacacaaagagttgcctcctagatgtaaatgcctcttgaacaacaatcaactattaactcatgcaaaaatattttgataacattttcacaattatctgctaaattaaaggaaactactcacagcaacaaatgccatcaacatctggcagtgaaacaactttgaggtacatctggacaaaaatgactcatgtctaccctcacctgttgcaggctttacacctacagagaggcagctcctctttgccccaacatatttagtttctggactgcattttcgccttctgttgcaaaatggcaatcaaccttattaccgtagaaaactgcatcttcatggtaaggacaaaggggtctgtacattctggaattatattcaacacttacatttacatgaaagagccttgaaaacaatagaataattagacatgtttgtgagataattatgtcatgtaatgatgcctattacccaaagagctgttggttccttaaaaaaaaaaaaacatttatcagccaatcttgcagacttgtaggatctgaagaacagcactgttctcatcagagctaaaagcatatgctatgaatggggtcctccacatggcaatgaccgcaataaattaccagtgtgtgttctgttttcttgagatgggctcaatttatcattttattgaaaaggttccattatgctaatgtcttacaaaatcacattctgctgttgctggaaggtcatgaggggatataaatttttgcatttagaactaagaagttgtatagcagtcacagactccaagggttaataagaagccatcaaattacattcaaggacttatcaatgacagctcttcagcatgctctcctagttaacaaaagagaaaaaggggaatattgttccaagcttaacatcacacacacaaaaatgcttcaagtataaacgtattaaaacttggttttaacacaggttgatcatttgaaaaaaaagtcattgaaattttatctgtcagtgtgaagtatcagtataacaggtacatttaatacgagtttaatagaggtttctagtacatagtactcagtttgtttaaattagctactatcttcaaagactttcaaagataagtttgctgaagatctacaaagaatgcaaaaattaatatgcatattttagtgtaacctcattgtgtctataaggaggataatggagatttttgactagcatcaaatcccacatctcagtgagttcttagggaaaagaaagatgatgagctaattattcaatgcaaattagatattattccttagagaaatgttttgtttccatcttttcaagaattactgtttccttccaatcatgaaggactgtggatgtaattcacgaatatatggtgccatcaatctatcaataatttgcagttatgggcaacaactgtcaaacagctgagtaaaaacacataaaaccagatagctccctttggaccaattattgtaaaccatagaaacactgaggaaaaacagttgctctttagaaacacttggtatatacttggcatccaattttgtaatgcaacctaacaagcagaatgtaaacaacagtaactgcattgctagatttgtcattctgttttgtctggttcagcagctaagtggttacgaatattaacattctacaacatcagtgtaccttaaattcaagaggccattttgaatggatcactgattgcattttgatggaattcccagggaggtgatgagtaagaagccaggttgtggtctagggctgggcacattcaatcttattctgtattaaagtacagagatggagatacacaatatgctctttcctcacctggaactaatttgacagggaaaaaaaaagctttagaaatgggtctaagatagtttggaaacccaagttcacaaaattgtgtttaaaaatatataaaaggattatagaacttcttgacaaattcaaattattatataaagtttctcattgagtagctccaaacactgtcaaaattattttttctgtcagttatgtatgtcctgtcaacaggtatatgcattcacgccaaatgaacaggccatggaaagtagacatctctttatttgggaaaccattactcaaagattttaccaaaaaaataaaaaaagatttttggaagagcttggggtgaagtggttgtttttgcatcagggtatatggaattaatgttgattcttccaaatcatgatgactctaatgaatctaatcaagtacacataaacactttgatctaattcaaagaatatggaattttgaatcaaaagacagtggttccaatcttagcctcaatatcttttagctatgacagtttggccaacaatttcatctttactctcagttctccataaaagaaggaatgataattatggccctaagagataatgtaagtgtaaatgtttcacaaactgttagaagaaagggaaatacttattattctcttgagcgtaaaatattgtatctctctggtgatgtaatggttgcagggagcaaagtatatttaccaaaacattttacatattaaataggactattttagtttcattctcttaataatcaaaaaaaatttgaaacttagaattaaaccaaagagattactggtactctttcaatgcgatgtaggtttattatatgggctattttacaactcggtaggagcagtggttcacttttttccagtggaaatacaaagaatttctgtccagtggagcagacaacctcaaatattatggtttattgccctgtaaacacttgacaagatttgtatctagtctagcaatcttatgctaacatctctttattaaattgcatatttacctatctataatcaagacactaatttttccaaagccttttgaaccaatttatacagcttgctgcttctcacattaagtaataggttgaagaaaatttttgacacttgtacattttatatctaatataatatctaatataatataatataaaatagcaaaacagctattttaccttactggaaattataatttaatggttttagaggtcacgctcaaatggaccaaataaccttcatttccaggaagtttgcctcatggactaatatactaaggaatagttcctgaagtcagacagatcttgaaatctgcaaccggggttctccactttttcccctttttcttttctgaatttgtgtgtttggttttgcttggagcacagactcacaataatctatttccctttggtggtcacagtgattgggaattgccttgatagtctgactggcaatctctggacctggatgacacagctttattctttgttgaataagagacaacagagactatgtgtaagtcacttgtgtttacttatctcttggtgacctcagatcaattaaaaatcatatgcccactggggaggaaaacagctctttgaggtctggactaatacatttttgtgattctctatcttcttttgacgcatgactgaagttgtaggactgaagctataaattctctacatggctttgcgtctacatatctgtaattcacaaaagctgttgcctccgttgtgtgaaatgtttccctgcttgttgcaggctgaattacgtcaaaattcctatgttgaagctctaacccccagcacctcctaatccaactgtatttgattaattataatgaggtctttcgggtgagccctcatgcaatctgactactgtccttataggaagaggaaatttacacaccagacaagagggtatgtagaggaaaccccgtgagaggaaacggagaagacggccatctgtacaccaaagagacatgcctagaaagaaagcaaacctacaacaccttgatcttggacatttggcctccagaaccacaaaaaatagattttggttgttgaagaaaaataaataatgacatatacaaatggaataccggcaaaattcacagaaaataaagcaaactctgagtacttcaagtgttctagatttttagggaaaaatctcctcttatagaaactgcttgctcagaaatccaatcacatacatatggtgaatctttggacaatggaacagttttaataatttgggtttaagaaaggaaaaacttttctctcatttttcagtgttaaatatgtgataaggtttctattttacattttaacaggttggggtttggtttcccaggaaaagcgtacttaatccgaacttctcgtacttctcaaactatttttcaatcacaaaatcttgcattacagtgacataattttaaagttttttgaaaaatatacatttttagctgactaaatagaataataattctggcaagtttttctgtagtaggttcttatatctttatatataacttgcaaacatggattgatcttcagacagctaggtaatttgtattaaggctgaaaacaaaagcaatgataaacagacataatatttagtttacatatttttggccctttagttatacatactatagaatggctatatttttgagtcacattaattgttttagttttgctactttaggagcctgtagctctaaaaattgtactatatatatttatagctttgttagtctgctaaaatgtttgtgtttgacacacagctctcctattatgactttccagtttctttgtgaaatcaaagatcttattttgaatacaagttataatcggatttggtggctgagacttaaatagaagaaacagtaacagaaaaatacaacgatttatccaaagtaatgggatgagctttctttttcaagaatgaaaagaatagggtattttttccctaaagcaaagtgttgttttgtaccagtatatgaaatgacaccgtgaaagataaaacttgagagaacacagcaagttgtggaaaatttgagggaagtgaattttaactgcttttgtttataacacctatgtctgaaaagaagctataaaatatattaaaattcacctaattttgattggcttatttgtgagataaattaagggggaaaatgatctcataaaacctatatttccaatgcattaatgcaaaattaaaagtagtctttttcttagttgaattaataaattcatcttagaattcttaccaaggcatagtaaaaatactatttttcccttttgtgtgatatgaccagaaagcagagattttataacccaccagaataatctctgctttgtgttgattctagcatagtgttagaaaataaaaatctacaattatgaaaggcaaagtttcctcacttgtgaatgaaccaagattccctgcaatcatattacatttaccaacaattatttttgaacacttgttaatttgattaaatcgataattaaaggcacctaggattttattatagccaaacgaccaagtctactctgacaactactttaatttccccccagccccatgatcagatctaaaatttaaaaatatagaccataaaaattcaacaatatactttatacttaaaactggctttaaaatctcccacaggctccctggagagaggagctggaaagccttaggtttgtttcaagggttttgtatttcttaatcacctccccactacagaagagctatggaatgagctgtcaaatcagaaggacgctcagccttccctgggttcagtttgtgtacatgaaatgttatgcacagaaatctgttactaatcgaacattttatgggaagaccaaggagagtcatcagagcccatgctgtccattatatatatgttcttactctccggagaaacattgatcaaactcttataaaatagtcatacactgtgtcacaaagggttattttacactcgtcattctgatattgctggtcactgtagtaattaatccagccttttattagtatcaaactggtttctgtctccatctgatgcttgcctgagaactgtgctataaaccacaggcctggggttgtatcttcagcgtatactcctgtttccagacttctcagaaaggagtgtgccagatactctgaactactgatacttcaaagaatagactcttgggtactggcgttagagctgacatcagctcaacaactttcagactgtaccagggaatgaatcagaatttccaggacttattttagtctggaaatagatgttcttcatgaaactagcacctaacccaagatccaaaaaataacaattaattacacaagaacaaatgaactgatgagttaaattatggctacttattttgaatgtttttagtattgcatttaatgttaatttttatggatatatgaagttctctttcttcttcatcagtatcactttggatataatagactattgcttttgtatataattttttttttttttaagacagagtcttgctctgtcaccaggctggagtgcagtggcatgatctcggctcactgccacctccaccttccaggttcagtggattctcctgcctcagcctcccgagtacctgggactacaggtgcaccaccaccacacccagctaatttttgtatttttagtagagacgaggtttcaccatgttggccaggatggtctcgatctcttgacctcgtgatcagcccgccttggcctcccaaagggctgggattacaggcgtgagccaccagctgcttttgcatataaaatttaaaaaactgtaagtagtatctgatttttagcatccttcgaaaggcagaaagaaatacttttactgattctccttactttttcatgagaacatagttattaacataggttcaattaggatttgttctcatcttaccaggatacaattgaacaaattgattatgcaacaaaggatacacatggagaattatatatgagaataaatctcacttcatcaaacacagcggcacgctagtccggaaaactgacgagacacgtagctagtgcctacgaagcccagtggacaaatcaggtttactacctggctattagagtcctgttcctgagaacttcaagaagaaaggaattcatcccaatttatatatacagtgcaggcaaaatatggtggagagaatgtcttggaattgtttcccgagctttgagaaagaaaagcaaataataaaggcttttaaaagtcaaatctaagattccttaaaaaaaaatctcaggcagaattaattatctgggtcaaattatatggctatagatttgtaaagcaaactcaagcaggcctatctggttaattaacagtctcattggaactatgtaaaaaataaggccatgtttcatctggatgaaaatagcatttttctgtgattaaaacaaaacaaaacaaaacaaaacgaaacctttgtgggctaggtgcagtgtttaacgcctgtaatccagcactttgggaggccgaggcagagggatcaccttgaagtcaggagtttcagaccatcctggccaacaggtcgaaatcctgtctctactaaaaatacaaaagttagccgggcatggttgcaggcgcctgtactcccagctactccggaggctgaggcaggagaatcgcttgagcccaggacgcagaggttgcagtgagccgagatcacaccacaggactccagcctgggttacaacagagcaagactccgtctcaaaaacaaacaaatgaaaaccgttttgattatttataagggggggggcagggaatggagtgtaaaaaaatagccacaacttagaaatgggccaaatagacaactagatgtccttttggtgcagcgttgagcttgttttcctattggcagggagctgtaccactttgtagaggctgagataccttgtacatttttgtttggtaaagatttccatccagtgtaacagataaccccaaagtcaatggtttaatatcctcccatttatttatctctctcacacacacacacatgctagaaagaacttttcctttgatcctttgatgagtacacagaagtacagagagttgtataatgagtaaccatcccccagattcaattataaataatgtgtaactagctggttgtcccacttccactgatcctaagattgatcacatggcatcagccagattcccttcacttatatcaacccattcactttcatctaattgtttcatctatttatatctgttggcagaataaagtaggacttgcaaaatggtgaatatctaatttcgcaatgcatctccaattattgtctgaaacttctctgtaaagaaaaattttcctcaactactagggctatttggttaccttgaaatagaattcttacaggaaaagctagataaacccttattttatttttttaattatcaatttcctgagtttgattttagggctctagttatttccaggagtttctaatgtatttgggttttttagcaaaattatgacttgttaagtcttcaataacttttttgtcttagattacacttgttttcatcttggattatcccatcttgggacactgaatcttcattagcccctgtgtccttcaagtatgtcccttctgatttcataatctccactagctttcaaataagatagccacacaagatacacaaggttcatcttgcatatgatttgtcccaggcctaaaatcttctattcttcaatgattccttgtcttttttagttaaaaacagtattaagagaccacaatctgagtggccacaaacgtactcctagttaataggtttagatgaatgatccagacactctacctgaaaagaggggagagtgggaggatcaggagacaggaaaacactagtacatgaagtgttaaaactggctgctcatcagaatcacctgtgaaaccttcaacatagagattctcaggcctcaaccattatggaatatgatgatcaaaggggagcccaggttatgtaaaaggccctaaggaaatgaagtcactccggggcccactaggcgggagtgctgagttacagtctccaagcagccacatttccagaccttgggatccagtatattagatatgcttagcagttgaagaatttctttcttatcttaaatagtaatacatattcattctagaaagttcatataaaccaaatattcgaaataaaaataagtcacaatcccatcacaagaagaaactgctattaaatcttgcatctgcattttaatattcttctttatgtatgcacatgcataaacggggatatatatggttagttattttttatagagtaagatcacaaactactcagtaatttggaattgaattttgtcatgtggtgtctttccatgccattaaataatattctcaacatcatcttcaatggatccatagtgtttcattttatagaactgccaaacattcagaacctatggttgtacctcttgatagttttccattttttactaatataaacagtgttgaacatccttctagataatctactgtgtatatctgtaatataattttatcataaactctgagagtataaatgactaagtcaaaaggtcgaaattgcattttctcttgtgagaattctaaaataattccctatcagtttaaagtaagaaaagtctagggcacatgaaaagaactagaaatgaagaagcaagtgtgcataaagagggaaggaaacatgctgactcttatcttttagagctgtcacacattgaattttaatgtttggggaaataaccaatgtagctgttaggaagctgtgattcaaacatggtagcactaaacgatacatcactgtattgggggcaggtgcaacataaacctcccatggatatttgtcaggtgaagaattcaggaataaggtttgcctatctgtatatagaattttgaagtcagggtaccttctagtgttgactgcaatggttaagtcatctgtctgtctctgacaaaagagctagaccctgcttcaggaatgcaaacttctcccactgctatggtctgactgtttctgtccccaaataattcagatgttgaaacctaatcaccaatgtgatggcattcagacataagaaatttggaggtgattaggtcatgagtatggagccaccgtgaatgggatacgtgctcttacagaagatgccctggagagctgctgtgctccctccaccatgagagggcacggctggaaggcaccatctatgaaccagcaagcagccttcggctgacatcagctttaaaggtgccttgttctttcacttcccagcatctagaactggaagaaataaatatctgttgcttataagccactgactcattttgtattttgtcatagcagcccaaaggggctaagacacccacaattgggaatcttggatgagaatgaactatatttcccattttcaaaaagcttatcaatgagtgaataaacaaatgttgttttcattcatttaacacatattattaagttagtaagcatcaacaatgtgcccagcactgtgttaggtactgcaacagcccagagtgagaggaaatgcccctgcttcctggagcctgccttccagcgggcagcctaccacctgcgtgtgctattctggtggccaggacgctgttgtctacagtaacctggtaaattaactatgttaagagagtactttttctttcttcacagaaacaagaaaaattatttgccgtggagtccaagagaggagcatatctatcgaaatggtaattgaaagagaaactggaaacatcacctgtatgaaaaatagtggatggctctgttaacgaaacaggcatgctggtgacaacaggcaacaaatctaatctaatctaatctaatctaatctaatctaatctgtttctccataataagcagcaatcatacaacccactaaatgactgctgttgcttgtcactgaagatgtccatattttactgggacataacatttcttcttggcatgaagagaatggattaagcaaatgaataaaagctatggttctactttaccagcacaaatggacaaatccaaaataaataactgttacagcaactatgctaaccgtattaattaaaatatgcaaggtatactcattctcattttcataaaaggaaatcctaaacgctcaatttgaagtatgtttcctcactatttgtaggaacttctagtcctagaattcttggtccacctttccccaagattgtattcatttgttaaatatgagacaccaccaaaattgtaatgatgccacaatgggagagttaatgaagtaaaaaaatattaaatgagtcaactattattaaaaaagaggcaacttcatatccatcaattagaaatcaaagagtctggctggctatttatcatcaaaaatcttttattggtataaaaaagtccacacaataagcagctttttaaaataaccactcaggccagagtatcactcaccaagctgtgactttatgttctttgtaacaataaagaaattacatggcaaacaacaatctgtgaaaactttcaaatcatactttcctaagctatcgctctagattaaaatgtttgccttagttttcagggggttagagaagagtgtcttatctccaaacagaacaacttcatgaagatgcatacacactttcttcttgcagctaaggaaggaccgtctttgactaggtaaagatccatgtatttgaatcatgaaaatatccaaaaagacgggctgggcatggcggctcacatctgtaatcccaaatactgggaggctgaggtgggcagatcatgaggtcaggagtttgccaccagtctggctaacatggtaaaaccctgtctctattaaaaatacaaaaattagctgggcatggtggtgggtgcctgtaatcccagcttctctggaggctgagggaggagaattgctttaatctgagaagtgggggttgcattgagctgagatggcacctttgactccagcctgggtgatagggtgggactccatctcaaaaaaaaaaaaaaaggaaatatccaaaaagacacattagcaggactcagttcccagtgtgttgtttgaggcactgaccctgatctgaaaacagtgctcagttgattcaatctgaatctgtgtccaccgtcttcctgctcacttagaataagagctgtgtttgcattgcacaatgaacacccacttgctgaaagctaacttgttcctaactgcccccatccttcatccactgccagagccagctttgttaagccccctgtgacctatatctgtgacctatccctagctaatcttctctttcaaaatatgaagtggggtacacactcatcgccaaagggtcctttgagcaagtcccagtagaaaatttatccactttttggatgaagtactcaaaaaagagtactacatttcccaacataaaatggaaaacaaatacatatgccatacatcattcagggctggaaaacaacgaaaatgtaacactccagaaaaacagccatgggaagtattattcctcatgccatccatcattatcatagagcacccactattctaatttagctccaaatgtgtggtggaggtgatcaaactttaaaattaagtaaacaaagagattcatacaaaaataaaataaaataaaataaaataaaataaaataaaataaaataaaataaaaaccctgaccccaaaactagagtaacctgacgtctcccaagtatgggttggggacctagcacctgttctgggggcaattcaggcaggtagccctggatctgtaaacctaggtagtattttagagcctgagcacaatattgggcctttgtacatgtgaactagaaagcaaagggataactgaaatggataacagatagtcagcacttggtatattccaggcctttctctaggcccttgtcacgaagtatctgacatcaacttcatgagttaggtactttttccttatctctgtatgagaaatggggaaactgtggcctggtatgtttaaaaacaaaacaaaacagtgcactattcacttgaggatcttattaaaatgaaggttactgattcagtaggtctgatagggggccaatgattctgcatttctgataaactcccaattgctgctgctggcccacagatcacactttggactgcaagaaagtaaattctccgagtcctagaggtagcaagaagtagagccaagacgggctaagttgcttggctccggggcccacacttactgccagtcggcttagcatttgcatggcagacacatcacagcccaggtaccatgaatgcgctcaaggattcaaaatcaatgtctgtcaccctttttgactgcattttctagcaacaaaaattctgtattcagtgcgtagtatataccaggaactgtggtaaacactggttcaaacgattttcatttaatccactgaagtaaattatcggccatttgattcccttcttacaggaagcaaatcacaaccccactgatgcactgggactctagtgagtttaattatcatgcacagaaaagattgagcattaatttgcaaagaattagaatctaataacacacctctaacaccaaaggtagtcaacctttggggattgaggaagaattgtaagatcttacagagcatcagaggtatcatttggaaaattaattatagtcaaatagatgaagaaggtgtaggagtttgggcctgattctgtgaaattatcaaaaagtactctaaaaaagaatgtagtgatattttccttgtcataagggtttcattttctattatataatagatattttattaattctgtttttcttacataagtagaccataaattcttgatttatgtatgaaatgtttggaagctacaggtcatacaaaataacaccttctataaaatttcacaaaatttccattagtccttatttactcagaacaaatttagaaagattgaaaagagtgtattacagacagttaaattctaccacttaatttgaaattttttctttatcttccctttaagaaagtggaatccagcagcctgcctgcatttttggcagactctgcaataattacgatgctcagatgattcccaagatggacctccccagctgtaaataccctgcctccacgctcattcctgtcaagtgcagatctccccatcttggcatatgggcagtgtcctctgaaacacttcagggtttgaagagtaaaagatgtaaatgatttgcttcactggccatgtaggcctccaggagagggacacccagacactaccatttgtagaggcctgtcgttagaagagcacactgtccagccaggcctcatggagtcttgaatgcaatgtctcccttccccttgaaatcacaatatgaccttgcagaggtgacttcagaaaaatcaaaacattttgaggctccctacaagtactttacttaacttcaacaaccaatgctgtcatttctcacctactctcccccacagttactttttatttctttatgtttcaaaacagataaccaaccacaaaaagcaaaacaattcccacagaggcatgaacccaaacaggcacgaacaaaagcacaaggtagacggggccagcctcagcctgtgctgccccggcatggtattcctctccgcagctttttgtcaattgcatgctgacactccttcccgctctatttcatgacatgtctcctctccttttggaagcatataagcaaaaacatggggctgggtgtggtggctcacacctgtaatcccagcacttcaagaggccggggtcagtggattacctgaggtcagtagttccagaccagactggccagcgtggccacagtttttcttttttttttctcaaaagcaaaaaattctgaaaaagtagtataccttgtgatatagttttaaaatctgactacttggctgaaatcaattaacatgactcttcaaaaaggtccattttaagactatatctactttctaaccaaaacatctagaggaaatgcaaaatttcctttcacctgatagctatattcaggaaaacacaggctactggatattttacataagctctgaagtgagacggtccctgggtacggcttgaattgtctgggtcggttcctcaagtggtctctgcagtttcctcatctataaagaggatatgaacatggtctaccttacaaggctgcaaggaattaaaagaggtatttcagggaaacagggtttctatagtgccaggtttgcggcaagcactcaccgacaccgcctgcaggtatggcccgttcgcgatgttctgggcagtgcagcagttctaggatttgaaaaccttccgggttgtgttgcctccaccctttcctcctgcagttccttcacaagcagccagcatgaggcttcctgaagtcagatcatgtcactccattgttcaaaagtcaaattttctcaacagggtcaaatcctgggcccagcagaccctacctgacctctccaccctgccctttttctgacatcctcttctccgagctccacctgctccaagctccaccccatactggctgctgcgttttctgggcgggggcctgcctggggctcacgagttgctgtcgcctctgccatttggcacacaaatggatgctccctgagggtgccctcctcacagtttagctcatcacacaggcctcgcggctgctgtatattacggaactccccaccaatactctttgtccccttgactctgctgtttctcgatagaacacacacttactagctgctccaaatagaatagctccgttgaggtaggcatcttgtctgtttctattttctgctacatcccagtacctggcactgtgcttggcacagagtaaggactcaatcgttatttgtttatgtagttcgttaactgtatgacggatattggaggagcctcctatttttttgctaggtccaatagcttcatctcatctgtcaggagatgatgaatggcgcctcatttaggaaacaccaataacacatgaaggtaatttacacacaggcaccctggagcccaggtgcagctcaacgttcttattgaaaatgtagtaaaaatagattttattcactgaccatattttaaggaatactattttttactatttcgggcagtactactcaaagcacagcccctgggcccgcggtgttagcatcacctgggagcttgctggaaacgcaacttctcagcttccatccaaggccaactggtctgggcccagtcatctgtgcttttataggtcctcaggtgattctgatgagcactaaagcttgagtggcactgctgtaaaaactacttcaatgactcgttccagttctttgacgtcctcttacaagtctttagtgtgacatgcttgcgttcttagtaccaacagtgtaactggttcttcatgtacatcatgttatcacctctcatgttgaccacttatcttttgccaactaaaaatacttgaaaggcaccttctcgggtttcagaagtttccatttgtttcgacaacatatgaggctacagcccagctattcacccattagagccctcccacgtccagccagcacttatattcttcgaagttaaaattgaagactctggaagcacagaaaattgggatttcttttaatctctttttctgaggcacaggttttcaaacattgtataaccaaggatttttttcatcttttcaaatgatagatgttttatgtgtttaatatgtgaagtacgtaaagaggaatggtctcaggctgctgtgattggcttggtgtgttcacctctcaccgacctgcctctgttctcccacccagcgtccgattgttccgtgagaacaacaggtaggatccataattgtaaggctggaaaaccttagccatagggcagagtttctcagagtatggtcagtaccaacattttggggcctctacccccagacaaatacatcaaaatttctggtcacagaaaaagaatgaaagaagattttttttctcgccattctggccatcaaagaaacatggaaaaacatgcaagataattctgcacatgagagtctgtgaatctctgctctagtaactttacgctatcatttttagtgaagaaaaataatcatataggcatactgtttgcatatagtcatttcaaatcattccattcagtcttaactcaaaccaagaatgaaccaagacatttgaagagatgaaatctcaatttctctgtataattttaaataaagcattcgctctaaaagctaaatgcacaggagttctgttgaatgactgactatgtttacaatttgaagcaatttagtaaacatgtatcaccactcttctaagagattttggggaaaactacagttaattggacaaaaactccatcctcaaagagattaaaaggtgaagtcagaactggagtacaaaatagcaagtaataagggagagtcctaagagttctgaaaaggattccctccagttctaatgagcaggagaggattacttgtagtttagctgttagtttaacacagagttaaatctgaaagttgacctgggatgcaccatctctcttttcccaatctttacagatgcaacatatctttacagaggccttttagtagcagcatgtagggtgccaggaagttgcccccagtgtgtagtggtgcagggagaagtgttaggatggcaaccctgcagcccccaactgcaccatgtagagttgcctgagccagtccctagcctgccaaaagcacaaggctggcaggccacaagacagaggggtaaatgagaaacagggtgatcagaggttagatgtgactcagacatgagtggaaagtcaaggtgaaacagcgcatcatcatagatcatacagtactctgaaggctgctgtcatttaccacattccataaatttactagaatttattctctattgtttgggttgaaataatcacacatttcaatttaaaaatataaagagaatattagacatttagcagaattttctcagtgcctactggtacttcagaccctatatagagagaatactatattttcttaaaatattatggtctagagagagagagagagtcagttgaaagtgtcaataattctaagttcattctcataaaagaaaattctggagaagaccaagggcaattttatgataaaacaaaataagaagactaaaattttcagatgaatatggttgataagagagtagagccagatgcactaggaaatgtattaaagaacatgaatatgtacacaacaggattcttgtgctcaaattgtttttaatattcagataataagtaaaggtttaattttgctctaaacaatgtgatttttttatttttagtaagaattttattttgggaaatcaaattaaagaactagtagataggtctcctaacataataaatccaatctgttatacagttgtacaggaacaaacatagtaaatatagggtttggtaccatttttggtttcaggcgtacactgggggatttgaaacgtattgcctgttgatggggagggacaactgtacatgtgagacacccagaaaaaatgcataaatctcaaagaggtgcctaaaattcaggcttgaataccatcttcaatggcaaaggaagaaagggagaggagaagacaagagtaaggtttgttaggcagattattcagttggtgccttctcaaggatcagagtctccagagactctgtcctcctcatcctagtaaggagagggagacacccttacaaatggagacttccttggtagatataaatttcccttacaaaagggtcacttctactctgtttttagagcttttcctgtgtctactgtttctcaaaataatcagcttaaaataatacttatgctaaagtggcatattttggggtggcatattctggtctcatacacactcaaggtggaattttccattgtttggtttataatgttggagcatgagtattctctagaggtgtcagtgtcagaatgatcttatacatactctggttgaaacgtcagaattgttatgggcttgggttcgatatttatattaatatattattctggtcacaagagtattgcaggggtttagatttatctcatttttccccatttttgacatttatttccatttctcaatttttctttccagacctgaggtgcccagctcacatgaagcagagcctctttccctcccacaatcatctcaagatcaccagagcatcagttaatgccttactttctgggcttatctactcctgtatttaaagatgttgtttctacattttcacttgtccttggaaattatctttttttattttttgcaagatcatcgaaaatttttaagttccttaaattttatttagtaagtttagtaggaggcatttcttattatgttaggcttccatcttgcaggccccagaactttctgacactgtgaaggccataccagcccacaactgccaggatctattgtatgtgggaggaaaatcaacttctaccctgtaaagtcattgtgattattttgtgtcttctgtcaaacacagtaaaaattaattctattacacctttgactatttagattagagaataaaagactaagaggcacatattaatttttttaaaataactaaacaataacaatctttgccaaagaaaagcattttgaaatgggtggtagcatagagagaaggaagagtcctttcacactaaggatgtcattgccattggcatatctggctttagaaactacaaatggctcgattagctttagagttctttctgctttttagaatttttctacatcactagaaacatatctcttatatttaatctcaatatgaaaacctgtttcatagtacttacaataaatgcattctcaaatgttacatcaaagtactccacctacagtgatgtctccttgtagtgaattagagactccaatccaaaacgtatcataaactaaatatgcacccggtgaggccatgctccatgcagactgcactaaacaaacaaacaaaatgctttaataatcttagagcattccaattacctggacttccagctggtggtgagtccttcctgctgtcagtgtgcagaatgacagccagccccacagagtctcctgggaggactgagctgctgaggtccacccgagtcaagctctggggctcccgctcacagcctcccgccgcgtttctggggtcgtcgcctccagttgcattcatttcttgaccttttctccacggtctctgcacaatgtgaacaatgctctgctgatccaggtcacaattctgtttgggagcaaggtaaaaaaaaaaaaaaaaaaaaaggaaatgtcaaacatgaaatgcgagatagagtttaacttgccctccgtggtagaagggaagcaaaagtgacatgtaactgaccaacttaggtgctcctttgcccacagcagttacacactacacacggtagacaaacaacactgaactggggccagaaacagaaatttgggaatacgtgaaacacaatagaatgctgacgtcatattcaaaaggacataaaatctagcaggaaaaaataattaccaaactggatctataagcacagtgaaaacaataattccttttttccccccaagacagagtctcactctgtcatccaggctggagtgcagtggtgtgatttccgctcattgcaacctctgcctgccgggttcaagcaattctcctgcctcagcctcccgagtagctgggattataggcgggcaccaccacacctggctacgaaaaatattcttaaatagtaaaactgattgacatcagaattgatatgtcattcatctctgttttacaaaagtacagaaagtgagttattatcaatgagagggcatttctttaaagcatcggaaatgaatgcgtttgagtaggctccacacacaccgctccacgggcaccaacacacacatcattacactggtggggaagcaagacaggagcacactcttgccacccagggttcattctctttctgacgatttaaccatgaaaaccagctaacatttacgaaaaggttttgcatctacatattgacacgtaggaacagaagactttaacattttgtagcataaaaattaaaagtcagattatttgctagcacaagaactaggctaccctaaatggaattctagtttcagaatatctactacatagggccggccgcggtggctcaggcctctaatcccagcactttgagaggcctaggtgggtggatagcctgaggtcaggagttcgagaagagcctgaccaacatggcaaaaccccatctcaactgaaaatacaaaaattagctgggcgtgttagcgtgcgcctgtaatcccagctactcgggaggctgaggcaggaggatcacttgaacgccacccccacccccccaaccaaaaaataatatctactacatagaagcagttactcatatgcttgctaccctcttaagacacagcaaggaccttactctctcagtaaatcgatgtggccggccgcagtggctcacacctgtaatcccagcactttgggaggccaaggcgggcggatcacttgaggccagtagtttgtgaccagccagggcaaaatggtgaaaccccatctctactaaaaatacaaaaaaaattagccggctttggtggcatgtacctgtaatcccagctacttgggaggctgaaacaagataattgcttgaacctgggaggcgaaggttggagtgagccaagatcatgccactgcactccagcctgggcaacagagagagagactctgtctcaaaaaataaaattaaattaaattaaatacaaataaaccaatgcctttcaaatacctcttgccattgtcattttaggaatgctccaagaacactcaagtgaaatgcatccataactcatagcgatgaatgatgcccttccctgctgctttctcaagctcttctgttgccctcaccatcaatgtccctcgaacagtggtgcccagcactcaccaacacccctgaccccaaatacaatggctagaatctgcctcctccacccaggagggcaccaggacacccttcgtccttaaatcccattccaacctcttctctactcttacaccctggggctccgtctcatccccaggccctgtgcccctccccattctcagagctcccagtctctccctaggactgctcctactcagcagaggccactgtgcatcattctctgacctgaagtgctcccctgcatgacttcccagtttctgtcaaaggaaaaaccatcccccacatcacccgcttcgagccttcccctcccacctaaaaatctcattatcctcccatgttttgtaacgggctgcaagagaatcactatcttgaattcctcctacctaatctttgacatcggcaaggcaccaacagttagcaattctgtctcagaattacccttcacatcttcaactcttttacatctcaatagtcacctccccgttttaggccttcctcatgataatagctttgtaattactccccacatctgatatcgccatactccagtccaatacatacaagaattctgggtgtgtgctacataatctttctaaagtgtctcagtattacttgtaaaatggactgtaacatctcccatgttcttcaagtgtgtttgtacttttttcctttctaaatcatgatctagatttgatttttcatcttccttacccctcctatatgatacatgtggcagattaaactattcttcaaaatcatgcacgcctgtacattagtgcgcatacatcatgctccccacttcctccctgcaatctgtgtccagccacatgaatggctttggccaaagggatgttagcagatgtggttgaaccagggccttatatttgtcccgctgctaaggtccatcaaaagaacatccctgccaggcacagtagctcacccctataatccaagcactttgggagactggggtgggcggatcacttgaggtcaggagttcaaggccagcctggccaacacggtgaaaccccgtctgtactaaaaagataaaaattagccgggcatggtggtgcgtgcctgtaatcccagctactcaagaggctgaggcaggagaatcacttaaacccaggaggcgaaggttgcagtgacctgagatctcaccactgcactgcactgcacagagcaagactccgttgcaaaaaacagaacttcccagaaagcttctacctgttcacacatggcccagacctgagtccaacccactgaggtgaccaagtgcagccacactcacagcatgaagcagggacccgcagctgaagccagcctgaggccgcgggcaccctcgctgacctgtaggcacatgagaagatggcatacttttatggcactgagatttctgcttgtcctctaatcaataatggcagacagtcctctattttccattctatttggacaagctatcactgtccatgatcagctccgtgtcaggcagcactcctccagctgtgcacagcctctagcctaagtcgtttcagagaaatgggcatcaggatccgagtatactcaaggacttgcacaggagcatgtgagctttgccacagaaggaaaagtggagaattagcaccctagcctatcttgaggtttctatccacattttttccctacctttccatgttcaggactcagttacttcctgtgatcctcctagagaaaagtaacacctttctccctcatctgaatctaaaaatctttgcttactgtgctcttcttattgcagtggttagagcttggacagtatatacatatatattgtgtgtgtgtgtgtgtgtgtgtgtgtgtgtgtgtgtctgtgtctgagtcttatcttccaacttattttagaaatacttgagagcagcaacttggccatagtagcattcatcagaacacctcacacagtgctttggagccaggagatgtagaaacatatctatgaattctaaaagtttgaaaaagtgaatgactgaagggaagtaagaaagaatgaaggagtgaatgaatcaatgaatataaacagtcataagctcagtgcccaaagtgccacagagggaaccagcagaacaagaaagaaaggacacagaatttaaagtcaaacggactcaagctctacataatttattagctgtatgaattttggcaaatgattcttcctttcccagctttctgccattgacaataatatatcaactttgaaggctgttttgaagatttaaggaaatgtaaagagctcagatcccgatccgcaatgatacatcgttggtagtattgttaccatttatgagtttcagaaaactaaagaggatgggtccctaatcttgtacatgaataaggtgtcagaattctgtttagctgcacacttctgtttggaaaatatacagagaaggcagaataagcagaagctatcaatgtgacaatctctctggtagcattccaactttctgtgaactaaaaatcgatacaaaaaaataattcctatatcaccatatagccagatgccatgaaacacgtgaagaacctgagtgaattttcagggacaggtaaaatgtgacaaatgttgatgaaatctaaaagatttcaaatccagattttcctaatgctcagggtacagctgcaaaggggaaaagaaagttctcaaacagatttcagtagttacagtgatacttataggacgcatttccctcagttggcatccctgtttctgaaatcattaattgcttaatctttgactcttacagaaaatcttcttggttccagaagcggtgcctttgacagacagtggactcacacaccacactggttcagttcaaagccacattccatggacagtacattggatacagtccagttgtacagccacgcaaaagccccaaatactacttagttctcctagtatacaaaaaaattcctcagatgtgggaagaaagagattttcggtgggaagacatcagagtgctccaatatggtttcaggctaccttagagcagaaacaatgtcttatttatctttgtttctccaataaataaaatattacctgtcaaagagaaaacccttaatacaattctttctttttttataacaatatattaatccaacaagtaaggcagtaacaaattcttcagtgtagacaaaccaagtaggtatttctgtaaccgggtttggtcttacactgtcaagcacagctgatgacccatgggagactgagggatcagtatcttgggctttctgtctataggatccttgacatggaaacataccagtattaacaaaacatccatgggagttttttttgccaaacaatgatcaactctcatctggttggacattatccaataatatacaaaaaactgatgtatttttctttttccaaaaagaagttccttcaacggcacatagttaagatccaaatatttcagattcttccaagcacttaataaagagttacaaatatcatctctaaaatgattaataatgagattctaaaattgttaacaataccacattattaatacattgttttcaggagttatgaaaatagttatgttaataataaaaaacatatagaatatacttagccgtatattgcagaccattacaggttttgagacataataaattatttattattctcacactctgatgagggaataactatcaccatctgctatgtctcaatgtgtcctcaaaatttatttgtttcaacttaaccatcaatgtgattgcatgaagaggtggagcctctagaaggtgattaaatcatgatggggcagagccttcatgaatgggattagtgcccttataaggcagtgcaagtgactttctgtcctttttgcccttttagctcttcccctcttccagcaagtgaagacacaacaagaaggccctcaccagacactgaataccaacaccttgaccttggatttcccagctttcagaattttataaattgcccagtctcaggtattttgttatagcaagacaaagaatacaagacaacatacataaagttagtgtgtaaacagagctagaaatagtgtgtaaatccaagagaactgtgcctggcacagataatgctgttttacagattacttattgtggttgctgttgattccactttatagaagacaaaggggagccacagagaagttcacgatgggttcaacaacacccagctcccgagtgtgaagccagggtaggaacccaggccatcgactcctctgctggtgttcattgactctgctgagaggaagtggagacttggatgaggcagacaaactaggacaagtctacaggggcccatggtgaagaccagggtttggatgctgcaacggaaccaccccaggtacgaaggaatgattcagagaagagccagatagctgaaatgttaaaaacatgagaagacaggatctgggacggggctgtataggaggtagcaaagtaaagattagtccagtgtgattttaaagaggaaacaaaacaaaacaaacaaaaaggatgaaagtaagaacaagtgggttgcagaggaatcagtgagagtatggaaagtgaaaagaagatggtataggtgagctggtaacacacctcgcagactccggatgctggtgctggctcaaggtaaagtctgtacctctggagatcccgtcaccccagggaagactgcacttatcacgtcgtattgtagtttctttgtatgcgttgctctctgttaccagacaataccgtctttaagaaaaaatactgcaactgtgtctgtagtacctactgtagggacctgttcataaaacacactcccctgtgtctactgaatgactctatgatcctttaagcacatacctagaagtgaggaaacattccagatggcgttagtaacttacccaagtcaagtctgatgcataattgggaaatgaaagagccaggcctgcagcctcagttttctggctctgagcccaatgctctatttcaaacatcccaccttggattgtccacctctctgtgctcacgacataagtagacatgttggcagaagtgcccagccagtgtgcttttatcagcatactgatcagtctatactcattggcatacttactgtaccactgtctatggtctgtaaagtaggtagggctgtcttcaatatcttcagtatcattcattcattttcagttccttctaaatctgttaaactctatttcctcatacaaaatgcttaaaatcatttcagtgtatggccaacaaacatatgaaataatgtttaatatcactagtgatcagggaaaggcaagtcgaaaccacaatgcgataccatcttactcctgcaagagtggccataataaaaaaatcgaaaacagtagatgttggtgtggatgcggtgatcagggaacacttctacactgctggtgggaatgtaaaccagtacagccactacagaaaatagtgtggagattccttagagaatctaaaagcagaactaccatttgatccagaaatcccactactgggtatctacccagaggaaaagaagtcattatacagaaaagatacttgcacacgcaagtttatagcagcacaattcacaattgcaaaatcgtggaaccaacccacatgtccaccaatcaatgagtggataaagaaatcgtggtatatgatggaatactgctcagccataaaaaggaatgaattaatggcattcacagcaatctggatgggattggagactattattctaagtgaagtaactcagggatggaaaaccaaacattgtatgttcttactgatagatgagagctaagctatgaggacacaaagacataagcatgatacaatggacttcagggacgtaggggaaagggtgggaggggagtgagggataaaatacaacatatatggtgcagtaggtactgcttgagtgttgggtgcaccaggatctcacaaatcaccactaactaacttacgtaaacaaataccatctgtaccccaataacttatgggaaaaaaatcatttcagtggaaggctgtcaaactttctaatgtgtaataactttacattttaaagactgaacatttctgatttttatttggatttttaatagactacattttctatctagaaaaggaatacaatcagccaagaatgatcagactaatttaaaaatcaatagtgttaacagattctaatgttaaaacatttttacattgagttctttcttaaataactttgaagacacacttttaataacaccttaaattgtccttttttgtgctgaacaatcttggcattctttctattttttgcttcttctgaaaataacttctaacaaacagatttttttttttttaaggcagggtctcactctgttacagcccaggctggagtgcagtggcatgatcaaggctcgctgctgcctcgaactcccagactcaagtgatcctcttatggcagcctcctgagttgctgagactacaggcacacgccactacacctagctaattttctagtttttttttttttttttttttgtagagatgggatctcacttatgctgcccaggctggtctcaaattctcaaattcctgggcataaatgattctcctgccttggactcccaaacactgggattccaggcctgagccactgcacctggctttaagcagatgtggttggaagcccatcacagtttttaataacgtattttctatgccaagaaaagacaaaacggcaatgatttaataagttaggccgaatgcagtggctcacgtctgtaatcccagcactttgggaggtcaaggagggcagatcacttgaggtcaggagtttgagaccagcctggccaatgtagtgaaacccgtgtctactaaaaatacattaaaaaaaattagccagacgtggtggcacaagcctgtaatcctggctacttgagaggctgaggcaggagaatctctcgaacctgggatgtggacgttgcagtgaaccaagatcgcaccagtccactccagcctgggtgacagagcgagactccgtctcaaaaaaaaaaaaaaaggtgttatttaaaggtgttttttaatgtaatggctaagaactattttgtttggtcactgctaacaatgaaatgtgtttcaagacaagatgagccagagatgttcacagtaagtcagaataatcaaaaagggaattgttcccagtgatattttttcacttgaactccagttcccctccatagttttcaatgaacactaaatgccaatttatattaattggatgagaacagaaactatcctttcaaactgatccttcatttaaaaaaagggggacttctaaaagatgaatatttgtgatttagcctttcaatttatttcacatttcttatgactgattttcattatgatcaaaaatattatgctgtgtaaagatactgaaaggccccttctctggttcccaaaggcaggcaatacaattactgtgaaaggtcaattagccccacactaattagccagtgcaggcctgggccttgtcacctccatgtccctcccaccacaggcctgagacctttctgctgctcatgaggatcctacaccagaggggctccatagggggcgggaggggggaccgctcaggaatcactcggtttggctacatgccagcaactgcagtaagtgatttagttttgaagagcagaggacagtgctgtttgagcatgtagggtcgggatttcacttctctgggttccctctttcatgaatacaaaggatatcggatcaccaaagctatgcccattaaacccactttaaaattgtgttttatattgtcaacattgcaagaaatgcctcaagtatcacttcttttttctttaagtattattttattactagttgtgataaatattatgaacactttaaaatatatatattttatttgacagaattaaattaatgtttttaaagccatggaatacgctgtatagaattactggggtcagggtttgagagcttaacaacacacgctcttgatgaagctgacccggaaactcaggcacgtcggggaggtcagcactacccaacagaaccacatgcgagtttatgccacgcttcccaaattccaatggttgcgattaacactcaaaatcatatacctccgcgattgcaaaacaacatctgcgcaaggtgtttactgtgggattatttataatagaaaattatgggctgggtgcggtggctcatgcttgtaatcccagcactttgggaggctgaggtgggcagatcacccgaggtcaggggttcaagaccagcctggcacacgtggcaaaacctggtctctactaaaaatacaaaaattagccgggtgtggttgtgcgtgcctgtaatcccagctacaggctgggaggctgaggcaggatactcgtttgagccgggaggcggaggttgcagtgagcctagatcgggccactgcactccagcctgggtgacagagtaagcctgtgtctgaaaaaaaaaaaaaaaaaaaaggaaaaaaaattttcagaaacaagtgaaatgcttgaccatagaagacaagtacaatctgtgaagaaaaaagaaaacaaagcagaaaatagaatatagtaagggactttctatgtcaaaagcaaagaaaattaagtacatacaaaagtagctgtttttgtaaaaggaaacgtagaaaggaaaatcgaagttagtgaaaatggttacctatgagggagtagggaaatgggttaaagggatcgaatgggagccatgtttccctaacgtgactatctacagtttcaggtgtgaggcacagaaaatgtttcacaaaatcacaacaatacttactaaataaaaaggagaaaaaaagcaaactctaaaactgaaaattaccagaaacatattgagctgacaatgtcagtacataaataaaagtagttcaagtaacttttggacacagtgctctgtatatcctttagtacaaaaaaaggaacccaaaagaaattttgtactttatttactaagttgattactggtatgatataggtgtaggaattcagaaactatttgtatttatgttaagatgaaaaattactaaacttactgatgtttttggaaaccgagtttttcacagtggctgaagaaggtgagaaggagcttcatgatgttggagttgaaataaaggaaacaaaatgtacttatgaatttttaaaaaatccaattcattgaggggaaattactcacctatccagaagttgcagaataatgagacccatgtatatctattcatcaccttattcaacaattatcaacttgagtccaaccttgttttatcagtatgaattatcatggataaatgatattatcaatatcactacccactttcccttcctatattattttgaggcaaatctcagatatcatattatttactcaacaaaaatgatccatatgtatctctacgaaggaggaattttcctataaaacctaactagaataccattagaggaactgaaaaattacaaataagcatttaatggcatcaaatatttatgtgtccataattttaattttttccaaatctgtttgaatcgagatccaaacaagtccatattttgggactggaaggaatgtatattatatcttcttgtaatttaattaattaatttattaatttattaatgtatttatttatttatttattttgtgagaccaggtctccctctgtcactcaggctggagtgcaggcatgatcagggctcattgcagtctcggcttccagggctcaggggattcctaacctcagcctccccagtagctgggacaactggaatgtgccactacatccagctaattttttgtatatgccatacagacagggttttgccatgttgaccaggctggtctcaaacttctaggctcaagtgatctgcctgcctcagccttccaaagtgttgggattacaggcctgagctactgtgcctggcgttcaatgtttttttattaagacataactaatatattgtagttctcccttttaaagtgtataattcagcagtgtttagaatatttgcaaggttgtgcagccatcaacactctctaatttcacaacattttctcttcagttgcttttacaagttccctcacccatctctcttcctgtttttacaattaaatttgaagaaaaatgggttaatccattgtagaatttctcataatctaaattttgccagttgcatatgggtggtattactgaacaagtttcttcattgtccttattatagaaaattttatatttgtggccaggcacagtggctcacgcctgtaatcccagcgctttgggaggccgaggcaggcggatcacaaggtcaggagatcgagaccatcctggctaacatggtgaaaccccgtctctactaaaaatacaaaaaattagccgggtgtggtggcaggtgcctgtagtcccagctactcgggaggctgaggcaagagaatggtgtgaacctgggaggtggagcttgcagtgagtggagattgcaccactgcactccagtctgggcgacagagcaagactctgtctcaaaaaaaaaaaaaaaaaaaaaagttatatttgattctacaggcttgactaggtttaggcttaatatgttttgctgggattcctgtaagggtgctgctttgttcttcaagaaggaagcactatgtgactatgcctgagtctgactacatttggctgtagtgtatcttctttatggaagatacgctaaaattgtaaaatggtgatcttttaatattatcacttcttctcaaactattagataacatatttctatcaagataaattttccctcaatagctattttgttactcagagataaattttgtataggaaggcagaataaatgctctattattttcttggtttatacattttcaaaataagttgactctagcaatgaataaaaatgcaatttttaaaagcattattaaaaaattatagaaaaggccgggtgcgaggctcatgcctgtaatcccagcactttgagaggccaaagcaggtggatcacttgagataaggagtttgagacccacctggccaacatggtgaaaccctgtctctactaaaaatacaaaaattagccaggcgtggtggcggatgcctgcaatcccagctacttgggaggctgaggcaggagaattgcttgaacctgggaagcagaggttgcagtgaaccaagaccacacaatcgcactcctgcctgggtaacaagagtgaaaatccgtctcaaaaaaaaaaaacgaaattacagacacacacatattaatgatgtccatcgattgtacttattattttgattggtggttatctatagctaattggcacatcttagaatgggatcctgaactgtggcagaggcgcaagagtctttggtagcttccctgccatcctgtatgacaagagactccagtctgctttgaacactttttgttctagacctgtaataaatcattttgacaaataaaaatggcatttaaagatgacgatgtggatggttagagatactcattgctagtggattcataaacgtctgtcagctttttcagtgacaagaggtatgttttgttcgttttttaaagataaaatacatcacgagttcaatctgatatttcccattcaaaccgaggagtagagggttttaaataatctccttcgtcttccatcttaatcttcttttctcttgttcaaaatcgtgaaaatgaaatgattagatgtcacataattactcattattttagactacattatatacacaatgtgaatgataccattaaattgattactaatcatagtttaagtttttctgcttgtagttctttttgtcttgggatgtacctcattaaagatgtatagtcaaactgctgtattctaaagtcacttggaataatgtggctatgattacaactaaagatacttgcattcatttttttgactttattttttattcttagaactttctatttaaaatatttaattctgttttataattatggaaaatattttcaagtttctaaagtcaaactttaaaaacataaaattgtcaaagatgtctcacttctacttttgtctgtttaatatattcactatctttttgtttgtttttagatttctgctttacctctaacagaagctggtgtgtgtgtgtgtgtctgtgtgtgtgtgtgtgtgtgtatttaagcacctctcttagataattgatagcatgttatatacttttttcgcttaatttcccctacaattaattctacagtagtatatacacatttccttattatttttcacaaccatacagtaacctcacgtgtggataaatcatagtttattcaaccaataccctatgttctatgacaaatgaggtcccactggccaagtttgggaaaatataaatacaaaaaagaatagattgataacaggttataatacattaaagaaaaaatccatgaatatatgataatattaaaaagtatacgtgtgaggagtaagaaagagttcttccatacagaacaacagaataaatatggcaagaactgtcggcacagacaatcatatttttgaaggcactgatataataattaattcactcaaggatcaccagtagaagctacagcaaatggatccaagattggtgggaatcgggattttggcagtttccaagtatctgcccacagattccctaataatttcaaaagaggagggttatttctgcaatgggagattcggcaggcatcactgtaactaagattcacacgggcattgtcagttacaaaggattcagcattaacgacaacaaagtttaacccaaatttagcaatgaggagacaataaaacaaatcgaggttgcaggataattctgcaaacaactgacccttacaattcaaatttttgaaggtgcaaattaggtgtgtgtgagaagactgttctatactaaagcaaaataaagatacatgataactgaatgtgatctgtatatttgactaaacttttggtcagaataatttaaaaaaattatccaaagcatacaaacaacctttaaaactcatcagtaaataaataaacaaacattaaaaaagggccaaaggctttaacagatacctcaccaaagaagatacagagatggcaaagaagtaggctccacatcttatgtcctcagggagcagcaaattaacgcaagataccactacacaccaattagaataaatcccagaacaaaggcaacaccaaatactggtgaggacgtggaataacagaactctcgttcattgctactgggaatgcaaaacggtatagtcactttggaaatctggtggtttcttacaaaactaaacatactataaccacacaatgcagcaatacctggagtatttacccaaaggagttgaaaactaaaatcatgtccacacaaaagcctgcacacagatgtttacagcagctttattcaggattgccaaaattcaatgcaaccaacatgttcttcatcaggtgaatggataaagtatcagacatacagatcatggaaaattattgagcactaaagagaaatgaagtatcaagccaggaaatgacatggaggaaccttaagtgcatattaccaagtgaaagaaccaatttgaaaaggctacatcttgtatgattccaatttgaaaaggccacatgttgtattatacgacattcggaaaaaggcaacactatagagacattgaaaatatcagtagttgccagggactgagggatgacggagggatgaatagagacagcacagagaatatttaaggcagtgaaaatactcagggtgatactatgttgatggataaatatcattatacatttgtccagacccacagagtgtacaccaagagtgtaccctcatgtaagctataaatgtgaagtgattacaatgtgtcaatttaggtttatcagctgcaaaaaatgtaccgctctggtgggggatgttgataatggagagggtatgggcacatttgggcagggagtagatgggaaataccttcctctctatgatgtgaacctaaaactgctaaaaaataaataaataaaggcttaaaaaagctataaaggacaatttgggaacaattgggaggatctttgaatatggactacaaaagaaatatcattgtatcgatgttaaattccttgaaatttacatcacacattacagcggctacacagaagattgccctttgcctttgtagatataggctgaagtgtttaggaacaaaatgtcagtctatctgcaattatgtttagcttcttgagagacagaggaaaggaaggaggggaaggtgtgagtgagggagacaaagaaagataaagcaaatgtggcaaagtgttaacagttggggactctggagaaaggttgtacagatatttgctataaatagatttttttaaaaaattttttaaaggtttgaatctcctaaaatatcttcatactcagtcactaaatggaaagtaaccactgaaaatcagaaatgttggcgaggtgaggtggctcacggctgtaatctcaggactttgggaggctgaggtgggtggatcacttgagctcaggagttcaagatcagcctggccaacatggtgaaaccctgactctgactctactaaaaatacaaaaaattagccaggggtggtggcaggagcctgtaatcccagctacttgggaggctgaggcaagagaatcgcttgaacctgggaggctgaggttgcagtgagctgacattgcaccattgcactccatccagcctggacgacagagactccattaaaacaaaaaaaagaaagaaagaaagagagagagagagaaggagagagagggaaagaaagaaagacagaaaaagaaagaaagaaggaaagaaagaaaaagaaagaaagaaagagacagaaacaaagagagaagagaagagaaaagaaaagaaaagaaaagaatcctctgtcttaatcctgagttctaatttgattgccttgtggtctgagagactgtttgttatgatttctgttcttttgcatttgctgaggagtgttttacttccaattatgtggtcaattttagaacaagtgctatgtggtgctgagaagaatgatttggggtgcagagttctatagatgtctattaggaccgcttggtctagagctgagttcaagtcctgaataaccttgttaattttctgcctcattggtctgtttaatactgacagtggggtggtaaagtctcccactattattgtgtgggagtctaagtctctttgtaggcctctaagaagttgttttatgaatatgggtgctgctgtattgggtgcatatatatttaggatagttagctcttcttgttgtattgatccctttaccattatgtaatgcctttctttgtctgttttgatctttgttggtttaatgtctgttttatcagactaagatcgcaaactctcctttttttttgcattccatttgcttggtaaatattcctccatccgtttattctgagcctgtgtgtctctgcacatgggaagggtctcctgaatacagcacactgatgggtactgactttttatccaatttgccagtctgtgtcttttgattggggcatttaagccatttacaattaaggttaatactactacgtgtgaatttgttcctgcattcatgatcctagctggttattttgcacattagttgcagtttctggaaactgaacaacctgctcctgaatgactactgggtaagttatgaaattaaggcagaaataacaaagttctttgaaaccaatgagaacagagacaatgtaccagaatcactgggacacagctaaggtagtgtcaagggggaaatttatagtactaaatgcccacatcagaaggagggaaagatctagaattgacaccctaacatcaccattaaaagaactaaagaagcaagagaaaagaaattcaaaagctaaaaggccaggcatggtggctcactcctctaatcccagcactttggaaggttgaggtgggtggatcacttgaagccaggagttcaagaccagcctggccaacatggtgaaaccccgtctctactaaaaatacaaaaattagctgggcatggtagcgtgtgcctgtaattccagctactcgggaggctgagggaggagaactgcttgaactgagacctggaaggtagaggttacagtgagtggagatgacgccactgtattccagcctgggctacagagtgagactccatctcaaaaaaaaaaaaaaaaaaaaaaggctagaagacgacaagaactaactaagatcagagcagaactgaaggagacagagacatgaaaaacccttccaaaaaatcaatgaatgcaggagctgttcacatatacaccatggaatactatgcaaccataaaaaagaatgagatcatgtcctttgcagggatatggatgaaactagaaaccatcatcctcagcaaaccaacacaggaacagaaaaaaacactgcatccatgccataaaatacaactcagcatagtattccatggtgtacaaaaaggatgagttcatgtcttttgcagggacatggatgcagctggaaaccatcattctgacaaactgtcacaaggacagaaaaccaaaccccgcatgttctcactcataggtgggaattgaacaatgagaacacatggacacagggaggggaacatcacagactggggcctgtcagggggtggggggctagggaagggatagcattaggagaaatacctaatgtaaatgatgagctgacgggtgcagcaaaccaccatggcacatgtttacctatgtaacaaacctacacgttcagcacatgtagcccagaacataaagtaaaattaaaaaaaaaataagaaaataagaaatgcggtattactacaaaatttttaggatgaaaaattgtatgtatttcatgctatctgtcatgaattcagctatctaacctgctatatcctacacatagcttacaaactgacctaagaaaggagggaaaaatgaaagcaaaatccaaagttgcttataaaaaagaaatctttgttttggaatatgagaaagctattgtataaatacagattaccaatatggtttaaatagaagaattatagtcaaataccatagcaaatgagttaaaattttgcagctcattacagttttgaggtctctaaagtgaataagcataatacccaaaatactgactttgtagaatcctaaaatccagttatgcagtctacagcagcagtcctgaatctttttggcaccagggagtggttttgtggaagacaatatttccacagatgagggcaatggggatggggtgtggtttgtggatgaaactggtccacctcagatcatcaggcattagttagattctcgtaagaagcacacagcctagatacctcacacgtgcagttcacaatagggtttgcactcctatgagaatctactgccactgctgatcagacaggagctccagcgtcatgctcatctgcccatactcaccccctgctgtgcagcccaggtcctcacaggccacagacaggttctggcgccacgggggttggagacccctggtatagagcaacgcatgggcaaaagcactgcatgagtaatcaaggtcaaaggcagaattaatggatgttctaatttactatggaggcaacatagcaaaacctcttaaacattttacaacaaagatcctgtccatattacagtcttcaaacagatatggacttccatacaagaagagtatattaaaaaaaaaatccacaccctctcagatgttcactcaaagtgataaaaatggaaacaatggaatcacatctgctaaaatccatattagaaagtatacaaataaaagtgcttatgataaacagctaatgagaataaatggatacactattaagctatcttggcagaatttatcaatgtcttagatgtacatgcagaaattctcacatatgtcctcaaaaacacatgtacatggatgtcctttgcaaccacagtaaaaaccatggcaacaatctaaacagtcatcaatattgggctggctgccattcatacatacaattggtaaacatttgttataactctagaagtacacggaaaagaaggcggtctattttttaaataaaatcagcaagttgcagaatagcatgcactattattattagcccatttgtctgtatgttgtatatcactctgtatatgcattaacttattgggtacacatagcaaattttgattaactctgaagaatgggattaagtgatggaagagaggaatttgaatgtttctgaaattttaaaaagtctaagcacacattactttgataattttaaaaagacacctgggaaattatttgcaagtaaaatactcatttaattcctgataagctttcctttctttctttctctctctcttttttttttttgacagaaaagataatgacagtaaatgctttacttagaatagaatggaattttttttctacttttctgtcaatgtctttatggatgatgttgccatcttcattttgtcactgttagttgtaacttctttctgacctatgttttaccctttctggctacaagctcattttacacacagttatttatatgaacagttgggagccactcactcacctctcttttgagaaaagaaaaatatatttgtgctttctaacttttattatctttatgccaataagtctttttattttcacctaagatttgtgtccatttttggaatggcagagatgctggaaatcatatttcaatccaactgaaatgtacgtgtgagtgtgtgtgtttgtatgtatgcatggttttatgtctttagaattctttgtgagtgctccagtaaatctggtgccttctgagacgacaagagaggattaaggaaatggtatgagttttttgtaactatctcaatgaaaaagtagagaagcatagagtgaaaaaatccttagaacagtcttgctctgtcgcccaggctggagtgcagtagcacgatctcggctcactgcaacctccgcctcccagattaaagcagttctcatgcctcaacgtctgagtagctgggattgcaggtatgcgctatcacacccagctaatttttgtatttttagtagagacagggtttcgccatattggccaggctggtctcgaactcctgacctcaagtgattcacccacctcagcttcccaaagtgctgggattacaagcaggaataaatgttactgtattaaaagtattagatcctgacccctgcttgatgtgttaagctcagtgtcctctatctgaaataaagatacacactagcgtgttctccagattcaccttaattttacctgaacaatattctaaaattttcaaattatagcacaaacatactaagtacacatataattcacaaaaattaaaaacatatatttagccaaaagtaaataaaataaaatcagtaaaataaacaaatctgagaacttcatgaatggcaaccacagcctaaatgcaaagaaggaataaaacagctacttcttggctcttgggctttcatgggcccaggatccactaatgtaagagtaatttcagagattttgaagggtaactgggtatatttatgtattgtgttatttctttcttttttttttttttttttttttttttgagatagagttttgctcttgttgcccaggctggagtgcaatggcgcaatctcggctcactgcaacgtccacctctcgggttcaagtgattctcttgcctcagcctcccaagtagctgggattacagacatgtgcaaccatgcccagctaattttgtatttttagtagagaccaggtttctccatgttggtcaggctggtctcaaactcctaacctcaggtgatccacctgcctcggtctcccaaagtgctgggattacaggcgtgagccaccgcacccggccatattgtgttatttcatctcacatcttgaccttgaactttgccagttctcctataaatagcaattccactgtagtgacttacatttgaagtttgggcagtttttgataaatatccttattactggattttcttttcaaaatgaacaagaatattggacaactcaggtcctccgtttgaagacattcacagctgagaatgatattcgtatacatctgggccacagactagcagttcatctagttaatcagttactatgtagccaacctcacaagttgctatttactgccaatatgctgcacagctacaagtgttatgggctaaattgtgtcccctcacaagtcatacattgaattccaaacccccagtatcccaaatgtgactgtttggagatagggcctttacagaggtaaccaagttaaaatgtcagcattagggtgggtcttatctaacatgaatggaatccttttaagatgagattcaggtatagacagacacagaaaacagaccatgtgaaggtacacggagaagacatctgtaagcccaggagagaggccacagaaggaatcaaccctactgacaccttgactttggaattgtgagaaaataaacatattatttatttaagccacccagtctgtagtgaaggttcattttatacaagaattatacaacattttactggtccctctcgaattctatagcagcaggcatgtatcagggatcttcacagatattttggagatttttttttttttttttttttttttccgagagggcctctggcatatactcttgacataacatctgggcaccatgggtagtacctcctttatgacagatacttcattttaattaggggatgactgcattatttcaagacaaagcaggtgtaggttattattgggtgttgtatcaaagaaataaagaaatgtaggatgacatggggttattcatttctgcattgaaaataaggggaaataaggagttatatagtaggatcttcgcaattacactgaaaccagtatagtgcgtgcttgttgaatgaatgaatatcagtaataactctcaagaactgtattaagcaccatatttactaaatatcttacatattatttgtaatcatcaaaccacactgataaataagtattgtagcagagacagctggcacctcatcgaaatctgtttcctcctcttccccgacaccagatgacctgatttcccaaattccttaacatttagggttggctacactgattccttttatctgatgggtatgactagaagagatgtgtgccactttgaagccaaagcatgttcacagaagttgtagtgaacacagacagacaacaaacagataaatacacgacaaaatggttgataaatgtgtggcggcgggggcatagatggagagatgggcaaaatacaagttagagacaaactctcaactgtaagctgggagctcacatcctatggtttcaaccacacaaccaaagactacaaaatgcagcgtggcagcataatcaaatttacatcatcaggttttggattgtcaataaactttctagagattactctgcacagccaaaattttaaaatgatatcagatacaacagctaaaattactgggttgaaactggaagcttcctttttaaacagagctgtaaatgtataaaatgccacattagggcacaggttttatcacgtttatttgctagctaattattgaatccaaagcctttccaaacttgtttttggatgttcttgtgtttgtttgtttgtttgtttttcctaaatctttatagccgtgagccttgatcttcatgttttctttctcagaaatcaatcattcctttgtgctacataccacctcctccttcctgatagtatgtaggccatcttcaaactccctacaacttcaccaacatttccaactcattttcatacttttaagcccactggcattatacatgcaatactgactccaataaaatttatcatgtgggattagcataagcagaggtggcaaacttctcatttgttgctcccaaaaacaaaatgctagatcgctctcaagtaagaagaaacttgtatcacagtgtggtttggatggttgctatgacaatatcgagttcttctttgagaaagaccatgataaggcattcattaggaacataagtacctagcagtgagggttgttttctttttcatttttaaaatatctggccaagtagctggcgtttaaacagatcaagcattttacctacattctccaaactttaatttcataacgactccttgaaataagatgatggacaacaaaactggagctcaaagagatgcataacttacctaaagggatatcactggatttgcatccaggttcatcttgtaaaaccacgttgaactgcttaccttgactgaataaatcagcaatgagtacagatatctactttaattaacacatctaaattttgcttcattctataaccaaagcagttaaagggtagaatttggaagcacttaagatgaaccctccaattcttctctattgtctccaaaggctgtcccatctaatggtacagatgtgtgaaactcagaaaaatgataacagattacagatgagacgcaacgaaagcttccagccaggaaggtgagtgaggcagatagacaagctcatgaatttccagaggaacatatcacaattctgatttgtctgtgaggaaaagacatgatgtctccctataaaaattcactgcacattgccaggcatgggggttctcgcctgtaatcccagcagtttgggagtctgaggcaggaggattgcttgagcccaggagttcagaatcagcctggacaacatggcaaaactctgtctctacaaaaaaatataaaaatcagctgggcatggtggcacatgcctgtggccccagatactcaggaggctgaggtgggaggatcgcttgagtctgggaggtccaggctgcagtgagccatgatcatgccactgcactccagcccgggcaacagagagagaccttgctccttgcaaaaaaatcactggacataatgaaattatgaacataagaaaaggttggatttaagggctattttaatgtaattcccatcattttcatcattcttttgtgattcatattatttaccatggaagacttctatttaaatcaaaaggattaactgggagggttacattgataacaaataactagctatcacaaatagaaatttgtgaagggatggaatgtgagaaaattagctttgattatgaaaaatgaaagagaaaagcctaatgtagaattcgcagctaagtgggggcaacccatgccaatcatttcaaaggctggtcacacccgaggcgtgactaacccagcagcagatggaacctggattctacatttcaccatgcttggggtgggcttggggctccatgacccacaattttcccactgcatttcccaggccaaatgcctcaggttctgtcttattccggaatcctgttcatgattagaatcatgctcaagagctaaaatcttcttctgaacttaagccccactgacggaagcactgaatatgcctaactcttacagtttccctccctgcctggaagtgggctctataccaagccaggtggtccagagccactcttctgcccacatcctatcctcatcctcatcttaaatgtagccaacaagaggaaaaacatccattctggttttggctgctggtagtaggcagcggtctaaggtagctcttgagtgtctcactccctgatctgtgtatctgccttctatgagcagcatctgtgactatgaagaatgccacccgtgtgattaggttacactatagggccaaggagaggggggttttcagatatacgtcaagtctgtaatcggctggcttgttcagcaaaagggagattatccccggcgggcctgaactactaaaaagaagtgtgcaagtgagctccatgaaacggggtctcaagttcagagacatgaagtgacagagacttcacgttcctgctaggcttgaagaagcaagtcatcgtaagttctacagctgcaagaaagtgaacttctccgaaaaggacacggagccctcaccgaggcccccaccaaccccttattgtagcctcatgagcccctaagcagaggacccattaaaccaagcccacaaacatggaaatggtgaaacactcacatttttctaccatgataccatttataaacatcggatacatttatcattccaaggattcttgccatttgcagatacctatgcttggctgctgaggaaggctgaagccccttgaggacaaagaaacatgagcttgttgtcatttgatcaaacgggctcttgaagcttaggtcagcagtaccattgtgaagtctgtttttcactttaaggccatgtgagacaaagagatttgttgtggtctgtagggttttactacaacataggatgtggaatatggcaaaagtgtagtttcctacacatgggtttcctaggatggcagtaatcaagtaccacaaactaggggtttaaacaacagaaatgcactgtctcacagctctggaggccagaccctgaaatcaaggcatcggcagggctggttccttctgagggctgggagagaaggacctgctccagggtgctctccttccttgtagatatccaccttccccttgtgcctgcacatcgtcctgcctctgtgcttgtctgtctcactttttttcccctttttctaaggacacttatcatattggattaaggcccagcctaatgaccacactttcacttgattaccactgtaaagacctgatctctccaaataaggtcacattcccaggtgcttcaaaataggtgtttttttttagccaggcatagtggctcatgcctgtaatcccagcactttgggagactgaggcaggtggatcacttgagctcagcagttcgagaccatggccaacatgatgaaaacccgtctctactgaaaatacaaaaattagccgggcatgatggcaggtacctgtaatcccagctacttaggaggctgaggcaggagaattacttgaacctgggagatggaggttgcagtgagccgagataactctagcctcagccaacagagcgagacactgtctcaaaaaaaaaaaaagattttttgaagaacacaattcactccataacgcccataaaagaggaaggagagagcatccaaggactaggtaccttactggagggcagatagccagctgcctctgctgtggcagcaagacaccaaggtgaccctcccaatttcaatagccgtgggatcatcaagggcaggagaaagggaaaggaagaaccttgaatgtgactgcatatctaagtccctaaattgaaacagaatgacctacctggaagtaagagtatgatttttttctttccttctgagagtggaaatgagggcttgtgagaaagttgaaaaatagagaaagtttcatttcagcttatctgagttgtgctgcatgaatatttttattcgcctcctatgtcctgagcatgagaattgagcaccagaggaagaatccaagactccttcactttatccccagtccacagaccgaccattgtcctcagcaataggctgactgtcattccctctcattttgcatgcagggattgtacacgctgaaaaactcccttctgtctaacctcccctgcagcaggtcaagtatagttgtttgctttaatataagatatctgttgtactaagacttcattgaataagtttcttaaacagacgagcaagtcatttttccactcttgagtggcctcttagtgagttaatcattttgtggaaatacaaataaatctaacacaaaatatcagaattttttccttcttaatagaatttaaattctttgatttaaaacatcataatttattccttgttagatttttcaaataatatattcaaatgtccatgttaaatgtcagattaagagacaatgatttttatgagtaattttttatcaccaaaagttaattgcctcatgtatatttctccactgagttagtaatattatgacaatattaatgccgtagattttcaagctaaaacagatctatttttcaaatggaaaattaattctaaaaaaatgaaagtactaatttaaatcattaatggcaatttcctctttgcagactgccttgaacttttccagttctgccctaacagtccaggagaaggaaaatacaaattttctggcatggaaataacataagaaggagctgcaagtttcttggcaaagacattgacaacttttcaggataatcacaaaagggataggataactctaaaaatgaacataatgctagtctgagccagttaagtgctcactttcatagcttctggtagaaagagcattcatggaattaaatattaaatatgttctccgaagttctgagatagtaggataactgtgtgtacttataagaaaggagcgatgtcatgggtgattttcctaaacatagcagagaatcaggaaaacagccaagcatttgctgagacggaggcacataaaacatgaatctgagaatcccaagggtagaagagagaaatgtggagggttatcatcataaatcatgttagaaactagggcaagaaactcatggtgacctctggacactaaaatgcagctggtcataattaagcttcaggctttgctcttcctgggccagttcattggcatcgtctactgccaggcctcgtaccagtctacagaagagattgcctggaacaagcctcttgatgttattcacacttatgaaccaactctggtactagatgcaaaaagcatgtcacaagagggatgggtgggatgggggggaagggacatcgcaggaatcatgccactttccagccccaccaccctctggtgccacgtccacccttgatcactattaccaacccagtatccctccagcacttcacgggagggtgtcagggatcacaaggaaacacatgggacccacacatttcgagatgcctcacctcctgctcgaaagtcaggtgaagaaggattcttgagccaaacatgaaagattttttgagagctaagctgacaggagaatttcccgtaaaaagatgaaagccctggctttaacagagccccttttcatttttacctttaaaaagcttttcctttcatgttaccctgaggttattcaccgctacgacaacaatctccaaagacgttttctccattatagaagaggaaaaggttggcgttgggatttggtcaggaaatgaagcgttgaagacaaacaagatgttctaatatagagcaaacctgatgagtcattttctaagtgagcagccacttccagatacaattcatagtatcttcctagttattactattattattattgtttttttttttttttttctgagacggactttcactcttgtcatccaggctggagtgcaatggcgggatctcgcctcactgccacctctgcctcccacattcaagcgattctcctgcctcagcctcctgagtaactgggactacagttgcctgccaccacacctggctaatttttgcaattttagtagagacaaggtttcactacattgaccaggctagtctccaactcctgacctcaggtgatctgcccacctcggcctcccaaagtgctgggattacaggtgtgagccactgcgcccggcctcttccaagttattctgtcatttggcactgatccgtctttcaaagacattcaattaatcaccagagatgcaacaccataaaggagcagaatatttcaatatattacctgatatattttcttttgtcattacccttttgtaccctgtagctttctaccttaaaggctccacctacaggcagaggctcattgccttagagaaggagagacttaaaaaaaatcccaggcaaacagagggtcaagtaaccagacttggaattgcacagatgttggtgaatctacagcagccacaatggtccaggattgaatctactccatggaagcttcgaagtgggaagagccgaggatgacctagagcccataagaagataagtctgaatcagctggaggaaggtggatacccacaggatgtgtgatggggtctggatgagagcagctgggtgagaagcagcaccactgccttccttagacccaccaggatcagttctttcggtagtgatggagatggggagggggatataaaaacccccagatctctttgattaggtgaaagtaaagcaaccaatggaatgccctaattctttctgggatctcctacagcacacaaaaaaacctgatttccaacactgggtagcagcaatactgtaggtatggccccacagagtgtctatgcacagagtcctgtggtcgctggggacccaaggggtgcagtaaatacctcatgaagggcaaggaggaggtcaaagagactttctgagaataacagtatttccaaagggtgctggctcaaaaaatgaaaatatgtaagccagatgtttagcatcctgggtaagatattaacaagcttcaacatcagatgtaaagggaaggaaaagaaaattgattccacaacatccccagtttcacttcagtagaggccaataagacagaagccaacaggaaattagacttcccttcttcaggcagaacagtggtgaggccctatgggctgatcatccccaggaaaaggatgaaaggataagaagagggaaagaacccgaatgggaaagagtatttctcaaaggggcccaagttttaatttataagattaaaagaatgagggttaaaatgtaaacaaagccaccaaaatatagaaaacacagatttggaattctaaatccatgtactccattcatggaggaggtggaaacttgctgagttctcggaccactcagccagttcacagacataaaaggagacccagcggagagggagtgggtgagtgggagatcaccgccctggagagggcagctgtcccattggggggccccacctccactttttcgagtgctcttcctccacctcaagcccggtggaagccaggggatgactcagagatggggacacagagggctctcctcccagcctgaagagctagagcaggctgtcaggaggaatgtgaatacagtgggtggacctgtactccagggctgtgggaaagactggggttccccaaggaccagatgtgggcaggtggagagacagaaagagagagagacagaggaagaagggagacagagagtgcccgccaccgcacccggctaattttttgtatttttagtagagatggggtttcaccgtgttagccaggatggtctcgatctcctgacattgtgatccgtccgcctcggcctccgaaagtgctgggattacaggcatgagccactattcccggctgggagaagtcttagggcttagacatgagggccacctggagggtggcaggaccctggaaacaagaagccaaagtcaagtctttagggcagcaggagagatcagaaggggccatgcaacccggctgaatagagaggcatcattgggaggcaggagagatgcagaaaagaggtttccagcggtgcaaatgtactaagagttcatgaaagcccccggtgctgaggaatcagctggaacccttggccaggctccaagtacccgagccaaaagctctgtttcctggccccattctcctccttcctacaccctttcaagcttcctcaaacttcttcagagcttggcctgagagagagaaggaggtgaacagagagagaggagagagacagagagagagagagaagcagagactctaattaaacctcttcctcaatgtcaatgtcaggcagagaagaacctgtggcttgaaatgagcaagaaatacaaattgtggaattgattaataacttgcctgaataccaggattagtaaatttagactttgttcactacttcaactgcccacaggactgagtaaaacaaaaatcacagaccctgctgaaactgcaggaatgatttaactcctgcacacgatttaattgggcaactggaaaaggaaatacaaccttttgttctgacgttattaaagatgtgcttgctcagcatcattattgtattaagttttctgctgaagaagattaagaagagaataagaatagaataagagtaaaaaaaaagagaaatacaatacaataaaaacataaaagaaaagaatagaaaaaagagtaagaaaaggaaaagagggatgtaagtaatgcagattcaggtgtaagcacaaactaagttccatctagagactactgaaatactgcactcactttgataacccagaaaacacaggacaagatctgaacgagacctggatctgggttgtgcttcctcgatcactaaccctagtaaccatacttattagctaaaacctctgcctctagcttttcatttggaacatacatttaatatacagccctacataagttcagccaatatgcagctcaacaatatattaactaggcaagttgtatttcagaatctgtgtgagaagcggcatgcacgcagcctcccagcattcgctggtgctggggcttgtgcgtgacaacatcagggagctcttccaaatgctggtcgctcggtacccatatggaggctttcttcctctagattgccaagctttcttaccagaggaagatttaggctgtgtccacttagggccaaaataatgaatcagttcagttgttatgtgtgcaccatttatactggggtttgacagaattttaaactttttactcgattgccttgatatcatggaattattgctatttatcagtctatatttacacaaaaggcctgacatggctacacacaggccctgtggtctgataccacgtaaggcacccacagcatccctcgccagctgagatcgaatttattcacacacatgcgtctcccctccaaatggaacttattctgactttagatctcctattaggactaatgccattaactaattgtccaataatttcagcaaaattcaaagtataaaacggaagtattacctggccccactacaggagttgtgggaacctcactggcaatcagatttttcctgtctgtcttctcttgctcttcacttcccaggaaagcaggcagatccactaacttcataattctagagcaaagtggggccttacacacaagcctacgcttgcccttggagtttattttgacttctgcataggtggctgccactgcagttgtcagaatctgaaattcaggagatgccccttgacaggcagggacaccatctgatggcagtgtgacaaggagcattgttaatacaggaagggctttctaattgagagtggatacccatgcagaaattttcggatgttcccaaggccactacaaagaaacatgaaataaaaagatatatcccatgaaactacaattttggaaaagtaaaaataattacagcaagtttgtatctgggatttgttcattttaaataaaatttaaaaacaaaaacaaagcaaaagagaacaaggaggggagagggacagtaaatgggtaaaaagaaggaaaagatggaggagaaagaccaagagctgtcaaggcccacagtcgccttaaaacagaatgtgcccatccccccacccccttctatgccccccacccccttctatgccagcgcccagtacctcactccctatctgcgctgcctcccagccaggggccttgacaagcccacactctccaggaagggtatgagcacagcctctactgcaggagaggatggagacaagctctgttcttcttgcttttatgtgagtctgatactcatatcactcatctcctttctgagcattgcaggctttaaggaccctctggctggctccttaacccagcttctgaaatcccccggagctgcctgacttcccactctggaccctaagtaaacatttacagaagcagtggatgccgcttatttcttactccacaactatctatccattcttttgccaaccaaattattatgtgccaatcacattgaggtaaagcaaaaatgaacgcactttaaaaacattaaaatgtgctcagattgcaaatgtatacagctattatacccagcaggaaaaaagccaattaatttacgtatttaagaaaattttcttacttgaggacaaaaattaaaaaggggaaggaaactcatgttgaatttcacttagaaaagtcaaagtgaaaataatcagaatgtcttcagctacccaaggatttactgttaactagaaaaaagcatcgtttccatgccacctcagctttccaaatctatcattctaatccatttttaaaaaagaataaaatctgaaaaataaagtacatctccaggcctctcatattgcaaatgacgtgtccaatcatacttctacaaggaaaaaattaatggcaaagggggccaagagttaactgctggaatggttaactagaaaaggcccagtcgaaattaatccccatgatttcatgtgaatttcaagccatagcttaatcctacatgtcagtacaacaggaactgcttagctctgctaatcagattctagaatttttcttttctttttttttttttttgtaagcatcttagtttcgcaaaggcagctggctgtgatggtattggtcactctgctgaagaatatacatgggacctaaaatagctctgggtccttttcaactgtggcagtttcatcaatggcatccgttacaagatcctggtagtaatattgatatatcaaagtaccaattaaaccatctgcacaagggtatccatccacctgtgtctgataccatgtaaggcattctttcacatctggcacaaagaaggaaaaaaggcacaattctacaagattggattttgaaagaacttctgtttgaagagtgaaaagaatagatgtgacatgaatggacagatgaattaggaggcatacagtgtaataacacaaagaaattattgtgggttcatatctaaactccatcagaaaatatattcatatattctgtaacatgaacacatttaatctatagtggttgttctcagagtaacagaaaaaaaatattcttattattaagttcactttcagaaaaatataattaaaaaccacataggacaaggagagacaaagaataaatttccttgaatcatctaaaaataaatgtatcaatatagcaacataccactgtgggctcttcatccttcctgcttcattaattacagtccagtgacacctccatgcccagtcctagctaaaaatcatactctcaacactaaatattaagtctcagattctgacaagtatgttcatgtcagtagttacaacaagcaaaatatgtgaaatcaggattatagctgtgggtgctagaagtggattctctgtcctattattctccattttcacacaactacacatccatccatcttccatctttccgattctgttctgtgccctcagaggttgacacccacaggccaaatcacttgggctcccttgtcctgcaacctccagttgggttttgacaaggggaggtaccaggaggtcaatgggtacagacggaggggagagagagagagagagagagagaaattgactggggcttccctccatccttcctggccctgcttgcttgaaatctctggttccggtggggactgcaaccctctaggatttaccatccaccagatgtcccttctgctagggctccaattctcattagctctgggaacagcatttattcctcttgtccctaaagacctaacaatagtaacagcttcgcaccatgaatagttcaggtgtcttgacatccttctttgttttttttaaaactgttttcttcagcctcctatctgagggtactgttttcttctggaatctgaactgacacaccctggaattacagggttatgtttccctgaagggaagggtgacaataggaagtactaatgaagatatttccccctcaggatgacatatgctctctaatttagtgactctcccacccccccaccaccccccaccccccaaccccatgaggtcagcatggaggcaccagaggacatatttacaattcttggccttcaccttgatgaaagcagcaatcttggggagagggagaatggtaaggaaaaactgccgaggtgcaagctgtttcttgaccctgtgcccatcctgagctgtataagattctcagagcacaggaaaagaaagccagagccagggctgagccaggtggaggaggggagggctggaagcctggacctctgggaggtgctgccccgccatgtgccctgagggccttgatgtgggagcagaagagatggcctggtgtgtccaagacagtgagggcctggttccagcccccgctcttccaggagctaaaaagagcctccacatcctactgcactgaaaagaggagttggccttgctgaagggaggatggcccacaggggctcacagggtcagggcaaagggttgctcttggggaaagctgcaaggaggtgtgaactggaggcagagctgctggaacacatctcagatgccaaccttaacagcgaagacgcatcaggcatctcagccccttcgggcagacagagacactgtgctggatggtgggacgctgcccatgacacggctcactgtgagctcccgacttagattcaatgccagaaacaggggcagagaggccaatggctgaatagaggagacttccaatctgaaacgcttgagtgtctctcccggtgggtaagattctggtttttacccttaggtggaaggtggaatgggcacactagaacactattcttttctccctctttgtgagcagcttcttcgataaaaacagtctatttttttcccaggtgcacccaagtgttcagtggcttcagtgaataaagtcactggaagatatggggctcatttctatttaattagatataacttttcattatcattattgtgaacttggctttaaattatgcaaatatatataaactatacattatcacttccctttatttaatcctttatatatatatgtatttattcctttaaataaatatatacatatatttattcctttatatatatgtgtgtctataggtctgtgttttcatggccatacagtgggctgcaggccactttgcaggaattcttcctacctaccacacttactgcttagcacacaggtgttcaaaagacatctgtaacaaataactaattacacataattgtaaagtaaagtaaagctagaccaaaatgacataaaatctgaatcaatgtttccatgcagaaaatcctagctttcactacagctttattcatttcatacttatataaaatactcatggtatttttccacatacttagtgctgagttacactcatgtttgctttccattctctgctgtctttttttaataatacagaaattttcatacaaaaatgtactgaacacgtgtagtagcattatagaatcagagcagtagctgcaaatgatttatgaaactatctactctggataatacaacagtgctatacatacacaattacttcataaaatatggaatacaaacatgaataggaatgcctatgacattcaatgtgttttgtcggcctttaaaaacttatttctgaacacagtggcttttcttcttctttaaaaaaaaaaacacattctatcagaatccatctaaactatttcagagatgtgaaaagctgtcatatttgcaaagaccaacagagaaaaaggtattacagttatccattccacctcttgatgccagttaaatatctttgggagctcatttaggtttctaaaagagaagatcatgcaaaatgcttattttaggtctccttaatggagactgaagaatgttatgcagctctctgcgttttttttttctttttatgtctaaattatttgacttctttaaacctttcacctggatacttttcaagttttccacatgcatctttaatagaggaggcctggaaccaaccaaacatagattagaacacctcacttctctaaagttaacctttatcgggcaagctcagtcactcaagaaagagtcaagagccaggatgtagacaaaagaccactgagctgccacatcttcacaggaccaactaacaggcaacagaattgcaccaaagcttgaggtctgtaacctgtactcagatccatcgtaacccacttattctttttgtagacaacctaccaacaaccattaacaaccttgtcttcaacctatacattaacaaaataaaatgcatgtcaggacacagatgacagtacctaaacaccaatagcaaactggagctgatggtggagctacatccacagacatgcactaaagaagaatagatttttttttaatggatgcaatcagaactccacagttttataacttctgaaaaaaagagataatatatttatctagtacttcttatacatgatttttatagaagaaatcgtttaattgtatacacatatatcaacataaaaaaaaggccacagaaatgcaaaaacttttttaaaccttccaatgaccaggaagatatgcactatgatttctcctttgtgcatcaagcgctttgggagctaaagaggcttgccaaagtaaagtagcgcgtccatggaagagagaagaccagattccaggccatttaacccccaaggctactgatctttgtagtatagtcaaagacgcagactcagcattcttaaacttctgattgcctttcactcacttgcctgctcttgcctcctaaatatatgtctgttcttaggaactgtatttggtctttgtagtagtcagtgagggatgccataaccaaacactactgacagggcggcctagacaacagacactgattttctcgtggctctgcagattgcaagtccaaaatcaaagtatctggacgtttggtttctcctgaggcctcctgcgttggtcttcagatatccattgtcttgctgtgtcctcacatagccttttctctgtgtttgtgctctcatggtatttctgccttttcttaaaagcatgccagacctattacattagggcccaatacttacagcctagtttaacatgaattgccttggtaaagaccctatctctaaatacagcctcactggggaggttaaacttcagcaaataaattggccggggcggggggggggtgcagaattcactttccctgaaaggcatatttattctcaatgcttcgattatatctccaatatgatgtacaccaaacctgtctcttcaggtctcaggtcttatttgtgctacagtcacaaatgtatttccaactacctacgcaatattctcattctgatatcctgttagactaaacttgtatcaaaccaaactcattggcatcctggtcaaagacattttcttttctcgtgtccttgcattaatcaatggtttgatttggtttgaactacttttcactattcctgtcttcctcatttctccagccgataagcaagtcttactgataactctgttcaaaatgtgtttgcatttagtcattttatcctccccctctaccacttgagtaaaggccttcataacctcacacctgaaagagcacgataatcatctaccaccttggacccaaggtagatgctcaaccttatttaatgccctcctattgtgtatgagaggaatccattaataggatggtatgtcactcttattgttaggttatgttataagacataggtagctttaagaaaggattaacctaagttagacttaacctaatcaagttaccccttaaaagagacgtagctcatcctggtgaaggagacttcaatcatgagagaaattcaacaagaaacagattgttcattgttagctttgaaaatgaagggagcactcactgtggcacggaatgcaggcaggtgacagtccccggggaagagccagtgaggaatggagtcctcaatcctacaaccataggaattgaattctgccacagctacctgagcttggagaatgaccccaagctcctaatgagatttcagtccttattgacaccttgatttcaatcttgtggcactccaaacacagaacacatctatctatgttatgccaaaacttctgagctacagaaatggtgagatcaccaacaggggtctctttaagactctagatatgtggtaagttgttacacagccatagaaagctaacattacttggttaccctctaattcacctcccactgccacatttatatttcttgttcaattagttcattattttggtgcccttttaccaacctcattgaacattatcataatgctaagggcctatgggtgagtattatatgccttaaacatacacacacacacacacacacacacacacacacacacagacacacacacttcccagagaaagcagttacgtgacttttggaaacataaccaaactgtcaaaagaacataaaactagttactcatatttggaaaggtaattcagtactatttgttctgctatggtgtaaaaaaaatccacaatattttaatggcaatagttattaaatagtgaaaatctagcagcatttacatcaactaatgttaagttccataagtactatgcccaaatattattttatcccttatcatgttaattcctgccattgaaacttacacccagttttcaaagaactttgatttttgcctcacctaagacagcaagtctattcccccaatttggcaatacaaaaacttttgtttcaggcaagccaatgttctcagtgctccactgtgcatctctgttcaatgcgattcctttcagaaccacttatgaagaagaattcctctccatcaatccaaacctttgagatgcatctatgcatctatgaacttcttgttcataaattcattaattaacaaacatgtactgaagtacctactgggtatactagaaatgatgagatgctttttcattggaaattggttaaaactaataaagattaggaagctgtaaaaaaaaattagacaaagatctctatgcaagaatatcaaattatactggtcaaaattcatctctactttacaaaagatgtctgtaaaccacaggaaggagacattgtttttaaaagtatacatgtatagttggctatcttttgcttaacagagaaggaaaataagaaaacatttgcttatctttaagaaaacaagctcaggaagagtaagctggaaacatggcgttgatggaacacaagtggtggatggaggtagtggagggccaggaggaggcaatgggaggataggaatgaggagggaggcagccttctctgcagggaattttttgtatagattttgctcctggaaatatgttaaaggtccaaatacattcagtcaacaaaggcaggacaatcctataactgaaaacatactgaaacaaataaacctaattatatctcaaatggatatcattacctctgtgaagggagaaaaaaaaagaaatagaagtaatccaagtgattataattcatttggaataggccttttcctcacctctgaattgcaggggttgttggtatttaagtgattgaaggtcgtctcttatgttgccgcaatcccctattattttggcaggactcatgactcgtctaaatagtcagttttcatcttttatttatgctgtttttttctcctatgtacacactatagaaatggaaacttcactgtagtaaacttttccctctttgttaatgaccactgctggcctaaaaatgttacctttattttaacactgctgcctatggctattagaaaaagttgtttcacacataaacatacttcttggaaccaaaaactttccatataactaaaatgtaatgcttgactcatccagttctatctatctatctatctatctatctatctatctatctatctatctatctatctatttatccatctgtccatttatctatctatccatctacctgtctatctatctatacttcccccacacttatatatgatcctcttttaacgacttggggaacttttcaacattttgttactccactggcttttcacacaaatggggaaaagacagacttaagggtaccagataaacaaaaattactaaatagctaagagcaactgtctcaagggtcctggggacctggaggccctgctgccaatgctgggacccagcacctccactccagctgctgctgccagatgtgagtgccagggtagtcagatgtgttgtttaactcaagtgaaaatggaaatccaggtttttagatgtaatcaaacagtttccaaatattggcattcaattcaagatatttatttctaaactatctgagggccactcccaacccatctataggtcacattcagctgctgaggacattgtgagacctcagatatggaacaacaaagccaactagagatacctaagcaccaagttatgtattacaaacaagatttgcacacaagggagaaataaaactgggagcagaagtggaaagtgctgcagaaggaagacttgaactgaatttagaaggaaaacactacatcttagagtatagaaaataaaagggaaaaaaaagtttgccaatatgtcatggctaattatgccctcagtgtctttgtaaacggaagtgccaggccactattcactgaaacttagcttggttttaccaaacctcgaaaagttaatattatgatacatccagaaagatgaagataaacatgacatgtttataatgtgatttccccattctacctctaattttttaaaaaaattatcattgctttttttttaaagttgtgagtatgtttcatataatgtttctgatcttttctcaatgtccagttgtttttacttcttgctgggtcagagtataattcttgaacgagcttcgctcttatttccaaatgcttttagaccatgggtccaaaaagccatattagctagaattttgcataaactgaagataagaaaactatgagtgcatgacattcttataagaaaaatgttttggtttttagtttcctaattaagttttgttaaatcaatgttgtcagctctgacttctagtgtctctgtgtcactagcatttgattgctgaataagtattattttggtgtattttaaagtattattatctgtcacaatatatatgattttggaactatttgtaagtatactgaaaattctatatctaaaaccatatatacatttatcatatagatacacctatctatagtatctatatctgttttagatacatattttacatatatacatgttaatgtcatgttaatgacatgttgatatcatctcttttcttttacatgttttaatctttttcttgctcaattcccttgactatttcacaatggaaataaaaaagaagttcttaggaccaaatcttctataaccttattacacaattgggttatttctattattttttaaatatatggaaaataatcttcataagttccctttctcccaaatagtatattgtaaatattcttatacaattaaagatgggtcagaaaaagaattctacaagaagtaaccctaaatgaaccctagtctacataacaaaagatgtacaatggtcagagatggcctgactgagggtgtcgggtaatttggtaatgctggttcacaagaaatgatggttctaaggggctgcagggctggagagagtaccagacacccctctctgtggaggccactttctagtaaatgatcagctggtgttaacccctatggggcaatttccaatatgagtaattacttcttgtgcatctaaatcttccctgaatgtgcagctgggaatactttcattacatgttattctttccacaccataaattaatccctacacgtgctgtagatcccctgtgaatctcaaaaaggagttgcgaagattaatcatttaatttgtgtgaattgtgtgaaaattgttttcccctggctctttgagaagctcagtatatgctcagctgcacacaacggaagtatttgaacaaattaatttactgagcaactactatgtgtccggtactacgccaggcagtgggagaatgaagaaaattattagacaatctctgacttcaagggatttattagctagtaacaaaactgaaatgacatggttaggccacaacctcaaatgcctatggccaacgaggcagagctaagagcaactgtttcaaaggcccaggcacgctgccaatgctgaggcccagcacatccactccagctgatgctaccgatggacacgatcaccagtgtgtccaggtgtgttgtttaactcaagtgaaaatggaaatcctgctttttatgtgtaattaaccagttctccaatgttggcattaaattcaagatttgtatttttaaaactatctatctgtgggccaatccccacccacctataggtcacattcagctcctgaggacattgtgagaccatggatctgaaacagcaacaacaaaaccagctagcgggatggtgtggtggcttgtgcctgtaatcccctcaatttgggaagccaaggcaagtggatcacttgaggtcaagagttcgagaccagcctggccaacatggtgaaatcccatctccactaaaaatacaaaaattagccagtcatgctggtgggcgcctataatcccagctactcaggaagctgaggcaggagaatcgctttaacccaggaggtggaggttgcagtgaactgagaccatgccactgcgctccagcctgggcggcaaagagacaccgtctcaataaaaaaaaaaaaaaaaaacaccaactagatataactaagcagcaaattaagcaccaaattatgtattatgtacataataaattatgtattacaaacaagatgtgcatatatgggaaaaatgaaactggaagtggaaaatgccacagaaggaagacctgaactgaatttggaaggaaaatactatacctttgactatagaaaatgtaaggggaaaaaaacagtttgatgacatgtcatgattaatgatgctctattgcatgctaatacaatggagattatcctaaatgatggagacatgaccttcacagaaaaatctggaaggcactgcaaacattgaataattttcatataaactcagatgtgaacaacatccatgctcccaaacatttctccgctagtaataagaagatgattatgaaaatgaaaaccttgttcctttcagctattacgatataaaaagtggttattgttaatacattgtgagatcaagagtgttatacagacaagaatgatgaccctaacatttgctttcaagatgttttgaaatatttgtcaagctggtcattgtgtggagatgacatttaaggattaaaggctctttgcaaactcccctctcctggccatgcctggcctatgcaggatcctttctaataagaaaggatgcaaatgcatgggtggtgacaggcacgtggccttcttcaccgtcactgctaccaggaaccgagggatcactacacatgtctcagttgtttgtagcccctcagggtcaggaaacacctttcaaatccacgttttatttcctgatcgatgaaatgcagccactgtggcatattcatgcatctctgctaagaaagaaataatattcatgcatctctgctaagaaagaaaagtcaaaaatagaaggggaaaaaaaactttttgtgggaagagagaaactggaacaaaatgggttggaataaaagattgatgaagaggtattcaatgcttgcagggaaaaaactgggaaaacaattgatgtcaggaagctttagataagacactcaagaatttcattttaatatttattgcttgtagtgaaattgatcggtatctccggcatgatgaggtcatgaaagaagagattgatgcaggcaaattcattatttctgcttctgttctttctgttttgatattagtctattttctcccaataaactatcctattgcatacctcccaacttttgccatttgtggtaatgtaattttcctgtcatcttttatgaaatactagagtacccatctgttgtacgggtagggataaaatagcttccttcagaagaaaacactgactgtaaacagccaagccccatgaaagacaagtgaatcttctagtggtcctttatcagattatattttctggtgccagggcagcccatcttgcttgaccttttttacttatgtacatgagaaaaaccgtgggtcctaatcagtcatatgataatattctgggtttttttttcctagcatagttattcaactaagatattttaatgcaaatactctgatttcaatttattgaaatcaaggaaataaacataaaaaaatggaaacaaacaatgtaatttagtcaggtatcttgaaagatcaagcactacattatgtgtctcagagactggcttcagaagtcagccgctgtcctcagagacatgactgaccttaaaacgcaggtgacaatgataccccttttcctcagagattgtagcaaatcccaactcaaaatctcacaaaaacaaatcacaacaacagagtctcactctgtcacccagcctggagtgcagtggcatgatctcagctggctcactgcaacctacgactcccaggttcaagcgattctcctgcctcagcctcccgagtagctgggatcacaggtgcctgccaccatggccaactaatttttgtatttttagtagagatggggttttaccatgttggtcaggctgttctcgaactcctgacctcaagtgatctgcatgcctcagcctcccaaactgctgggattacaggcgtgagccagaaaatcacaactctatccagaagatgctcctgaatctgacatccagggggataggatcagctgccttcttggatgtggtgaagggatctttatctcagctgtcttgccgaataagcacatggagctgatttcgattgtgcactgcagatcagcaaaaatctttctacttacactgtgcgtaagctgtatggaaaaagttgtactgttgaaattatttttaatattatcacattgtaattgttagattagattttttttaacttttaagctcaaaggtacatgtgcaggatgtgcatgttagttacataagtaaacttgtgtcatggagttttgctgtacagattacttcatcacccaggtattaagccaagtatctattagttatttttcttgataatctccttcctctcatcctctgccttccagaaggccccagtgtgtgttgttccctatatgtattcatgtgttctcatgacttagctcccacttatatgtaagaacatgctgtgtttggttttcccttcctgaattagtttgctaaggataatggcttccagctccatccatgtccctgcaaaggacatgatctcattcttttttatggctgcatagtattcaatggtgtatatgtaccacattttctttatctagtctgtatgagaatatagacgggaagacaaagagagagtaatgaaagataagagctaaagtcccaccaaaccatcttaatttttgccaccaacttaggatacttccctcatgtcacatgtcaaccaaaactgcagctgtctgatccaccgtctcatgtccaggccaggtggcctctcaacatctgtaataccataatagcttcttccttggatgccctgcctctaccaggccagttccccaccatagccagagggccgaagtcctagcaggtgccatggtgacggaagcagaggatgccagaagcagaggatgccagatgcagggtcaggagctgaggaaagcaggcggcctgcagcaagaaaatgggtccctggagcctgcaggagcaacagccctgccgacaccttgttttctgcctggggcattctgacctccagaagtctaaaggaagaaatttctgttgtttaagttcccacgttcatggtaattgtggggtggggggagcggggagggatagcattaggagatatacctaatgtaaatgatgagttaatgggtgcagcacaccaacatggcacatgtatacatatgtaacaaacctgcacattgtgcatatgtaccctagaacttaaattataataaaaatatatatatataaaaaaaagcagcaatgggagactttacagtactggatacatgaaggttttatgtacaatttttaaaaactagtgaattcaaaacaactgacatacctttagggtcaatgaaatttgaaacaaccacagcaaatactttgttagtgtccatattattacataattattaataacattaagtataccatcttttcagtatttaagtgaaaatttacaatcattcagtaaggaaagttttctgatgaccatagcgttctttttacttggtaactgaaatagtgaaaacagaaaatcataaaggctatctttttccaacaaagccctgactggaaagaaataacaaggtcatagtctctgctaacaagggcaactaactttcctgtaacagttgaagttttgttatagtggtttgaaagattgctgatttataactttgagatttaaaacacttgctataagaatagatttgttaaaatatttgttgtagcaaagaaaaatagctgtgaaagatgcttcctgggagatggtttgtacctggcaactcataatcattagctcacaatgacttcactgatctgggtctaatcaaagcatgaggaatctgaaaatcagaaacatagctaagttattctcccctgtaaaatctattatacaggtgaaaataaaagttactctaacgacacataatctcaacttgtttaagtaataataatttttttcctttttttttttttttttttgagacagagtctcgctctgtcgcccaggcaggagtgcagtggcacaatcttggctcactgcaacctccacctcctgggttcaagcgattctcctgcctcagcctcccaaatagctgggactacaggtgcgtaccaccatgcccagctaattttttgtatttttagtagagacagggtttcaccgtgttggccaggctataaataattattatgtcatattcttaagactgctcagtgcttagggtgagaaagccttcccaagggagggtctgttctctcctgcctggtcatagggcatagtacatctctctccatttattttctattctttgagacaattattcctcatgttccaatattctttttcttttcactgtctttctgtcttgaataaatctccaacatcccccacaactatcccttttaagtttcagatacccagacaacaaagcacataaccaagacgcttgatcacacacacgtgcatgcatacacgtacacacttatacaccatgcatatatgtgtgtgtttgcacacaaaaatcttgcttcgcaaacagaaggcggcatgtaaataactgcttggaactcattggcagataaagaaacagaggagatgtcaattatttaagataacaaatgggtcttttctcttagtattgctcccctgccagagcaggttcaatcttaagaattttacctttatcccacccctctgccactgtttcattttatggccttaggactgtcatttggcttttccttgaccagttctttccataagacttgctggcctttgtttcctttctgatttttactgttctcttgtccttgctgccctcactgtaactggcttctgttcatttctccaacctgtcaagagcatttagaatcccattcctacccagctaggttctgttgccccatctgactttacgacatcctcatgcaaggtgaccatgtactctactccatcaccccagtcactgacgaagagccctgggcacagggctgacccaggcgatacaacacctgtgtctgccaagttaatggcattccattattaattactcgttaggagaaatgtgtgggatgacaggggataacacacacctctaacattcccagacatcgaagcaagcatctcatgggcttctgtggaagttcatttacataagtggttcttgatcctgatcttgtagaggtcataaagcctttgtggatcggataaaagctatggattatcttttcgaaaagctgtgcacacacacatgccacagcattttgcataaaatttcagaagattcaaggatttcccttgaagtacatctctagaactcctggagtttagaacattcaggttaagagtatctagtgaaggtaattttaaatattgtagcatctacattatctttaaaagaaatgtacactagatgccagaagaaaatataatttgaaggattttctttaatctagatgatatcacatatataccttaaaaataatcttgattgacctatgctctcaggccaaagaaagaattattcatgcaatcaaatgaaaatgatttttttctgctgtaaaaagtaaaattattttttaaattgtggtaaagtacacatttcatacaatttgccatcttacccatctctaagtgtacagttcagtagtgctaaggaccacagttgtgcagccaatctccagagccatttcatcttaaaaaactgaaactctatactcattaaagcattacacaataactctcaatctcccccttaacccagtccctagcaaccaacattttaccttctagtctctatgaatttggctactctaggtagttcacagagtatttttctttttgtaactggcttatttcacttagcatcatgtctcaaggtctttgttgctgcatgtgtcaggatttcatgcgttttcaagggccgaataatattctattgcatgttgcatgtatatactgtatcaatttttttttatttttttgaaatgtagttttgctcttgttccccaggctggaatccaatggtgcgatcttggctcactgcaacctccacctcccgggttcaagcaattctcctgtctcagcctcccaagtagctgggattacaggcgcgtaccatcatgcccggctaatttttgtatttttagtagagatgggtttcatcatgttggctagactggtctcaaatccctgacctcaggtaatccacccacaccagcctcccaaaatgctgggattacaggcgtgagccaccatgcccagccgctgcatcagatttttgtttatccattcacacatcaatgattacctggattgtttccaccttttggccattataaataatgctgctgtgaacgtgggtatgtaaaatcaaatttttagcaaagaaatcttactgctgtgtaaatactattgtttgttttaaatttttgaaacttttaaaaatcatttcattgttaggcacaactgacaaaaagagaagtacacaaaacaactcaatgagtcatcaggtagcaaacagtcatatcgccaccacccaagtcaagacacaaagaaggtttccatgtagcgcttgctctctgaggtgtgtctactacacaacacagagttcccatgcagaattaatctggtctccccaagaatgctgccagacagagattagtaatcccatgttctgggttgagtaaagggaagcttagagaatgtcttacaaggtcacatagctagtaagtgatagaaataggattctaaacatcagcctttttcaccccacctccacatgggttggactacatagaggccagctggtgcagtaaaacacatcaattatattaaaattatccagaggtataaatgtgactcatacttggttaatgaccacattgtttatccttttgatattcttcattgtgacttctgaccactgttctaattttgccctttagagtaatttaaacagatgccttaacatttccacatgcaagatcctaagtagctaaagaccgtgggcacatccccaggaagactcattcccaggaattctccctaggttctctcagggaacggcatctccaggcaacttactcccctgactgtcctcttgtggtcacattagtgtgttaacacccctagtaagtaaaggtatgtccagaactgacactgaattttagatgttcactatcaacccaacgaacagttcattcactcattcaacaaatatttctttagagctttgcactattccagactatacctcctctgacaatgctttgattaatgcagggaaagtcacaggcacatttttctactcttgccacactgttgtcttatactgaacatgggatcaagtaaaatctgtatgcgtttcacaggaactactgccaaggaaggtccccagcatcctatatttatataattggtttttcgaaatgatctttgtgctgtcttcacagtagatcaccagggtttcatgtggtaatatttcaaaattagtattttggtggttgatcaacagaatccaataatattttttaaatgttttttcagactttaaaagttaaatttttatatctgtttagaaagaatcctttccttccttatatgcctctccttccttaaaaacaaacaaatgaagtgtgtataattgttctctgttgttatggtttgcatcttatagccatgaactctaacgaccgacttcctatgtgctaaaagtggtaattgatctaactgcattacaatttttcaatataagcaactagttattgaagtggcttaatttggcaaggaaacacctaatgagtcaatggctttattcggttaattcagtgaaaagtgctaatgattcagaaagtttaaggagttattgtaaggccgcctgtaggaaagtactaataaccaagctatgaccaactgcctcaaaagcagggttgccagggtaggcaacttaggatacaaagcactcagtgaaatttgcatttcaaatttgttgttcatctgcaattcaaatttaactggttgtcttgtgttttatctagcaactctattttgcagccttcaacatagcaatgattaattaacaggagatgttaataccagatttacttctccatgggcattcactacccacaaaaaaggtagccaacgtattttgatgtttgacttctgcaaaattagaagacataagtcttttttggaaatggcttaaaaatagaaggggcaggataaaactgcagatgccaactgtcattttccactccatccattcatttcataaaattatacagccagaaaaagatcatttagtccaaatctatttacttagaaatgtcacaagaccaagaaagtatcttacttttcaataattcctcagaatctgacttcgcatctactcaacctatttcattttggatgctgtaaggtcttcagagctagaaaggatgctgcagtaaatctggccatcaggcagctaacaaagagggcacaccagacagcagacaatgggctaatgctggagatggccctggaagggcatgggtcaggttctatgatgtcctggtgatagaagtattccaaggctggacagttctgcaaaagggataggagctggggaaatcaagaggagcagtggccaggaaaaatgtgcgtgacttaggcatacaagatgtataggaccatgaaaaatgggaaagcaaaactccataagaatttttggtaggctgctagttttttaagttacattccacagccggatgtgatagagtcccagtcatgatacctcatgtcactggccaacagggttgattgagccacaaccaggcttatgaagttggctttgcccctactcactgcttcagctgaatatctccctaaactgaacattctggtaaaaatgacatcttcctagaaataagaccaatttaagcataggtgagattcacagtctataatagagaaaaccataatttatgactttttataagctaagtttatcattgctaacactgttctttctttcatgcacacattccaccgacaaacagccaaaaattttaaataaaccaaaaggattcaatacatattcacagttctagacttattggctctagaaattggggccttttccttttgttttatgctaattaggcttgaagtcataatttcccttaaacacatgagcactattaagcgccaattctggggtatttaaagagttacaaagagagtgcaaaaggggaaaaaaaacatgaatacgacctcattcctttctttaaaaggatctcagtatagttaatgaaataagacatatttatatgaaaagttggcatatattgcctgtgcttttatgtaaaagctgcattagtataaaaaacagtaaagattatagaaattcaaagaatccatatcacttttgataggggtgctcaaaatttcattgcagtaaaaaaaagagggaattgaacctggacttaaacagttaagattcaagtaaaactgattatttgagcatctactcaacggggagagtaggcttattcacatatattctctaaatttatgtcatttcattcaaacattaaagcatatcatttaccaataaagcctcaaccatttacttcttccatatttcatatataggtaatgatatggtttggctgtgtccccatccaaatctcaccttgaattgtaataatcctctcacatcaagggcagggccagctggacataattgaatcatgggggcactttccccgatactgttcccatggtagtgaataagtctcaagagatacgactgttttataaatgtgagttcccctgcacaagctctcctgcctgtctccatgtaagacctggccttgctcctccttgccttctgccataattgtgaggcctctccaggcatgtggaggtgtgagtcaattaaacctctttgctttataaattacccagtcttgggtaagtctttattagcagcatgaaaacacactaatacaggtaatgaggtatgctagtagaaattaagtttgtactgtgtttgttttccctatgtcttgggaacagatgtatcagaaactcacacactcactcgattggggagaaacgtggggattctctctacaaagagcacaatcactgaaagtagtctgcctgaaggatagtgtcctatttcaactttgacatgtgatggctcctgagggtagagcattgaaaagaaggcaaaggatggtcgagatacatcccattcacctatttccctgtctcaagtaaatgtatatcctgggaaggacagacagacatgtaatagggagaagtgaggtggctggctacattcagttcagtaattgaatatagatacaggtattggttctgaagtttttttaacatggtaaaatatatatataatctacctttttagtcatttgtagttgcacagttcagctacattaagcatattcacattgttgtccaaccaacaccaccatccaactccagaaatttttaattttcccaaactaaaactccatacccattaaacactcacttcctgattcctacccctctccaggccctggtaactgctattctattttctgtctctaggaatttgactacttgagtatctcataaaagtggaatcatacgatatttctgtgtgactgcttatttcacttcgaatattttccgagttcttccatgtcatagcatgtatcaaaattttattcctttttaacggtgaataataatatcagaatatgaaaaatgcctacagcagcaaaaagtaagccaaatagatgtgaagccaacaaagggcctccatgttatatacatacataccacattttatttatccacttattcattgatggacatttagctactatgaattatactgctatgaacagtgatgtacagatatctgttcaagtccctgccttcaggttttgggggtatatacctagaaatgaaattgctgggtgatcatctatatttcagttgtgtggaaccaccatactgatttccacagcggttgcaccagcaaagtacaagaatttctatttctctacatccctgttgaactttttacttccttttttgttgttttgataatagttatcctaatggatgtggtacttcactgtggttttgaccagcatttccctaataattagtgatgttgagtgtcttttactgagcttattggcgtgattatgaagatttgaaagttacattttataaacatagcatcaatccaggcaggccaaagatataacatttgtgaaagcaaaaacgaattgaaaaaacacaaacaggtgacttttcaatgccattgatcagcatgctacatttagtacttaaatactgaaaaagaaacttaaaaatccaaatatagaataaacggttaagtgtattacgaagcacttgtcacaaaagaacactaagttataaaagtaggaagactggtaggtaatacaccaaaatgtttaaggtggttatttttaagtgtgtttcataagtaagctttgttttattctttacacagtcttcatccttggcactcaagaaatatttcctgattaagtcacaaattgatttttttataatagtgtgtaattacgaaataagaaacaaacatatttgttttaaaaggaaaaataaagtaaactagtaaattggttctgctgtacattagaattgtctagggagcttttaaaataatataaatgtgtggtacttctcttcatcaaagatcagaatctttgggggtggaggagcccaagcatctgtaatattaatacacaaagaaagttgagaactactgttgtggaaaataagaatgaattaggccctttggaagtgttctcttcatcgtccgttgctgcagttgattaaagatgaaccactcaaccagcctaaattgttgacccacaaaaccatgtgcaaactataatagctgttttaatgctctaagttctgatgtggttacttacacaacaacaaattattaactcacttaaaattttccccaataagggcttattgtgtgttaggcacaatacaagtgcgtaacattcattatctcattaaattgtcctaacaaaccaataaggaaaatacattatttcaaatgaaaataggcttgggatgcttacacagtttgctctttagcatccaattccaatcactaatatactaacatttgcctaatataaattagaggaaattaagagagacaaattgcaagatattgcattgtaaatacataatacatacacaaatacacaaaaattcattgtaaataattcatcagcatgcttatttttcaactaatgtaaacactcaacattaggtagtcagttaggtatgcctttggcataactgaataatatatataatatacattgtactcattaggtaacttctcatcattcatcctacttccacccacttaccctgccaagtccattgtctatgactgcacactccatgtccatgtgtacacattctttagctcttacttataagtgaaaaaatgagctatttgtctttctctatctgacttgtttcacttaagataatggcctcccgttccattcatgttgctgcaaagtacatgattccatgttttctatggttaaatataattttattgtgtatatctgccagtttctttatccaatcattcattgatggacacttaggttgattccatatctttgctattatgaacagtgctgcaataaacacaaagtgcaggtatcttcttgatgtaatgatttttcctttgggtagatacccagtagtggaattttaaaactgtaatagaaatacaaaaagccaaaaaaaaaaaaaaaaaaaaaaccaagcattttaagatcaaacaagcaaaaaaaaccaaaaaaaaaaaaaaccccacaaaatttcaagatacttcaccaaaaaaaaaaatatatgaaaagcaaataggtaaatgaaaacatgtgcaacatcattaaccattaagaatgtgcaaattaaaaccattaagacaccactacacacctattagaattgttaaaaataaaaagactatttcaagaattggccaggatattgtgctgctaattgggaatttaaaattatataaccactacaaaaacagttttgcattttcatgaaaggctaatcatatacctcatatggtctagccattccactcttaggtattacccaaaagaaatgaaagtttattatgaaatattgaaaaaatgaaaatgcatttctaaacaagccttgggtaaaagaagaaatgaaaatggaaattaataaaattcaaaagtgaatgaaaatgaagacataacataacaaaatttaggggatgcagctaaagcaatatgcaaagaaaattttttgggactaaacagaaaaaagtttccaattgtcttcacattccaccttcacaaacaaaaaatgaagagcaaatgaaaagcaaagcaagaagaaaaaagaaaacaataacgatcaaggtgaaaaatcactggttgagaaaacagaacaataggaaaaagaccatgaaaccacaactttgttctttttgttgatcaataaaaattatactgtcttgtcaggctgatcaggaaataaagagaaaggatacaaattaccaatgtcagaaacaagagaagtgacaacactacacattgtagagataccacaaggataagagaatattctgagcaattttctacctataaatttggcaacttagatgaaattttacaattcctgtaaaggctaaacacaaggacctactaaatttcaagccagagagaaaagaaaacttgaatagacttatgtctattgaagaaactgatactgcattaaaaaacctcaaacgaagaaaacttttaggcccagatgtcttcactaatgaagtctatcaaacatttaagaaagaaaaagaagcaattctacacaaatgcttgagaaaagtgaagacaaggcaatacttccaatttattttttttcagccattattactttgatacaaaaacaagacaaagatattgtgagaaaagaaaaccgaaaatgaatattccttaagaacacagaaatgttaacaaatagaattcaacaatatgtcaaataacgatacattgtgactgaatggggtttcacccaagaatgcaagtttgatttaacctttgaaaatcaaacataatttaccatggtaagagagtgaaaaagagaaatataatactctcataaggtttaaaataaaagcatctgacaaaaatctgaagtctgtcttatacagtcccacagcaaattaggaaaaatagagaactttctcaacctgataaagatcatctatgaaaatctacagttaacattacatttaatgatgaaagattgtctactttccctctgagattgaggccttaatgttaagtcttacaacttccactcaacattatactggagctgatagccagtgcaataagtcaagaaaaataaaatgcataagattagaaaaaaattagaaaattcctattctcaaatgacttgattgcctccatagaaatttctatagaatctaaaaaatgtcattaaaactaataagtaaacttaacaattatctcggttataaagtcaatatacaaaatatctaaaattggaattaagaaacaccatttacaatagatcaacatataaaatacgcaaaaataaatttacaaacagtttgtgtgaattgtacactgaaaagtataaaacattgctgagtgatattaaagaagaaagacctaaataaatggagcagtatttgctctggaattggaagacgtaacattattaaaatgtcattattccccaaagtaatctacagattgtcaatcaaaatcttagaagatggtgatagaaactgacaagctaattctaagattcatgtgacaatgcagagaacctgaaacaggcaaaaacattttgaaaatgtagtacaaaattaaaagactaacaccatctgacttcgggtctcattgtaaagctacagaaatcaagacaatgtggaattgacatcaagataaataaatatatcaatggaacaaaatgagggtaaattcaaaaatatgttgaccattgagcttttgaccaagtatcaaaggcaatttaattgataaaggacggtcttttaaacaaatggttctagaacaattgactatccattataaaaatatgaactatggtctatatcttgcatctcttgcaccatatataaaaatgaacttgattcacaatagcaaagacttggaaccaacccaaatgtccaacaatgatagactggattaagaaaatgtgacacatatataccatggaatactatgcagccataaaaaatgatgagttcatgtcctttgtagggacatggatgaaattggaaatcatcattctcagtaaactatcacaagaatgaaaaaccaaacaccgcatattctcactcataggtgggaattgaacaatgagatcacatggacacaggcaggggaatatcacactctggggactgttgtggggtggggggaggggggagggatagcactgggagatatacctaatgctagatgacgagttagtgggtgcagcacaccagcatggcacatgtatacatatacatatgtaactaacctgcacaatgtgcacatgtaccctaaaacttaaagtataataaaaaaaaaatgaacttgaaatggatctcaccaataaatgtaaaatctaaaactgaaaatttgaaaaaccacttatagaaaaaaacataagagaaaatctttataatctttgcttagacaagaatttcttagataataatacaaaaatctataaaaatctataaaagacttcatttattttgactgtcaaaataaaaaaaattaaagacttcaaatttaaagatttttttaaaaagccaaatattgagagaatatcttgcaaatcacatatttgatatatgatatattcttgtatctaggatatatataaaaattttcaaactcagtaagaaagcaaacaatcatattgaaaatactaagaaaaagatttaaacaaacacttcatcaaagaaaatacttgagtggcaaataagcatgaaaagatgtgcaacatttttagtcattagggaaacgcaaaataaaaccacaatgagatactactacaaacctatcagaatgtctaaaattaaaaaggctaatcataccaaatactggtgaaggttgggaataactgaaactcccatgcaccgcttctgggaacataaaatggtaatcagtttggaaaagattttggtgatttttacaattgagacataagctgatcatatgactaagctattctactcctagaaatgaaagcatatgtctattcaataattagtacacaatattcagagtaactttatttataacagtgcaatagccaaaaatgtgataaaaacaaatgtcaatcaacaggtaaatgggcaaatactgtggtaagtctacacacctgtatacaggtgtgcaactttctagtgtgtagatttaccacagtgtttacccacttacctgatcatttgtttttatcacattaaatataccagcaacatgaaaaaattttaaaataattatgtttaataaaacaggccagagtaaggagtgcattctatattattccatgtaagtacattatagacaatgcaaactaatctagagtggcaggaagcagattagcagcttcttgaggctgggaaagagtggggaaggtgccgcaaagcagcacagagaacttcttggggaatttctgtgtttactgtcgttactgtggtgatggtactgaggtatacaaagacactaaaattcacaaacatttatatgccagatacatgcagtttattgtatgttgattatgcctcaataaatccacatgaaaagaaacccaaattaacccaaaattatttgtaggggtaaagtaaatgcattagaatacaggtagacaaggagatactggaaatcttgaacagtatcagtaatgctttgctaagcactggcacagggggtccacaggtgcgcagggggtccacaggtgctcagttcataattctgcttcacaacttgcacacacactataaactctagtatatataaaatagtaaaaatattgatccttatatacaattaaaatggcctctatttcacaatgacaaatatgtgtgtatatgtgtacgtatctatgtgtaagtgtatatgtgtacatgtatatgtactggaatgtgtatcggcatgaaggggaagaataaaaataaaaataaaatgacaaaaatgtctcacatgaaccaatggcaatattgtgtcctaaactagtgagtatgactaattcaacttttgcatctgatgtaaaacaaaacaaaacaaaacaaaattactactgttgctttaatccactgggtgatttcccagtaatttaatttaaaaaaactggcattaagaactaagcagaacgaggatattttaatttggaaaaaaaaatccataaatacacaagtaataacattattttaaaattaaatgactgatttcagaaggaaatgttttcaacaactttattagtgctagagccctcatgccacagctcctggaagacttcaggctctcaatttaagctctttgaatgtaaagagagccagacaaacagcttttcttctgtaacactccatttggctggttaacacaagttatcgattctgggatttagggttgccaaatgctttcttaagagctctgtgctattgactatcctcgtttcctctgcacttcttttcttagtcttgggtaaaatttaaaactctttgtaccatttttcaactcatctcgacggaaacagcctcaatttactataaaaatgtcaatggctcactagtgacctaacctcaaaggattgggaacgctgcctcagacatctcttttctatgttcccagggtctacagaggctctaccacaacaagatggggaagcccagtctgtaatccagcaggacagtggaatgctactggtgagacctacaaactaagtctgcagcacagtcctgcagcttccccgaaagctcagcccaacaagcttcctgaatttcacattcattttacacaacatacatgttagtagatatttttaacgtacatatgtctatttaggggaaattattagcatcattattgccaacttacaagttattattttgcaagttttatgccctttagaagtgactttgtaacagtttaaaatattattttctttaggtaaagagtcatatttgaaaaagagtaagtcaaacaaattgtatacattttataaatttgttgaaaaccttattcttagagactgtaaagcaatggagatctttgcaaacatccgtggtcatgtctaatggtgacggcacacataatagccaatcagagctcagtaaaacataagccagcaaatcagaggccgctcatagaaggagtccaaattcctttactgcaggatgaataacttgtaaaatcctaacattcacattctaatcctctgaatgaatgctgagtagggaggagacgaagcttagaagcaaaaggaagcttgcatcctttgatgtcctctattgttgaagttacaacaaattaagacaaaaataatagttatgttagaagacaaattaaatacacgaatcataaagtagaaagaatttttgaagaaatgatattcagcgttcccagggattataagtcaggcaaaattaagtcatgcagcattttaatgtaaatattttgcatgatacatttacccacaggcttatcctaaagcagtatgtttgcacttttatcatttgccttaggatgaaaaaaaatcaatgaatttaagagttttaaacctctttaatatttgcacaatattagatgtgctataatctcatataaaactacctcctagagagcttttgagaattgcttttgcctggggtctctggtactaatacttcaagagattagaaacatcttacttaagaagagttttctttttgcccattaaaatcaaacaagctttgttaaacactgaggcagaagagattcataaatcaatgatactcccctgaactgcccaaggtttgcatcatagattaaaaaccaatctcagaattgaaaaagctacagtgccacatatctgtcacaacactaatttactgaacttaggaagaaaataacactagcatagatttaaatagttttctatgcaatatgcaatgaatcaatgtactgacttgcttggggtttatgaaaacaacaactgacaatgaatatcatcctaagtaaagagaggagttatggtttaaaatcatgtgactacacaattcctacatttttttaaagaataatttacatcaaaatttttctctaactctaccctattatcacagattcttttccttgcattcttttcaatactatttatctgctatgaataatatttccatgtttaaagcattctattattttatgacctaacaaactccaggatttaaacaatgctcatctaacaggaaataccgcccttccaatctaaccttcatatgctttcgttttcttccttttcttctctctgaacatggaaaatgagtgccatttctatgctgaatattgatcaggagagaaaaatatatgaggtgtgagttatattgtgactacggtgattttccatccactcagtattacttatcgtgtcaatcacttaatcctgcagcataagttcttttttgcttatgatggaaagttttgttgtgttttattttttatttttgttttttgaaaaaagacatgagcaatctgattttctttggacttcacaaaatccaagaaagaagatttactgaaaattcatttcttaaaaaatgtgaggtccttgacaatggtcttctctacagtttcaatgttaggttttgaaaatgtgaggtccttgacgacggttttctctacagtttcaatgttaggttttgaaaatgttaggtccttgacaatggttttctctacagtttcaatgttaggttttgaaaatgttaggtccttgacaatggtcttctctacagttttcaatgttaggttttgaaaatgttaggtccttgacaatggttttctctacagtttcaatgttaggttttggtcatctctgagcgtgcataacatgaatggaaagtttttttcggagatcagaccgttatgatttttggaagtgtttcctgtcaaggagaagctcatggtctccaaggtcttatctttctactgggtggatgggccaagggaacacgaagaagcataatggagctctgtctgagagaatcaccagagtcttccccagcgtttctcaatggtctacaaacaggtctgcgggcttggatcacagacggagatccaagatgggcatgggcatttacgtgggcagggcaagcgacgctggccacactgcaaggccctcaacgttcccacgtgaaaaaagaaattgttcctcaaacagcaccactaggtcgggtgcggtggctgacgcgtggaatcccagcattttgagaggccaaggcaggcgggtcacaaagtcaagagatcaagaccatcctggccaacatggtgataccccgtctctactaaaaatacaaaaagttaatgggcatggtggtgcacacctgtagtcctagctactcaggaggctgaggcaggagaatcacttgaacccaggagacaggagacagaggctgcagcgagccgagatcgcaccactgcactgcagcctggcaacagagtgagattccgtctcaaaaaaacgaacaaacaaaaaacagcaaaacaagcacacgtgagaagccctgcttgttctgtgaacacagtcatttctgcctttccttcacagtaattcaaaagcatttactgaacaacgaatgtgtattagaacttacaaagatgggtgaataagaaacagctccttccttcaaaggtctccctatctacgggagaaaagagaccggtaaataaagggccgtgcagacgtatcttataagtgctgagctagcagcaggacaaacgaataaaggaagaaatggcagctctgatattaaagccctcagctcctcctggaaagaggaaccaagccttggtgaagcttcagagaagaaggaacaattaaaacaggctccagggatgaggagaatggactggatggaggaggagcgagcggctgccaaggtaggtgtgcctccaagcacagaaggcagccaatggtcatgcccggttcctgggccagagagcaggggggtggtaccaggtggtgctagggcccctgctacatggctggagtttctcttcttctctagttcattccatgttctaaacacaacaaatcacattgcctccaggtgttaggaccaagaatattaaggtcctgaaccaaaatgccaatatttggtaaaatggcattccctcatttatatatataagtgcgtatctgtatgtgttcgggtacttctataaaatctgccagtttttaacttcctaaatataatggctaactcttttattgtagacaaaataactaaataattgcacagacataatccaacatcatgggtttgattttcttaagggtagaacagctccagccatataaatgcagtgtgtgagtgaaaatgaggacggaagagcgggtgcagcacgggggacccagcagtccttgagccaaggtctggaccctcaaaagcagtggacgtggaaggtggtagctccgatagccagtgggcatatacgcacagagagcctcactctccagctccaaagccttccatatcgatggctccttttagcactacagggtcctaaggagagatgtcaaaaatgtttaacaaccgttgcagcagtaccgggttggaagggactccgtaagcaagttcctacctcctgagcatcaggtctggccttggtgatggtttttctctgtcaaggagattttcagcatttgcagtacattaattttatgcatgaaatttatcttcatgtactgttcctttgtttatttttgagaggaatataaaggggaactaagaacaaacttttgctcgaagccctactctagaaagaattctagagtaacaggatctctaaatttcaaaggaagccaaaaaataaaaaaataaaaaaactcaataattttgtacattttatatatgttttggtagaataaaataaatcctgtaaaaccacagaaaggtaatttaagtacttggaaatctatgtcaatatagccaagataatggaggtaaactaacctggatcagagaaaacaaaagttggaaaacactgagggatcatcttgtcggcctatcagaaacggtatccaatctacaacatcacagcaagtcaacatccgatttcttcttaaggctttccaacagcaagaactttgccatcttacaaggcagtccatcctatcaatgaatagctctacgtcttagaaagttcccctcaggaaagaaatctggtcctctatacctttcatctatcaatccaagttctgtcctctggtgtcctaaagagcaagtcaggtcttttgaaaaagatgtctcttctcatatttccagtgcttatcatgtgcctctataattatgctcttttccatggtttataagcacattgctgatgtgatgtggggtctctgcattttttcttggtgctgtcttgggaagcggcatagtatggtggtatcttctgaaactgcagactccaggcccaaatgggctgtggaaaggggaccttctttatacatgtacataagttctgagcaataaaaaattttattctatctggtatttgtgcagtagctttttataaaagaaagcaaacagcttcacctttgtttctgttatatatcctcctgttggttcagcgcataattccaactataaaggctgaaactgaattctagatattgagtctgtcactcagggcatccgttgttcctgcaagctcagaaccaagtctgctatgcattccttctgtgttttgtacaagcagatggaaaatgtctgaaacaaaaagaaactaaacaggtagtgctttcacatgccactagagatttccttctacttcaactgtgccattgtatttaagtgaagttctggaagttacaaatccccctgttactctgctgtcctatgaaaggctatgaagaaggtgcatgtgtgaaagtgccagctgcttcactgacacactcaccttcacagcctaagcaagggtgttgatcccacttgacacatcaggaactcgtgttgtggaggcattcaacagcccacctaaagccactgagtgggtgggaggcaggtgagtgactgcaatacagaccccaggggtccttcacttacaaacacatcaagagaagacacagtgttgatgcccagatatatcgtttcaggttttccatcactctattacgattttagaaataattttaggcagggcacactggctcacacctgtaatcccagcactttgggaggccaaggcaggccgatcacttgaggtctggaattcaaggccagcctggccaacgtggtgaaaccccatctctattaaaaaaaaaaaaaaaatgccaggagaattctatcacaagaagcacaaggatgatctgtgccccgccataattcaatcgctcccaaccaggcccctcctccagcaatgggaattacaatttaacaggagatttgggtggagacacagagccaaaccatatcaaccatcaatcctaaacagtgggtttaactttcctttcaggtctcagaaaagtacacaggacaataaaatatgcccgcttcatcatttcatttatgtatccatcccttcattctttcatgctgtaaacaacataaactgtagctcattcctttcttctgctctatgaaaacatttttacagcttcccatctttcttcctacttatccttggttacttgtcatttcttcagcatttgtacttcccctttcaaaatgtgagcttggtggacaccacctaaattggttttgttagatatcaccccatttttctttctgagtatcatcacatgtcagtaaatagttggaatttattcttccagaaccttaaatcaaattccttcagaggatctagaccctgccttttctagaaatgtggaggccagttttcctaaaagccatagtacgtgtctgattgacctggcattttctttcttgctgactgagacctccgtagcggtggggttattgtctctgacactgcaactcagtatggaatatgtgttccccttgtagcttcctccaccatttttgagaatgcatgttaaccaataaagtcaaaactttaatgacttttagtgggatgtattcagatatttgttcattcaataagtattgatcaatttcttgcaaaatgccagtcttgtgacctatgtagttaaaatgtcacccctactcttccttcccaagaactctgccatctgctctttaaaggttacaaatgctggctcagctcaaccagaattaatccaggcatgtggtttctttggctaacatgttgcattacaaaacgaagtcatttctccaaaatttcacatacaagatttcacatacaattccaaattattaattcctcttgaaaaactggaagacaactctgagactatatatccatagggccaaaaccagtgagagacaagcagcagcttcccctgcagaaaggttttatttctccatgtgaatgaagataagttctccaggagcagtgtcaacacagcacacaacctggcctgcgcccctctctctcctgagccctgtaggcatccaggtttatacctcctgccctaagtaaagcctcaatcctcctctcctttaggacgcacataaattatttctgccattcctgctcccttggattggtaaattatcgtatcagtataaacccatgccatcactagcccatatggcccttcatgaaaaattggaaaaaggcaccctaattctactttatatccatctgttggaaaattgctgtgaattactgattttgtcatatgaagttacatggcttctttatcccagaaatttatcataataaataaccaatagcaaatcttggaatcgcactgtgtgaatggtgtccctccacatgagacactggcaggcagggcccagacagcaccaacatccacgacagcccccaacccacacctgcttgtcacctactacagttccatccaatagcaccaccaccaacacttccactgccccacacacagcttcatgaaggccattatgccaaggggaggttttttccttccaactattatttctatgaaattttttccttctaaaatttgctctccaaatattttaccctgcacagggctctacatgctgctatttgaaagaccagtagcagaatcttcactaaccttccaaacagatattttgagataatattaaggggactttatttccatagtttaaagaaatattttgccctgttactatactttttcctattttgaattttaactagagaaagagacccatatattcttgatgtgaaaagggacaagttactctttctctgctactctctttttataaaaaataaagcaaataaaatgccacattaaaatctttttttttttttttttgaaacagggtctcactgtccctcaggctagagtgcacatgcaggcacacctcttgtcattgtgcttcaagttgttgtgctttgaagatactgcattttttaacaaattgaaggtttatggcgaccgtgcatcaagcaagtccacaggagacattttgccaacagccatgtgctcacttcatgtctctgcatcacattttggtaattcatataatatttcaaacttttccactatcattatatctgttattgtgatgtatgatccacgatcactgacataaatatcgtctagttttggggcaccaccaaccatgcctatataaaacagcaaacttataaatgttacatgtgttccgactgatacgccaactgcctgttagacactgtctctgtctttctcctcaggtgtgcctcccgatagcctgagacgcaactatactgtattagaccaattaataatgctacgacggcatctaaatgttcaagcgaaaggcagagttgcatgtctctcactttaaatcaaagctagaaatgataaagctcagtgaggaaggcacgttgaaagccaagacaggctttgcaccaggttggctgtaccaacaagttagtcaagttgtgaatgctaagaaaacttcatgaaggcaatgaaaagtgctactccagtgaacacacaaacgaaacgaaagcaaacagccatattgctgatatggagaaagtctgagttatctggatacaagatcgaaacagccacaacattccctaaagccaaagcctaatctaaagcaaggccccaactcccttcaattctacgaaggctgagagaggtcaggaagctgtaaaagacaaggttgaagctagcagaggttggttcatgaggattaaggaaagaaactgtctccatcatgtaaaaatgcgaggtgaagcaacaaatgctgctgtagaagctgcagcaagttatccagagcatctagctaagattggatacaccaaacaacagatattcagtgtagagaaaacagccttttattgcaagatgccatctgggactttcatagctagagaggaaaagtcaatgcatggcttcaaaacttccaaggacaggctgattatcttgttaggggcaaatgcagctggtttaaagccaatgctcatttccattaaaatcctagggcccatcatgctgaaatttctgtggccatgctctataaatggaaaaacagcctatatgccagcacatctgtttacagtgtgttttaccgaatattttaagtgcactgttgagaactccagctcagaatattactgcttattgacaatacaactggtcacccgaaagatacacaaggagattaattttgtttttatgcctactgactcaacatccattctgcatcccatggattaaggagcaattttaacttgcaagtcttattatttaagaagtatatttcataaggctatagctgtcccagatattgagtcttcttatggagcttggcaaagatctttgaaaaccttctggaaaggattcctcatcctaggtgctctaacaacattcatgattcatgggaagaggtcaaaatatcaatatgaacaggaattagaagatttggattccatctttcaatgacttactcctcagtggaggaagtcactgcagatgtggtaaaaataacaagagaacaagaactagaagtggagcctgaagatgtgaccaaattgctgcaatctcattacttgaatggatgaagagttgtttcttatggatgattttgtttttgtttttgagacaagagtcttgctctgtcctccaggctggagtgcagtggcctgatcttagctcactgtaacctccgcctcctgggttcaagcgattttcctgcctcagcctcccgagtacctgtgattataggtacacggcaccacgtttggctactttttttctttttcttttttttttttaattgttgtatttttagtagagatggggtttcgctaggttaggcagggtggtcttgaactcctgacctcaggtgatctgcctgcctcggcctcccaaagtgctgggactacaggcatgggccactgcacctgacctgtaggttggttttgagacataatgctatcgcataattaatagactacattacagtgtaaacataacttttaaatgcagcgggaaaccaaaacactcatgggttgcactttcttgctatatttgttttaccgtggtcttctggaatctaacctgtagtatctctgagggtgtgcctgtaacaataccagagttcattttttctaaatataccttttgttaaatcaccaccattttcttaaaaagcaatatgtttatgccaacaacatactcagagtgagattaaattctttaaaagaagttgactttttgaatgtaataaacttaatatataataattacatcaaactgctcttatttctcctattttatcgctcaccagtgattttgataatgccttcttctcctcacccttctacacagttcaaggccaggcctgccattccttcagaggtagagggctacacaactggtaagtccatgccgagtgaagcgagggtggccaactcttccagcaaagagaggggccctgggacttgagactttaagtgctgaaacaggaaacgtcctgggtaaactggggaggattggtctcacttaagggcaactagattcaagtaattacagtgattctgccacacaccttggctttctctgagcagtgcggcccatctcacactggaatgcgtgatgctaaagaacctctacagggtaagcaagggcagcaaggacaatggaatagttgggctccatctgtgaaataccagagcagcaaacaggagtatgagaggtttccataacactttctgaagactgtttgtcatttttccacttatctaatcaggtgttttcataaaactcaacagaatatgtatacaagtataaaatgtatacaatgtatacaagtataaaatgttcatattactctatcttcacctcttcttctttttcactagaaagatgtcacactctcaatgccaatttcagtctatgttacagctacaacgatacctcctctctctggaagcctcaggggaatgtctgggtaatggagagcaccgtatccacactttacaattttaaaacttaaagccacacatctgcggcacatgacagtgccaactgccaagtactgaactgacagagattcacaccataatgctaattctctgcacaaggaaggaataaaagtatgtgtcaaaaatctgaaaatgattgatgcctgccatctcatcaagactgtctgtcacacgatttcgattgatgatttgagattgcatgtgagcgggacgcaggtgctgcaggttgcctaactagctcaacacttattctcaacaacacaaagacaaattaatctccacatcagaatactttccataaagttcattagactttactacatctacaaaaggcttgaggtggttggcctaatctcagggatactaaattcctaaccatagaggacagctcaacaaatcagccactttcaaaggtactggtgagtccaagagacccaaaaatgtgagaagcagtgctctggccattgtgaaggcactgaattgttttcatcactgggggagaacatatctactctcagataaggatatccctggattttctggctgtccagttgagactgctaaggactcggtcagaggtgtaattagaagaacaacttgtgatttcagtgattatttctaaagcacacagtactgtttaaacatgactcttatgtatcttgtgactacaaatattgaattagtaaactctcatctctaaaaaggaaccccaaatattgacttgaaaataaccacttttagccacaagattatagatgcaacctgttgaaccatttagtatgaatctgcctaattaagcaagaggatttcaaataaccaaatatttctattataaaacacaacccaaaataacagttaagaaaagttatctcacctcccccatcctcacataaccaaggtatttgaaattgttttaatatttgcataaatatttaaaaagtttcacctttaacagaataggtaactagacgatgcctcatcttttctcagagttcaacacatttggacccattctttagatgaatgcacttgtttataaaaatgtgtgatgaatgtcactacattagcacgtaatagataatccaagttattttcagacttaatcagttgtaagtaaagtgtgagggatttgagaacacagagagagggctggtggctctgcagctcctggtcaacatggaaaatatgcagcatttcccgtggagcctctcagtctcgctggcagctgcaggatcagcaggtctcgatccatcatcattcctccttggccccatacgggctgtgaggacacctgggtctaataacagaagctaatcactcggcagtcatttatgaaagagacataggaatggaaagaaaaccaggaaaaatgaaacagatgaatacaaaagtacgctgaagagactgatgttaaatggaatgggattataggatattttaagaaaatgtgagagtattacaagtaacaaactacttctaatagcaaaatattgccataaaaatacattattaatgttacataatacacaatatttcattataacatattataaatgcatctttaaatatctttaaagttttaagaggataaatctaaaaattaactttccgataagtttggaacatgcatagaatgtagagatttaactttgataaataactctgtactaggacagtggcccgggagacagaaggagaagaagcatttgctcctgacttcaaggttcttaccatctccaggagagacaaatgtacaattataaccacagcaggagatgataaggctaataggtaaatctaaaagaagtagtctctgaaaaagagtgttctctccctctccctctccctctccctacggtctccctctctttccacggtctccctctcatgcggagccgaagctggactgtactgctgccatctcggctcactgcaacctccctgcctgattctcctgcctcagcctgccgagtgcctgctactgcaggcacgcgccgccatgcctgactggttttggtggagacggggttttgctgtgttggccgggccggtctccagcccctaaccgcgagtgatccgccagcctcggcctcccgaggtgccgggattgcagacggagtctccttcactcagtgctcaatggtgcccaggctggagtgcagtggcgtgatctcggctcactacaacctacacctcccagccgcctgccttggcctcccaaagtgccgagattgcagcctctgcccggccgccaccctgtctgggaagtgaggagtgtctctgcctggccgcccattgtctgggatgtgaggagcccctctgcccggctgcccagtctggaaagtgaggagcgtctccgcccggccgccatcccatctaggaagtgaggagcgcctcttcccggccaccatcacatctaggaagtgaggagcgtctctgcccggccgcccatcgtctgagatgtggggagcgcctctgccccgccgccccatctgggatgtgaggagcgcctctgcccggccgcgaccccgtctgggaggtgaggagcgtctctgcccggccaccctgtctgagaagtgaggagaccctctgcccggcaaccaccccgtctgagaagtgaggagcccctccgcccggcagccgccccgtctgagaagtgaggagcccctccgaccggcagccgccccgtctgagaagtgaggagcccctccgcccggcagccgccccgtctgagaagtgaggagcctctccgcccggcagccaccccatctgggaagtgaggagcgtctccgcccggcagccaccccgtccgggagggaggtggtgggggtcagccccccgcccggccagccgccccgtccgggagggaggtgggggggtcagccccccgcccggccagccgcgccgtctgggagggaggtgggggggtcagcccccgcccggccagccgccccgtccgggagggaggtgggggggtcagccccccgcccggccagccgccccgtccgggaggtgaggggcgcctctgcccggcggcccctactgggaagtgaggagcccctctgcccggccagccgccccgtccgggagggaggtgggggggtcagccccccgcccggccagccgccccgtccgggaggtgaggggcgcctctgcccggccgcccctactgggaagtgaggagcccctctgcctggccaccaccccgtctgggaggtgtacccaacagctcattgagaatgggccatgatgacaatggtggctttgtggaatagaaaggggggaagggtgggaaaagattgagaaatcggatggttgccgtgtctgtgtagaaagaagtagacatgggagacttttcattttgttctgcactaagaaaaattcttctgccttgggatcctgttgatctgtgaccttacccccaaccctgtgctctctgaaacatgtgctgtgtccactcagggttgaatggattaagggcggtgcaagatgtgctttgttaaacagatgcttgaaggcagcatgctcgttaagagtcatcaccaatccctaatctcaagtaatcagggacacaaacactgcggaaggccgcagggtcctctgcctaggaaaaccagagacctttgttcacttgtttatctgctgaccttccctccactattgtcccatgaccctgccaaatccccctctgtgagaaacacccaagaattatcaataaaaaaataaattaaaaaaaaaaaaagtagtctctgatttttgcaattttatttcgtgagaaccaagaaaatcagaaaagctctctaattctatgcattttgtcccaattactcagtttctctatttcaagtaaattggatataacacttgaataggattctgccttgataagtatttatccaaccttattctaaagtttaattcattgttctgaaaattggatgaaaaaagtgaacttcttaaaggtttgtgaataaaaaatatatagtcaaaccataatgaaattcttcctgaataccaatgtctagacatttccctgtagaaaactggcagatatctaatagagtattgcttctgaaaattaactgtgtagttctgtggtacaaaatcacttgtaaaaaatctcctggtgtcaaaacagcatggaactggtaccaaaacagatatatagaccaatggaacagaacagaggactcagaaataacaccacgcatctacaaacatctgatccttgacaaacctgacaaaaacaagaaatggggaaaggattccctatttaataaacggtgttgggaaaactggctagccatatgcagaaaactgaaactggaccctttccttacatcttatacaaaaattaactcaagacctaaacgttaagacctaaaatcataaaaaccccagaagaaaacctaggcaatacctttcaggacataagcatcggcaaagacgtcatgactaaaacaccaaaagaaatggcaacaaaagccaaacttgacaaatgggatctaattaaactaaagagctttgctcagcaaaagaaactatcctcagagtcaacaggcaacctaaagaatgggagaaaatttttgcaatctatctatctgacaagggctaatattcagaatctacagggaacttaaacaaatttacaagggaaaaaaaaacatcaaaaagtgggcaaaggatatgaacagacacttctcaagacatttatgcggccaagaaacatatgaaaaaaagctcatcatcactggtcattagagaaatgcaaatcaaaaccacagtgagataccatctcatgccagttagaatggggatcattaaaaagtcaggaaacaacagatgctgcagaggatgtggagaaatagaaacacttttacactattggtgggagtgtaaattagttcaaccattgtggaagacagtttggtgattcctcaaggatccagaatcagaaataccatttgacccagcaatcccattactgggtatatacccaaaggattataaatcattctactataaagacacatgcacatgtatgtttattgtggcactgttcacaatagcaaagacttggaacaaacccaaatggccatcaatgatagactggattaagaaaatgtggcacatatacactgtggaatactatgcagctataaaaaaggatgagttcatgtcctttgcagggacatggatgaaggtggaaaccatcattctcagcaaactaacacaggcacagaaaaccaaacactgcatgttcccactcataagtgggagttgaaaaatgagaacacatggatacagggaggggaccaacacacactggggcctgtcagggggtggggggatgggagtggatagcattaggagaaatacctaatgtagatgatggattgatgggtgcaggaaaccaccatggcatgtgtatacctatgtaacaaacctgcctgttctgtacatgtataccacaacctaatgtattaaaaaaaaaaaaactcctggtgtcacttcggccattcaaagtcaaatgttcttctaaatctaggtattcattaaattaacattgtagagggtttgctttttaatgaaatagttttttttgaaacctcactaattggtatagtgactcttgcatggctcttccatcggtatacatatttaagtttgaattattgctaaatcctctttgtgaataactaacttggccttgttctttagttctgtgtcaacctatttggtagaaagtggcaaaagtagaggcaagaatatttcaaatcatgcaagtgatgctgaactcagtttctgtcatatatttaagcacatctgattatggccaacgtttcccttcaactttcactctacatgattgcaatatagtttttccacgagtaagtgagaagtgcagataatactttcaaaacaaaacaaaacaacgttggtgtttaataagaccctgaataagctattgatctgtgaattagcaccaggcacgatgtgaagtagtttacatatattatctcatatcaccttcttaataacttaatgaggtgctattatgataaatattatagggtgaaaaggactaatcattaagaagtcaggtcacttgccaaagtttacatagtaagtaagtggtggacctgggattttgactcattgattaattgacacgacaaataattaagtgtctactatgcaccatgcagtgtgctagggagggaagaatcatttacttactcctcagtgactctaaggcagatttaaggcacggcttctctaagctcttgtgttgtcatttgccgcatgacacagacatagaaactagagtgattttcctccttgtcaagcccaatcatggtgatgattttaaaaaatattattaatgattacctttggcttctaatccctaacgtgatatacttatctactgattacagaaatctttgcttagttttattttccaagcaaacacaaaatatgatggtaggaaaaaagagtccaggttgctcctttcataaaatcttattcctaggtttctctcttgtggcactttaaaaaaaagtatccatgaaagccaaggattgatgtaaataaccattaggaagagcttaatgttgacaagtagaagtcgagtttgttttagaaaaacaataggaaaacctgttatatactgtctgcaatgctaaataaatatttctcatcagaagaaatatctgcttattacatttttgtcttcctgattagtatgctttattcctgacatcaacttgaaaaaagatgcaataaatgagaagtttaaataacacaggtataagactgttaaccttgggatcaagggattatttgttaatatttttaaaatgataatacctttatattaaggctaggttctagacgcacctcacattctccacccctttctggctttgcagaagccatgactgggtctgtggaataaagccttagccatcccgtgtggttgttgtttgctactacagcagtagccatagctcttaccctcccctaggaacagcaagttgcattgctatcctggtttcccagaaacagtaataagaaaagagtaggaagtataatggtagactacatggtggcactagtggtggatcaggtgaagtatattggatatctgagactagatggggtttttttaagtgtacttacataggatcaaacaacatttaactttctgaatatgcatttagtaagtataaggcacaagttgtttctgtacattcattttcatggaaggggtgtgtgtgtgtatgtgtatgtgtgcaagcatgctcacaagtgtagaagacagggattatagaagtaaaataataatgcaagatatgcaaaatttaaacagttaaaattttaggaaacctacatgatttctaatgttgcaagataagaaagcttctgctaaaaccaacatatacaaaaacgttacttatgaaatacttttgtagagatttcacccatgagcaatagaaaaaaaggaaagttatttaatatattagaaaaccctaagaaacgtggtctgtggtcactccctctctggcacctttaccacagtgatgacagagctatgcggaaaagaatttctgtgccagttcagccatctgctgttggctcacaaatggagttaacagtctaaaaggaaagtttgttttgaggtgccattcccatgtgcatacaatccacaaactgcagtgtataaacgtggctcagtctaataccaagttaagacttggtttttttgaagagcatattgcacagcattttctggaaatgctcccaatattagatacatgtcacattcgcatagaaacatatggtcttcaatgtgcaatctcaaatcgtctacagagactctgcaatcagagattccctgttttaccttccttttataagtcaattttcacttagcaaactatcacactgtggtgatttggaggcattattttaattcctaatgtaaatttacttttaacagatgtgattctatgaatcatatagcagcatatgatattagttattagctgaaatgatgccaaggggtgttacgtgctggaaactagagcaactgagccaaaccaaggtcacccccatcactgccctcacagctgggtcagggaggtctggcctggcccttgtccattctgaaggttgagagaaaaatggcgtctttatgatgccccctgcccaccgagatactcagatatatttcgccctgtccttgaagcagccccactactactaacagtggctctgaaaatgtggacttgacagatagtacctgtcactggctttctatccaggctccattcctttctgggctgcaggtttgaaaatggatgtgccccagggaacctgaatacagtgagttcacacacaagcaggaaagaagtgagtttcttttggtttgggttgaagcagttgctcaaacgtgataggcagaagaggtaaggatttcactgtgctttaacaaaatgcttccatggtaatcagtcctgtatactgtataatcactatacagaaacaaagtgtgcaccaaaaggtaaagaattttcctaggacaagaccgcagctccacaaacaaccaaggaagctgttcagaaacctctttctgtgctctcttactcccctgagttcatccccaggccccagggcctcccattccagatgtgaagaggtgaagaccacgcctggaataactccgaatacaacacaattgctcctcacatatcagctgttcttttccctgttcactactgagaaaacatagataaatcacggcactttctgtctagcattgaaaatggtcattttaagaatcagggcagatgttggctacacacagaaagctgcccaagggtaggcttgaagcaaaataaattaagaaacccatcatgtactcttgagtgcagggaaacaaactgataatagcaacaagtatgcatccttttcaagtaaagataatgagtcaacctgctgattgcatattgtggtgactgaatacattgtgcaatgattaacaaaagaactgattgttcgtaattcaaggaatatctttccatttactgaggctttacttaacctctagcaatagttttgtcaagttattcacaaaggccgtataaatcttttgttagattattccaaggttcagcatatttttgatgcacgcaattttaaatggtagcttagaaaaatcacatcttctgcctgttgttagcatacagaaatgcaattgatttcagtatgctgaatttttattcagcaaagttatacattctcttatgaatttatatgacttatcgttatattcttttgagctttgtagtcacattagctatgaataatgataggttcttactttccaaccttgaaacttgctatgttttgaatgtgtccctcaaatttcatatgttggaaacttaatccccaaattcgtatgttgatggtatttggaggtggggcctttgggaggtaattaagattagataaggccatcagagtggggccctcataatgagactggtggctttataagaagagaaaggagatcttagctggcatgctcttgccctctgccatgttatgacacaggagaaaggtcctgaccagataccattgccacgttctaggacattccagccttcagaactatgagccaaatgaactcttttctttgtaaattacccaggctgtggtattctgttgtaacaacataaaacaaagacaataacttttgttcttttactagccatattcctttcagtggactggtcataatgaatataatcgtgttttttcccaatcttaaaaataacctttgagcatttttgccgtattttccacagtttttaaatagatctttttctattagattaatgaaaatttggctgggttcagtggctcacacctgtaatctcagcactttgggaggcaaaggtggatgaattgcttgtgcccaggagttcgagaccagcctgggcaacatagtgaaaaatctgtctctacaaaaaaaaaaaaaaaaagctagccaggtgtgatggtgcatgcctgtagtcccagctccctgggaggctatggtgggaagatcacaggagcccaggaggccgaggctgcagtgtgctgcaattgtgccactgtactctagcctgggtgacagagtgagaccttgcccccatacccccacccccaaaaacaagaaaaaaaaagtcctctatttctagtttgatacgtttttaaccatgactgcatgagaaattttttaaaatactttttcagcatctactgagatcatgtaattgttttaatctgtcaatatggtaaattacattattgattatttatgtttacataacatgactatttcatgttactccagacaggtatatctggaataaatcctagagggttgtgagatatatatctatggatatatacatatatctatatatgtgtctatatctatttctaaatttgctttcctagtatttgtagtcatatcatcctttaacaacattttaatttcagatttatatttgttaagtgtacttttttattcctaatattatttgtgtctttagtatttttttcttgatcagtcttgtgagatgtgtatctattttctttgctttttaaagagcaaactattatatttattatatttattttatttttttctttgttgatgtctggaattatttttattattttatttatccattttctttaggttctttctgttgtcttttttctgacatcttatgttggatgcttagttcactaattttcagcctctgttcctttctgatgaaaaaaaaataaagctcaccaattttccttgaagagccattatagccacacatgtaaaaggatcaatttttagtatatagaattttttttttattttgtatttttctacattaataataccatctaatttcctttatgatttcttctttgatccattagttacttaagaggttttcttaattttcaatatgggttgacctagttaagttttctaacttcatttcattgtattcaaagaatactgggtataagaaattaatctttggctttgatgattcttgctttatgacttaaatatgtgtgtttgaataaagagaatgtattatttgtgatgaatatcacatttataaatttgtgtcagatatagtacttatgtatatatatatttttatatagcatttgttaattttattgcttaaattttatctatggctccctcttatttcactgagacaaatagatttagaaatctcccattacattgctgaaatgatctatttcttcttttaaaaagagcttcaagctcattcatatttttttggtaattattttacttgaaacaatggttttgaagatactggctatcaagcattgaaaactaacaatccctaagagacagaaacaaataaggtgagtcttaacattactccaacttactgccttgagagcgtttccaggctggggcctaaggctaaagtgaggagataaagctgagagttgagggagacgatggcctccaaatttcacaggacaaaatattggtgagaggtgctcagagacagagtgtcagagatctgcaaagacttgttcaagtttatgcatgtgagaaaactaaaaagaacctacccaaaaggattagagataacagtgtcagggacccacgagggtaaggaacagtgcctcttatacccaccagtgaaactgaaaaccttgctggttcacagagcattgagtagaatacacagagtggccggcctctggtgggcaacagtaagtcctagactgacccttattccagttctgcctaacaaccaacaacgtgacctggaaggataaaactatttccaagtaacttaactcggtcccagaacaacgaccaaaaatatctgtagaagagaaaaaaacatatctaataatccacaaagcataagtcacaatatctgatatccagatattgtggtcaacagaaactgacgaggaatgcaataaatacctatattagaaaagaagatctcaaatcaatgacattttctataatataaaactaaataaagaagaacaaattaaatccaaagaaagtaaatcagagtcaaaatcaattatataaaacagggatggacaaattttttctgtaaagtgtcagacaataaatattgtcatctttgtaagtctcctatggttttgttgcatattcttattatttctttttacaaccctttaaaaaagtaaaaatcattcttagatgcaaggccttacaaaaacagagctaaatttggtctacagactgtaatttacccaatactgaagtaaaaagcaaaaaagaaaaagagagagagaaagagagacagaaattctaaaaatcaacagcaaattagttgagatagtacaatagataaacatgtaggcagagagagaagacataaattataacatcagcaaaggcaaaggttacatcactacagattgtgcagatattaaaaatataaagacagattatggacaattttataccagtaaatttgactacttggatgaaatggacaaattctttgaaagacatagtcagtcaataaaaaagagataataacctgaatagaatttgttgaagagactgattttgtaaaaacctttcagtgaattctagcaaatatttagggtaaaaattacatgaatctacacaaactttagcagaaaattaaaaaggaatgactggcctggcacggtggctcacgcctgtaatcctagcactttgtgaggctgaggtgggtggatcacttgaggtcaggagttcaagaccagcctggccaatatggtgaaaccatctctactaaaaatacaaaaattagccaggcgtgttggcatgcgcctgaaatcccagctacatgagggggcagaggcaggagaatcgctggaacccaggaagcagaggttgcagtgagctgagatcgcgccactgcactccaacctgggcaagagagtgaaattctgtctcaaacaaacaaataaacaaacaaaaaatgaatgactactttccaactcaatgaagccaccactgccataataccaaaaccagataaaatattacattcctcagaaacagataaaaaattaacatttttcacaaatgaaattcaacactgtattttaaaaagtacattatgatcaagtagagtacattccaataatgagaggtgatgcaaaacgggaagagaagtaaacttccttgccctgataaagagaatctatggaggacctacagctaactttatagttgacggtaaaagactgaaggctttccccttaaaaggaggaacacagtgaggatgtctgctcttatcagttctattcaacattgtactggaggttttagtcaatgcaataattccaaattaagaactccagataaacaaaagacatcgaggctgggaaagaagaagaaaaactgtattccttcaaagatggcatagtttctatgtgaaaatcctatgggaactcctaccagaagtactaagtgagtttagccaagttggaagagaataagctcaatatacaaaattaattgtatttctacatactagcaacaaactgttggaaattaaaacgttaacactaccatttaccacatcatttaaaaaaatataaaacaggaaaacatctgaccaaacaacagaaagaaacagaagagacattgaaaacccaaaacaaaacaccactgagaggaaataaagtagcctcaagtaaatgaagtatgttatgttacaggttagaagactcagtgttgtcaaaatatcaatactctccaaattcatctatagattcattgcaatcctaatcaaaatcacaacaggctttatttatttattttagaaactgacaaagtgattctaaattttatagagtaacacaaatgacctggaatatctaaaacaaagttagagaacactactaaatttttagaactaatcaagctaccgtaaaaaagagtacgttattggtacagatacagacaaatagatcaatagaacagaagactccagaaacagacacaaacatgttgacaactgatcttgataaaggagcagaggctattcagtgcagaatgaatagtcttttcaaaataccatactgtagcaattagagattgatatgcaaaaaatgaactttgatttctgctttacatcatatacaaaattaacacacaattgatcatagtcttaaatttaaaacctaaaactatataacttctagaagaaaacaaaataattcctttatgaccttgggttaagaaaacactttttagctaagatccccaaagcatgaccaaaaaaaagagcaaagttacaaattaaatgtgttaaatttaagactttctgcttgtgaaatatactattaaaatatagaaaagacaagtcacgaacttggataaagcatttgcaagttatatatctgataaagaggacttatgtctgtaatgtagcacatgcagaactcaatggtaagaaaacaactcaccatcctgggcaacagagcgagaccctgactctataaaaaataaaaaaataataaaaatccaagcaaggtggcatgtgcctgtagtcccatctcttcaggaggctgagatgggaggatcacttgagcctaaggaggttgagtctgcagtgatccatgatcctgccactgtactccggcctgggccacagagcgagtctacgtttccaaaaataaaaataaaaaataaaacaacccaataaaaagtggaaaatgaagaaaacaacccaataaaaaaatgggcaaaagatttgaatggacactgcagcaaagaagacatatagatggcaaataagtacctgagaagatgcccagcattactttctattaggaaaatgcaaattaagaccacaatgagatactactacacacctgtcaaattgaataccttttaattaaaaggtagaccaaaccaagtgttgtcaagaatataaaacaactagaattcatctatgtttctggtctaaatggaaaatggtacaactactttggagaagagattgccattttctttgggaccaggacatttcgcagggaagtatttgcacaagaggcaaaaaaaagcacatgactacacaaagaactgtatacaaatgtccagctttacatgtactcgtcaaaacctatttaaacccaaatgtcagaacagataaacaaactgtagtatatatttatgcaatgaaataatattcagcaataaaaaggaaggcacttgcaaaatacactgtaacatagatgaatctcaaaatgattgtaatggatgaaagaatccagtcaaaatgtatataccctgaggtttttgtgtgtgtttgtgtgtgtgtgtgtatgggtgtgtgtttattaaaatatatgtaacttttctgctagagtttttttcctgtggtataaaaacaaggtagttttcctaccacctttgagtagataagtgtacttaacattaaatgccaaaggtagacaccagcaagcttttgagccaccccctccggacaccagagtgctacttattctaacataccctaccgggtcagatacaaatgaaagacagactgagcaggggacacagagctcagtaatattgacagcggggttcaaaaggatttgagacatggacttcacaaacagcagcaccgtaggtctccctgaagcactcccagtgaattcctatggttggcaatatctggaagatctctgcacccaggtcatcccaccagggggccctgagaaccagaactactttttatcactgtgcttcacgtagtctatgaagcagaaaaggcagattacggcaggttgtcacaaagaacaaggtgagtcaaaccgcaggactgcctttacttaagcatacaacagaaaaggctgtgtgtcaaactttctgaaccatttatcttttatagactgctgaagactgttgagttcagcgtctcttaatccaaagcgctgttttagaaaagataatctacgtggcaaaaaatctggtcaggtcagtgtgactgcgcatcctggggccatcttgattatgaaaaactctaatatgggaggagagagactttcagtaacaatcactcaggggaaagcaatggcatcaccctgaagggcatggattaacagataaatagtgaagcaggttaaaatctaacagtcacattcctgtaaaagatatcttcatctcacgtctaattattttcttttccattgctcttctctaattagtacttgcttagtaatggaagcatcgagaaaggacagagagagtattataattctagcaatagaaagctagacacctcattttctagatttgattacacatcttaaaagtatccatttttccccaaatttacatggcacctataatggcataatttaaactttaagtagataagatgaatagatggggactgaatgcagcgtgcttactttaaaacaaaaatgtgggttccttatttcctaatgagtaaacagaaatagaactttcctataattttcaatgctgtattttattttgattatctttactagtatgttgaatgagaagtttttcacacaccaatgtccactgcaaatgtttttagaagttctcactaagtggtggtagcaggccaatgccaccatgctctcaacctcatcgtgtggcaggttgatttagtcagcttcccatattttccaagttctgcttttatttccatccccttaagcaatgaaagtcacaccattagagttggctctaagctacctagggtaagagtggacggttagcagaaaatacataagcaataaccaaatctaatttttatctttctctcgaataggcagcacaaaaattactggaactgctaaaaaaaaaaaatgaaattgagtgctaagcatttcagcagctattctttcacatatattaaatgctatttagctattatatattatgtacataaaataaatgttaaatgctaaaatgttaaattttaaaaactaagtatacgtatatgaataaatttttaaaaaaattcatattcacatatgtatacttaattttttgaagaatattaaaggtaagacaatatagagacatgaataatacacaatctgcaaaaattaactattggattaatcaactatgtagtttaccttgtacatagttcctggaatttttggaaagtggcatgatataatagaaagagtccagacattagaattaggtagactgatattgaaaccccacagcctacttgattttgagcatgtattacttaagttgtagtgtcctcatctgtgaaattccatataaatctaatgtggggattgaccaattttatgtgtctgtagtgtcagtatttgctagcacatattggctagcaaagaatgtacagtttttaatatgcaaatctgctagaagtagggacaaactgcacacttacaacttaagcatgcaattctccatagcttttatgatgattgcagttatattattattttatcgttataagttccacaagtttctttgactatccgaatataaccaaactagtttcctttatctcttcatatgaaatgggtgtatttgtctagaatttaattctgcagcatatggaaatttgcctctgcaatgttatgtattcctgtgacattctctggaccattctcaaccgaagaggaaggtatacacaccattccttgatttttaaaaacttaacaataaaagaaaactaagagagtggttgttatcatacctcggtatttaaaatagcaaggcaaaagcataaatcctctgaccatttactcacaattgctcatgaggcagatagtggcaacttttaagaagacaagatgagaataaaattgcgtcacaaagcagtctcttgattaccaatattaaaatcatttgtacttatcaggaacaatggggagatcagaccttctaactctaaatgagtaatataacagattatagtctctattttggccagaatcacaaaatgtactttttaaagtatactttaaaaatatggatcatatgaagtatgcataaaaataagatggcatttccacctctaattagcagctggaaaagctagagtaagtgtatggcaaatctctactatggccaattatatttccaatgaagcaataaagcatacatttattacataatttaacagatatatatattttcagttccttcctcccttcgttatactgaggaatcttcctctggacagtgctatcctcagatgttttactctttgtattatttgtctttactgtgtctatcaaccatcagcaaaccattaattgaataagttgacgtattagcttttatatttttgaactaagcaaataaattactagtttatttatgcagttatccttatttggagactcttaaaatatcatatgaaaggtttttttttaaatgcaaacacaatttacttttcctcagtcaattaaaaaaataatattgttactctcacttaaaagaatatacatcaacaacagaaatactcattaaatggaactatgtcaggctctgtgggagattagaaatacaaagcctataagacagtctacaggtttgaatttctctttaaaaatatttattatatttttctgttttcatagaattagagaataatatatagtttcatgttatattgataatagagaaattggactttatttacaatttaattataggtgtttgaaattatgttctaggctagagatctaaaacataattatgttttagatctagaacataattatgttctaggctagagatctaaaacatagatctcacattatctatttaattaagagactttttaaaaggcaagatatgagaactggaacttaaattttaacaccatctgtaatctatctatctatctatctatatatatataacaatttagtttttcattttgtgtagatatatatacacacacacatatatgatttctgggaggagtcaggaaatacctctaaacaatacatactgtctctctaaagtccttcaccaattacttcccatattaagtactgaaacaaaaaccatttacctaactgcagctgtagtagcaagaagaaaagcccatttcttcagcatgaataaaaggcaaaagtaagcaggaaagtgggttggagatgaaaaaagaaattactcaggacaaactgggtatttccttttgaaccaaattaaaaaaaaaaaacatggtcaattttgatggattctaacattcatctcagggaccctgagtgacataaaggaaaccaagtcaggaacaatgtctctgtcttcggaagtctcctgtgaagcagaatttgtttacaaggtaaaggattaattaggtttaccttaactgatctatttgacaaaaactcaaatgtaaattattaagagcaaagatcaactcatcaaaagaaatgaagattctgcatacaagtgcccagcagatccatctataggttgatacagggagtacttatacaggagtcttgttggtcctccagtatacagggctatctcagacattctgtgtgagggcactgtgggcactttacacctgccacattcagagacaaggccaaaaccaccaacgtgacctttattatctcccttaaatgtagatttctgtaattaaatatcttctacccttggtcactactacttagcaggattacgctattcaataaattgactacgtaatgtagaaagcagaaaatgttcttgcagctttaatcttctctaactgaaagatgctaatctttctactctgtggtcctaaattgtgccccttgctgctttcatagccgtccccccacccccatcccatttcttccagggccatcatttcctctttcaggacaagaaatgactacagtgttccatgaatataataccatggtttacaccacgataagagactgtgtttcactatgattgctgtaaggtggccacatgggccccagactaccatagtagactacaatatttaagaaataatctaatatataatacatttttttttgcttggtcaaaacaaagtttaaattaaatattaaaatcacataaagttattttgaggatatcaacaaactgattctaaagcttatatagagaagaagaagacccagaaaagcctacacaacactgaaggagaacaaatatcattggtaccacccgactttaatgcttactataatgtcacagtaataaagtgtgattattagtaaaaaaaaaaaaaaaaaaaaaaagataagatagacaataaacaaatcaatggagatcccagaaatagatccacacaaatacagtcaactgatctttgacaaagaggcaaaggcaatagaatggagaaataatcatcttttcaaaaaatgatgctggaacaaatagccatccacatgcaaaaaatagaataaatcattacagtttacatccttaacaaaaatcaactaaaaatgcgccataaacttcaatataaaatgcaaaactataaaacatggagaagataacaaataagatcatctagatgaccttgggtttgctggtgattttttacatgtaacaccaaaggcacaatccatgaaagaaataattgataggcagggcttcattaaaattaaagacttctgctctgcaaaagacactctccagagaatgaaaagccgagtcacaatcagagagaaaatattcacaaaatatatatctgataaaggagtagtatccaagatatacaaagaagtcttgcaactcagaaacacataagtaagggacccatttttaaatggtcaaaagagttaagcagacatcctaccaaaggaaaaataaagaaataaataaatacagctggcaagtaagcatattaaaagatgctcaccatcatatgtcattatggaattcagaaataaaacaaaattagatagtactgcccacctagttgatggctaaaattcagaacactgaaaacagccaatgtcagtgagaatgtggagcaaaaagaactctcattccttcctggtgggaatgcaaaacgttatgaccagtttggaagatagtttggcagtttcttacaaaactaagcagatttaccatgcaatccagcaatcacactttattcatatctggacaatacctggaaacaagatgtccattaatgcatcagcaggtgaatgaacaaactctggtttatccttacaatagaatattatgcagcaataaaaagaattattgagtcaccaatagatatgaaggaaatttaaatacatattgctaagtgaaagtctgtctgtaaaggctatatactttctggctctaactaaaagatatttggaaaaagcaaaactatatatagaagcagtgaaagatcagtgattgccacaggttcaggggaaggagggagagatgagtacgtggagtacagggtatgtttagggtagtggtgctcttctgcatgacgttataacggtggatacatgccattagatatttgtcaaaacctacagaatgtacaacacaaagaatgaagcttaatggaagctatggactgtagttaataataacgtatcaatattgcttcaccaatttaacaaatgtaacacacaaatgcaagatgtgttaataacagaggaaagtgtatgtgtgtgttgggggagaaatagggaaaatctttgtgcaacttttctgtatgtacaatttgtctgtaatcctaaaattacagacaaaagttagtttatgaattttaataaacagtttggaatatttttcgaaatctttatttttcacttgccatactgaaagttacctggcatggttcttttcagccttgtaagcaatcaaaatatttccacaatctaattcaatcaagcttggtattttactgtttgaaaatcttagcattatttacagatttaaggtatttctattccttctttttaaaataataattaaattgtttaatgaaagcatttctgactgtaaacgtttaaatgctacaaatttacatttctctgttcataaaagaacttatttttggtttcttatctttaagacaatgccacattcatgataaaaatatacttcaccaattttgaaatagttctagtagataactattaaagatcattaaaaactcttgagtggatgcattcagttctctaaatctagagtgcagcatatcataaagtgtctcctatccctatcttatcattttagatttttttctccaaagtagtgctcactatcagaaatcaccttgtttaggccaggcagagcagctcacgcctgtaatcccagcactttgggaggccaaggcgggtggatcacttgaagtcaggagttggagataagcctggccaacatggtgaaacctcctatctactaaaaataaaaaaattagctgggtgtggtggcggctgcctgcaatcccagatactgaggagactgagtcaggagaatcatttgaacctgggaggtggaggttgcagtgagccgagattgtgctactgcacaccatcctgggtgacacagtgacacactgtggcaaaaaaaaaaaaaaaaaaaaatatatatatatatatatgaaatcactttcttcacatatctgtttacttgtttcctaaatcatctctcccaattccccagcccatcagccccataggaacagatgtacttggaagtgccacagcagaggaaaaccaccaggtaaataaatatttgggaggtgactgattgaataaattaacttatctagatttggtttgtcaaggacattcggaaaattaggtagaatttagctccatgaatgttgagaaagttgagttttgagagccctaacatggccaattcattttacagaggtggaaaatggggctgacagatgttaactcaccttgtccaaagtcttagtaatggaatcaggaaaaaattcaatcacttgacttttaaccaataatcttttttactacaagagttaatttgctaatgaaatctcctcagtattttctcaaaacagaacaaaaccatgagttaagtattcctttttctttgctataactaaatataccttttaaaattaaaaaaaaaaaaacataaacatggttataagtgatcttatttcctgcatttgaggcagctaaaccagtatttcccaaaatgtcttaatacccacttcttgatctgctgcaaggaaaaatattgttcagtggtcaaatacgttcaagaatcatgattattatatagagaatagacgtttgcctcttaatggaattggaaaattcctacagtaaagatacatgtttagttaagggttggctaaactacttcactgtggcatcctctcttcaaagaacccatcaatattctacagaacaaatatgccatacaacacatttttatccgaaaatcttttataattggcttatattattgttttattcttcaaaatgttttctaaactgtctcagttctcgtcccatgtcatacaatattttataatttttcaaattctcacttttatgttctcacttactaaaatacggcaaaatataatttatatatacatatgtgtgtgtgtgtgggtgggtgtgggtgtgggtgcgggtgtgggtgtgtggtacctggaacacaataagtggaaaaatttgtttcctctgtcttatcgcacccctttaaaaataacacaaacagaaagtgttctttctaatagtgcaacttacggtccatttattttttaatatttgttatttaatccatggcactcacttttttgaactgcagtaaggtgttcttcaacaattcctaatttttctgtgaatcgtttacttggacaatgccacattcacatatacatcccctaacatttgcatttattcagtttccttttaaaataagtgctaaacaaattaatggattttgaaggagaaaggctttcctttcaaaagaatggtaacctttatgtagttgtttttagatatttcctataaaacctgtctactctcgatacagtcagacatcttttcttcttttttaaatattaaaaataagcacataaaataagtcatttgttctttaaaaaacaaacaaaaaaaccaaaaaacaaaaaacctacaaacacaaaatcatgtaaaccagaaatctttcacagaggtcaagaagtcaaaagtaaacaccgacaatgaaacaccgacaatggtaagatccttgtgaggctctcgctccacctttctcattacttctatgtttccgtggcacaccacgggccagtgcttactaagacctctgcttagcgatggagttagtgggtctgcacctctgattgtgctgggcatgagacatactgattaaaaatggtaaaaggataaaggaactggcctttgagagacaacatggatgaatgatgagtttttgaattaaatttttgacagctttgatctttactgaaaatttaaatgaaaaacaaaacaaagcaaaacagagttccaggattttagaagtgccttttatcttaagtgaaatgttctcatcagaaactttggcatcccatccagtgcctttgatgctggctgtgaaacaagacaatccatcttcttagctgggaagacaggcccttcaccacccaggaaaccataacttgtaaacatcagtcaagttcagatggctacatttttacttcagaagttcgctttgcatttggagtggctcattaggggaaaagagagagagagagaaagggttatggaccaaagtgtgtttctcaaaaaattcatatgttgaacccctaacccccaatgtgatcgtatttggaggtagggcctttcgaaggtgattagggttagatgaggtcacgaggatgaggtcacaagccaggattggaaagcttgataagatgaaaaaaaaagagtgagctttctactctgtgtgagaacacagcaagaaggcatctctctgcaggccaggaagagaggcctcaccagcaatcaccttgatcttgaacgttccagcctccagaactcagagaactaaacatgtgcgtttaagtgcccagtctatgagactttcttttatagtagctggagcagactaataccgacagaccaagagagagaaaatggagagaaattttctggcttgtcttttaattattctttatttataaaaaaagccacattgatttttgcagcagtgatgcaagtgtgctgtgcataggtttgatgttctgctcaaattaagtctaagtttttccactaaaggaattatagtgttaatatgccaagagtcctatctgctcacgtacttccagtctctgtaaatacgtgcagcctgatatcaaagcaaaccttgaggccattaactataacattcttggagaaacagctgaagacctactaagaaaaaagtaccaaataaccaaagctggcaattacaattccaccccgaaaagaaggaaggcatgcatatgaattatgaaaaatagggactgtgcagctctcagattttcaacaatgaattgctcacattctacaccgtgtgtgttaaatgtttaaaagtaaaagatcccaaacattttgccaaatatgcagtgttccaaagggaagtatcaaaaggatactcatttataaaattatggttcagtagataaattataaggcctcaaagaacatgctgttacttctacttgccaatttataaattgactcaagtcttcatttaatttatgaaaaatcaaatcatctcaagaatgttttcgttatttttctctaccatgtaaaatatatgttttgtatgtttgataagttgtatcctgtcaattttagaatttagctatttggaacatataaaccacatttctacaactcaaaatagtataatgcttagttacctatctttaaaaaagtaatagtaatgcactgagatatttgggggtgggaggtggcggacacaagtttaactttcaaaaataagggccgtgtaaaataactgaaaaataatcctatttgaattaaaattgaataatattaaaaataaatttctactgaaaattacacctgtttctctattttatttttcttccttttaggatagcagaaaattctgttagataaatcagactaacatgggagacattgtaaatattaagaaacaatagtaggaagaggcggactcacattcatcttgctctttctgctattcccttccaaaaccaactgtgaacaagcactcagggtggccagggtacgtgaggaagcctcctctagcccagaaaaaaactttatttcacaaaaagttatccttcacaataaaaaacactattctataaaaattgtttcccctggccaggcgcagtggctcacgcctgtaatctcaacgctttgggaggctgaggcgggtggatcacgaggtcaggagatcgagaccatcctgactaacacggtgaaatcctgtctctaataaaaatacaaaaaattagccaggcgtcgtggtgggcgcctgtagtcacagctactcgggaggctgaggcaggagaatggcatgaacccaggaggcaaagcttgcagtgagccaagatcacaccactgcactccagcctgggtgacagagcgagactccttctcaaacaaaaaaaaaaaaaaaaaaaaaaaaaattgtctcccctgacttgagttatgggaaagagggttagcttcacttggccctccatgcccctgcccaggcacgtgtctgtattagtgttctgcagaggcaattcaaagtacattgtccaaagcccctctttgaaaatcttttgatgctgctgtaattcaatttggtttctatgttgaatctgaagttctgtgttactactaaccccctttctgtaggaaaaaaatgtatttttctatacaaacccatatgccatcgaggtacctgtatttaatatacctccatttagtagctaataaatatgtctatttgaaaactatttattcttccatacttaatcatagtgaactataaatccaaacttgacagcacaagaaaagtgacatttttcttctttcatttctatgctactttttccaaattatttcttgttctttttaaaaatgaagcaaagacatcatcattgttactattatgccttcagttaacaaaaaccttttaaaaagattatttgaaatgcatatgtaatatgcatgactacgttaacaggattatatgctattagatattgtgatataaaattacaactcactgggagatacagtcctctttgggcctctctcccttctatacatcttgctggacttgccaagatcaaaaggtcctgcccgcttttaacagactattactcagggttgcttatgcaactggtaacctaaagagataaggcaaggtcttcccctagacaaaaggcttgcatgcggcttgctataacagtagtcccagctcagtattcaccggctgtgatgcaaatccacccatgagtaagttccctctgagccaattgcttcattccctgcacacaagctgctgcactgctgagcactgtgtaataaagccctttgcctttggccccaagactcacgtcttccaccagcagcctgatacagtagcaggctcactgatttgtaagaggggtaaaatcaaaccccagacttgataataccatctacacagacattcactggtatgattcaagaatataaataactggtattcaatgtatccaaaaacaatcatgatgaatatttcaccaatgcattgctctttaaaataatacccaaataattatctgtactgtttccataccttgacctttcaactggacttttccttaatttgagcttttttgagttgtcatcagtgtcgtggagacttgcgccttccaattacacagtggtgttcaaacagaagaaattccaaacttttcttccttttgactataactaccctgggagtaaaatgtcccccaaataaaaacataaaataaataaaataaaagaaagaaagaaagtatctacttggcaagtgggaggtcagaagaaaaggggcttcaaacatcaaagaaggttctcaaaatactctttcaaatgaagaaagccccacgctcggtgccttatcttgcaagctcacatggccagacagcaacctttaaaggattatcttaacatgcggcgagctgggccctctcatgtgttctgaaatttaaaccagaaaatggctgcacaactgacatggttgtggggtgtgaaggggaatcaggaagagggaggagaggcttacatttccagaatgagccagagttcagataaagatatttgtgtaaaaaacaaagcaaccaggaatatgatcctgggctgtcaatttgtagaatacaatctaatacttatacgccataggtagtcacagaagttataagaaactacaagccctaaggcattttttagaatagaaatctctcttctccctctctctctctctctcttttttttttttttttgccaatatgtagtgtgggattttctttggctaaaaactgttccaatttccctgttttctaaatatactttactaagcatttttttttacaatcaggagtattgtaacctttgtatattttatcaataataaaataaatccataatttaaaaaaatcacacaaaagtgtataaagtaaaaagtcaaagtcccacatccccacctctgaatttcacctttatctgtgtgtatatgtatattttgatattgtattttgtaagtgtattgttctgtaatgtgctttttcatttaatagcatgattcacattcttccatgtcagtaaatacagagctttctatttttttcatgtctagacagtactttacaagatgattatattcagtaatgtatttaaccattcccctactgatgaatgttgaaatattttcccctaattttttactgtttcaaaatcaaaaatatgtacatcaacttcaagctttttactatagcccgtggactcttacgtgatttactacctgtctttgtcttcctctggaacttcttataccaaatctttgtgcccctggcctttcttccatgcctgggctaagccaaccttgtctctgcatctctgtggaatgtcctgtcccaaggtattggcgtggtggttcctgctgtctcatcactcgctccaaggttacttccttggtgaggtctttctagagctcctgttctacacaatctaatttatccttagtcaatatcttttataccttctcggtttattttctgtacagcacccatcaccctctggaataatcttgttcatgtatttcttactgtttactgttttcatgtaagatttttctctggtatgctctaatgtgtcctttattagaacaatgtctgccacatcataggctctcaataaacgtccactgagaagatgcataatggaagtatacttcaacttggattgtagcacatttacacaaatatttccattagagagatgcctcgaagtaaaattactgcccaaagatttgtacacacaaaatattgatgggtacttgccatgggtactgcaaaaaagctttaatggcaatttatattgtcaccaatattatggcaacggcccttttcccacaaatgcagttttataatgccaatttgacaggttataataatttttttgtaaattaaaaatcaccttgttctaaagaatctttttacatttatcacatttgtgttttatctccaaattaatcattgttgaaaatcttttttattcttttatcttttgggattacagaatgtcattctagttttcttccattattatacaagattgaaaggattttggttggctttcttagatcttatatccaaatgggatttattattatatgtggcataataagaactattattcttttaaaatgtattaattgtcttttgcttattaaaaaatagtcatggtggacatttctttaaattttcaaaaataaacacagaaaagaaaataaaaatcaccccaatagaaacttgcctgatttctttccactgcattccctgtaaaggtgtgttaatagaaatgtttctttgatcatacctataaagtggtgtttataaaaatgtttattcccggccaggcacgatgggtcatgcctgtaatcccagcactttgggaggccgaggtgggtggatcacctgaggtcgggagttcgagaccagcctgaccaacatggagaaaccccgcctctataaaaaatacaaaattagctgggtgtggtggtacataatcccagctacttgggaggctgagacaggagaatagcttgaacccgggaggtggaggttgcggtgactagagattgcaccattccatgccagcctgggcaacaagagtgaaactccatctcaaaataaaataaattttaaaaaattaaaatgtttattcccttatacaacattccctcatactcttttgtatacagtttgatatggtttggctgtgtccctacccaaatctcatctcgaattgtagttcccataatccccatgtgttacgggagggacccggtgggaggtagttgaatcctgaggccagttacccccatgcctgctgttctcatgatgtgaatgagttctcaggggagctgatggttttatcagggactttttccccttttgctcggcagttctccttgctgccatcatgtgatgaaggacatgtttgcttccccttccaccatgattgtaagttcactgaggcctctccagccatgcagaactgtgagtcaattaaacctctttcctttattaattacacagttttgggcagtcctttagagcagtgtgaggacaggctaatacactgttttttcgcttatgctatgaacattttcttttgaaaatgtgatttttaataatggtacagtatcttaatgtgtatgtgtattgtaatttgtatgagtgtattttaatggttcctattgttctacaagtaattcctttttctgttattaaaaattaacccaccaatgaaaacccatgctcataaaatctccaggaccatctctgatttcattcacaggatagattcctaaatgtggactcaataagaaaaggagtataaattatttcacagctcttttcaggccttttacaggcaggttgtgtgtactatttaaagtactattaatcccaccacatacaagatgtattaggtacttcttaagagtgcactgaatataagaaatctgttacaaaatgttagcagagcagaaagagaaaaaaagaaagaaaaaagggatagaatgagattagatcacctggtaaactgtaggaaacagctactgcccccaggactcaggaaactcaagaaagtactttatcagaacttctgagtgctgagtgcatgccaggacccctgaggatgggccgactgagtgggtagaaaccaccaaggcactgcctcccagtcacggaggagtggcatggagaagggatcacagacacttccagaagcaggagagagggaagggtagaaaagagaaaatgacagcgcctttcccctgacctgcctttggatccactgagcagatgtcacaggaactcgctggcaagggcatctgggaaatacagtttcctcccgagccaagcattgcggagcagcacaaagggcgtggctggggaagggttgggagaacagggaatcactctcacacccaagagtgcatggagcatatctgggtgtctacacaggtaagagagtgaggggtcaaaaccgggcttcttatgactctaaaatgtatttttagagcagttaccaggagagctgacattgttgaatctacctgagaagccagaagccagactctttgtattactacagaatgtgattccatgctgttgccaaatgccaggaatttctacatcgactgccatcaggacatggaagtctcattgtttcttaaaacgcaactattcttgaagacatggaaggtcatccttcttacatccttacatccttctttctgtggccctcctaggcttgtcacgagtcagcacgaatcccaaaggtaccagcagcacagaagctcacactctgtcatcagagctgggttggcagtgacagaaatgcttatgcaaacacaggctgacttctcactgaatgtatagaacatctaggaaagaaaggcaaaggatttaggccaaagcaatacctcaatgcagacaactaactagtggcagctagctagtcacctgctctcaactcttcaacgtccttcaaatattttctctaattgatatagcataatttgtgatgccaacaaccaagtgttttttcacaattacagagagccaaacctgtgtctctgctgctcccttaggctacttataatattggcctagttctcttagctgtcagcacaattaccttgtgattaaaaagataacatcaataggaatttcttttttatcagctaagccatggttacatgttgcatggacactagcactcattaccccatccatattttggtgagatttttgcccatttccttcgttttcacagaaaatgaaataaagcataagcttgttggttgcaaaggtgacatatagtaagtcaaataaacccataatgaagttcccttatacttcaggttagcttcaaaatcccactcaaatatgtatccaaaaagaaataaaacaggaaactttctggaataagttcttttgttgctatttttatattgaattggcaaatgtcatttcactgtctgaggtcaagggaacacaagggaacaggcagttctcgaaacagaaaagttggaggtgctgtgccgtctctagctaagaaaactctagttctatgaaatatcattccacctgagaaaattttcacatgattaaaagataacagtgccataaatctacccttgaacatcaggtgtgactcttactatactacccaatgtcttttaaaaaatatttagatcattagccaatttgtgtgggtgatacaattgtacacattccacaaaaatatcagccatttgtctagttcagcatctggtaatgtcaattaagggttttatttactcacaaagagaaaaaagtaaagatattagtttcaaattaagtccaacagtctattgagtacgtagtttaaatgtatttcagctcttcatcctccccagggcagagatcactggcagaaattagcatccacggataggaaccaacaacagggtagctgatgatgtttaggtgaactcccctctttataataacagaaataaccccttttcccctacaaagcccgtctacattttgcatagcactaaggatggcagacctaggagctgagttagccaaccctgaaggtatcctgcctcaagacttgtggctatttggaaaaataagcatcctcgtcatggggtcagtggaatcggggcagtttgctggagtgaaagcccccaattaggtcaccctgtacttgtcatcaagaatgagtacacatggcctctctatcatcaagtggccacctacgctttttgagtggtaattcttgaaatatggttttctctatgaagaaagcttttctctccatagaaaaagcttaacagcaaatttcactgtagtcgaaatgtttcacctttctttcctttttgatgtgatcgtcagctcttgactgcatctcgttttctcatgcctgctttctttctgctgtcagtcacaatcctttgtgacaaggtgggatcacctggcagatgatttggatgttgcctctcatggagatatatctcattgaccctttcgaattcagagatttttttttaatatagaaaaaaaggcatagcattttaacatcactaactaaggcaaaagataaggacactggactgaaaaaccaaggatgttgtataaatattcgtccttgtgtcactattttattggcttgaggtatccaggaaacaacttcatttccccaaattacattttattaccaaacaaaagatgaaaaaagtactacttatcccattaaactagcataatggttactttaattggaggggtgggagagaaagaaaggtgaatctacttagatttcttggagaaatgaacttacaaaaatggaagctggtggcaaagccaaagtgaaattcacgtttacttattccatgcaatatttctctgtccaacctatgtaaagcactacaaatgaatacagtcatagcaactaattgagttatcagcatctccagagtagatgttactagtatgtcctggcatatgaatggtagtattatgtgggatattagtagttcactaagagtcctataggacttcttgtgtctggaaaaagagtttagtgagtgatactgaaaaaccaacagcttggctcacgggcatcattgaacaaatggtactgagcatggaacgcagctactcagaacttatgagccaaatgggtgttttccgtacatggcttcttgtccagaatgctactgctattagcccaatggccatcactggttatcaaacatcctgacccaagtcaaagccagacgaagacagaaggccatcgtgggaaggtgaagcgattcatgcttagggcaagataattatttggtatcctttcaatccatttgttcaacatttgctcccaggagaggcgggatgcttcctggggacagattagagaagaagggacactgctaagtgctcatgtattatttcaagcagttcactctgggccccgacccaaatcctcaggcaacaaagcagcaccctgcaggtaataggaactgtcttctttagaaagcagtgtggtgaccaggtgttgctaatcatcagagtctcttggtgactcacagccgccctcatgcagctttgcgagttctgactgccaacacacacaggactcttcctaagtattatttcagctgaattctgggatgtgaacatcagactttcaaacccggctttctcactttctactggggtgaccctaaatacaagttatttcatttctctggactcagtttcctcatttataaacatgagaataacattatctactccactggttgctgtgaggaccaaataaaataacacaattaaggtgttatctggtatataataaccattcgataaaacttagcgattattatttatggcatccattccacaatggtactcaatggtactgtgtacactgcctaagaatcctaacctttatttttgctccactcatcacttctatttccagttctgtgatgccaacaaattgggtaattgtacagcagcatgttattatgtttcttcacctccccttcttactatgggtcccttctccgccttcctcaaacatggcagccctgtgggatgttgaggctcttgaggctcctcagtttgaaatgaatgagcttgctgaagtggaaacattagaagggcatgattggcagattattttgctccagcaccttcttgacagaagtgcacaaagctcttcaagaagatggagctgctgccagatgccctctgtccagcctcctggaagcccaggagaaagctggagtggacgccatccttctggcctcctcctgaaggacatactggtttccttaatttcttttctactttttgtccttcagtctgttgtccctgcacagctatagagaaaacaaggattacagattccatgtcgttttgcagccagggaacatctttggctagagatttgacggaagtcagtgccaagtggctgtgtccctgtaagcagtccattatttctaatggtctatttgcatgcaaacctccaggccagaggcagaagtaaacatcccagaaacttgtccctggagactctgggacactctcatttacacgctgtgctccattcacggcgctgagtttactcacacgtgctacacatgcgatcctcacgacagccctgtaagatggtattagcatctccattttatcagaagaaaaataacttccgagagggttaagcaatgggtaaacacggacataaatatggcaacaagagacactggggactactagagaggggagtgagggaggagggagggttgaaaaactaactattcggtgctatgctcactacttgcgttgcagaatgatttgaaccccaaagctcagcatcacgcaatatacccatccagcaaacctacacaggtaccacctgaatgtaaaataaaagttgaaattataaaaaattgtaaattacaaataaatgaataaataaaattttttaaaatacagttaagaaggggactttgcagtctggtgtacctgacactaaagcccgtgtatctttaccatatcatgtttaaaaaatcattttcaagagaggcaagaaatttcagtggagaaaaagactgagtatgtagaatggaagattctctagatgtgttgattttgtttatcacggtgtcaactaccggaggagtaggcaattttatgtggatgtagaccatgcacctttatcaggagtactttttcaggtcaattcccttccctagcactaaaaataattaatagatctctttgagagactaagacagtgaggagaaagtacatttacctaccacaactaatgagacctgaataactggaacagaatatttggaaaaaaataatggtttaaatggttaacgatgtgtaactagtaatataatagctacttcaacggagctttcatgtaaaacagaatttcattgcaagtttaagttttcttttgagaaaaatttggctatgtaaaggtgagtttggcaattttaagtttacaacttattggtcaataagtagtagtaagcctcttttgtgtttgttgagttaataaactatggttcttggacaatttctttgttggatgttaatctataactcttatttgacctgttatttgacatttctaacctcttccttaaacattaaccagaaccctgagtactttcttttccaacacgggtaagggattgattttttttcttaatttcataacttatgaagctaaaatgtgcaatattttgactgagtgaattaggaattcttgttgggatttgggaaaaagaaagttatgagaaactgatgactgcctatgtaatacttcctttataggaaattcttaatacccttatataggaaattttaatacccttcttacatatcttttgttcctggtgacatagaagaacaagtttaacaacatcttaagaaagaaaattattaaatatttacagtcacaaacctttgttcaaaaaagcacttaaaaattatatttaatagagtttaattgagtaaagtgaatcacatagccctcaaactagaataggtttagagagactagtgtttttgtgtggtcaaagaagacttatggaaaaaaaaggaaaatgatgtacagaaaatggaagtcaggtacacaaacagttgtattggttacaccttggtgtctatttgaactgctttgaagaatttgtcacctttcagaggccaaaacttggtgatcttcgtgattggaacaagaggaggttatagcctgattacacagtttactctgtacagggaaaactttaggccagacttaaaatacgcaaggaggcagcttaggctaaatttgctttaacaattctctctttatggtcaacctccaaaaatcatgaggggttaaccaaaactctaggcactgatgacattttgtcactattataaacatattcacacagttttaaattttattgggaagtagttggatagtgggttttgtaaagtgaaaagaaggactttaggttacttttctgtaaggattagagtagaaggaacctctgtgtgttgaaattttttgattttaggagataaaacctggtctgctatagtttttttttttttttaagttttagtttgtttatgtgatatttagtatgagtgactttagtttggtttggtctggtcggttggagcctagtacatgagtttagtcaaaagcaatagcctcttataattttatgttttatttatttatttgtttgtttgtttatttatttatttattcatttattggataggtgagagggtgacccaaactttactgttggcttcgtggtacttttagctattattattttcagttttcggtctcagtgtgtcttatatgttacagtgacttgttgatcactttttggagtttttgttgtttgggttgaagagggaccagttgacagtttatagatgtctgtatgtaaacatttgagaaaatatagtattttggggaggctactattatgactattaggaagataatattaagagtttgaaatatggtttctggtcagagtctctatgaatcaattaaaattgaagagttttaaacgtgagttagataaatagtatttgttttagccaagtagtctgttaatctctcacaattgaatctttataatttttatgtataacaaaaagtgttcataacaaaacagattctttttgtgtagtcaatggataatctagtgtgattttattattaggaacaattttagtaacagaatttagtcttttgtgtaacaatagtctttgtagtagaatttcttatggagtctattatgagggatgcatttataatgactgtcccatttattttaaactatggaaaaagagacctaataagtcatgtatcctgagaagagtgaaggacaaaatctttaggccaaacgttataaatagaatgaaacagctttagactaaacttcatgtaacaccttcaagtgtgagccacagtgatgagtaaccagggtctcaagctggtattttttcaagcaaaaaatacttcaaaaaagccactggagtaggggtggggagcgggtaagaagatccatatctgcttatcaactcctgtttttttttttttccatttctttttgtatttggtgtctacaaaagagccttaacatggtttaataaacatgtgtcatagactgcatggagttgcttatgttgtttcaggatacttaaaggaaatgctcactggaacgttctagattttggatttggaatgttcacccagttaagtatactgtaaatattcaaaactccagaaaaatagtctgaaatacagaacacttatggtcctatgaattttggatagggatactagacatgtacttacaaaatggttttgaaaattccttagtacaagaaagactctgccaatctgatacaaatatggctttgtacacacacacacacacacacacaaacacacaccccactctctctctctagatatatatacatatatatacatattaacatataacacatatacacaagtaaatatacttttcactgaattttgggtggacatggacccacggttcttgtctgggacatcagctactaggtctgagtcccctgtctgtgccctgtgcatctgggaatgtgtacacactcttcaaaactccagttaatcaccatcctccctgggaagcttccatgctagaggattgaggaatccaactcttgagaaacaagaacatcctcttcagctcttcattctaatacttagcagatatcatagtgttttcttagttgggagactagattctgtctccctcatttgccccaacttcatgcccactggagctccagacacccactggaggaggcagtgacaacaggatttgcctccaaagaacacagaccgcacccttgtgtgaataagggaattttgttactcctgattactttacccatcctagaatacgctgaatttagccataaaagaagttgaaaaagatactcagaagaagaaaaaagaacactagagtggcaaattgtattatattaccagttttacacatatccacatggatccttatgtttgtggggtccacagcctgaccactgtaatccctcacattcatgtttccccgccgtgtagaaaagctatacagggtattcctgctgtacacgcagccactgtgcaaagatgaccctactctccttggcactgaggagccgaagtcatcccctgagagagaggcagcctacaaatgaatacctggggccaggggcctccagagaggggagttactacaccaggcaatgcttctctcccagacagcttgaatattaaatgtgtaaacatactagacagcaaagtagtgccgaaaccaagaaatggacacacggagagagagggggaaagggaaggggagagggagggagtgggagagggagacggagagtgagagggaaagggagggggagggggaggggaggaggagagagagaggcagaaggagaagaacagggagagggagagggagggaggggggagggggaggggaaagggggaggaagagggggagagggagagggaaagagagaggtaggaagagaccacgaggagagaggaggaggaagacaaagtaaaggcaggaggagaagcccagtctgggaggtagagacagcaacaacttgagtcatgcgctggacacagtgcccacttagcaggaaccgctgcagctacagatgggtcccaaatcatgaacgaggacgttctggttgcacttccatcctaagaggatggtggagggtgatgctttttgtttcttactcatttccctgtgcatccatacagttagccaataccctctaaagtaataaaagtgtatttctgctccgagtaacttggttgaactaatattcaaatccaaatctgcagactggtaggctgactaggctatgtgaatgtgtaaggaacacagaatgtgcatacaaattccatacagacagagaggactgggctggcattaaggaagaccagtcacttcagaggactggccaagaggccagtgacaccacgctcggtgacaccacagctcttctcatggtttcaaccccagaggcagatattcttggctgccttcttgagtgccctgacgggggccactccttttgtctctttctttgatttctctgggtgcagactaaaattctccttgaatctagttcaaactgtccaaaagaggggatctattcagttcgattcatcacactggatggagttcttagaccaacacacgccacaggcccatggccagcctacagatcggctccctgatgtcatgccatggccatggaaagactgaaccatcacagaaggggctgccagcactgggacaggcatgtaagtcatatgagaccatctaccttggtcaaccaggcagtgctaatcgggagagtaagaggacagcacggagattagcaacccaaagcaataccccagcaggtattagagttgaccattggagcttggcatgttttggttattaatactccaaactattcatgcttaaggcaatgtggaatttcaagtgaaagccagatggttcttgggcaagaggaggaaagaaaaacaaagcatcatgtgcttgggagaacgcctagtaaaacaagaggatcccagtctctcccagcagagtgtgggcatcgttcactccctttggtacaatccattccctttctcgtcgggattcacacagcatggtcaaaggcaatactttaacatcacgaaatcaagctaggtttacaaatgtaaggtaagagataaagaaagaccatctatctggagttcttttctcccctttctttctatgtgtagaataaaaggacagagaagagacagaaatttaaagggaaacaaggcaagtgctgaaataaacctgccatctattttaagtgaaacaatttatttgggtttcaagaatacttttttctgtctctcgttcttcctaaatcccagattatcagtctaatcgaagatcataaaggagatgacaaaacaattatcagagagaaaactggattccacttagcagcggctaccaaaagtacagtttaatgtgttttcaatgaggtgggcccctgggggcctgaacacccacaggccaacggatgtttctatgtaagaagagcaacgtcatcagcaaaagcaatttcccacttttattaatccagtttattttaaggcatgattattcaagctttcgtctgctatagttagtcttgtattttcaggataataagactggtgaggctagttatcaagtgcctatgcacagaattcaaatggcctttgttctacctggcagtctcaagaactgttaaatgagcttaaactttattacaagaagaaacagaacatgctgagtgaaaggtctgcttagttgcttaccataaaaccacaactacttaggaaacttatgctctgcatattctaaacctgaaggagcctctaatggggcatttggggtcagttttaagatgattcctcaaaaatgcccccaaataagacctggaaggggattccacacttggctgtctctgcagagccacaggcaacaacacagaggtgccatgatttatttaatggaagcttggtagtgactcaatatcaagaactcaccttgagaagccacatttcaagtatctgaaaacaactggcaggcctttattcaaatactttaaatagatcaaagctgtttattctctaaactcctctccccttcttacacattttaaccaagtcaatgttttccttctatttctctcagaggtctaaacatctctaaactatatttggcctaaagttttgcttgaccacatgattttaagaactgttgaatttgagtgccattgccagggaagctgggaagatggctggataccagcatttacaaaggtctcatcactccatgagtgataaattcccatttctcacatggttcctatgggctgggagtaggagtcctcaattcattgtccttctgaaaggcccagatctatgaattgggagattacttgtattcagcagttacattttctactttttgtgggctttgaggagattagaaggggtaagagaaagatatttgacatacttctttctctacccctcaagactaaataaatactaactcaactatcttactacttcaagtttctaaataaatctcccattcagggtcaggctaatccccttaactctcctctccagtatcattctgatcccatccgacacctcccaaactgagcctcaatgcctttcccgcatggacccgcctctggctggtgaagccaaaggtcctgagagcatgcatgtggacagagctaggcaggtttccttggcgtctcctggggacgtcacatattatcctccattatgattgtcacagtacatggtatgagcagacaatagattttaaggcactttaaaaaaatgcttgtgtaaatgaaatggagcatttggattcaatttagtagccttatacaatatctgctttttatttcagagaagacttctgaggtagctgatgaacatgccggcagagaggttgaattccgaggtgaaccagtcattccaatccaagggagacagcgtttggaagctttaatgtaaacagaaaccctgcgggactcacttgtgcatacagctgtcaaaacaattcaatatccagagataaacagggtataagacacccactagtatattatactggaatgcaacatctttttaaaattatgttgccatattctgtactttatcgagtaccttccattttaatatttcatctaatagactgtaatttggcactttgggtagtaaatagtgaattaaatgctgatgtggcttattagggcaagtaaatttgaaatcaagtatagtgatagcattataatgtgacatgtcatcagtttacagaagagatttctcaaaggaacacagagttctgaatacatgggtgttggtatcatcatagagaacagcaagtattcattattcatttaggaaaggaaatgtgtacctggataatagtttaaagctatatatatatatatacacacatatatatatgtgtgtatatatatatatgtatatatacacacatatatatgtgtgtatatatatgtatatatacacacatatatatgtgtgtatatatatatatatgtatatatacatatatatatgtatcattaacatcaaggctgcatgaaccaatttgctttgcacaaagacacaggagaggtggtatcaagtagtggaaggagttgtggctttggagttaaagatactcattcagattctatcatttgctagatataagccttgagaaatatacttctgtgggcttcaatgctctctactgtttaaaaaaaaaccttgaaaaattccaccttgcagcattgttttcaaattgtcaatttcaactggcgctcagtgaatgggaggtgttggaaatgaagacattcagcacataaataaggaagtaaggtgtttaagagtctgtatcactggacctatgggcagtctttctgggccactgtcaagcctccctttttgagaagctacaacagccacatgggagagtccagcgaccagagtggccgccgtggtccagataaggaaaaccgccatggattcagccagacttagagcaggatccgcaggcgaaccgttcttcctcttccagctatttctggataagcccactgtgtcccttcctctgcagagcacacctgcatctttgattccccaccttgaagtccttgtcctttcctagcctgagtcattccactcagctcaaaagacagtgtctgggcatcgtctccattggaagacagttcctgatgtttcctaaagttctctttactcccccgtcacatcctcatagcatgcagcaataaatagaaattaccctgtttttcaattatatttctataactattgttgccctcctccctttcagtaatgtaaaaaattttcacagtatcttctgtatcctaattttccccactcaattcgatttttgagatgaactggcagctgcctattaccttttactttttcctctctaagtgatacttttagtaagcaatttacagctacctccaaggtgaatttgtgtgtaacttaattacattcacttataccctcattataattacagtagcttaaaatccccatctgtggaacaaaagatgtttccatttatcatgtttctattgtgtataagctgtccttaatattaaacaccacaatactctcaaaagatgagactatctctggtaaatgctatacctgtcccccccactatctctttataaatgcctcagttaaaaatgatatgtttttaccattacgcacttttttctgatttttttttattagtccaaagaaataaagtgctaacaaatagctgggtggatgaagtgagtgaggccattaatattctatactgatagttaatatacattctcttttccacattacgtccttagacttcaggcataactccaagtaaaaattcaacagaataaggaaaactgcattcattagtagaattgtttttctttttcccttataacacagcacaattgcagatcaggagacacacaagcagacctcccagactcgtgggtcacacttagggggttattggtcaaaaatttctggatatctgctttctgagaaagtagcaagattttgctggcatttactttttgataattaaaactagatttttattttatcctataatcggtagtattctcccccactcagagtcataaataaggttaaatagtacaagacgtatttagtcacctaatgatgctgatgatccatctcagccaaaacaaatccttaaaaccaggcaaataatattaatctcacaaaagaagcaactgttaactagaaatggaaatccaattaaatacatttcctgaataattaaataataatgaaaacttgaggaacatgtacaggcatacctcagagatactaagggttcagtttctgaccactgtgtaaagtgaatatagcaatacagggaggcatacaagttttgtggtttcctagtgaatagaaatgttacatttatacaatgctgtagtctattaagcgtataatagcattatgtatataaaaacagcatacaaactttaatttaaaaatacgttattgctaaaaaatgctaacaattacccgagccttcaacaactgtaatctttttgctcatggaaggtcttgctttgatattgatgactgctgactgactaggatggtggttgctagaagttgggatgactgtggcaatttcttataaaaagacaacagtgaagtttgctgcactgattggctctttctttcatgaaagatttctccatagcatatgatgctgatagcattttacccagagtagaatgtattttcaaatttggagttaatcctctcaaaccctctcaaagccactgctttatcagctaagttatgcagtatctaaatccttggatgtcatttcaacaacgttcacagcatcttcaccaggagcacattccatctcaataaactgctttctttgttcatccgtaagaagcaactcctcacctgttcatgttttattatgagattgcagcaatttggtcacatcttcaggctccaatttaattctagatctcttgctattttcaccacatctgcgatgacttcctgtgctgaagtcttgaagacctcaaagtcatccatgaggactggaatccacttcttccaaactcatgttaatgttaatattttgacctcttcccatgaatcacaaattttcttaatgacatctagaatggtgaattatttccaattaacttttcccagttccattagaggcatccctacctatggcagttatagcctaatgaaatgtatttcttgaataataagacttgaaaattagaattactccttgattcatgggctacagaatgaccgttatgttagcaagcatgaaaacaacattcacctccttgaacatctccatcagagctcttgggtaaccagctgcatcatgaatgagtggtaatgttctgaagagtcatttttttctgagcattagggcacagtaaggctcaacagtggacttaaaatattcactcgagtatgccctaaacacaggtaccatcatccaggctgtgttgttgcatttacaaagcaaggtcagagtagattcagcataatccttaagggccctaggactatcagaatggtaaatgagcattagcttcaacttaaagtcaccaggtacatttgcccttcacaaaagggcaggctgttcttggaagctttgaagccatgcattgattttttctctttagctatgaaagtcctggatagcatcttccaatagaaggctgtttcatctacactgaagatctgttgtttactgttgtcaccttcatcgatgatcataaccagaacttctgggtgacttgctgcagcttctacatcagcacttgctgcttcaccttacatgtctatgcagtggagatggcttctctccttcaacttcatcaaccaacctctactaccttcaaatgtttcttgtgcatcttcctcacctctctcagccttcatgatattaaaaagagttagacccttgtctgaatcaggtcttggctcaatggaatgttgtaactggcttgaacttctattcagaccactaaaatgttctccacatcagcaatgagactgtctcacattcatattatttatgtgttcactggagtagcacttccctcaagaatttttcctttgcattcacaaattggctatttggcacaagaggcctagttttcaacctgtctcagttttggacatggcttcctcattgagctaaattattcctagcttttgatttaaagtgagagatttgcaactcctcctttcacttgaatgctcagaggccactgtaggattattagctggcctgatttcaatattattttgtctccgagaatagggaagcccaaggagaggaagagaggtgggggaactgctggtcagtggagcagtcagaagacacacattaagtttgccaccttgtaagggagcagttcatcgcactccaaaacaataagatcaaagatcaccgctcacagatcaccaaagcagataaagtgataaactttaaaatattgcaagaattaccaaatgatagagatagagtgagcacatgttgttggaaagatggtgctgctaatagacttgcttgatacagggttgccacaaagcttcaatttgtaaaaaaaaaaaaaaacaaaaaaaaaaaacactcattatctgcaaagcatgctaaagggaagcatggtaaaatgagctgtgcctgtgataccagcaaatatttattacacgctgcatttctttaaattgtcttatatggcgggtattactttttcctatttcacaggtcagaaagctgcaatgcagagaggagaaatgatttgtttaaggaagtagagtaagtaggcatcagaggcagcattacattagcttcgaagtctttattttcactaaaataccctgccttcccctcccttttgttgctctgtgtcccactttagtatgaaggggcctatgtttatatcacagtaaagtcatgacttaagtagttttagacatagtatttcccccctcatgaaatttaactcctgcagcctattctatttctttaacaaagacatacagaatcatattaattatctttttaaaaaacctgaaaataccatcaagatacttatggaactcacatgaaagtgaaatagggagtatgtccccattccctcaaggaattgagtaataaactaagttttaaccaccaatggtagcaggtttgcatgccacttcacccagataacataaacacaccagttatctgcaacccctgtacgcccaacatggtataaagcaaaaagagaaccatttaacagcttttatattagctagtcattccagtaataaaacaggaagacaatcatacataaatgtcaccacacaaaaactttctctattacttattaataaccaacctgataatatcattaacggcttgtagagctaattgcggtggctttttactgctccctttgatatgtgcactatcctgaggaggataacatctgttagatctaactcatcccaaacatcaaatgtgacaccgtggtgtttaaataacttgactgcgcgctatttcagcaggtcctttcccgctctcctttctcatcttcacaaggctgaccacaggcagaggccttcctgtgctcattactgagtttcatgcagacacgatggagtgggagggaaagtttattaccttcattctgcttgaatccatccctgactttttggtccttcacagatttctttgggaaaataaaaatgatatattgttttctgaacaaaaggaaattaatttcaatcttttaaaaaccaacttgaatgttattcagttcggttttttccctaaaaaaaaaagtttcagattccaaagtttttcaaaaagtaacttcaaatttcatctatgtcaaaataagtaaaataggtcctcttgtcctattgagaatgacaagctcagtataatcttggaaaaatcaatttctataaatgactaacccgccaattgtattttgattttttttaaaaaaagaggtgcctatgcagatgcaggatacatataaatatagagtcaaccatctcctagtgactcaatcattaaatatttagctgacttaaattacactgcatgcatggggactacagttaatgacgatgtattgtggaaaatgctgagagactggatggtgtgttctcccagcaaaatgctaactaagtgaggtaatacatttgataatttgctaaatttaaccgtgccacagtgtctgtctacttcaaaacagcacgtggtatataataaaaacatataattttatgtcaagtttaaaagtatatttatactaaaaattaaactcatttttaaccctatagtttatgtgaaactatatgttatgtaactgaaatattttcacctaatgtgaaatcttgtctctgctcctgccacaaaacagaaacatgagaaagtccactcgtacttgtcagaggtgggttctcttcatcttgctgattcctctggtgggtctggtaaggctgagcttggtgttccctggactcccagaatggtttgggtccagcactgggctggccctcaggaggctgccctgcacatccccgtgcctgtgctgggttccgccccagcctgtctgtgaaatatgcgtgtacgtacgtgtgcacatatgtgcgtgtatgcatgtgtgtgcgcaggtataagggacagagacagacagatgaacacagatggagaaagaaaaattggtaggttgtattgagattccaatcaaaatctaaaatatgattttatagtttcaaactcaatctaaaccttttttgcagggtaatgttttatgactaagcagacgcagaagtcactctcaaataaatatagactacgtcaataaggtaacattgcattcaattatctccccaaggcagaatccctgtcttttctaaatgatgtaaataccttgttctctgtgtccacaatttaaaatggaagttaattaaaaagtcgacttgagcagggaccccaaatatagattcatttatttatttatttttaagttacacaaaagtattactatactagggtgcacactacaaaatatgctaatagaatttttgaagcaatgatgtgaataaaatgaatgaaacattttagaaggttcataaaggcaacaagaattgaaaatccagtaattacacactaagaaaaaataagcaaaaaaaaaaaaaaaaaaaaatttctccaaccaaatgtttactggaaggctgtgataatttttatactaaaggttattattctcaacaaaagcttatttttttccttagtaatagttcttaagctcaatttacaagcacaaattctctaatcttattgtgagaaggctgttacgaataatttttgttgttcatacagagaaattgagaaacaacgataataattgctcaaattattgaagttaagaagaaaataaaaattaatggtctagtgtttattcttataaaccctcctcacaacacacacacacacacacacacacagagagagagagagagagagagagagagagagagagagagagagagagagagaaattttccacttgtctgcaaatagtccctaaggttcttagccaaggtgtgtacctcaaagtctaaagtatgaagacttaaaagtggaatcaacagagcattttatcatgaaagccacacaagtgtggtatctgaaatggtgttctaaacatccttcgaatgctgccttttcttcaccttattgccaggaaaagcacagaagaatgcgtcaggtggaaatctgcatgggaggacaagcaatgaaacaaggtggcctctggctgagtagatgcactcactcattcctccaaccagcgctgtctgtgctaactccatggcggaattcctctgagtgctggggaacacaacagtgaacgtgacagacaaggtccttgtaaaacacacggtctcgtggggaaggcagagccaacaacacaaaaatattctctgcaaagcagagaactgaggtaaactcgtgtggttgtcagtgactggggtgttattttaggagaaggctgaattcatgcaattcttgagttaattatgttcttcgggctggccctggggactgcagtggcaatggaccaggtttcattgcaggaggagggtgttggcagcgactctgggcagtgtggggctaggccgaggaaggcgcctgaggagacagacacccttcctctctgacctctagggcccaggtccagcttcccaagacacccagcacaaggaaagctccaatcgtcatctttcatttctatcaagagtgacacttacggatctctaacaacgtttctatccaattttgggtctctaactatgtttctatcctgatgaaaaaagccagagggtttaataagaaaatgaaaattaaatgcactacttcctcacttagcacacagcaaggttgaggggcagcttttctgagcctgaccctaggaatttcctaactcaggtcaaaaggtgactgactcccaagccaaaggtctctaaggacaggtgtgttaataacaccactgccatgggtggagctttcagaggtctccaaggacagatgtcttaacaacactgctgccatgggtggagcctctctgtgccacgtactgtgctcggggagggacatgaaccacctcaccctggacccctctctcttctccagtatctgcattacatgtgcccagggggcccttctctactctgctgggatgccagcatctggcccagcatctggcacagaacagactcagcccaaatgtagaatataaagtcgggtatgggggtctgatgccctggcaaaggaactgaaagacttacccactgtccagtccaaagtccctaaaagaaagtcacagaggccaagaccccagacactttttgtccccaacacccaaagcttcattttaaaatcctttcagttcctccagaaaaaaaaaaaaaaaaacaaaaaaacctgaccctcaattcttagacattttatgtaaatgaggagaaagtaaggtgctagcccttcccgatcacttcttgttttgaatggatgtgtgagtcctgccaaagtgcaggctagtttgtgttctccaaatgcctcctagctcagtgagggtggtgtgcgcagggctgggatgggccacacaacatataggagcccaaatagcaagaaggcagttggagcacagcttaatcctgttgaaagaagccaccaagaagagctggggcaccggtgggtgcaggtgatgagcaaagctaccttcttccctaggtaatgattgcccatggggaaataatcagtaattcttcatctaggaaaatactagttgctgttcagagcctctgactggaagtgaggcatttccaagtatcaaacaatgattaaaagaaataaaaaacctttgcatcttggcatgctcatttaagaaagaaaacaaaatagacgtacacacagcccatttgcattccctctacccagtctaaaaggtgtccgatgattcattttaatcatttaccaatttcttggtaaccagtgtgtattgcagcagatacttggcaaaagcatgttaatttgctactaatatctgtataaaccagacattaatattctcaatttacaaataagcaaccagaacttcagcgaagataagtaacttagccaagattatccttctaataagtggtaaagctggaattcaaacacaggcctagtggagtccaaagctttccccactcctcagtaaaaagctaaacaaacttcctaattttctgagcttcctacatactctttgcactagggtaacaaccccatggctggctttattgcagagtttctctgcactggcatttggcctttgcctgtctaattttggctagttgcataagattctcacttagtgcaggctcaaggtgagacagtatttttgttttttcttaggtttatctctggagattgccaatgcttgcaagaatagcaatgctatcattaacctaataatgttggattaacttcaagagctgggtaatagcgccaatgttcatttcccgtaaatgttggaaactcctttaacctcatgagatcctacataacgtgggaaagagtccagttctgactccaaaatcttaataattcactctttcgttaactgctttttaaaaattaaatgtataacaccaaatagtgaaaaataataataatcagtttgtacctaaatttctttaaagaaatttttagttttttaaagaaatctttccaatgattctgactttttggaggggaatgccacatggtgattatactgctaaggtatatatatatatatatatatacacacacacacacacacacacacacacacaccttatatatatatatatatttggatttttttgagacagagtctcgttctgtcacccagtctggagtgcactggcacaatctcagctcactgcaaccttcgcctcccgggttcaagtgattctcctgcctcagcctcctgagtagctaggactatagatgcccccaccacgcctggctaatatttgtatttttttagtacagtcggggttttgccatgttggccaggctgatctcgaactcctgacctcaactgatccacccacctcggccttccaaagtgctgggattacaggcatgaaccacaatgcccagccctgctaaggtatattaacggtcagtttagtattatttgactatttgttaacataataggagtaaaacttaacactttttagggtagagatggtacaaaaaattaaagtgtaataaatataaatctataaaaacagaagttaaataagaagaaatcttctggggaagaagaaataatagagtatagattattcttaacgtaagtcaaatatttgataaggaccacaggcaccttcttttaattcagatgctgaattttctttagtcctagaaagaagtgttgttagaattccaaggatatttggatgaaacttcgctgtaaactcacgtggaaactattttagctggccacagatgtgaaactaaaaatgttgaaatacttatttcaagtgcatctcgaaaatctgcaatgacttcctcctggaagataattttcttactacgcatgcttgacatggatttcgaacatctgcaatgacttcatccaggaagataattttcttactgcgcatgcttgacgtggatttcgaaaatctgcaatgacttcctcctggaagataatcttcttactgcgcatgcttgacgtggatttcgaaaatctgcaatgacttcctcctggaagataattttcttactgcgcatgcttgacgtggatttcgaacatctgcaatgacttcctcctggaagataattttcttactgcgcatgcttgacgtggatttcgaaaatctgcaatgacttcctcctggaagataattttcttactgcgcatgcttgacgtggatttcgaaaatctgcaatgacttccttctggaagataattttcttactgcgcatgcttgacgtggatttcgaacatctgcaatgacttcatcctggaagataattttcttactgcacatgcttgacgtggatttcgaacatctgcaatgacttcatcttggaagataattttcttactgctcatgcttgacagctgggtctccacactgcatcacttccaggctcctttcacacagccctcctggcattctgcctggaaatatgtcatatagcaagtttcacacttttttaacatacttgcaaaaaatcttaggttagtgctaacctaagattagtgcattgtttctaaaaggccaacgcattacatttttcctgagaataaatattgacaactccaggatttaaatagtgcacttggctaagattatggattttaggtagtctgtatatctttatgatattgtcctatgtattttaacattcttcacttttcttagtactgccatttcatgatttttttttccttttggatgctattgattagtacataaattccttggttgtacaccctgttttcattgctaatccagtagaagaaaagcaatatgcccaaaatcttttacaaaaaaaaaagctttcttgcatctgctgcttgcattctttgtgtgatacagtattttctctcattattgttggtcttcaaaggcaacaacagcataaggtctgctcaggccagagggcctcctgatatagtcctcatggagaccacacagagcctttccaagaggtcaaaggaggccagaagtttttggttctttttctcctaacttttatgttcatcccaggtaagcctccatctccaatctctgtctactagaatctatacacaagctggtgcaccagcttgcctgctctcacttgccttcctttgatgataccataatgtctctgattctacaacttaatttttctttcactcaagtctagtccagtagatacacattcctgttatggcaaaagatcatgtactgctatttatggaactgtaatttattctgtacttataggtgaattaggcaaaccaataatgccagcaaagcatatagattgaggccaacatttgcagtcattagacaaagtggactcagccactatttctaagtctttagtttggcctaatacctaatgttacattgatgccatactgtaagctccttgaagtaattttctacatttttaaaactcagcctatcattgctaaaataataaaaattctaatgcaagttgctctttatttctattacctgtaaggacacttgtatttgagaatacacacttgaaatgagttaaatataccaacatggatgtttggcttcaaagaccaggagcatgtcggatccgggctcactgctaagctttctctgactaggcatataaatcaacatcttcagtgcttttagggccaccatgcagcaattccatgatgcttggctcaagctctgcgcatctcacattagtcctcctttcacccaagctggctccagtaattgggtgactgttctggcagaatcatgtgctaccatttaaagtgaactagacaaccagttgatactgggtgaggataggagattcttttttttttttttttttttttgagacagagtctcgctctgttgcccaggctggagtgcaatggtgcactctcagctcactgcaacctccacctccagggttcaaacgattctcctttctcagtcccctgagtggctgggattacaagtgcctgccaccacgcccagctaatttttgtatttttagtagagacggggtttcaccatgctggctaggagttggtctcaaactcctgacctcgtgatccacctgtcttggcctcccaaagtgctgggattacaggcctgagccaccatacccggccgaggctaggagattcatagaggacagagaagacattctaggcttcatattgaaattgtaaatgtgaacccataaacaagtcaatagagatcaacttttgcatgcacgatcttatttactcttacataataccaccaactaccacttaactggaatgtcataatgtagaatctagacaatctttattaaattattaaattagctagaatcactcaacatggtattgtggtaagagtaaataataaattttatctagcaaatttatttttggatatacattacttcaaatagttgtgtgaccacaggagcatcataactctcaccggttttttcttctgggagacagctaataaacaactttactacaatttagaaaataatcctttagatttagttaaaattaaaaacatttcatatactggtagctcaaataaaattttggttgctcactaaaccatattatttctcagacatgattatatggtcattttgattacaaaagaaatacaaagcaaagtttatttggaaaccttttcaaatgtttctacattgttagcaaagcattatatattttcaaaagtatccaaaattttttttgttacactgtagtaacttataatctagcttgtatttcctattttcccataatattaacaaacatttacgtatttgagaaagaattccttgaagcataatgagaatatacttgttcaaaaatctcgctttcatgttttcattttaggactataaacattaggtagttcagaagaggaggtgcaatgcaaaaggtcctctgcaatgctagggagctctgggcaaagtgagagcgttctgctttcccttagagaggtcctggcctaaaatgaacacgtacttccacgagcttcgggtgtgatacagaaatatgtatgactctatgtaatccttatcatggcgttcctaccaactcaaacatttttaaggttaactgagtactcgatgtaattgtaatacatccacctagtcactactacaagatagtctgtgtggctgcaggctatgaaggatagctttttattttttccttatcaaggtaatatttggaacacttcaaaaaagccatcacagtgccattatagatgaaaggcttcccggtagaaatttcatttcctatacctgtaacaggctttcctgcagaaatgatagcatatgtgatacatccaaaaggcttatctcatgaagtcccagtgaaatgtattaattttgcttttggaaaataaaaacatcactaatttactgagaactctgcaatgcagtgtaaattctgtacccaagaagtagagctcatcacttaagtgaatagaaaagtagcctatagatgttactgtggttatgataaaacacttttaaatcctgtatatgtttaaagtttaaagaaaagcatttgcatctcgttttcctagtgtaattaattggaccttgaatgttgtatgtttccctgtgatatttgaatgaaagccaggggttgtcttattatttgccttaatatctatttgcagtaaaaagctaacaaagaagtgtccaaatttgcaggtagtgaacccccatttaaaagatatactatctcaatcaactcacctatgtaactttattaatataaaaagagatatcctggctgagggcagccagaagttactctgggataactagccttcaagacgtacctcttggtagtcatactctagcataataccttcccacaatgaattatggctgccctgtgtgatcaatacaatataacagcagtaacaatatgtgctagattatataaaggaatgcagctgccacttgaacatttggattgctcatccaggggaagccagctgtcctgccatgggaacacagacactgtcctgcagaaaggtccaaacagagaagaactgaaggcccttggccaacagccagcatcaatttgccacatgcacttcagtttgccacagtgccaaccacattggaagtgaatcttctatcatcagttaagtcttcagatgaatgtagctcactgacatctaactgccattgcatgagatacccaaatcaagaatcgcccagcagtctctccacaattccagacctacgcaaaccatgaaagataatgcatgactattgtcctaggccatacgttttgaagtaactcattatgcagccatagacactgatacaaacgccaaagttacaagaaattctcctttgtttgcaaaaaaaaaaagaaagttcttactccagatgcccactgtcacctggggttgttgtgtggtttagcagtttgaatttcaaggtgcatatgctttaaaataaagggctggctctcaggcctagtctgtctagctgagcatacatataggactattattatctgagttattaacatttcttcaaacacagcattatccagtttaaattctgtcttcctcagtagacactaagttgtagaactcaggcactgtgctgtacccaatgcaccaggcaccttttctggtatacagtaaaagctcagtaaatgttggagacaggaatatgtcattcatatgtgaataattaaatgtagacaaagcgaatcgaatcatttcttgaagcctaatgagttctgggcaaggccttaagctgagttaagagttactattgcagagcttttgttttcacttccaggcagtccttggaatgctgctgggccattttgtttgtatatgtactaaaccagctgggattgtaggagttttagaatgttttgaaagaataaatttctctgaaatgagaagtggattgtcattttaggattcggagtagttgaggatgtgttcctcgtgtttgaacaggagtgcagtcagcattagtgttgtccagccctccttgctgccccaccacatagaatatcgagccagctagtccctttgtttttaggtgggacgtgtcactagttctggctaacaaggtggaacgatgggtatcacttcccagccagagcataagacgccaactcttccctgcctttgtgactgtggcaacttgtcatggtggagcctcgtgacaaggaccttgtctgtcgcgttcactgttgtcactcagtcagcctggagcccgaggtcccacatcgagcagacccactctggacccgtcgcttgtgttagaaaacattttttgttgttgtgtaaagccactggaactattggcacatttgttacagaaacataattttctgtgctgataaaggccagtgtaagatcgatataaattaatcaccctcccatatgcacatgcacacacacacacatttatacaaaagaagcaatcatatttactgtgtttttacctgcccagaattcttctccttttttggtaagaacaacttcactgacttctgagaaaccacaagtctgatgcatttaggttcaaggtgggctaacttatcccctaaacacacaggcatgaacacacacacacaatatacacacaggcatagggtttgactagggtgggcctatccacctgtttagttcccatggccatagtggtgttggagatagtatgcaaccgaggacagcgcaataagggtcactcctatgacttttgctggaactattaagaaagaggccttctcttcccactaggcttgctaactgatagaatgtaagcctgaagcttatggtgcctttctgtcaccaagaggacacagctgacttaatgaagtaaattccagaaaatttgcttaattattgttaaatgattctgtgaactctcttcatttagcaactgttcaggaaggtaagaaaaagaagcaaactcgggaatatcaacagatttgagatgtctgaattaacttcgagcacctggattaagtcatgtctaggccaacattaatgccaggaactcaaatatttaatccaacaatctctctttttttcttacgccagtctggctggatttctgcttcttgtaattgaaagagtcctagctaatacatcttctatatgcacacggctgtactagatatttggaggtagatggaaatgcagaagccgaagacaagcaaatataacatggtccttgcttcagaaatttaaaatttgtttacagggacaactataataaatgaaaagctaaacgctccaatccatgagctcttccagcagcgttaaggaggtctagaaaagctacttatttcctgcactgtcaccgctgacattgagtgttagggaactccttacccatttttattgaggcagaagagcacactcggcagtagaaatgtaagattttggccggtcacagtggctcatgcctgtaatcctagcactttgggaggccaaggtgggtggatcacttgaggtcaggagttcaagaacagcctggccaatgtagtgaaaccccatctctagtaaaaatacaaaaattatctgggcatggtgactcccacctgtaagccaagctacttgggaggctgaggcctgagaaccacttgagcctagtacctggacgttgcagtgagctgggatctcaccactgcactccaccctgggtgacagagcaggattctgactcaaaaaaaaaaaaaaaaaagaaagattttctcaaatttgtggaaaagaaactaaacaaaaattcactatgaatcaatttactataaaagttctatttaacacttgcaacataaagcaaatactttaaaattaaaaatcccagagtgctatgtaatacaaacatgaaaaacatataaaaggcttctagtatcatttcctaactaacatctggcttactgaataaagctttataacatcaacttcatttttccacagttattatcataggtagttataatgtttttcttaaaaaaatgaatatcaacacaaatttgctgttataaagagtaagacaacttcagccagatctttctctttttgttttttttttttgagacagagttttgctcttatcacccaggctggagtgcaatggcacaatctcggctcactgaaacctctgcctcctgggtgcaagcgattctcctgcctcagcctcccaagtagctgggattacaggcacccagcaccacacccagctaatttttgtatttttagtaaagactgggtttcaccagttggccaggctggttttgaattcctgacctcaggtgatccacccgcctcagcctcccaaagtgctgggattacaggcgtgaggcactccacctgggccagccagatcttttaacttcatcaggatcttcactttattttcagggaaacaaatatgcaaatctccttttctctacagtaatctgtgtgtatattacatgatgtggcaaatgatacattcctgcttgccacaactaattttcactaatttctccagatattctatttaagagggctattttctaatgggcaatctttaatattgatccagtaatttaccatacagactcaagaaaaagaaactgaagatgtaaatttttacttcagcaaaataccttcttcacatgacttaaaacataaacatgattatcaggaagtattatgaaaaatgggactatgaaaaatgggacaataaaaattctcctagggaaacttccatcaacaagaggggacggaaaaacagcattttctctcaccaaggaacaatcccctccccattttttttcatcttgttggtgaaactctaaaatgaatgtgaaagccacataagcaacagcaattgggtaggaactgtggaaggaagccagagatattgtcatggagagacatcttcctgaaagtgaggggaacactgaggggtcaaaatcagaatggggtaaaccaatgggtggatagctccactagaccaaatttggtttagagtaacagaggaggcaggtgaaaattaataatcacacagcaaggccacggttggaagaagcagtctgtatccatgaggcagagagtaagaaagtgagcaatactagaatagcaggtggactactgctctacgccccaccacatacaggacacccctccacaatacatgtccatgaaacccaagtattcaatgttgaataacacatacacacacacacatgcatgtatgcatgcatgcacacaatctatacaaacatactacaagaaaaagtctatttatagactaagaaatctcatcagaaaaatgttgttactcaacagaactctctggcaacctattctagtaagaaatgaaaaccaaacaatgaatcaaccaagcagttgtgtccatgaaacaagacaacagagcagaaatacaagagctggagacataacagagaaacttaaggaacaactgaaaaaaaaataaaaataagatgtgaagtgacacaaaggtacaaactcactgcaaaaagcactacaaggaaaaagatagaaaaaagaacaatgagctaaacggcctgtatgatttggaaaaaaaagaaatcaaagaagaggctgggcacagtggctcacgcttgtaattgcggcactttgggaggccaaagtgggcggatcaccttaggtgaggagtttgagaccagcctggtccaccatggtgaaaccccatctgtactgaaaatacaaaaattagctgggcatggtggcaggtgcctgtaatcccagctacttgggaggctgaggcaggagaattgcttgaacctgggaggtggaagttgcagtgacctgagattgtgccactgcactccagcctgggtgacagagcaagactctgtctcaagaaaaaaacaaacaaacaacaacaaaaaaaaaaaacaaagaagatttgaatctacatatggaaataacactttgtaataaaaggaaaatgacctgtagacaacaccagattataacttattaaaatgatcagtttgtggtttgtggagcaaaagaatcttctggacagccaagcagaaagatcaattcacttatgtggagaaataaatcagacttgcctctgactttcccacagcaacatgtaaatatcaaaaaaaaaaaaaaaaaaaaaagctaaaatgacaccagtaaaaaacacaaggaaagagtgttccaagaaaagtaatacagcatgttgaatattgttctcaaaattttttggaaaaaaccgaactatcattagcttaataatagaactaagactgaaatcattgtggattttagggtaatggaaaacagtttagtgcactttgtcctgactgtaaaacaacagcatttctttaaaatgggaggtgaaccagaaaaggtagatgggtgggaagcagaggaagtacatttcttaaaacagaggatacatcttttctcaaatgcttatggaacagtcatttccttgaagagactgcatatcaggccccaataaaatatgaattaatttgaatgagggaactactatatacatcatactctgagtacaatgtaatatacacttagaaattaataaagcaaaaataacgtgttattaatttaaaataattattttaagcaattcttgaataaaataggaaatccaaatgagaatcacagaatatagtaaaaacattgatgataatggaaacgcaacacaaggcaacccacgctgtgcatctgaactgatgctcagagaaaaattcatagttgcaaaagcaagtgtttttaaaaacaaggaataaaaagtatgttttcatgccaaaatgtggcaaatggagacagaactacgattaaatatatataaacaacataaccataaaagtcagaaaaaaagaatattaagaaaaaaatagaaattgctgaatcagaaaatgggcaaaaagagcagaaacatcaaataaactaaaaagctagttcttcactgggaaaaaaaaaaacctatgcagatactccttgacttacaataggtttatatcaccataaattcattgtaagttgaaaataccataatctgaaaatgcatttaatacatttaactatggcatatcatagcttactgtagcctactttaaatgtgttcagaacacttacattagcctacagctgggcaaaatcatctaagaaaaagcctatttttataataaagtgttaaatatctcatgtaatttattgaatactgaaagtgaaaagcagaatggctgtgtgggtagttcaattacggttcctactgaatgcctatcacttttccactattgaaaactcaaaaaatcatgtcaaaccatcataagttgagcatcatctttaagcaataaacttcaaactaatataaggaaagagaaagaaaatatacaaaattaaaataaggagaatggtaaatatgagggaaagaactttgcacaattctttgtaaatttattaacttgaagtaaatgaacaactttataagaaaatagaatttatcaaaattgagtcaagacaggaaatctcatcagaccaatttccacagaagcaaacagttattttggactcgataactttttaaccagctttaagcaacttctagagattattctgagtatttcaaaccacagtgttgccgggtgaagtggctcatcccagtaatcccagcactttgagaggccaaggcaggaggatcacctaaggccaggaattcaagaccagcctggccgacatggcaaaacccagtctctaccaaaaaacaaaaattacccaggtgtggtggcacacacctgtaattccagctactcgagaggctaaggcactagaatcgcttgaacccagaaagcagaggttgcagtgagctgagattgcaccactgcactccagcctgggtgacagagtgagactctgtctcaaaaaaaaaaaaaaaaagtttcaaaccatagtgtcattccgataagcagtattattccagcgtttgccaaccatgctcaggcatggagagttaaggaaattaatagccatatgtacttttctccaaaaggaatctatcggaacacaaggccgttcccacactttccacttcccactcacagttgcccccctactccctcacggtaaaacaaatgcagaagtctcactcttgagggctcttagcttaattcattgtctcggggtataagactttaggctgacccccaaaaaaggaaaagttaaaatatgtgtgtccactcagcctcctttaactaaagcactatacaataaatcataaatagtaggggtttgtgtctttccttgtcatatatatatatatttcttttatttcctttttttttttttaagacaaggtctttctctgttgcacaagctggagtacagtggtgtgatcacagctcaccgaagcctgaagcctcaaactcttggcctcaagtgatcttcctgcctcagcctccttagtagctagaatgccatcatatctgagtgattgttttttagctttcttagagacaaggtcctgctgtattgcccgggctggtttcacactcctaggctcaagtctcgggctcccaaagtgctggggttacaggcatgagccactctgcctggccctgtcatgcatatatttctgttaagggtatagggatatctggccagtgttgggatggtctggactcagatacccatgaagatctcatctagtctcaaggctttaaacaccgtctggattctcactcccagatttatatcttttccgccttgctttgttctcaacataactggccaacttcttctcaacattggtttacagcatgtccatgaacgtgaaattctttcaactcacaaggcccaacaccatctggcgcctttcgtcacttgtagctcgcctccagctctcctcactcactctggcctccagcctctcctgccagcgaatgcttgcccccttggagctttgggcttgctgctcctttaatctcattcttccccatgcagccctgtgcctcactccctcacccgggctgcgtctttactcaaatgccttcttgtcaaagaggtcgaccactccgccttatttagaactgcactctctgcttcctatccccagcgagttttatttttatctacagcatatatcaccatctgaaataccactgtgcatatctgatggatttatcttgtctgtcgtcagccttttctctttaaaaggaggctccaagagggcaccggtgattcctttccattgtgtgaagctgtaacccccacacctaaaacacagcctgacacaggtgtcagaaatagttactgaatccctggaatcatcaccgtattcctggattcaggaatggggaaaaaagtgttccatctgaggacagaactggatcaagttccaaagcagcctcaaagtttggatgggattggagtggggagtgacacaagtcgttgtaattacatgggcggggaaatcatggagttttgtgggaggaaggccaatgtcagaagaacgtttcagggaaatgggtccaggtggctcacttatcatcattaaaaagctatgcaagtttttacttctctttctcctctatccataaagtcctggtggtgaaggcttacctgtttttttcatggcattaaaccgaaccattcacttcatgattttgcctggtatcccagtaggtcttccctatcctaatacataaaatagaggttggttggcaatttgctgcttcatctgtcagtttagaaataatcctttttggccgggtgcagtggctcatgcctgtaatcccagcactttgggaggctgaggcaggcggatcacgaggtcaggagttcgagaccagcctgaccaacctggtgaaacccccatctctactaaaaatacaaaaattagccgatgtggtggcatgtgcctgtaatcccagctactcaggaggctgaggcaggagaatcatttaaacacaggaggtggaggttgcagtgagccgagatcgcacgattgcactccagcctgggcgacagagtgagactctgtcagaaaaaaaaaaaaagaaagaaagaaagaaagaaaatccttttttcttttcctcattagcaaagagctcagtgcttcctccaaaaggatattgggtctagaaatttgccaaatacctgtgagcatgtcctttaggattccaaatagtacactcatattttgaaatttggcaaaggcttgaaaccaacacttatgggtttttggtttgtttgtttcactcttgttgcccaggctagagtgcagtggtacaatcttggctcactgcaacctccacctcccaggttcaagcgattctcctacctcagcctcccgagtagctcggactacaggcgtgcaccaccacacccagctaattttgtattttgagtagagacggggttttgccatgttgggcaggctggtctcgaactcctgacctcaggtgatctgcccgcctcggcctcccaaagtgctgggattacaggcgtgagctactgcgaccggccacttctgattttttaaaaagtgaacatagagccacacaccaagtaaggaaatacttttagcagcatagaatccaacgcttgccttccttcatagatctctatatacacaaaatagaaatgaaaccaagcactaggcctatattattaatgcaagaagtgtttgcttgggattggatgagcaaaaatgtcataaaaacaaaacaccatgaatgtttcacaatatgccccgctcagaggtcagcccctccatgtgtcctgcagagctcctgaagcctttaagagacaactcaaaaaaggagtgaggcagcctgttctgacacttggacgtcttccaacgcagactttcagtattatttttctaaacatcctaaatctctagtgagaacatggaatagactatttctgtaatggcagatcttacaaaagagaaacaacttcccgaaaacatgcctatgtccagtcacagagaccaagcatcaaaatcacctgcaggggtttctctaagtcgccctcacacatgcttggacatctgtatgaattcaatgcacagtaaatactcctttgagggtctcttatggacaagacttcgagagaagaataagatacattctgcctccaaggaactcatcatctagtccacggtgtgtggtgatgggaatgcagatgccaggtgctatgaagtgaaccgtgtcacccccaacatttacatgctaaagctctaaactcagatacctcagaatgttttgggggacacggcctttaaagaggtgatcaagttaaaatgaacccattagggtggacccgaatctaatctgaatggtgtccttataggaaggcaagattaggacaggagagatactggcgttgcaggagcccagaagaaacgctacgcgggggtgtagtgagaatgtgccatccgcaagccaaggagacaggcctcaggaaaaaccacctgctggcactgtgcactcagagtaaaccccgagtgatctcagagttctagactccagacctgggagaacatataaaccacgcagtctgtggtatggcggccctagcaaactaactcacctgaatgtaaatatacaactacaaagcaacaaataaaaagatggcaacaacaagcaagcaatggaatggaccctcctgctgggctgaacatcaagacagggatttagaaccagctttacacaaggagcatcatttttccctaggtatgatttttatccaattcactttgattaatgacagctaccatttagcaagggctttttatgtgccaggcaccaaactcaacacttttcatgcattcacttactcaaccttcactgcaaccatgtaagatcgttgccattgttattccaaatggacagatgtggacactaaaacagagaggtaaattttgacctttgctgaagtcagatggctgcaagagttggaactagagttcaagtccaaagagtccaactctagaatccttagaaccactgtgcatactgcatgaacagtactcttaccttctctagtcaagagttcaatgtgaactttattccagaaaaacacaccattcaacatcttcatcaaatattataaagaatgcagtacttagatatagactctctatgcagcatttcctagctacatttgacctctctgtttcaatgtatctgtgtagcaaatattctatgaaacacaatttcttaattattgacctcgttgtgtctttaccagcactgtgactataccatgtggtgtgagagtcactccagtgaataaacacagactgaggtcaagagtctaatcattaccaaggccctgggaaccctccttgaagagaagagataggagcgcactatccaccatgaaaagttgaggtaggtagcaaagtcagtgtctacaccacccgccagcttctcctcccctcttccacacgggtgcatggctgccaccacttcctgatgggaagcttttcagaatacagataacatcctcactctcctgcctccctccccaccccagtatttttatttagtagatctggtatggctctaggaagctattcttgaaagtttaataatgattccaactttctgccaggtttaagagccataataatgttgaccaaaattgtagattttccaggatactctaagctttgataattttgtgcggacagttactagatcatgtgatctaaacgagggttggaaatacccccatttatattcccaggcagactttcccttgcccacttccaaagcaacctagactttgggactactctattccctcactgctcttgccctcactcacttaaaatacttttatctaatacaaaggtgctagatgttgacctgattgaagtagagctgttaagaggtaactgaagcttcagctaaataatgccagggggtaacattgtccagggaaactgttcaccagcagacctctgttgctcctgatgtactccaagttattttcagtttagcctttcataacgttgtacaaagaggctttattcataaaacagtagctttggttggcctcccacatcgtgaaaacaaatgtaatatagtaattaagtgtgctgatatgttatcattgcaaatgtcaagttcattgtagcagatgtgtcaactgaagatcactacccattaaaatcaaacaaccagtaggccccaaactcaccatctgatttcatgcgtcaacttcaatgcttaagacagtcaatcacaactgtcttccatgtaattgtcttaaaattattacataacaaagaatcagatctcaattcttatcacctgctagtcataattaaaatgtgaatgaagggctaatgactgacacagttacagggtataaaatactttcacaattttacttccccaaatagatggcattattattaagaaaaattactcaaaatgtgaaataaggaaaaaaacgactgatgtgttaatgtcttgctagagcaaagctcactaaatctccttgaactctctagagaaatgtaacttggttaaacttactacattttctattcatttgggcccaggtattttacacattttaaagtttgggttcctaatttaaaaaaaaaaagtgataaaatcagatgactaatatttttatcaagttaaaaagttttattatccagtaggataataaattagccactatgatatctacatcttttcaattttatttcagcatttctttttcatctgactatataaaattcctactctcatatcttcttttgaaccagttttgtcatcctgctgattccctcattagtagtcacatggatcttatgaaaataaatataatatcccattagaaacatatctgctactagtcggggtacttacataaagttgcagcaattatcagaaaaaggtaatatgcaagtctcctctaaaatttcccaactatattcagaaaaaaaaaacaaaacaaaagcttaagtgactgcttaggtgaaaataagacttccagaagaatgtctgtcaaagttgtaccaagaacattttgaaaatacaggttaattcaaagaagcactcacaaaatgccctcaatatgattttgagaggaattattacaagtggtatgtattcttgaaagccaggtttagggtacatctctaaagcagaataggttgttttcaaattgctaggtcattcaaggcctttaaaccactatattctatccataatttgcaaacgtaccactaacttacactaaagagatagtgagaaataagttcttgtggaagcaatttacacatacagagttgactataaagtcctaggcactttggcaaacatgcttaggggtggaaagtttcttttttggtaaagatcccatagattactatttacattttagcatcatctaaacaatctggaagctcctgaagctcatgtctcatcttcaccatggacacaatcacatattcttactctaagcatctctcatttttattctagttgattctcattcttcattcttcgtaaatgattataatgaatcctctgcctcttccttcccctcttcttcacctcactttcccctcccctcccagctttccctctgccttctcctcccctccccgctccttgtcttccatccctgcctctcccactccccctgtctctctgacactgttgtctccaaccacacacaggctccctgggtttctttcacaaataaaggaacgatttgcatagatggggtaatgtgcatctgcttttgtggtgtaccttccattcttcctttcttctgggaatagtaactccctcccttttcttttcttttgtattttttttttatagacagtgtctcactctattgcccaggctggagtgcagtggcacaatcataactcatgacagcctcaaactcctgggcttctgcgatcctcctgcctcaacctcctgagtagttggaactacaggtgtgctctaccatgcctgccatatttttttttgagagggggtctcactatgttgcccaggctggtctcaagcttctggcttaaagtgatcatccagccttggcctccccaaatgctggcattacaggtgtgcaccaccacgcccagacccctctcccttttctgtagcacaccccaccctcaccccatgcacttttgcatgattatcaatatgggttgaaccacatgaaattgccaattttgtagatcaaacatgatagaatattagcaaatagaatcatgagattgaacatatccttttaataacactaacgtattcagtattttatcaagcatataatttaaagttgtattactagttataaatttaatatttacctctttcaagcccaagcacaaaatatttggtttgtttaaactacatcatgtaggatgaaattaatacctcaagtgggattctcaacacactaactagaaacagctctcagagaagataattcaaagacgaatttaaaatcaatcccacagcaagtaaaaccaacttttttaccaagtagttcagtcacatgggagcagcggaatcagtgtgacattttcttttcacgggatatgtgcaaccatgctgtttaaaagggaagaaataagataagctgattttatttccaccagtgaaaaaagttttcaatacagcagctttcatcgactcagcatggctaacaaaataacattatcaatgaaaataaaataatagatcagctgcacaatctaggcatttttgtttttagaggccttctctaacatttctctgtagagatctgtgaatgcctggttcctgtgaatgaaaaccaccctgctgttttttctgctcctgctgagagacttgcaaagaataaaatctttttttttttccagctggagatcaattggtttgaggactgctctggcccccaggaagtattctttgcccccatggggggaagagatcctcagttccccaccctgaccagagtttgcccccattggatagttttcaaagctgaatccagaaacagacctaaaagcatatccaaaaaatgtgccactgaaaaacagctaacgattcacatggaaagtccacaccctccatctagccgggtctcctcctgcctcccttggggaagaagggggagaatgccctttccaatttcgctcgactgaaagcaagggctgtgtctgtcccccttgctgaaaagcctccttttgtttttcttttctactgtcaggaagcctgcctcagaggagtggacaatgcataccaatgaggaaaggagagcagaggtgattgaaagtgaagataatttttccctgtcatttacaggctgcttctcaaaccatgccccttttgtgattccacttcaaaacacattcttgccaactctcatccaggaggcttttccttagtgatctgctccactatcttggagtttggcttctgttatcacctgaggagctgaaaagcgttcagattcaaggaagcctctcctctgcccaaatcagcagaatttaaggctcatgaggatgaggactgtgacagggaagaaggaggtgacagggaaaggaaatgatactttagcttatttcattgttgaatggagcaaagttgaaaatgattcttctggtgtctctccttaaatcttggggtattgatacagactcatacaaaaatgaaaaggagagaaatgaacatattcatatagtcctttggggtttcacagtgatctacctacagcgacatgttattttaaattacaataatctatttaaagagaaatatggtggaatttacttttaaaaaggttacgttgcagggatgttttaaaagataaaaattaaatggcaactcaaaaaatatctgtcaggcatttaaaaatggatttcaagacaagcatttgaatcctactttacaagaagtgactaggttaattaggaaaataaggtatcttctgataacagtaaaccttgagatacatgtgtagctcttataccggaatgaccatgaatcactaacaaatttactttctagacaaaagatggaccacttagacagcacagtataagaaacaaggaatgttaaatgaagcttaacatcatgtaacagatgttaggttttctcctctcccccaaggaggactgtaatactgttggagatgacacttgtcaactgtgcaatgtgtgtgataaattacagaagcaaaaacataatattattatttaataatccattttaaatatcactgtcatttaaataccacctgtaagaaaagttgtataaatttggcaatgaaaaatacacaatccagaaaaaattacaattaaggatcaggtttttctttgaatatagttataatttttaaaaatcccttatcacttttattaactataattattaggagactggagacaaatataaccattgaagcaaactgagtacctttcaagggccaccgtctttttcctctaacctcctcaggctcacatccccacctcaccccaccacatttaaattactttaaaaacactaaaaaatgtttcctatattagaaatttgaatctatcaaccctgatacttctttagatcctggaactccctttgctttaaacacaatgtccaactattgagaaagaaatttcccataaagaaaaccatagtatttctttggtcacagctgagaggcatttttttttttctgatctggaaaacaacaatcacagaaagcaggttgtttgcaaaatgagatcttaatttacttaaaaacagaatagtaagatgaacctactaaaagtaacaccatagcactgctacaaatgatttacagttgttcacattactgccataatattggaacgataaatgacatgccaaggggctcaaagtaaatttctggagttgaactgcacaaagcaaattgctgagtttgtgtcatatcctaccgtgaggatggcatatctagagcaaggctcaatctagaaggtgtctggactgaggattctagggtacgatgaataacaaatggaacaaagatgtcacccacaggaagtggggactacgggactcactgtggacacctaagccaccgcctccctatgcgatgaaaatctgttcttcatagcaatccagtatacattcaaacaagcagaagaacaacacggggtaagggctacttaactaacttatattatcctattttccatggaattccagcaatcataagaaaaagttccatcttcttggttttgaatgttttaaattaaaagaatttcccttcccaacactacaaatatgtacaatgacacattaaatacaactgtgctttctaaaacctgatacttgacagagagctcttcttcaaagctcaactgcaagttaaattttactgcttatcttttgtttatcaccaacaagaaaaaaattgagcttgagaactgtaagcttataactgggtaaattatgttttgtataagaaatacaagtatccatatttggattacttttgtatagatgggatatacaaaggtgccgacattacaggactgaaaaaaagagccaacttgttttgcattaaaacatttttttaaactttcaaaacaataagagactagtggtctcttaaacacagtttaatgaatttatctctggcaatgtattgtgatatgtttgtgtgataaacctgataccatgaaaacatgaaaataatttctggaatgtttcatttcttaagcaaaaatttcttaaatatgaaaattgggggcttcttctgtgcagtaataggtaagaccagtctggtctgaagcccatatcaaatatttcaacatttcatgcctatataattggctttaaaagactaaaaactctctgtacagtctgttttttttattgttgtttttctcagtccttaatatcctggagtcagaacaaatgaagaagccccatcagcttcagaccacgacacacagcttgcaagagtaaatgatttatggagctacaagcatgagttatgagggagcggtctacatatttgcgttgtgtagctatgcagggggaaagagacaaatgagattcttgaaacatttgtgaaatatagaaaggaagaaaatagaaaaaagttaataagctgcctcagatagtaactaattagatagcaaggtattactgacaaaatgaaacaagaacaaaaggcaacaaaagttggtttagggccaaacattatctgtattttcacttttggatctctactcatttcctttttttccatttcattcaaaaaactattgtgcaaatcaccattctattgtcttctaacattgccgctattttcactggattttattcaatttaggaattaaattaaaagtttcaacatttccagtcatgttattctttcatgttttttgccttaaggagtagaccatagacatcacctattttaatagtttcatctagtccagaatcggcacttggagcttcaagctgggggttagggagaaagcacagacacaggcaggctgctatgctgggccctaagggcaatgtcaaactcaagattgcagatacaggctgggcgcggtggctcacgcctgtagtcccagcactttgggaggctgaggcaggtggatcacttgaggtcaagaattcaagaccagcctggccaacatggggaaatcctgtctctactaaaaatacaaaaaatcagccaggtgtagtggcaggcacctataatgccagctactcgggaggctgaagcaggagaattgcccgaacctgggaggtggagactgcagtgagctgaaatcatgccactgcactccagcctgggccacagggtgagactctgtctcaacaataacaacaaaaaagatttcagatacagagctgttggctttaggaaatgcacagaacttactgctccataatacaaacaaaactttaaaagggtgatgactgattccagattactcttgcttttatcttaagctaatctctgtgttaggtaaggacaagcaggtttgaacggctgttaggacaaggcatcattgtctacaggtgttatgatgaccatgaagattagaaagtagtgaatctgccgggcgtggtggctcacacctgtaatcccagcactttgggaggccaaggcggctggatcacgaggtcaggagatcaagaccatcctggctaacatggtgaaacccctatctctactaaaatacaaaaaaaaaattagccgcgcatggttggtggtgcctgtagtcccagctactcgggaggctgaagcaggagaatggcataagcccaggaggcggaggttgcagtgaaccaagatcgcaccactgcactccagcctggtcaactgagcaagactccgtctcaaaaaaaaaaaaaaaaagtgaatctttgaagttttaaaataatgctatctatggatagaataaaataatcagaatggaaagtgtaaagatgacatatatatagtgagcattcttaaaactgattatcattgatgtccatctattaattaggctgccttacaaaggaacggattttctatcactggaggcactgtatatttttataacttgttcccaaacttatgattttacagaccagtaaaatttctgttcttttatttaagaaaattaagatatctgatgctaaggaacagttaaaattttcactgatttctgagagatggcaaaatgctagtaaacaacacctcttcaaaaacaataggattctacttccttcacttctgaatgtttctgaaatcgaagatgcggcagaaccatcaattccaggttcaccttgccggcaaccctgcgtaatagacttagcgtagctacaattggttgtgcctacgcaaaaatagccaactggggaaagttatttggactggtaacactagaaactatttaaattttaacacgagtgtcacaccactttgtttaaatgtgttcaaacagaagacacaatgtggcaccgaaatgcagcaattgtgtggaggcaatcaagtatcacagggcagataatgaattcaataaaggcagctgaaattgccaaatcttcaaaaggtagaaacagatcgtgtgaagagtatcactcatgtatctaaatatctttatggtgaaagcttcctactttaagagtagctgttcaacacttagtgatatgtgattaagaggtaattaagaagttaagaaggccaggctcatggctcacacctgtaatcccagcactttgggagggtgaagcgggtaggtcacaaggtcaacagatcatgaccatcctggccaacatgatgaaacccgtctgtactaaaaatacaaaaattagctggacctggtgacacccatctgtagtcccagctacttgggaggctgaggcaagggaatcgcttgaacccgggaggcagaggatgcagtgagcccaaattgcgccactgcactccagcctggtgacagagtgagactgtctcaaaaaaagttaagacaacctcaaatttaaataaagaaatgtatttttagaatatattattcagactattctgactaatgggagatcttcataggtaatactcagcaacactcgttaataggcatctctccatttgaaagactgcaaaacgctgaattctgttgtttagtgcactgaattttaatcatttaaaaattgtgatgtctttaaatcaggcatgccatctccagttctcagtggctccactactttccaatatttgacctccagtatcatgctttaaaataccggcctggcacttgtggacatttgtgctaatggcccttggtttccatttataccactgccataacaatgacaaaattgtcgagggtgagtatttgtttgcacattctgtcctattttcctaaataatatattttttaaatcctcatttaagtgctttccatattttcccaccatttgaatcccccagaccccacctctacctggtgacattcaagataatcgtagcagagcagctttagctgtcaagaagtctgtcctttgctaagaggtggtaaggatggttaattattctgatcaagtctattcggtctgtgccaagaagaaaactatgtttctggaggtaggatggaagcaaagtcactagatttccttccttctccttttcatattccttacaagttgctgagtaagtatattttatttggaagcattttgataaattcaattaaacctgctgccaggctgtaagaatttttctgtgtgtagtttgtgggcagaacatcatcaatcagttttctccaccatttttggtttctagactattcctgtagttaaataaaaagtatatttactatattctcaaattattttctttctgctctttttcttaataacttacctacttactgacacgtgattggggacagacaatattttacatttctacaaagcattttatctcatttttctatttctaaaatgaaaatttgagtaaagatgtacatccttaaattctgtacacagaaaatatactaaaatgaatcaacttaataatcaattaaagaaattttttatttaaaaatggataagaatgtgtttgaaatatatggttcagtcttaaactaaacacaaagcagttctcctaactaaacagctgttttaaatctatagctcttctgctccagcatcctaacagctggaggaaattagagtccagagagacatgtgcataatttgaattaaacagatgcgggctgtgaagacaatcaaacaacacagggtaagagatgcaaacaatattactgaaactccaaggagtttttattttttattttcataatgatggcaaatgtggccatagttgtgatacaaactacctacccatcctagtaaaaagtcgtgactttttttcaaaagtgcaaaaggaaacatgccaaattctaaatcaaagccaggacagggccatctctgtatttttccatttatagcactcttgatgccacgcgttgactgtgagctaggggtcgctgcctttcctgcccccggcagccgggcatcccctgaggggatctgcatcctgcaaaacatgccaggccactcacaccatcacatgctggcagctgtgggggcagaagactgaggaagagtgagagatgaccagaagctgaagggagacatatgtaaagtagaaaaggagtaacttaaatgtcattttctgattcaaaatatgagtgacctgctttaatgagcaaaaccctgcatttaaagccacaagtagttcaagcactgagggccagatggtaccctttgaaattaaagcgctctcaaatggaacatagcagggaacctccctgtgcccgactgtgtaacaacacttctcccagataatgtccgttaacgtttatggctttcggtttctagctcagttcatgaacgtgtttacgggtcttctgttgagaaatcaagagttagtgtccacgtggcaggttttccaagacctaagtgtgaacgtgatcatcacatttcttccacctcttcaccttcatagtagacttttcaatactccatgaactcttgattactgatatgaagcacaataaatatagacaagcatttggaaaacagcctgagggttctgtaaatagctaaacattttaccacatgacccggcaattctactctaggtatacgcccaagagcagtaaaaacataggcctatacaaaagcctgcacacaaatattcatggtagcatcattcacgatactcaacaagtagaaacaacccaaatgtccatcaactcattagtggataaataaaatatggtacatacatacaatggaatattatttggcaataaaaatgaagtgcagattcatgctatgacatagatgaaacttgaaaacattgtactaagtgaaagaaggcaatcacaaaaagatatatattgtgtaattccatttatatgaaatgtccacaatagacaaatccacagaaagtaaattaatggttgccaggaactgagaaaagggaatgactgctactgagtatgaggttttcttttggggttgatgaaagtgttctgaaattgattgtggtggtggagtgaaaacgctcccaagatactaaaaaccatagaatggtatgcttaaatgggtgaagtgcatagcatgtggactgcatatcaacaaagttgaggccagcactcaaagagattgcagaacaagaattggagtgttcctggagcttcagatgtaggctccacgaaaaagtgatgaagagagagggacagacagtgtgtgtgtgtgtgtgtgtgtgtgtgtgtgtgtgtatgcgtgtgtgttgaggggggggatggctggaacctgtggaaaacacccattaggagggcagatggacccagtggctgatggtgtgcacggttcctgcacactcatgaaggaatccaagcacacccagggcactcctgcctgcaccaggggagctgcagggagggctcctgtcagcagaccactgcagcccccaaaagccccttctcaggaggaggggagggagaagccagctagaatcatctgcgagggtgtggggcaccaggacaaggacccaccctgtacccagtcccaccccccaaccctggaggtgtcacaaactgggaagcaggcacaagggaacatacaggtaggcaaggcaaagaaccagagacaaagcccattccttccttaggctccaggaaaagcaggtgcaagcaggggcggcaggggtgggaggggtgttggtaagaagatccaacatcaaattaacttcgacgttcgtattattgtcttggcttggatgttctaattacatccttaagactatgtctgtgacttctagtacctgtaaggaagtttgttaaagagtgaataaaaatgtcaggggaccttctgatttcccatccagggacagggaaaaattgctcttcctcaacaaaaggctggtgagagatgaaaatagttttgttttgattatattgcaaagtgttcaactttattataagatgtgtgattaataataatagctaaaatcaactgagcttaagaagacgtttacatgcatgtggtcagtcctcacaaaaacactatgaggtgtataaataaataaatgtacaagaataagacatttactattctcattgctcagatgaagaaactgaggcacactaaggttgagccagcaggtgcagggtcaacaagctggaacccaggaagttggttctgcagcccagtcctagccctggaactccacagtgcccacaacgctcccaagtgaaatatatgatggagcatctatgggaggtgaggttagggggattttactttttgaaaaatgctttttggtatttgaaatattctcatataaacatccatgacctataatgacagagagagagagacagacacagagatagagacagagccagagacagggacagggacagggacagggacagagaaagagaaagagagagagagaaccattttagaaagttgctggaccagggaatattttgcacaacatgaaatgattacttactatcctccctcctgatttgggaaaattttagaaaattacagtggaaagcagcagcccccaacctttttggcatcagggactggtttcgtgggagacagtttctccacagactggagcagggagatggtttcaggatgattcaagcgcattacatttattgtgcaccttatttctattatttgtactttgtaatatataatggaataattatacagctcaccataatgtagagtcagtgggagctgtgagcttgttttcctgcaactagatggtctcattgggagtgatgggcaacagtgacagatcatcaggcattagattctcataaggagcgtgcaacctagattcttcacatgtacatttcacaatggcggggaggggggactcctggtgtaaagcattatgtttaaaataccatagcctgagatcaaaattttaggcacaaatttaatcacattgaatcctttgtcttctattagttaaaaggttgtcctgctgccatcttggaatgagtgcaagttggaaaatctagatccgagggtttcacatctgagcatgcataacagtgccctggagagctgctaacagtgcagattgcctgcatccagccagcagagtcagggagatttcaggggagcccctgcccagtggaactcttaaaactgcatttataacaaccttcccatctcctttctaggagattcggatacagacagcccatggcaaatgttctgaggagtaatatggtattatttttaaaagctaacacccataaatactacattaaattaaaattcagggatgaatgaaggacttgtagctatgactctgtagctcagagacataaaaagtgtaagaagcaaaattattactcactaagagataagcaggaaaaagatggggacacttacagttttaacggcttacctcttttgtagagccagaaaagtcagcagcggttggaactctggtaacaatacagttttggtcttctacttatgtactctcttctctattactaaattttaaaaaccagaacagcaaacctaaatcaagcgatacagtcgagctcaaagaaagactgagctcaaatgccttacgtctgccccaagagaagctagcattgaactcacacatcctccctgtgagcacaggcttgccagccacagctcaccaccgctttcttatgacccaaactcatgtccagagatctctgattctccttaacagaactccaggtaatcattaataattgagaggaaacaggcttacttggaaatcttattatgcacgatgtttatcaataaccctccatcaggaaggaagcaacaggcagcacctgcgtggctgttttgtgccaggcactctctggatacttgcctaacattattaccctcacagcgccctgaagatcagatgttatcctgatttttattatccctgtcttctcaagtaaagaatctaggctgttaagaacaataactaatttacctgccatcccatgagacacagttgatggagctaagacccagggtggttccttgtgactttcaactttccctttgatattttggcctctcttaatttagctacatgaaatgttaacctattatgtactcttagttcaattttttggtttatttgtaatcagaaatgatacaatatggcaccttctcaatgagtccatcaattcatatcattgtctattaactcaggatggctagctactcattaacaaatgtctaccaaattcctccatggccttgctagatagtataaataaacaggagaagaacaacgcattacaggaaaacagcaacagtctactgcaaacaaggagaatcaagtaagtaaggcaaagacactaaaggactcaggaacatcattacataatgttgaccagtaactattaatataatgcaatataaaataggaatgcaaaggtattgactgaaggagctacaaaattaagagatattctactaaactattaaagtatgtattctatttataaaataaaaataatttatctaaataagttaaataggaagtaatatctaatttcagcaaggaaagcttatcttcaagtttagatgaagtccttaattacaagtaactatcacatatggctgctctgggacccacaatttgagctgagcagcagatcatggtttgccactgggaattctttagtcttgtccaggaaagattcttagaatctgcataatggaaacagttactaagacaccatgtatgtatgctttacttgctaacttcaaagagttctagagttctgttttcatattttctgagttattttgttttagcatgaaagtatatttagaaagaagggctacttaataatatttctttaatcaaattcttcatataaaaacttctggtccaaataccatttctgctagaaaaatttacctgcccctagtatacaacagtaacattgctgtcaagccagtgatgcatcattgatagaaatgcattggccacagcatgaaacagtatcacatggtagtttttatgccactgcacatgagctgacagccttacttgggtcttgcatgtagagctctcacagggcagggaaggtccagaatacagcaggtttgactgcacatcccaatattagtggtacttttaaaaaatgactttgggtcacagagttctttacgagtaagaactggggataattgagagggctcaggtatctgctacttttaaaaatggcttataggacattaagagtcataagaaggaggctgggtgcagtggctcacgcctgtaataatagcactctgggaggctgaggcgggcggattgcctgagctcaggagttcgagaccagcccaggcaacatggtgaaaccctgtctctactaaaatacaaaaaaattagctggacatgatggcgtgcaccagtagtcccagctacttgggaggctgaggcaagaaaatttcttgaacccgggaggcagaggttgcagtgagccgagatcgcgccactgcgctccagcctgggcgacagagcaagactccatctccaagagaccaaaaaaaaaaaaaaaaaaaaaaagcatcataagaaggaaagtaaaaatgattattcttctagtcgctttctggattctttgcctttcattgcttctatagtacatattaatattacaaagaaatctgaattggaatagacaatcatttcccttacatataaaaatgtaactgaataaagacattaccctaaccatcctggggttacattcctagatactcttggattccatctacaccttctcaactaagcacttacagatgtctggctttatatatgtacacatcagtaactagaactaagtgttgaggtaatgaacaacaaggagatgacagagtgactaactctggccatgatgaaaatggcagatctaagatggaaattatactaggaaattccccaatcctagaaatacagttggccttcctccctcccttccaccttccctccttccttcccttttcctctttcattttttatttcctttgtaagacatctagacaaagtttaggtgctatataactcagggacaatcttcagcttcattgtgtgagattttattcatgattgccttatcacacacaatgacagggagtaggagaaacctcatttgagtatataatctgctgagtgtgatgcaaatgtcagtatctgtggtatctttgcagttacaacccactggtttcctctattctcttaccacttagaggtgaatttctaattctaggaactggtcgtcatcagaaattgatgaagacttcaagacgttaaatcaattcagccactgctacatggtaccttatagaagagaccattaattatactaaataatgtctattcatttattcaacaaatatttatccagtgcctacccactggataaaaataaccaccctgagtgtttagatgaatgcctaatgacaagggtgatgcttatgccattctaaaagtgatgaattgaactgaacatttatttccacacaaaaacctacacacagatgtttatagtagctttgttcataattgccaaagtttggaagcaaccagcgtgtcctcatagggtgaacagataaataaactgtggtacattccattcagacaaggaaacgccattcaatgcaaaaaaagatatatgtgaccaagccatgaaaggtacaaaagaaacttaaatgaagattatcaagtgaaagaaggcgatatgaagaggcgactttatgattctatctataggacatcctggaaaaggcacagctataaaaagggtaaacagatcagcggttgctcagggtagagggaagaaatgggtgatgaggtagagcacagaaaatctctaaagcagtgaaaagactgcacaatcctacagtgttggatccatgtcactaaacatttgtccaggccctagaatgtacaacaccaagagtgaaccctaatgtagaggactggctctgagtgacaatgatgtgtcaatgaccagttgtaagaaacgtaccactgggggtgtgccgggcgtggtggctcacgcttgtaatcccagcactttgggaggccgaggcaggtggatcactaagtcaggagttcaagaccagcctggccaagatggtgaaatcccgtctctactaaaaatacaaaaaaattagccgggtgtggtcatgggggcctgtaatcccagttactcaggaggctgaggcagagaattgcttgaacccgggaggtggaggttgcagtgagccgagatcacgccactgtatcccagcctgggtgacagagcaagactctgtctcaaagaaaaaaaaaaaaaagaaaagaaaagaaatgtaccactggcggatgggggtgggaatgttgatagtggggaggttgtgtgtaagtaagggaatgaggttgagaattttccacaatttccacacaattttgctgtgaacccagaactgctgctctaaaaaacaagtttcattaattaaaaatcaaattgctgctttcaaggttcatggttcacagccacataggagatgggtgtcttagcctcatgtaaggtggagaattagaactaaaatccttatgtagaatggagtcctagaaaaccaatgactttcgttaaaggattgactagaaaaaaaaaaaatctacccatcagaacaggtagaagaaaacttattgacctgatactagaccttacatttgatggtttgtaatcagagatctgctcttccttcgacaaaaggtttaaccttatactatttatatagtccatttttcacaacgctgaaaaataaacataaaaaagtagttacacactgcatgccagagacaagcttaaaactatggtgaagagacacactgccagcctgccacgaagcagccccacaaagcccaagaactcacattctaacacagaaaccttgtgaaaatataatcttccaagggagagaagcaatacacccagtcaccatcaggattagttacctaagaaccacagacacagaattttgtacagatatcattaaattactatttttcaaatgattaaagacttaatggaagaacattgaaatataaaacaagagcaggattccatcagaaaaggcagtgacattggaaaaagaatcacatagaaaacccatcaatgaaatatccattctttgaatgccactgggaatgcaaaatggcccaaaaatggtacaactatgaatatacaactaagggcaaaagaaaggtatgattaaattacctggaatgcagcacaaagagataaagtgatgaagaacttagagaggaagtgagaggtactgaaaaaggaataaaaagtccaacatataatgaacttatattctagaattagaggaaaatgcaaaaggaagagaagcaatatttgatgacactggtgtatatttttctagaaccgatacgaatgttctcatacaggaatcacagtgaatacggaaagaaagccaaagctgaacgcatggatgtgatagcgactaaccacaaagatttgaaatgatttctaaagctgcaagagagaaacagattacctccaaaaatactgcaagtagactcatagcatacttaccagtagcaaagataaaagctatacgctatgtcttcaaaggactgcaaaagaataatctcaatatagaattatctttcctgtaattcagaaaataagacaagttattcctaaagaacaacaaggtgggtgatgtgaaatgccttgtcagataccgcaaattataataaaactatagtaatataacaacgtagtattggtgcagggaaagacaaatagacaaacagaacagagtagacggttcaaaatagatccaggtatacatagaaactatatatatgtcaaaggtgtccttatgaggcatgactgttcaatcatgggaatacacaacaggtgatccctgtgaagaaaataaaataaaactggatcttgcgtggacagcacatgtacacaaagataaagtccagttgttaaagacctatatttaaaaactaattttcttttttctgagacaaggtctggctctgtcacccacgctgtaatgcagtggcacaatctcggctcactacaacctctgcctcctgggctcaagccatcctcccacctcatccccaagtggctgggactacaggtgcaccagcttgcctggctaattttcatatttttttgtagagacgggtttcaccatgttgcccaggctggtgttaaactcctgagctcaagggatccgcccacctgggcctcccaaagtgctgggattacaggcatgagccaccatacccagccaaaaaccaaaactttaaaatgtatacaaaaatattctttaaaaatattcaaggccacaacatatgaaaactttcacattagacacagaagatacaaatcataaacaaagatgaagtaagttttccacattaatgtgggaaatcttatacatccaataacagcatcaaagttaaggagacaaaccagaggttgacaggttatttgtttcctacgttagccccaaaatactaatatacattgtgcattaaaataattcacattttaaaaccatcacaggcccatgagaaagtttggccaaagtatactaaatgctcagaagacaaaatgcaaatgaatagtaaatgtgaaaagatgcttaattgagaagtaattagagaaatgcaagttaaatctacaatgacagaaaagtttacaccagtcaggctcaaaatttaaaagtctgaaaatattaaacgttggcgaggatgtgaataattgggagttaaattgttatgatcacctagcagagcaattatttagtatctattaatagtaaagctgaagttattggtgcacaaataccacacccaggaattggtctagagaaagtcttatacctgtgcacaagacttgtataagaatgttcagtgcagcactatttgtgaagcaaaaaaattagaaacaccttaaattcccaatagcatgagaataaatccattgtgatgtcacacatggtatgctattcattagtgaacacaggtgacctactgctatatccactaacacgcattaatctcaaaatatgattgaacaaatatgttcagttgcatacaataggtaacatcatatcatttatttaaagtttaaaagcatgcaaattagcagtattccatattacttataggctggtaaataaatgtttttttttctttttttttttgatggagtctcgctctgtcgcccaggctggactgcagtggcgcaatctcggctcactgcaagctccacttcgcgggttcacaccattctcctgcctcagcctcccgggtagctgggactacaggcgccccagaccacgcccagctaatgttttgcattttttttagttgagacggggtaataaatgtattttttaaagtataaaaacatagttgataatgacaaatcccaagttcaggataatagttacctctgtagagaaggaagaaatggaacacaatcagagagcagtacatccatcgcttcagttttagttgtaatatttttcttaagttgaatggtgggcccactagtatttgtcatataattcccatattgttttccatccctggggttttgcaataacaattacaaatatgtatctccctacaaagtttatacaatggtttatatataattcattcatctttgacttgtaatggaaatctgacttgcacaggaagtcaagattgctaatgtcagacttgcaaaagaacaagcatgctaatcaaattcaaagtcactaatgtaatttccatgtatttctattatagttctcgatttagattctacatctaacctcatcttgactgagaatgtatgtatagattctcaaataagctttatctgaagaatgtcttactatatattatttggtagcactaggtatcaaacactgaggctcaaatttatatttctgttctgttctaacctcaacaacagacagataaacaaacttcctactggagatcgccacctaaaatttatttgaaaccttaaacctctcaaataaagtttatttgaactgcccctcccacaataacccattcctctttttcttccactctcctctgtgcctggtggcatcaacatctaacatgagttctatatctcacatagccaagtatcaatgtgtcatacttcaattttctctttcccttgcatctcacaatgcgtacatctgctagtcccattgacacaacctctaaaacatcacaaagctacatgtgtccctccattacaacgtctagtaccctagcgaagccccatgctccgtcccccaaacacctagactagcctcccaattagcctccttgcttccaccaacttccagccacacttacctcccttatggccttggcatgtgcttacctaatgcccactctaggtcctttgctccctctctctggaatgattttctgcagatattcccagggctggctcctttagctttcagctcaaacttcaccttccaagagaagcttttcctaaatttccaatataaggtagtgtcaccagtcctcagcctattttaattctttccaagcacttatcactaactgaaatttaccatttttattgctttacttgctttaaacctgaagattgtatttggttgcatgtaccggaatactgactacagaagtataaccaattggggtttatttttcgcatgttacaagaagtctaaacaaaagccatctagaactggctgggggctccctgatgccctcagcaacccaagtttcttctatccttctgccctgtccttttagcacgtggcttttatcttcatggcactctgactaaaagcattaataaccttcttgcacatggaatgcaggctccacaagaaaagggaccttgtctgtcttacccatcaccggaagaatgacaggtgctgtgttaacagcttgatcagctagagcagtgaaagaggaactcaagagtcctcaacctcagcatcattcctgcatcctgggagtcctgcaccacagcctccattcattggccctggagattctacccggatttctcttctcatgaagccctggccttcatggccttctttattggccctgccttagtccagggcttagtctcacgctacagtctcctaagtggcccgccacctgccccatttcgcctgccaccctgtcacacccacgacacaaactgatcatattcatctctagaactcttatgttttcttaaagtctgcactcaaatagaaagctccacaaaagtggggacgcaccggtcctgcttaccactgctctccaggcctaggaaccaggagtgcttgctgtggaggagacacttggcaagtatttattaacagaatccaaggaagcatctaaattcccgaagattatgtgcaaagcccctctgcgtttgacccggctcatcctcttcccggtatcaccttcctcattctcacttttgccatttgtttagtcacagcaaataattgtaattctaaagtagtgccagacctttgcatcttttattttataatatctgcataaaatattccttccttttaaaatcagaaatcttctgttcatcacttaattcccagcttatgattctcctcagcttagaggccttactgactcagcctaggggagcagacagtgcctcctggatgcagcactttgatgatgatgacgatgacgacgacgacgacgatgatgatgatgatgttaaaatcacaatgccagcaactgacatcatggggtgttacaacgtacaaggcactcttgtaagtatttctgtttggtgactcatttaacccttgtagcaaccccatgaggtagataacacaatttttctcattttaggagaggaactgaggcacagagacattaactaatgcaccaaaggtcaaaatggcataagctacattccaacccatgtggcccacctcctaatccatgcactatgacttgtggacatatttgtacactgtgacctgaaagattgttgggagcagggctcataccttatgatacataatgggtgcccaataaaagaccgttgagtgaacagattttaaaacaatcagttgtataaatacagaatggggaaactggcttacatatatatatatatatcttgtaaaaacagagttggggtttaaatggactgtatggctctctaagtcatatcattgatcctaaaaataaattacaggccacattaataggcagattataccaaggggcatgtagtaactccagcatagatcaggccactttgagaatctagtacagtcctctctctttagaaaagaccaaatggagttcgtccaaagtaggtaaaacatatggctgctaaaataggaagagaaataactgaagggcatatggattatcgtcaagtatctgagaaagtgttatgtacaaaaatttcttctgatttaaaagggcagaacaaatctaagggtggaagaacaatgtgctcagataaggaagcaaattccagttgtgtgtgctgggcccactcaggctgcctcctaagaatggacagggaacacctcttcccaacgccgccttcagtgttattatgttggtcccttaaaaaaaacagggctggcaggttttgcagggaaactccaaagtgacaatcagagctttgtatttatagagagtcagtttacctgcttatcactgcatttatcccatttagttgctaaaaaaaaaaagaaaaaaatggacttggttgccttgtggagaatggatagtagttgagccttgtggtgaatggatagtaattgagaatgcggcagagagagatgacttcgtaaccaacagatacatatcatcaatgcgcacagaaacttaaggaggggccaatgtgatacgcgaactgttgtcagtcctttacatttagttatttttaaatttatttttcaggaagtatctataaaaacactatatgtaaaactatttataggtcaggaggctgaggcaggagaattgcttgaactgagacccaggaggcagaggttgcagtgagccaagatcgcgccactgcactccagcctgggctacagagcaagactctgtctcaaaaaaaacaaaacaaaacaaaaacaaaactatttataggttaaacactctttataagtaaaactcatttatttaaagaaacagactgatatttttatagttctctcatcaatctcttctattaaaaacaaacaaaatactaaaagaaaactgccaatcattttgaataagagatggtccactacattcctccaccagaggcaagaattaaaaatttaccaagtcaagcaggaaaccctaaaagattatcaacaaatgtattatatttttcaaattcgtaatgcaaaatctataggtatgttttctaatcagtccaagactccaaagtaattagtgaatttattgccattttcaaaaagtaataccccttgatatttaagtttcaatagtatggttttaataaactgaaatgaatcattagaagaatttcccccctttatcataactgattaagtctattttaaagcttatatgccctcttcagggaaatctttaaaaatttccaattgtttatatcagtgaacagggctgaataaccaatgtataattggttaaatcagatacattatttccccctcaaaacaatgccattgagttgaaggcaaaggatagaaatgaactcaccagctatatacaatattatatgacataagcaatattaaagattggtatataagaaaccaagcttggctgggcgccgtggctcatgcctgtaatctcagcactttgggaggccgaggcagacggatcatgaggtcaggagttcaaaaccatcctggccaacatggtaacactccaactctattaaaaatacaaaaattagctgggtgtgttggcacgcagctgtaatcccagctactagcagggctgaggcaggagaatcgcttgaatccaagaggtggagactgcagtgagctgagttcacaccactgcaccccaacctggcaacaaagcgagacaccgtctaaaacaaacaaacaaacaaacaaacagaaaccgacctttaaaataaatacaaacacaaaaagattagtatgtatttaatctgcaaggctaaagccacacaactggatttcagtgtactacaaaatgacagatcatataaattcaaaatcttcattctgcttatcaattacagaggcaaaaatataactatttaagtgggtcttagaatgtattttctcttcagagtgcttcctgatcctcttgccctctattttacattcaagcgactcatgaattcttaggagaaatctgaaattacttcatgccccttgttaaacagattttgaatggtaagtactcctgcaaaattgctcccccaaataaaatttcacatacagatacattcagtgcattaaaaaagtaaactccattagaatagaatatagtattttcttaagataactgtttagacttaactcaaaggagttcccacaaatatattctgttctcagttagttcaagtgtggaataggcaatttggcatggggtaaatctgtccccttttgcaatgttttaaaacagaataaatcgtgggatgaatttactgcgcattacaaataaaatgtttatattttctttgtgaattattcatcaaattaaactaataacatgttaaaatttgcttatgtgtcagtcctttgtaggtaaaatttcatataacactcaaaacaaacatataaaatataggcattattactatctacacttcatatagatcagaaaaataaagactggagagcttaaatgacttgtccttcccagagagtctgactttagagtgattcatatctactgtacttcattataacagtgtatttgaaagtctagttgaactcttaagtgatttcatctagtgtatgacattcttgaagttttgacttctcatttatatatagcaataagcacatgtgtaggatggcatcataaaactcccttggaatgaaaaaaacatataaaaagttttaggctcctacaagaacagcatgtatctcaatgttcctcaaaatgagaattgactccaaggtacaaaacaggtaaactgaggaagcagatgttaattaaccactttagcaggttctgaagttcttagtgtccaaggtttaaataacactagaactatcttaaacaaatgtttgtgtttatttcctgttttctgaacaatgtttttgatgaattacgcatagatggaatgcaaacacacagacccaattccctttgaaatatgtaagcctataaaaatgagcagaaaatatccttggcaaaacctgcactgagctttcaaaagcccacatatttgaaattgagtttgtgatgtactcaaaacacaaacatcagtgggttctcgcattcctcatttctccctctaatgtcagaatattctattaatttaaaaagcagagttctgtgccataattagtctacatattaaatcttatctgagtgacacctctgaatgcaaagtatccagaacaaataataagacaagaaacattccatgcaaaataaaattcaatgacagaataaaatcttcaatccaatgcagtttacacaagtacacccacaaaaattataatttttcccaggaaatgcattccccaaatgaatgtatgcttctctgtgtgaagacatatatgtacaaaaggctaaaacattttttaaaaatccaaaaacaattgatactagaacactatactgacaccaactttataaatcatgggcttgcccaacaattcagtaaatacttgatgttctgcctccattcaaatgagtctgtgcatcctctgatttagcacatggccaaagaaagatctttcagcccatccttctgtgctttacaaaggctactatggcaatcttcacttgtccaatgtgaatttcagttaatttaacttctgctgctaaattgtttatgataattttatttttatcaatattaaacctaatatttgaaaaaaaaagttaacacaacatattaggccagactctcccattcccatttaattgtgttttctgtgtcttatgggcatcactaaagttatactttaacataaactattataacataaaggatcacatcccacacatttaacttcatctgccatttaacttatatctaaggaagatcaatgctggaataaatatttactaatggtaacttattaattaaagctatgacccaagcccatatataaatagaaaatgaaggagcacacatactcccatatgtattcatcataagtgagtttggtatataagcttcaaagaagtttctcatatacaatcttattgttccttgacagtcatctcaggcttgttacaatgacttagtaaaaagggaaaaaagtaaagatggaatttcagtgaatcatctttgggttcagagcttttgggtgtatagacacaacctctcatttcttaaattcttccctaaaggatgatgactgtattaagcaaaatctcagataacatcaggtcaattggatgatggaatcttagtccaataatggagacaacagaatatctgaaactaggacttcagtgaacagtaacacagtttcagtatggcatctcttctctgtcatttatcaggtttcctgtaccctaataagatgcatcctatgttaagagtttggagattggattgctgcagagtttcaccctctcacacattgcttgccttggaatgtgagtgtaatcacaatggaaacatctatgagatgagagcctattaaatgaatccacagactatatatcttcagcatcttataagctataagaatcttagctttttttttttcttcaagtctatgcttattgatggcaatcctcagagatgttttgtaagtccacatgggcacagaaatgtcaaggcttcctttcaaagaaaaataacatttctgagagttctgaattatgcaaagaggtaagtcattcagggatactttctgacatgtagaggcaaccagacacaaatagatgaaataacggtcttcccaaagtgagcatttgccctgtacagatgatcattctttgattctagactcggacacgtagcaacacttactagttcgtataataatgtacctgttctttggaggaactcaagaggatatgtacatttgcctaaataaaggaggccagcagtaagttccatttgcaaggcaaaccttcagagagaagatgcttgtatcagtcctgtagtgaatgagcatctcatttacatgaccaatctcttacacagaaataaatcactgcgtgactgtgctctgggtataatggtattgagcctggcctccttttatcttataatcagttaaaataggaactatattggtcatttgcagaattcttttatatacaaacaaaaaatcatggtggaaatgtattcagtgctctaaattgatactagcctctttctgttttatagtcaatagaaaaagcaatctctactaaaaatacaaaaattagctgggtgtggtggtacatgcctgaaatcccagcgacttgagaggctgaggcaggagaatcacttgaacctgggaggcagaggttgcagtgagccaagatcatgctattgcactccagcctaggcgacagagtaagactccatctccaaaaaaaaaaaaaaaaaaaaaaaaaaaatttgaataaattaccaaaaaaaaccatgaaatttcaataaatttagttcagaaatgaagccattacatccctaaattctattacataaatatgttactaatgtttactctataaccacagcagatcatctgtttccttttttttttttgaaacagagtctctttgtggcccaggctggagtgcaatggcgcaatcttggctcactgccacctccgcctcccaggttcaagagattctccgcctcagccttccacgtagctgggattacaggtgatttttgtatttttagtagagacggggtttcaccatgttggtcaagctggtgtcgaactcctgacctcgtgatctgcctgtcttggcctcccaaagtgctgggattacgggcatgagccactgtgcccgatctggctcatttatttcctaaaattataatgtatgactaacaaatcaatttaaaaactatgtacaactggagtacacaattgtcaagaactatttacttttgcttagtttaaatatttggtaaagagtttgcaaataaatactcatcatgtctattcagatctataatgtgctaaaaattctgtttaagacttcaagaaagaggccaggagtggtggctcatgcctgtaatctcagcactttgggaggacaagatgagtggatcacctgaggtcaggagttcaagaccagcctggccaacatggtgaaaccccgtctctactaaaaacacaaaaatgagccaggcgtggtagcgggcgcctgtaatcccagctactcgggaggctgaggcaggagaatcgcttgaacccgggaggcggagcttgcagtgagcagggattgtgccattgcactccagcctgggcgacagagcgagactctgtctcaaaaaaaataaataaataaataaaaaaaggcttcaagaaagaggcattaatgtctctataagttttactcaccctgtactcttagtatgaacaagtctttaaatgtgtctgctaatcaattaaattatttttctcatttcttatgttaaatatcactcattgaatacatactctccctttaaaagagagacaaatagcaagcttattttctaagaaagtgatagtttcaattcctctgtgaaagtggacagatatcctaggttttttttaaattcaactttatattaaaatgcttacacattctaacgcagttgtaagagatagcagagaaagatgccagctaccttttccccagcttccgccagtggtaacatcttgccaagctagacgttataattgtactataagcattgttacagtcagcacagaggacggccgtcaccaaagggtcccttctgttaccctttcacagtcgtaccctcctctcacctgcttccacccccttcagaactgctgggaagcatgaatctgccctccatttctatcattttgtcgttttgagaatgttatataaataaaattattcagtgtacgatctttggggatgggctttttccacacagcacatttcccctgagatccatccaagatattttgtatatcaacagtcggctccttttttactgctgagtaatattctagggtgtggaggtaccagtttgttgaaccacagatccactgaaagacatcagagttgtttccgtgttctgctaatgtgaataaaactgctataaacattcatatacagatttgtgtgtgtacctacgtcttcatttctctaggataaataactaagagtataactctgtcatctggtaaatacatatgtcattttttatgaaactgctatattcttttccagagtggttctaccattttatattcccagtagcaatttgcgagtaatccaatttctccacatcctcaccagcatttggtgttgtctttattttgtattttaatttacctactttacctattactctagatatttctttatacattcttaacttgtcatgctctactgcagttgctattttgtaggtcaagtttagaaatcttacctttccttgcatctgtgtttatgtttgcctgaaatgtttcttctacatgtagaactacattagacaatgctataacttttgctgcaaccctctaacataatttagaaaactcaagaggagaaaaacagtgcattgtatttaaccatatttttgcttactatgtttttccctccttcctagtgttccaaaattcctttttttgttgtttcatttgtttagaaaatttctttagccattcttttagggtaggtctgctggtgacaaattcgcttagtttttctttatctaaaaaaaaaagtattgatttgttctttcttcctgaacgacattttcactgggtataatattacaggttggcagttcttttctttcagcatttgaaaaacattgtgccacttccttctagccttcatggtttctgatgagaaatccactgtaattagaacaatgttagccctatagggaaggtgtgatatttctctggcttctttcaagatctaaaatttgtctttagttttaagaagttgaattacgttgtgtgttggtgtgggtttctttgggtttttcctgttttagattcactcagctttataaatccatctataactttatgtctcttgcaaactttggaagtttccaacacttatttctttgagcatttgcccaccattatcttctccttccaggaatcccctgacacaaactttaaatgctctgttggagaaccacaggtctctgaggctctattccttttttctttttccagcctaccttttctttgccatttggaccgtgtcatttctatgttccaacttccagttcactgactcttttctctgttccttccattcttatgtcaaacccatcagtgagtgttttatttcagaaatttcaaacaagaggctctccactcagcctttactagtgttggtggggacaaggatagggccgcagtttttctgttgcatttggctggagtagactggttattgtctaaatgttttctatgttgctaggcagcccctttctgagtcctctggataaaaaacaggccattgttggggatttcttccttccttcctttcttccttttcccttcccttcccccttcctttacccctcccttctctctctctctctctctctctctgcccctcccttcctctctgcttcttttttcttctcttttctttttgtctatatatgttgacatttcctggttgccagcttcttcagttccacatctgaggtaacgtagcaaaaagaaaactcaagaaattcacctctggattcttccttgggttctaaaatccctactctgtccacattcttctcactactttcagaatcttcctaagcttgtacagcggacccttgaataacatgggttgaaactgcatgggtccatttatatgcagattttcttctgcctctgccacccctgagacagtgagactaactccccctcttcctcttcctctttagcctactcaacatgaagacaaagacaatgaaaatcttgatgatccacttctacttaatgaatagtaagtatcctctctcctttttgtaatgctgttaatgttttctctagtttttttattataagcatacagtacatattacatatgaaaaatatgtattaatcaactgttcatggtatcagtaaggcttcccgtcaatagcagactactggtaaagtgtgaggggagataaaagtatacatgagttttgtctacatagcggttggcacccctaactccatgactccacgagtcaactgtacaatatgcaatgtctaggctttttagtgtagttgctgggaggaagagggaaaagtatgcctactccagcttcccagaagcaaaatctgtgccagatcattcgttttcaatgtctatattttttccattttcctttaattttttaaagttcttaaagtcttgccaataacaaaactgaacagatgagtgtgtaatgaaaataactatactctaacagtgcttctctaagtggcctgtggatatgctctcccagaactgaaaattctatgaaaattttttagatgtgacatcaattctattataatcttacaaataccctttgccagttaaatagacaaactcgctttttaaaattatgacatttcataagactgtggtctcaagctatagttccccaaagtacctgaggtgaggcactaaaactaatttcctcctcaaagaaggtgaaactaagtgtgagagatactgctcagtatgtggggtgaccattgcctcagttttcctaggacactcccaacatataattttgtcctggaataattattgacagggtcttcttttatactcacaatatctcattttgcatgataagctaatatatatgttcatatcacctatgataaagaatacgaaaccaggaggaagacacccagcaagcatagacaccaccccagccatctcttcttctcttcaggacaccaaggtgtatatttaacattcattaatggaagcattaagtagctcatatggaaggtccatcttctttttctcagcagcaacttattattagatattttgtgcttatactgtgaaatatagcacctgtaatgataatgggtaactaaatgatattgactaaatagttgtaaacatatgttctaagattatacaagaatatctaggatgctaaaattctgccagttgtacacttaaagaaaacatagccatcaatttgcaattacatgtgtaacttcctagtctttacagtgaaactcttctatgaacaaagtttgccaacttctcggcacctaaatcatttaactgtgatttaatagaagttccataagtatgaacctttctttttcagtgtcctcagacacaagttctcaacagccagctaggcatctccaaacacacgtactcagctggcatcaactcccatcatgttggaacaatgcagcatccttcccccaaccaaaccgggtcttcagacttcccatttccttctatggcatgacatttttctctagttccccaccaatgaaacttcaatgccaagttagtcaaggttatgtgaaatatagcccatattttattttttgtccaatcttcaacatctctcttcaggttctagaagaacaagaacccatcctttttggcaagcattctctatgctcattcccctattcctccatctacagaatcctacctcaactcaattcatccaagaagttcttcctggtgacttccaaccagatgtgttttctccacctttaaaacttcataatattttcaggtgcgatacggcagttatgtttcatattcttatattatagctattaggttgaacaacatgaaattgttgaacctgtaaaaatggcaatcccatatggttcaatctaatatttctctcggttttagggctcataaataaagagcagtctccatgaaaacaggggctgagttaggtctctcttttggatcccctgagaagcctaggacattggaagtgcttaagaagtgtttgtcaaaatagactcataaatcaacacatgtcttaggcatatatgtttgcaaagtcaatcatctgaagcaattagtctaactacatatgaaatcgctaattgttttatgaatcagcacaaatggcagtttagaacctgaaggttttggcaatataaaatgttttgattcaaggagctgttttaaaattatttatttgtgaaggaaacatccttggatttagaggttggcagatacagtgaaaatctttttagttgactgaaatagaaaaaaaaaaaatcaaaaccctttttagcacatgcacttcccttataaaaccaaattgcctgaaagcagaggccagcagtttgtgcacaacgagtatgtgcctcaacaccatcagcaggagatgcaatgcagaatgacaggaacaatttgcatttctgtagcttctttgtatacccaaattctgagagcattttacaaagccataaatatcgttacccacaagagacagggaaaggatgcagatacaaggacggactttgtgtactctgacccaggagcccccctgcgcggagcagtgatacccacacagctgtaaacctgagtgcaattaattgatgctggttaagaaaaggggaacatacatctgcagggtccttcacagtcacagggaccattcccagaaagcgtttcgtctttcttgcattcacaaagaatagcgtcaacaaatgttgagttgtatttgcgagtttccccaacaaaggacgggtctctagttctaggtgatggtggtattatcagtcacctcaccagtccccctaattcctacaaaaatcaccaatccgaatgacatgtgtgtagggctttcatggggctaggagcagtgggctgccagaagctctgctggggccaggagagaagagagcatcgttcacacttattacgttgcaggggcctatttccagggacaatgttactgaaccttggagaaattcatgcaaaggtatactgttgttgtgctccaggcttccttccccatcagctgcagaactgtgcgattctggtcctggccaaggagtgcccaaagctagttgccaatgggccccggagcccacacctcctctagcgcagcatagcagcagccctcactaacctccaggggtcacaattgggttacaaattcctcacagtgcagggactgagcagcctgattgggaacaatttattcgaatccttcttcgttaagattcaaatggaataagtaaggtagaaattgaacagacacagaaattgtgccttgctgctcctgtagtcagtagacatttattcactaagcctagctcgtgtgttctttctctctctctttctcactcgcagttgttcttccaatctttcctgcttgctgttttaatgcataattaagaaggtcagaattaatgaagcagtgtggagtaaagttcaaggaatccccaggcactatttattctattagatctcaggcatgaatgtcagattggcagcgcaggcggcatgagcaatggagctggcggcatcccaagaacggccgccaagggagactcacctgcacagtccagtcattcctcagctccttccctgcgaaaatcacacgcaactggtcagccggaaccccctgtcgcttagcaaccacctccttgagctggaagatgctggtgtcagaatcgacctccactgggaaaccatggctggagttgaacctgacaaacactgaccaaggaaattggaagggagaagagaaagtgagcatcactcgaagcccttaaatggtgatagcaacatttctcaaccgatttacccctcgcagcccttcagtgaatggtatatattttctttcacttacaacaaaaaacttaatgctatagagcaatatttgggaaaaacagagttagttacccacgagatttccctttcatatattcgtcagtgacctgcaaaccaaaattgcattctccctttgacatccatcctgggaaacagagagacttgagcaggacacttgcttgattggaattgaaagagtcccatgagtttattgaaaagactcagctctgacagcatgtacacactcacactccctccacagtgaccctcttaataaaaataggaggcgatgtgttagcactcaaggtatagcaatggaaaaaaatctaagctgctctatagaccagagtgaagacccactcggggctatggctcagagccctagacttgggtggtcctggccaaaatgctccactgggtctatgaagacaattatttgccctctttttggcagggagggggtggagacactagtgacaccatttgtcttattgaagccactgttccccgtgagacccaggctgcatcctctagtctgtctgtctgcatgccgtcttctcactgcacctgctgtcccacctcttcagcgtctctcactgccctttactttccattctttctctcactgcttgaagtcacgctctcatcacatcttttctagagtctcataatagcccccaactggagtcttgatccacgccatcacctccaaaaggccctacatagttctgcaaaatgagccttattaatacagagctatgtcacaccactcaaatcctttaagtctcacactgtcggctggtgaggaaagactccaagatccctttcatctagcacaaacctacattccagcattttcttcattaatctccatgtgtactcttttaaactaaatgctcccagaaaaaaaaaaatcacaaaaaactgctgcacacaacttcttgcttttattcatgacctccctccttctcctcttcctattgaaatcctgcctacctccatggcccacttcaaatgtgacctcccccaagaagcttctggctatcagctactgcaaaagcctgatcttccttattcagggcaccagtggcatttactatatatgtcttttaatattcaccacattcctcatggaagcaggatagcacacgggttaaaagaacatcctgaagcattaggaagacctatgaaaaatccccacagactcctttaattggcttaggatgctaggggtcaatctattaacctccctctttaggtctcagttcccttatcttgaaaacataaataaaccacagaccatattattcggttcattaaataatatttatagtatttaaaactatcgtcttgtaacatttaaaaataatggacatttagctgtttttgatatacattttgccttctttaaaagataacaaactcctcaagggcaagtgttattgtttatttactgctgtgtttcctttaaatgtagtactatagctaattatttctcaataccaatgtgagatgacccacctcatcataattataataatcattacaatgccaataataatcaggcacttactatgtgccagacattgtgctctcatatggtttttctaagcctcccagtgatctggtcaggtccctattattatccttattttacagaataataaacgaaggcacagggaatgggacccacttttctaaggacattaattactttctaatggaactgggtttcaaatttatttcaatctaactctaaagctcattccatttctactaaaataggcttcctgaaaccatctcagaagaaaagtccaggccaggcacaatggctcaagcctgtaatcctaacactttgggaggccaaggggcaaggatgacttgagcccagaagttcaagaccagcctgggcaacaaagtgagaccccatctctacaaaaaatttttttaaacaatcagcagggcgtggtggcgtgcacttgcagtcccagctactctggaggctgaggtgggatgactgtgtaagcccaggaattagaggtttcagtgagctatggttgtgccattgcactcagtcaccctgggtgacagagaccttgtctaaaaaaaaaaaaaaaaaaaaaaaaaaaaaaaaaaaaaagtccacatttctatccctcatgattaaaaagataacaataaaaaggctttatgacataaatcagatattccctatatgggtgtgcagtacaaataaataaaagctccagtgaggagctaagagcaaaggaccgtgaacaataaccatgaacaacatgggccccaaaacagacgtgacactccagtgagggcaggtggtccagatggcaccacaagaacaaaggcctgacatctctgaccagcacggaaagtgtttagaaaaaggaaggacgaccagtgacaaagtgctccaaataaagaaaattcatgaaaaatactaattacggaggaaaaggtgcttttgatacacttttaagtcaatttcatttgacgcctttgaaaatagaggggaagaaataaaaatgtattggaagccctgaggtatcttcacagcatcctcagatcagagaccataagacaaccaattcatcagaaaagacacatgacaagttaggggctatagggacaaaagatatgaccccagttctaaatttcattttctactagtgagaatagatttaaagtaaaacaccataggaaggaatgtgggaagaagtggctggaatttgtgccaaagctgctataaaaccagataaaaattccaggagatcctaagtttatgattttgctccaggggttcaaatcatggaactcctactgcaaggatgagagtttttttgtaaagggaaactgcaaaaaatattaaagatacctctgtccaactactgaaatcctaagtatatacaagttttttctataatagaaaagttacagatttaaagttacagtatttagataaatcataaatactacggatatgaatatttttaacagtaaatctaacatacaatataaatttaaaatggaaagataaaccaaatacataatatttgaccaactaaaacattcgcatgaataagaaaaaacatcttaagaaactcactgagttcataatcaagtgccattatgtgaaaaatggctagtgctgaatggcagtaatgtgatttgagtgggtctcaacctttttctgacatatgtgggaaacatgtcatgtcccatctgtaccagcccctgaactccagccatgatttccaaaacaggagtggaaggaagtacccagttctccccacctactacctctttaaagtcacagaaggcagaacgtctttagagctacataaagagaaatttgaatgctggttgtaacgcttgctaattttatgacaagttacctggccaccttgactgttagcttcctgatctaataaatcggtataagggatgcaacaccaatgtctgttacacaagatttattgagattatggatgtattagaaaatctcagaaagagactagtacagggcctatcctcctagtgctgggcaagtgtgtgctccaaaaatagttccctattctaggcacctagaggaggtagagctaatgaaagcagtgtcctttgcttgcatggtaactaagggagattagataggatgtgggtaaatactaaataaagtagccaatttttctggattctgctcctcttggtggacagaaaacttccagagaccaagagatatgatagagaatatggctcacctctactttctaaggtttaattacatatgaaaagcttggaaatgcattgttttaataattgttttgatgacgtataatatagtatcagaaacaaacaacataccagtaaacattatcaatcatgtgtattatcaatcaacatcataatgcactgataacaaaaaacataatgagatatatccagattccttttttatgatatccctaaccagggttgagaagtcccagagagtaaggaagtgaatgggtgggaagaggggaaagggttattggtggatgggcccttatatttcttttaagacaattttatttaccaagtctgaccagggtataaacttcataaatatagtagtcaatatcaataattaatgattcttaaatgattctggctgctcctcaagcagccattccgcctcctgcactgagaagagcaatgtcattcatcagcacagccccatcctccttgtcattggtcaaatgattggttcagggatgatgcaagccaatctgtgcctggcactccccttgttccagtgattgattctgcagaatacaggtgacataaggtggactaatcaaagtcatatccagaactgtcaaaggttcggtgaagtccttttagatggcaaataacatcatgtgatgcctcagacagttttgctgagagacccaaagaaaatcacagcccaagatagaccattaacatgagcacaaaaatggactcagtgcactgaaggcaggcaattcttcctcatgagagggtttcctaagctccgtgggatgttcggctccacctgcagcccagtaagtatcagaggcacgccccggttaattgcggcaacacaaaagtaactccacatgtttccaaatgtcccttgcctgggaagtttcttctgcacctttgagaactatcactaaatctagtattccctaactttagcaaaccaaccaacctgtcctcacaccctcctgcgattactaccccatttttctatatagaaattttcattgagaatttcttatcaccctggtctccatttctttattttatactcttccgtgagccaacacttgaagactgctcttggtaaagcaatgagctctacacttcaatcctgtcatcacatttcagttcttatcaggttgaccttccagggacattcaatatagttggcttctgttctcatcatcctttcttctcttggcacccgccagagaaacccttctggtttcccctacaaaagaggacatacttttgtagcttcctcttctggattctctccctttattggccctgcagattttggagcatcccaggagtctgaatctgtgtattctcccaggtgacctcctctaatcccgtggctgtaatgcaatggatatgtcatcaactcccaaatccttatttccagacttgccatctccctggacctttctttctctttctctttctttctcttcctccctccctccctccttcccttcctccctccctcctttatttctttcttttcctctctctctctctcccttcctctctctctctctctctcatctcactctgtctcccactatagagtgcagtggcacgatctcagctcactgcaacctccgcctcgcaggttcaagcaattctcctgcctcagcctcccgagtacctgcgattacagatgcccaccaccacacccagcaatttttgtatttttagtagagaaggggtttcctcatgttggccaggctggtctcgaactcctgacctcaggtgatcaattcgcctcagcctccctaagtgctggtattacaggcatgagccaccacacctggccctcactggaacttcagataattgcatctactagcatttgatatctacacggatgtccagtagataaataaaataaacattctcttcctacacctgtcttagtgctttgccttattcctaccctctttgatccatcaataaattttgttaacggtagtccttcatttctaacctaatctcatctacagcaatctatttccctacccaataatttgtggtggaacacaaatctctagaactgcatctttggactcatagctcaatgttaagtgaccttgcatgtgcaatttcatcttcattgggttgttataaggatctgcattattactagctacaagcatttttatagctcgttttttattttttaattgctatttttatgttttatattttattatttatttttatttttataactattacctgcatactcatttagcacttgagtatatgctgtatgataccatcctctagtagcttgtttcataattctttatttctgtctttgaagatctttgtgacaggaagcctcatttcatctccccacttatacatagaggccaggatttttgccttttataatgaattattaaatgctatcggatcaaccctcctgcaaaaaaactactataaaattgggacttcactaaagaaagcagattcttgaaaagccatagaagagtgaacaaaaaaaatgaagatttctagttagggggtccacatcaggagaagtacagttacgtaaagggagtgcccattctcacagctttaggcttgaagccaggtgcagtccgtgcacatggcatgtgggccagcaggcactttggttgcaaagccacagtttttctggctgaagaagcaaaacaccaagactgggacacctgcctccgaggagacacagaagaaaatgagtcagaaagagaaacccaaatttctatctatccacgtctctggctaacccctgaatgatgaaggtgcgttatcagactcaaagttgctcagctaaaggaaggatgtgctcaaggaggtgaagtataatgcccctgtgacagtaaatcccctgtgaatgtaaacgcccctatgactgtaaatgcccctttgagtgtaacacccctgtgaatatgaacgcccgtgaatgtaaacgcccctgtgattgtaatccccctgtgaatgtaaacgcccctgtgattgtaatccccctgtgaatgtaaacgcccctatgattgtaacacccctgtgattgtcttcctcctgaagaatacagcatggaaaggggaacaaaaacaacctcacagtggagaaacctgacaggcgctaccgcagccaggtgatcaaggtcaacatcaacagtggtaagtcatcttgatcatgtttacccttgacacagtgtgatgcaatgggcaatttatctctgtgggctttctctcaaaaacacataagcccagtctaatcttcacgaaaacatcgcacaaaacgcaattgagggacgttgtaaaaaacacctggccagcactgcgcaaacctttcaaggtcatccaaaacaagaacagtctttagaaactgttagagtctaagggcctaaggagatgagtaaatgcaatgtggtagcctggatggaatcctggaaaagaaaagagacattcggtaaaactaagaatatccaaatacagtttgaattttagttaataagaatgtatcagcattctttcattaatgataacagatgtagtataacaatgtaagaagtttaaaatagggaaactgggtgtggggtacatgggaactccctgtactatttttgcatctttttctgtaaaactaaaactgttgtaaaataaatgttcatatatattaaagaaaaagatctagatggagatcagacttgcacacaaagaacagattttcttttcaagatcaaccaaaataaatgtcttccaaaacaaacaaacaaagaaccaagggtcactggagaaaaaattacagaattcagtgtctccagtaattacgtttataatgtctgcgatataattttaaaagtatctaacatttcaaagaaccatgaaagtaaaccattctcggagaaaagaaaatcaagtgagacaaaaccctgaaatgactctaattttgaaactaggaaacaaaattttaaaggagctagtagtattactgtccttaaaggagtaaaaaaaaaaaaaaaaaaattgcaatgagtggaaagatatgacagataatcagagaaatagaaattataaaaaggaatcaggccgggcatggtggctcactcctagcaattttttgggaggcccacacgggcagatcacttgagcccaggagtttgagatcaacctgagcaatacagtgagaccttagctctattttaaaaaaaagaaaaaaagagagagagagagaatcaaatagaaattctagaactaaaactacaattgcctggaataaaaatctgttaaataaatttaatacccaaatggagattaaagaggaaagcattagtgaagaataaagaattgtttttaaatgaatagatgttagggacatattagataatatcaaatgatctaatatatatgttgttggagtcacaaagaaaaaatgaaagaatggggcagaaaaatttttcaaaaaataatgccctcaaattttaatatgtgatgaaataaataaatttacatattcaagatgttcaacaaatgtcaagcaggataaatatgaacgtgcttgtgtcaaggcaaatcatagcatagtcaaactatggaaagccaaagacaaggaacaagctttgaaaacaacaagaaaagtttgtctgtcacatacagggttaaaatgatgtaattaagggttaacttctggtcagaaacaatggagtccagaagtgacggcacaatattacagttcaggaagaaaacaaaaagcaaaaaatgcttgtcaatgcagaagtttatatccagtgaaaatatcttttaaaaatgagaataaaataaagatattttaagattaaataaaattaagataatttatcacaagcagactcatatcacaagaaatatcaaataaactcttcaggctgaagtgaaatggtacaagacagagattcaaatccacaagaaacagtaaaagcatcataagtgctaaatacagaagataattaggtaggaatttttttgctttattcaacataatttatttaatgcagatgactgggtaaagcagaaattctattccatggggagtttagaacatataatatgtatgccaagtatggcataataggtgcggggtaaatatgggtcttttatttattttatgaagtggagcaatattaacaatgaagaaactaagaagttaaggacagacattatatttcttatagtaaaaatcaaaatgaataaaaatattgacccaaaaagcaagcaaaaatcataatggaattccaaaaaatattgaaataatccttccaaaaagggcaggagataatgaagaatggaagaaaaatagagaggtagatagaaaaatacaataaactggtgaccagaactcaccacatcaataattacattaaattttaatgaagtaaacactccaattaaaaggcagggactacgtggacagagggaagtgggtccagctatactctgtctacagggctgcattttagatataaagacacaaatggtttcaaaataaatgaataaaaaatacgccaagtaaaatgtaatcataagaaggcagggatgacaatattattaatatcacaaaaaatagattcaaaggcaaaactattttgaaaaaacaaaaagagagaaacttaagactatgctgccaccacttgaaaaggtggatcgcaaggctcaagaatcatagcccaagccttcccactccttccctccttgaggtggaagaggtgcccggtactgcatcgggccagactgggaatgtcaaggtctcctgccacttccaggttccccggctggaaacagaatgaggacttcctaccctcctcagggagtaagagaccctggtcttagaacatagcaactgatgaggacatcgcgcatagcctcaaggaaacagctttggttctttgacgagggtgtatctccagtagaattccctcctctctctctttttccttctctctctccccaacatactctttttttattctttgattaattcttccacttttaaaattatttagtagaaaccacattaagggagatggagaatgagaggtaggaaaaaggcaactgaaaatctatataataagacgtgtatactgtggctaagaccatggatgttagaaccctctgtgtgggttcacagactagctctgtcccatcctaaccaactatgtaagcatgtcacacagtttctctctctcaatttattaccaacaaaataggcaataataatagtatctggccagacacggtggctcacacctgtaatcccagaagtttgggaggctgaagtgggcagatcacctgaggtcaggagttcgagaccagcctggccaacatggtgaaaccccatctctactaaaaatatcaaaattagctgggcgtggtggcgcacacctgtaatcccagctactcaggaggctgagacaggagaatcacatgaacccaggaggtggaggttgcagtgaactgagatcgcgccatggcactccagcctgggcgacaagagtgagactgtgtctccaaaaaaaaacgatgagaaagtggacataataataagggcaaaactctttggggaaggagatgacaaagaaaggagaagaaagactggatgataactagagagggtttgtgtcttataaggtatacgttctcagtatactttgtacctcatcaaaaataataatcatagtatctacctcctaaagttgttgtgagaatttaataaatcaatataagaaaggtatttagaagagtgcctaggcacattttaagtttcagcaattattgactcttaacttcaggtccaacatatagtgtaaaaattattgtaattatcacgtcagttgtgccatattaatgtttggttttaaaaatgtaccatttattttctttaaataagaaaagtgttcccaatggagctctattccactacactttatagtaaattgtaattggtctaaagtgtcgttagtatactgatagtgatatcttctgtttaaatagagctctcaattttcaaagtgcttttacagacattatctcagttaatcttcacaatagcactgaaagataattgggagaccatttactattcctatttttaaaataaagaaacagatgcacaaagaataaaagtggcttgcccaaacttcacaaggaaagaagcaggaaaaagaatcttgggtcctaaactccctcctctgtgtcagtggctttcacactggactgtatgttaccctgagggtatatgggacgtgccaatggaaagttctcctattcctcacacaccgttccttcaaacagatatgtctggaaacacatttatggctgtttcatgatggatcattttgtcccagcttcccttcgaaatcaacattctcccacttcacaaaacaaaggaatacactcaatctcccccacggtggctctggtgcaccaccacagggtgttaaaggagcatgccttgaacaactgggaacggggagcctcttttaacccaacccgttaactcacagtagagctttatttctttcagagtaaggtaaaggttggcattaggaacgatgatgtattttttagccatttcggactgtgttttcagcacgtgggttgagttaggctggtatgaatacagatacacagtaaagagggacaagagagatggtgatgttcatttaactctcatagctcttctaccccttggtattgccaaagaagtaattcctcctcagggaagttctcagaagatcagagctaagattgttgtctataatactgaagatgacggtatcttatatcacccaggagacaaactgctggcaaagttccatctcttacctaaccatccatctgtccatctgcccattcatccacacatccacatagccagccatccacccatccatccacctactcctctgtagtatagttatgcgttttgagaaatgcatccttaggcaatttcatcattgtgcaaacatcatggagtgtatttatgcaaacctagattatatagcctattacacacctaggctatatgatatagtatattgccccaaggcaacgtgtacagcatgctactgcactgaatactgtaggcaattataatacagtagtgtttgtgtctctaagcatagcaaaggtacagtaaaaatatggtactataatcttaagggaccaccatcatatatgtggtccctcattgactgaaatgttactatgtggtgcttgacagatataagatggctatgggggcccatttttttctgaaaaattaactcctattggctgtctgatttgaaaaagattggttttacatcatgtcaaaaggcggtcactttccacaaatggaatatgcagctccaaggttttgatttaaaaaatgttaaataaaataattttattataaatattgtattgacaaaagtgtattaaactgaagaacatttcaatttttcccaatgtttcaaaatttgtcagattgaacaaaatacctctaaatgatagaatggcaagaaaaattaagtgagttaaaaaaaactttataaaatatatttgatacatttcctagaaattgaataggtgaatgtctctatataattttgtccaagtaattagcttcaaattctttattttcaacaaaattaaagatggattcaattgggttataaattgacagatcactggagtaattatgacaaatattactaataaatttttgttacaattttgaagacattaaaagaatgaagttgctataataaaatctcttctattccaataaacttattagttagaacacgggcttacacccataacaatgaaaaggaagaacaaaatgatgctgaatccatttcattccagcaataagtaagattcatccacagacaggttaccatgcataaaaataagcccattcatctaattaagggatttatttctaatatttttatgcttagtaattatttgtcaaaaataccaagaaaccattcacccaaatatatatttatatttttaagtgatttgtatactaaaaatagcatgacacatcatgattcactagaaattaatactaaggcttatggtacaagagaatttaaaaatatatcataaactttaattcttatacatgtttttgttgcaaagatatattttgagatgatgtgtaaagatatttaaaacaaaaaatagttgattcttgttattttctataggctatagttgtagtctgtaaagtcaccacgaacagtaaactgctgaatactaaagcattgttcctaggggaaaaatacagggttaggttcctttgagcctctggttacaacattttcatccaccagtcaatacataaccttgttttatgtgtgtttctgtttaaagacagcttgtttattacattttattgattcattaacattgcactcatagccaatatcactataactaatgccttaactaggtttctataatgtgtatttctccacaacggacatcaccacctacttaaactcaggaacactagccagtacttcagtactatgcttggggccatttcgaacaatgaaatcaccaataaaaagcaccaaaatatgaaaaacatgacactacatagacctcaaagagggcatttgtttgcagtacgaaagttgaaacaagaaagcagaacactcaacctcaactgagaacatgcttattgagcaactcaaatcttcacaactctgccatttctgtgaatgaccttaaaagcttccagtactgattttggggcaaggaataattttaccatgttggtgaatttgcaaatatggaacccgtgaaaaatgaagattaactatattacattgggataaagttatgcaggagagtagaatagaaatgaaaaagtttgtaaaaaagaaacaatatcaaatttcagactattaaaaatcatcttttacatgtattattagcaagatgatactgaagggtaaatcatcagttttaatatcccccaaaaacatttttaaaatgatgcaattgctgtataatttaaccttaatatttataatctgaccatactgcaactacttaaacctataataaaatttttatatcaacttaaaaatgtgcaaggaagtatatggtttctcaaggtgttttataatacatatgagcaaaataatttcaagattactaactttagaaatagaagctaaaatcacaatgaggctgattaatacaaacaaagaaataaaaactacacaaaatcccaaacttaagagtcaggcgttgaaaccaaatagccattcagtgatgcagacacaaactctggggctcacactgtaatgagtgtgttgtgtttgtcttattaataatgatgaagtatttttttataaatactgctttgctcatttttatatagacaattttcaaacaattttatatttctcagttgcttcaatcaaaaagaggtttgtggccgggcgtggtggctctcatctgtaatcccagcactttgggaggccgaggtgggcagatcacttgaggtgaggaattacagccagtctggccaacatgacaaaaccccgtctctaataaaaacacaaaaattaggctgggtgcagtggctcgtgcctgtaatccaagctctttgagaggctgaggtgggtggatcacgaggtcaggagtttgagaccagcctggccaacacggttaaacccagtctctactaaaattacaaaaattagccaggcgtggtggcacacacctgtaatccccagctacttaggaggctgagacagggagaattgcttgaacctgggaggtagaggttgcagtgagccaagatcgctccactgcactccagcctgggtgatagagtgagactctatctcaaaaaaaaaaaaaaaaaaaaattacctgggtgtggtggcacgtgcctgtaatcccagctactcaggagtctgagacaggagaatcacttgaacccaggaagcagaggttgcagtaagccaagatcgcaccactgcactccagtctgggtgataagagcgagactccatctcaaaaaaaaaaaaaaaaaattttttttaaattaatagaggtttgtaagaatatctaagaaaaatatttcctcagacaggagcattactttaaggaaaagatagtactatataaatatattccactgttaaatatttccagtacgtgtcttttcctcccagagatgggacagcttgctggctctgtgagtaaaattaattagtcctagctttttgttgcctttttttttttttttcccagtggcagcttgtaactttatctcttttttttaaatatccataaattttccatgcaacaataggataaatttatttcactaattttaggataaagaaaatgaataaaattaaatgacttatattgagtaaaataaaagaagaggaagaaataaatgtttttgttttgtttttaagacagggtctcactctgtcactaaggctggagtatagttgcatgacatcggctcactgcatgcaacctctgcctcccaggctcaagggattctcctgccccagcctcccgagtagctgggactacaggcatgcaccaccacacctggctaatttttgtttttttagtacagacgggattcgccttgttggccaggcaggacttcaactcctgaccccaggtgatccaccctccttggcctcccaaagtgctgggattacaggcatgagccaccgtgcctggccagaaataaacgtttttattgtgagccaacagaaattactgattcatgcattaaaaatattgaagcagatacagtccaaaggcagcatcatattactgtagagatactacatgcaatctgcttggaagactgtgcatagtaagcacttattaggtagataatggcactcccctgaactgaaaacagaagttataaataatatttaaaatccaaaaacatgatggtactaatattagtacaagaaattaccaccttatatcttatattaacttagcaaaaattattaattaatatttaatgaaattgtcagttagatggtcagtaaaaggaagtctttggcccacagatcaaaattcacaatacaattttatccttaatctttaaatacaaaattacatttacgagcgtatttttaacttcgcagcagagatttaagccagtggcaaatacagaggctctcaagccagactacctcagtttaaatgtctgcttctcaactttcttgctttaataccttcaaaagtaaaatactgttcacatgtatcttacagagttgttataagtatgaaatgtctgactacatgtaaaattcttagattaatgcatagtatacagtaagcactcagtaaatgttagcagctactaaataaaaagtagccgcattttcaaaaatgattcggaactttctagtaatcaccaacattactttcagaagctctagttggaaatatttgttaaaatcttctcttaaaatctcaacagatagggagaaggtggaatctcacacactgcaggtgggaatgtaaaatgctaccgccactttggaaaacagtccagcaatccctcaaatgctcaaacctagagttatcatatgatcctgcaattctactcctaggctatatacttgatagaaatgaaaaatatgtccaaataaaaacttgcacatgaatgtccctatcagcattattattaatagccaaaaggtggaaaccacccaaatgctcatcaattaaccaatgatatatgcatgtgtttgttgtatccatacattggaatattactcagcaatgaaaaaggatgaagtgctggttcataccacaacctgggtgaaccttgaaaacattgtactcagtgaaagaagccagtcataagatgttgtatgattccattgatattgaatgtctagagttggcaaatctatagacacagagagtgcattagtgattgcctaaggtggtggtggacagtgtttggggagaaacaggagttactgctaaagggaagtgggtttcttttgggagtgatgaaaatcaaaattgactgtggtgatggttacaaaactctgtgaatatactaacaaacaatgaattttagaatttaaatgggtgaattttatagtatgtgaattatatcttagtaaaactgtatctcctccgctgtccctccctaaaataaaaccaaccaaatctctgtatacccatcacttattaaagtacttggcaaaacactgtgacttagtacttttgggataagcggatgaatgaatgtgcattcacttcactttaaatgttttttcccctattttcatctattagagaaaactgtaatcatgagaagaaacttacaaaatttgtaaacatcatctttcacatttagagtttgtttttataatgtgacaaagtttttctgttaaatatctcacagttgctgtacctagaagtgctttaagaacctgaaatagtactaatggtatgaaaaaggtagacttatatttcaacctttaatatagaaaatataatttgctcaaattactcacactgttctaatttccatatgctctaaagtaagtatgaataagatttagacctaattgctggtgacattaaaattcattcaattcttactgtcaacaaatatttactgaataagtaactatttgctaggcacagtgctagaaagtgatattacaaaaatgaataacacagcctggtgacagagatattacaacagaattatgtacaagaatatgatacatgctatattagggcttgtgccatgcgtaccacaccaaatgttttaagaatgaagagaaaaaaaaggaggctgggtgtggtggctcacgcctgtaatcccagaactttaggaggccgaggcgggaggatcacttgaggtcaggagttggagaccagtctggccaacatggcaaaaccccatctctactaaaaatacaataattagctggacgtggtggcacacacctgtaataccagctactcaggaggctgaggcaagagaatcacttgaacctgggaggtggaggctgcagtgagctgagattgtgccactgcactccagcctggaggacagagttaaagtgtctcaaaaaaaaaaaaaaaaaaaaaaaaaaaaagaaagaaaaagaaaagaaaagaaaacaaaaaaagaagagaccagcactttgggaggccgaggtgggtggatcacttgaggtcaagagttcaagaccagcctggccaacatggtgaaatctcatctctattaaaaatacaaaaattagccaggtgtggtggtgcgttcctgtaaccccagctactcggggcggggggctgaggcaggagaatcgcttgaacttgggaggtggaggttgcagtgagccaagatcacgccactgcactgcagcctgggcgacaggctgagacttcgtctaaaaaaaaaaaaagagacaatgaagaagagtggctaaaagctggagtagttcaaaatatttcagagataagggaaaatataggaatgatagagaaaaataagtaggggatttccaggtagagatttgttttttattgctacaggttaaagacacagtttaggaattactcttttagacaacaacagtgtattttcattagccatgaggttgtcagtattataggatggaggtatttacagtagtgagcagagagcaggcagagtcttatataactgtgagaactctggagctgtcccatgaaacttttaacgagctaaattttctattttacaaaaggacaacgtaaataattcatctttcaatattaagacaacatgttaactaatcaaaaatatcctggctatcacaaaattcaaaaggaaaatgtcaaaatatctacatgtttatattttgaattgaaagatattctaaaagttgtttcatgattatgaactgcacaatggagaccaatgtttggttcacaaatgtgtgctgttaattagattgagagtgattgtatatggtttctcacaaaggcatcttgagttcaaccatgtaaattgatggaattatcaaaacatcagacctatttcatttcaacctggcttttataaccaaggtgtgtgtgtatgtgtatggtgtgtatacatgtgtggatgtgtgtggatgtgtgcgtacatgtatagtctcccccaatataaatgtgaggctacattttcaggttaagagggctaatgtgtatcttgccttctcatcacaaattgttctacaagtccatccataatgataattatatccttcaatagacggctgcttacttcccaaattttaaactgaacaaaaatattacggatccaccagataattttaaatctatctacttgaactgcaaaattaggagttgaatgaaaaccttacttagtgcagtatgtttaaaactcatctttggctaggtgcagtggctcacgtctgtaatcctaatagttttggaggccgaggtgggtgcatcacctgaggtcaggagttcgagaccagcctgggcaacatggcaacatcccatctctactaaaaatacaaaacttagctgggtgtggtagtgggcgactgaaagcccagctacttgggaggctgaggcgggaggttgcagtgagctgagatcgcaccattgcactcccacctgggtgacggagtgagactccgtctcaaaaaaaacaattaaaaattaaaaacgaaaaaaaaaccacgtcatctttgagcatgttagtacttgctttgatacaaagggtctgcttgagtttgtattaaatcatttaactctccttgtagtttcctctgttattaaatgatgagaatgttcctaacctattgcaaatgattacttaccatggaaatacaaccacaattatactcaagattattccaagcacaaagttttgcatggaatcactgtaacattaacactgtctaataagaaacaaaacccaaatctttctgttaggagattattctccatgggtctccggccttctgcaatcttacctcactacctctatgctggactagctttccaagggggtttgtataggaagcatccttataagacaaaggtagtgtcttcctctggatcaaagggcagaagtgcttcctgtctgtcataaaagattcgggttccctgagctccgggttcctctccttttaacacatcctgctgtgtgtgcaggtgtcacttcacattgccctgtggaaactggggcctggagatgttgacaatgtgactactgctatggggcaagtaataaactatccagctccctgacccaggaatctcatgtcttggggccaatgtttggttcacaagtgtgtgctgttaattagattgggcaccagctgagtgactgtatatgatttctcacaaaggcatctcgagttcaagattggcatccatgaaactgtgagcagcctgcaagagggataaagtctcagatacttcacagttcctgacactgtctatcatttccttgacttaggcattacattcttactctctgaagctgttattttgttgttgtttttggggacttaataagcacattttaaagataaaaataaagcttaaactgaaatcaaaataccagtctttattttattttaatcaaagactgccctgacctttttttgagatgagatcatgaggtgacgtttaagctttgtaaatgcttatacataacaagtactttcaacaaaaaattctaacaattcttgatgccttatatgccagcttagaagaaatcaatcattgtttactttttcacttaaatttgcagatgctgattaaaaggcgattactattttttttacacttaggtctttctttaatcaaaattgactatatctctataaatgggaatcagggatctgctattacacaaaaatagatgtcaacatatgaaaattaaataaatgaactttgccactgccctgtaattaagtgataaagatttcattcacttttctaaggttttaatcatttatgataacttttattttcttaaggaaaaattgaactttgattttaaaaattctaaagttttcctaaaatatagcactaatatgtaatggagcaaactttcaaagtcacattctatttcattagaaatttgtctacaaatggccgggcgcagtggctcatgcctgtaatcctagcactttgggaggccgaggcgtgtggatcacgaggtcaggagatcaagaccatcctggctaacacagtgataacccatctctactaaaaatacaaaaaaaaaaaaaaaaaaaattagccaggcgtggtggcgggcgcctgtagtcccagctattcaggaggctgaggcaggagaatggcgtgaacccagaaggcggagcttgcagtgagccgagatcgcgccactgcactccagcctgggcaacagagtgagattccgtctcaaaaaaaaaagaagaagaaaaaaagaaaaagaaagaaatttgtgtataaatacaagttttaagagccccccctcctccttcttaataaatattaatgcatttgctcctccactaaaaacactttaagaaaatcaacagccatggcgatctcatggctgtgatgtgctcagggcaagcatctatgtaacatatccctattctgcaacacctcacccagcagacagaatgtttacctaaaactccctgagcttatgaaaacttcaacaatcatgtcaacatttaagctcgttcccaattaaccagtcttaccaagcatcacttctatgaacattttaaagaaaaaccagtgaagtggtgaaatcaactctgtccaagcttgcatgcaactctaggaaggcggttagcttatctctcaactagttcttatattacaccactatatttaacatctgacttttgttgctgtttataatattaccctttattttccttcaattttagaacctcagtttgtggccacctacagaataaactttcagctttaccaaattttctcttcttatgagagatgcacaacacttaatagagagaacactatttttcaagctgcaatatactgtggtgttttcatgttagacataaatagtgtcagtgaaaatgttgatcaaagaaatgaaattctaataggatgtcagaagaagcagattaaacaaatgatctagctgttccaaagacatcaaaatgcaaaataattcttttctggaggtattacttagccaaatgtaatttctttagcaatttcaagaaagaataggaagtgttaatgttagtttaattatagaaataatgtcaagtgacaatggcagggaagaaactgaatgctgatttgatctacacacagtgacatggacatttagaaaatatattatatgataattatataatcctggctaaattctttgataggtttcagttgcccctgtaaatgttctaaaattaaattcaggagggtatattgtgatatttaagaatttaacaaagttatctcaagaacatctcacactctcatgctatctgcaatccttgaatatatggtgactaatatatcttaatgtatttttgtatatcaatattttatcatgttatttcttaagacgacaactccaaataacaaagtgttgaaagaaaatatcagaaccaccaatatttttctttccttgacatacttgcagatatatatttttatgtttataacagaagttaataaagaaacatgcccagcttattatttctggattgattgcagaaacagctactaccttttttgatgatgtggaagtttatgcatgtattgaggaggcaatagctgtgataaattacttcaagaaaataacactttccattgcctttctttttttccttacaacctgtgttatggagtgaaatgtacttggccttgtcttcaggaggcagaagcaatcatttgcagaataggctttgtgtgctaacatttaatattaatctattcccaggcattatattattaactttgaatagatgctgacaagtcttgtttttggagggaggtggggcagggtatcgctctgtcacccaggctgaagtgcagtgttgccatcatggctcactgcagccttgacctcccaggctcaagtaatcctcccacctcaccctcaagagtaagcaggacaataggcatgtgccactacacagggcaattttttttattcttgttttttttttagagacaggagtctcactatgttgcccaggctggtctcatatgcctgtgctcaaaggatcctcctgcatcggtctcccaaagtgctggaattacaggcatgagccaccacatccatttcacttttgctttttttttaatgtgccattgttgcatctgtttctactgaagaataaaacagataccactatgctctttgttttccttttttttttcttttaatcactacccatttattaaaggctaggtggatttgggtaattcatcactgctaagtaaggtaactaagagcacgtttatggatatattatatacactggttacctcgtttcaataaataagcagctggtaagtcatctcccagttttatccccaacttctaaaagaaaaataggtcgaaaaaattaacaaatctggttaggaaaaatacactgagcccaactattatgattccctggattctattattacgtttatttattagtattatgagtctttgctaaaatgttgacttcttatggaaggcctctcaacagtgctgtttaaaaatcacacgtaatcaatcctttcactcggcacaccctaacctttttcccttcttcctttttctccacagctttcatcaatatcaaacacaattcatcatgaaaatcaagatttattcgttttgttcactactctatccccaatgtctggcacatactagctgctcaataaataagaatgaatgtgtagtataccacatggatgaagtatgggaggtattcattcaagcacttatcatgcgctctcctaaattacttaacatcagtgactgcccccactccacccgctcctcatccagcctccactgaatgaggaaacagcaccatgaatgaatagctcatgataaaaatttagcgatcgtcatcagtgtatccctttatccctatcattgagcctttggttctatctccaaaatatttattagatttctctacctctctccatctgcattgtcgtgaccattatctgtcttttgaatcagagcaatactctcagaacaggactcccaaaggcagtcagaggaatcccttgacacaagaaaaaactcacgtcacttcctactttaaaggcctcaatggccttctattgttcacaggataaaatctacactccttactgcagcctacagggctgcacggcctggctcccacttgtcctccagcctcaaccccctgtcacgctcccgctacgccgcccaccgagctcccgctatgctgtgtctggaagaagccaaccccttgctggattttacaccttggtacttgttgttccctttgcctggagcactcttgcctcctatctttccatgactcattcacagcctctagagagtatctcaaatgccagctgcacaggtcttcctgtgaccaccctaattaagcagcctccctaactactctctcatcaccttgtttactgctaccgtggttcttatcaccactttgttaacttactctttgttaaatgtaagccccgacaggacagggactttgcctctgtatattcacagggactaataaaatacgtggaacatggaaattgctccatatataacaaccgaatcaataaatagaacattctccctcacttgggtggcatccctcgtctcactaattagaatgcctgacacagaagagacatgctacaaatgttgaagtgaatgagaaaactgaaatcttttattgtatcctgagtggcacccagaaagatctttgttcattaatatttgcatataataactggactgagagaaaaatgaattcatttgattgacatttactcagtgtctgtccagtgctggaaagagcatatggcaatttggcttgcaagcacagaacagaggatatcatttctaaactgttcggtaatcccataaatataggacacacacatttcaccaaggcatttggcaaagtttctcattatatcttgtctttaacatgcaggaatgcagattggatggtagcccagctgatgggtttggtactagagagtggttagatgaagacagcttaagcatgttcaacagctctttcaatgcagcaaatatttcttgagcagctccggccagccaagtactgagcttgaggctagagtaataaaataattaagtgtggtctcttacctagaagggtgcataagtcttcccgtaaaacatttcagatctctgccctgtaccattgacattatttttaaattaatatattggatggatatatacagaatgtacttctatcaaaatcatatgagaattttaggggaaaaaacagaagaaataataaatcaggatccaagagatgataggtatctcaaaggctggaatgaattctttaaattaaatttagtgcagatatgaggtcctaccaatgaatccaaaataccaactacatatttacaaaatgggggaaatatggaatgtatccactcataaacattccttagggattttaatttacagtactctataaaaatctattgtgatatagtgatcacagaaactagtttcaccttctggtgtatttacaaggaagtaatcagcctgtgctcagaccacacttaagactactgtgtttgaaggcacgcaccacactataagaaaagttcagaggaggcggtcgagatggacacgaggatccttgctgcaacagccaatggtgttgctaaaacactgacactaatgaagaatttgtggaatgttaagaaagtgggggggttgcaggggggggtgggtgacagaggaagtcattctacaaaaaggtacttgcagatgcatgtttatagcagcacagttccaggttgcaaaaatgcggaaccagcccaaatgcccatcaatcaatgagtggatcaagaaactgtggtatgtgtgtgtgtgtgtatacacacacacacacacacacatacacatactactcagccattaaaaggaatgaattaatggcatttgcagcaacctggatgggaatggagatgattcttctaagtgaagtaactcaggaatggcaaaccaaatatcgtatgttctcactcataagtgggagctaagccatgaagatgcaaaggcctaagaatgacacagtggactctggggactcaacaggaaaggatgggaagggggtgagggataaaagactacaaattgggttcagtgtatactgcttggatgatgggttcaccaaaatctcacaaatcgctactaaagaacttacacatgtagccaaatatcacctgttccccaaaaacctatggaaataaaaaatttaaaaaaagaaagtgtgggtgaatggtagagaaggagggagctaactgtccataagtattcaaagagcaggtatgcagaagaaatagtaaacctgttttacacgatcctagggcacaggactaggaaactacatgaggacagattttgattcaccataaaaaggcctgactatcagtgctgtcctgcgaaagtgaagcatctcgtgaggaagtcagctctctatcaatgacaggtctcccacggccactgggacatcctctggacaaagacatcagactcaggacttaaacgctgcatagacagcagatttctagaccctatgtccttgacattttatgatataatgaaaagggaactaaaaaataaggaagtatacattttcattcactcaaccaatgcttgctatggctaggcgctgttttaggcaccgtggacacagcagctaacttaggcaaagtaatcccagcattttgggaggctgaggcaggcagatcacgaggtcaggagttcaagaccagcctggccaacacagtgaaaccccgcctccactactagtacaacaattagccaggcgtggtggcaggcgctacttgggaagctgaggcaggagaatcgcttgaacccgggaggcggaggttgcagtgagccaagattgcattactgcactccagcctaggcaacactgcgaaactctgtctcaaaaaaaagtatgcttgtgaagcatacattctagatggtttgggacaaaatgaaacacaagcataaaacaccaatctttgggtttgagaggatacttggtgctagtttgaggcaaagctacacctgaggcattcacactttaattttgtttatttatttttaaattttatttatttgtttttttgagatggagtctcattctgtggcccaggctggaatgcagtggtgcaatctcggctcactgcaaactccagctcccagtttcaagtcattctcctgcctcagtctcctgagtaactggtattacaggtgtgcgccaccatgcctaatttctgtatttttagtagagatggggtggggcggtttcaccatgttggccagaatggtctcaaactcctgaccttaggtgatcggccagcctcggctacccaaagtgctgggattacaggcatgacccaccacgcccagcccacactctattttttatttatttatttattttcatttttatttatttatttatttattgacagagttttgcttgtcacccaggctggagtgcagtggcacaatcttggctcaccgcaacatccacctcccgggttcaagcgattctcctgcctcagcctcctgagtagctgggattacagtcacctgccaccgctcccggctaatttttgtatttttagtagagatgggttttcaccatgttggccaggctggtctcgaactcctgacctcaggtgattcacctgcctcagccttccaaagtgctgggattacaggcgtgagccactgtacctcgcctccacactttatttttaagctggaagttatcatagatagagccatttgttacaataactgcagtagaccttttgcctttattcccgctatatgttctcctttcctttctaacctgtggcttccactcctcaccactgcaaaacaatttacaattaattgcttatactgcaattattaataaaatatattttgccatttactaaactattagatatgttttctgagtttttacacattaaaactttccacagtaaacattataagtgttcattattagaattcataaattatacagaagtgcaaaaactaaaggatgtatctacttctgttactttcacagaataatctatgcatatgtactaatacagatttagacatatgttatcccaaatctggtagtacttttgtagcttttcattttattctagtactaaaattattagaacactagtctttttggaattgatttttaaagtcccctaattggaattgcagccatctttttggtctgtcctccgattgaagaagatctaacagtgcaatcatcatatgacacttaataagcatccttgctgggcacctggtccataagaacattgagaataaatactttcctgacattcagtcagattgattgatgcacatcaagtcaatgacactggggaacgctttgtggatggaatgactacataataacaggaaaactctaggaagatacacttaatgaatccttattgatctaaatacacctaaaacttgtttgtaactttaacctctgccacattatagaggaagacattccaaactcaaactttttttttatatactttaagttctagggtacatgggcacaacatgcaggtttgttacatatgtatacatgtgccatgtgggtgtgctgcccccattaactcatcatttacattaggtatatctcctaatgctacccctccccccaccccccaccccaagacaggtgtgatgttccccactctgtgtccaagtgttctcattgttcaattcccacctatgagtgagaacatgcagtccaaactctaacttttattttattttattttattttattttattttattttttgagacggagtctcgctctgtcgcccaggccagactgcggactgcagtggcgcaatctcggctcactgcaagctccgcttcccgggttcacgccattctcctgcctcagcctcccgagtagctgggactacaggcgcccgccaccacgcccggctaattttttttttgtatttttagtagagacggggtttcaccttgttagccaggatggtctcgatctcctgacctcatgatccacccgccttggcctcccaaagtgctgggattacaggtgtgagccaccgcgcccggccccaaacttttattttatatatatatatcttagtagaagttgaacaaatatttccgaagctgttcagaacaaggtagaattcaacatactggaaatgtgtgtgtggcctgaaaattatagccagctactccagaaacctatagttgtggtgttttggaatttggtgacttggccatggttattcaattaaggaaaatattctcatacttatttttatatcagtctttcctactcaggtccttcaaagaaaacatggttaaacctattctctccccttcatagttgcttaattttattttttccaacccaggaagtcctaacttgtacaagtgtatcctcataaaatactaatgccttggtcatgttatctactctgaagtcattttaagcctttccctttgctaggatgcttaccacaactggatatttcaagtatggaagcaccatgatgtgaagcaaagatgggaaagtagttttatttctgtttgcaaacaaatgatgtctccttcttcactggtattttaggtaaaggcattaggaaaaactactggcttcagagaagaggacttaatgacactaagttgtgtgatctggtgaacacactttgaatcagttttgtccaaatgcatttccctatgtttgccaacatcaagctccctattataacatagtttctagaacagtgctgcccaatagaaggactagtaaagccaccgatgtgggccacatataaaattttaaattttctggtggccatgataaaaaagtaaaaatatgcagatataattttaatattttatgtagatgcaaaatattatgatttcaacaaataatcaatataggaggtattaataagatagtggtcattctttttttgtaccaagtttttgaaattgggtgtatgttttgtaattacagcacaactcagttgggactgtccatatgtggctaacggctactatattggcagacaattctagaaccaagctgaaaaccataaactgatggcaagtgtggaaagagcacagtttgcactctcagactactagattacctagactctttactcttgaaacatcaaatatgaattcatctattaaaaatgtcaccataattatagatgtaggttagcctttcttttacaatgatggggtaaaaataactgatttcccaccagctttccggtgcaacatccattaccataataaagcaaatttaaatttaattagaatgtaattaaaggtaatgtgggtgattccaggatagctgatttgttttactagtaacagaaacgccctttgccacttatatgaagctggaacaatattaatcaaatgacttattatctgagagaacaaagtacagaaatatttacataacatagtaccataggcagaatatccacgttaaactaatgttaagaacgacaaagggaagatacgccagcataatacatcttacttcttttccaataatacaactgggacattgcaaatacccaacttctagaatctgtcaggaagagtaatctacatgtatttaattctctcctgcacatgttgaatgactaaattgtgaaaatatatttgaatgcttttttttagaaatcactatacttctttgttaggttacttaatttttagcataaacccaccaaatcccatgtcaattgttaaaaatggatctattcaagcctacagtataaatttatggtttcccaggaaatcacaggaaagttgttgtaaaaggtattaaaattattgccaataaatcccatgtttaaaaatattctattaaatgtaaatgttgaaagtagtattaataacagctatgttcaaagaaaactttaagggcaaacataaaacaatttacttggaaggccatattacaagattcaaagatttgctagattctttgaacaggtttcgatgggagatgatgatcttgtgatctgtagataagagactctgaatatcaagtgatcagaaaccaaagcagagataaggctactgaaaatagcctatttcctgtgctggtctggacctaggctttggggtataggcaggcctgataccagaagtccgatgtagcaaaaggaatgaaggaaaaagatgaagagacaaaaacatgctgacactgtcattatttctacaaatgtcaaaataaaattcaaaatgaaatcgattttttaattataaaaattcttctgagaattgtttattttcccctccagacataagtaaacttaaggcaaggaatcatatttaccttctgatatgcttcacatagaatttgccactttttatcagcaatattaaaaatgattatgtgatgaatagctttcagtctatacgccctgagagcaggcaagaaaaattattcaaaaaaacaaaatgcttctcactattaaccaaaaaacagcctatgaaaaggcacagtcaaatgatcttggtcaacaaggctaaggcacccattcattatttattgagggcttattgggtataaggacatctaagaattattcaacgtcaagtgttgtgggccaaaagccacaagagaaaaggattttcacttccaagtccagcctaatagttccaatcttggaaagaacgagagaaataacagaggaagagaaaagaaagagaaacttggaggaggaacaaataaacagcagacatgttgttactggagaagacaaaaaatgcagtgagaagatagagacgtaagaaccgcgcaggtacatgcatgtatgcatgtgtgtgcatgtgtatgcatgtgagtgtgtgtgtgcatgagtgtgtgtgtgtttgcatgagtgtgcatgtgagtgtacgtgtgcaaatcaagagacacaagcacagggctgcgtgtgcaatgcggctagctgcgtcatgcctccggaagtacaaaacaccactatttatttatttacgcctctggaagtacaaaacagcactatttatctatttatgtattttgagacggagtctcgctttgtcgcaatctcagctcactgcagtggcgcaatctcagctcactgcaacctccgcctcccgggctcaagtgattctcctgcctcagcctcccaagtagctgggattacaggcgcacaccaccatgcccagctaatttttgtatttttagtagagacagggtttcaccatgttggacaggatggtcttgttctcacctcgtgagccgcctgccttggcctcccaaagtgctgggattacaggcgtgagccaccgcacctggcctaacaccactctttttttttttttttttgagacggagtttcactcttgtttcccaggttggagtgcaatggcacgatctcagctcactgcaacctccgcctctcggtttcaaacgattctcctgcctcagcctcccgagtagctgggattacaggcatgtgccaccacgccctacttatttttatttatttatttatgtatttttagtagatacggggtttctccatgttggtcaggctgatctcaaactcccgacctcaggtgatccacccgcctcggcctcccaaagtgctgggattacaggtgtgagccaccgcgcccagcccactctttttgagggtagggttcacaactgtgtatatgtaaaatttttagtctcaagatttctttaaagtggtaaacagtcatgctgcagactcataaactgtgtaaattcatacaaaagtttagtaaatcttctcaatcccgtttgtataggctttcttaagtgaaacaaaggggcagaaataaacaataggtaatgataactgtggaaaagaaaacaggcagcacagcatgaggaaaggacgagcacagggaagcccaatgggtcagaatgatgtgcaagctcggtcttgcctggttcaacctcatgaacaagagaagatcagcaaacgtgataccccagccacaagagtaacactgataataataattacgattctatcgtcatcattcatgtggaggtgcatgccaggtgctttcgaattgttaaccacccacaagaagcctgaacacctagagttctcctcatcgtgtacataagcaaagggaagggagagagagtctttaattggccccagaatatacagcaataaatggaggagctgaggagtaaggccaactggttctgaaatcctgcctgtggtgtctggctgtaaaactctgactcttgcctaagctgaagtctagcctgggacctgaagtgcagcaactctgactgaagctggatggttactctacttccagtattgtgctcaatgaagaggtcagtttttgagcaaatacacttgactctttgagggagttaagaaaaatgaaattgaaataaagccagaatatacaccagagaaaattttggtgtctattttcctgaaatcacacaatctatcttaaaatttttacaatgctcaaaggtgtttcatcattgcccaccaacttctatcctggtaggtaccaggaaattatcatctctcaggtttcaaataaagcaggtataggccagctgttcttgctcacagtgatactacaggcagtcaaaaaataaattcgctgatgaatgttacctcctagaacttccacgcgtgggacttacacactgatgcacgagtttccattggcatttttgacagcatctatactcctcttatatcaacagaatatgtccagaactactggctttataagagtcgagttatgcagttgctacacagggtcattttgccagtcctttcattcaaaaccatctttggtgactcccttcattgagaacaagatgcaaagtcttcaggtgttcacagtcctttacgattccctttttccacctatttcttgctatactttcccctttcagtatccactcttttctcatcctcctcctctctgctgcggcctctcctacttcacaaacaccagccacagggagcttgtttctaggtcatgcttcatattctcctgcataactgcatgttctctgggataacctttcccctacagcatctctaactattcaggaagctaaccttgtggaaggtccattcaaattatacccgtcttacaaatcctgctctatctcttgctgttgtttggcaacactaggatcctttactgtttgtcagcctcatcctgtttcccggcttctgcaactgtttttctcagtacagtgcagagtcccagagtgcagggtcctaaagcgcagggtcctagagcacagggtcctagagcgcagagtcctagagcacagggcgaacatggttatccacggtgagatcttcttcccctagtacctaccacagtctcccatataggagacattcacatgtatttgtttaattttatgaacaactgtagagcttactctgagaaaagaggtttcatactgacctgtaattggatattctctttctggcctagtatataacctccctgattcaggctgcggctcagagttcttcaaagagtaagtacagttatcactgttgaaagtgactctggctgtaaacatcaaagacgtgatttctaatgttgttgtggctgaaactccgcttaaacactagggagaacaacaagtccacagaagtcacatgtctgttcattaaacgcacaggaagaccttgaactaaacccttcacaaaacatctaacacagagcttgcaatggtgaggagcctctctctcctgcacagccagtgaacaatctaggcttggagagacagagagaagagcaagagcattctaataagcaggtgtctgtgacctcctgagtaaccaaccgtgaaaccaagagataagtacagtcatgggtcactgaacaacgaggacacattttaagaattgcgttgttaggggattttgttttgggaacaccacggaagggacttacataaacccagatggtacaggcgactccacacctaggctctatggggcagcctgctgctcttggctacaaaccggcacaacatgtttactgaatgccttaggcaactgtaacacaacaagaaacatttgtatatataaacacaaaaaagtaaagtaaaaacacagtataaaaggtaaaaaatgggacactcgtctaggaaacatggagtttgcagaactggaagttgctctgggtgatcagggagcgagtggcgagtgaatgggaagacctaggacatgactgtccattaccacagacttcaccaacactgcacactcaggctacgctaaagttagaaaaaaacatttcctttcctctgtgataaattaactttagcttactgtaactttttttactttataaactttttaactttttgactcttttaataataccggtttaacacacaaatgtattgcacagctacacaaaagtattccttcttcatatccttactctatatgctgttttccaccttaaaaaaaaaaacaacctttaaaacttttttctttttttttgagacggtgtcatgctctgttgcccgggttggagtgcggtggtgtgatcttggctcactgaaacctctgtatcccaggttcaggagattctcctgcctcagtctcctgagtagctgggattacaggcgcatgccaacatccccagctaattttttttgtatttttagtagagatggggtttcaccatgttggccaggctggtcttgaactccgtatctcaggtgatttgcccacctaagcctcccaaactgctgggataacaggcttgagccaccatgcctggcctatctttaaaacatttttgttaaaaagcaagacataaacacacagtagcctgggcttagagagggtcaagatcatcaatatcactgtctcccacctccactcacatctggtcccactggagggtcttcagggacaataacaaacatagagctgtcatctcctgtgatcacaatgccttcttttggacacctgctgaaggacctgcctgaggctgttttacagttatctgtttttttttctcaaaaataattagtaggagccaggcgcagtggctcacgcctgtaatccagcactttgggaggtcgaggcaggcagatcacgaggtcaagagattgagaccatcctggccaacatagtgaaacctcgtctctactgaaaatacaaaaattcgctgggcgtggtggcgcatgcctgtaatctcagctacttgggaggctgaggcaggacaatcgcttaaacccgggaggtggaggttgcagtgggccaagattgtgccactgcactccagcctgggtgagagagcaagattttgtctcaaaaaaaaaaaaaatagtataagttctataaaataactataaatacacaaaccagtaatatggtcatttttctaatcacgtactatacataattgtatgtgctggacttttacacaattggtatcgtagtaggctcattgaccccagggtcaccacgcacacgaggaacgcattgtactaggatgttaccatggcgaagacatcactaggctataggagcttttcagctccatgacaatcttatgggaccacccttgcagatgtggtctgtcactaactgaaatgtcatggggcacatggctgtatacatttttttactgtatttgaatgatacggacaattactgacgaccaaaaatagggaggagaggaagaagatgacatggaagtaagtagaaactatttctgaaggagaaaaacttacatgggaaaaagactccttctttgtgccatggatttgccagttgacatgactgaaaagcagtcacccaaacaatgaccaggaggaccgagtgctgctggtgaagcccaccagagaccagcggacggggactgctgctgtgttagcgaggggaaaaacagcctaggacactgcccaccccatcttcaagggcttccctgactctagcaaatcataaaaaccaaaacccataaatgatgaggccaccaagtcataaagaagaagtcaaacccaatcattacccttttgttagatagtatggaaggagacagtgtattttaactgattctctttttttttaagacagagtcttgctctgtcacccagcctggagcgcagtggcacgatctcacctcactgcaccctccgcctcctgggttcaagtgattctcccgcctcagcctcctgagtacctggcactacaggtgtgcaccaccaagcccagctaatttttgtgtgtgtgtgtgtgtgtgtatttttagtaaagacagagttttgccatgttggccagcttgtcccaaactcctgacctcaagtgatctgcctacctcagcctctcaaagtgctgggattacaggcatgagccactgcgcctggcctaaactgattttcattctactagaattaatgttctcatataaagaattaagtagtcagctatatggaaaagtgaagctttcaaaaataacccattccctattgatctagccagcttcagatttataatagcaaacaggataccaaattataacgagaccacaaattcttatctgcagaatcctcatgtccatggagaggtaaacttaagtctcttcaaaatctgtaaatactattagctaattattctgaaactggttgctgatacattttaaggtttctcttaaagttaactcactttctaagattctaccactactggtgggggaaaaaaaagcagtttttttgttaacgtataatgtttccattaagtggaaattcaagggcaggcagatgctatctcttaagagttgagcattttgtattaaaattaaccagcatgatatttggcatctcactgggatgcaaaagggaacattatttgctgctgcgtgccattagtgccagaaacattttttcataaaatgaagagtgcagctccactaatctattagtcctaagccattttagatcataccattgattaactaaaatatttttttttcaaatgacggctgatgacagagcactaccttaaaagtcaaagaactataaattaaacatgaatccagttaccatgttctgtcaaaacaagaaatacatgcgtgtgtttgtgtcctttatatgggccaacataagcttttcctattatttctggaaatattcagatttattagcacacataaaatcctcagactgaaattattataacatttatttcaaactgaaaaaaataccaaaggagtaatctggggggcttggtgtctcatggtggactcctatttgcttttgccccttttcttctttgggtcttaccttccagcatgcttaaacttctagttatagaaacccatggcaacactcactgcccagaataactatgtttactcagataatgaaaagtggtgtgataaccttatctcctgggataattaggttatgtccaaaaagccaggctccttaaagatccttttcaatgatctccatgcttgatacagggcactgactttactacaaaaatatttaaaacactgtggcttttcatactttcacaactttttattttatgttcagctgctactcaaaaaactaactttgtgcagtattccaaccaatacatcatcacataaatacatcttttacacaagcaagtgcacttgaagaaattccagttgaaggcatacaagaacctccaaggttacccaggaaacctattctgacgagttatgtatatgtcaaaacacatgagtctacatcttcataaaactgtgtgactgagagtgcatcaggggttaagctacgtaaacaaacaaaaccagcaataatggcaacagaaatattcacaatattggaatcaaaagtaactatttgtgacatctaatgttgattggttatccataattttttaaagccttcatattaaaaacaacgaaagaaaaatacatgaaccaagtatactatgtaaaatggataaatgaaagcagagaaaagaaagcaagcaagaataaatatctactccaaaacccaactctaaaatgagatgcataggctctttaaatcacaaaatctgtgtggcttactaatggaaggatccttagagatcatcttgtccaatctaccttccaacgtggaaatttattatccatcatacctaataccaaactgacgcagtccagcagaaacactccggcctgagggtatgcactgattccattgttggacagctagctctatttgttacagcccaacttttgacggatgtgtaagacttgaagacattaagacccagaaatgactctatgattatactatgattataatgactatatgattatacctcattataattactacagcctccataaatatatgctactcaaagtgtaaaaagtcacatcaccagaagacaaacataatgtgaacccctatcccaaggataatttatctgccatatgcacaaaacccagtctcacgatattcgagtctgggtcctctctgagaaacagacatcaagatctgatgacatgtgcaagaaatttattgggtgagacacctgtgaaggaagcggggatggattctttggggagttgcgattgttttgtgtcttatgtgtggtggaggtaaaagaagttatgcctatgtaaaaacacatagaactgtgcaccaaaaaagttaatttaactatatgcaaatttttaaaattagaaaatatatatttaaaaatttggagggaggtgtaggaagctgagaagcatcagactgggatacagattcaactctgtgaaggaggcagtggcggcagtgggggcggggaaggaaggaaagaagggacgtagggaaggagggagagagggagagagggagacggggaaaggaaagaagattttaaatatgtgataacacatgatgttccaaaaggtgaagaaaaacaagccatctcacagattgctggaggcagtctacaatggtaaggctaccaagaaggacaagttggacagctctatcaaaattagaaaggcacaagccctctgatccagcaattctacttttaggtatttacatgacagaaatatgtagacatatgtaagatgatgtgtctataaaactactaattgcaagattgcttataacagctaaagctgaaaaaattcagctcagtgtcaataataggggacaagttaagttaaataccttgtgttccattcatttaagggaataccatacattcttgaaaaatactgatgctcatatgtactgatgtagagatatttccactgaatgaaacattgcaaaaatatgctatcatttgatcatctgtattaaaaagatatatatggttgtctatgcataaagtatgtctaaaaaagaagaaagcaacgatagcatcagatgcctcttaatataaaggaactggctgtttgggcaagagaagttggtgggaaatgtcccactgtaaatcctagtggaaaattttgaaatttgaatcatgtaaatatattacctgttttgaaaggtaagcagactctattttaatgaagatgaaaaagatcattctaaatgttaggtgaagaatacggttcattagggaataagtgtcaaggcaggaagacctcttcaggaatggtggtagcaaaacagggggtctccgtggggctgacagaccctgcatacatgctaaagatgcagccaacaggagttgatactgtaactagatataatggatcgggggaaggggactcaggctggactgacttttggcttgagtatccagataaacaatgttggcatctgttgagatgggtatgactgagttacaaacagcttagcaggtgtaagaagacaaaaacaagaattctgtttgggacacattaacgtagagatgtttgttagccttccgaatcaagagagtaacagtacatcggagtccataaacgtgcctactgagatcaacagtgcttttaatttgcggttcttcagctgcagtgagacggggcatgcttcttaggagtcctggtcattgtgatgtataacactgtgactatctgttcatcatgtttgctcatttgcctattgggcattttgttccttattatttgtaagtgctgttagcatattcaagaaaattggcccttttatcacttacattaaatggttttcttcagttcatcaattttacttttacattgtttatatcattttccctagaggaactctaaatttttatgtggtcatatttactagtttttctatggcctgtggcatatattcttttcataatcaggaaaaacaaagacaaatctcatcagtaattattaatgtgaatgtaaattctataacataaaaaatacattttatataatttcagaagttttgtagtacttacacaagtgttgagggcattcattcgtcacttttgtagttaacccactggaatatctttaataaagtaataggatttttctttattccttagaaaaattggatatttagggatattcttcaattcaaagctcatgatcaactaaggattctttagaggaatggtacgtattattttttacttacagcattaaaactcagctagagataacaattgtgtttgcatagcttatttttaaaacatgtgggcacagtgactttgtgcaattattttagaaaacaccaaagtagtatgagagacactgctattttttaaatgctactcagcacaactaatgacttataaaataggtaattatttcctttgaggtcagaagtagacttaaatgttacagcagaaagccaaaataaatgtgattggtttttctcaaaatagtaaattagcacttgactcccacctgcacactggtatttatcttcctctccacaactagtaactcaatttgatgcagtagcagggtactgggatgccacacgtggtttaactcaccaaggagacagctgctttgtactgacacccactacacttgtctttaccccaacaactgttcacattaatctgagttaactaccctttggagcaacctgttcaatctcagttagtcgcctactggagtgcacagacacaggtgattgagatttgagggaaccacagtcacactgacagaaatggaatctcacccactgcatcttcagtctggctggagaacctgaaggagctaaaggcttgttagaaaatcctaaagaaccataatcttctatcgcatatgcaaagcctgttttacgtcaaatgattgtcagtggctattaagttgcattcacacaaatcgctaacaaattaatatctgacattaagaggggtttatttcagtcttttgtttttcttaaattataaaatgaattgctcttttatttttgaaacgtgcatacactttaaaaatgaaagtgactcccctctccacccaaccccctcctaattccactctccaggggaaagtgctgttaatattttggtgtacaactttgcaggctcttaaagctgcattactactcatacatatgtatatgtacgtatgtatgaatatgtatgattgatatatatgatgcacatatcaatctagcctgctgtttaagcaaaaatggtatcatacaaaaagttctacaattccatttgtactcaataatgcacaaaactccttccgttaaaggaactacagttctaccacatttttttcttttggtgtcatggtgtaccacaccacgtgcatatcagaatttatgtaaacattctcccttggggggccattccagttgtctctgtttttcataattaacaataatgcatctgtgaatatgtaccaccatacacttgctcatctatttgtgagagaccgaatatgagaagtgaagtttctgggtcagagaacatgtccacttgcatttctgataggtattatcaaatgccttttcaaatggtggttgttttacttgacattctaccaacaagaaagactattttataaggctgcatattcaaaagttattttaaaagcctcattacatgtaagacaccatatggagcatgtcacaagataaacacatcagtactctcatataaaagtagattttggccaggcgtggtggctcatgcctgtaataccagcatattgggaggccgaggtgggtggatcacctgaggtcaggagttcaagaccagcctgaccaacatggtgaaatcccatctctactaaaaacacaaaaattagccgggcgtggtagtgcatacctgtaatcacagctactcgggaggctgaggcaggagaatcatttgaacctaggaggcagaggttgcagtgagccaagatcgcaccattgcactccagcctgggcaatagagtgagactctagtctcaaaaaaaaagaaaagaaaagtagattttaaggaaaaaaacgcataatcacctactaagaaggtctagaaagtgtgattaactctttaaaatctaataagatatgaactctacctccttgaccacccagtgtctaaagggttattcctggggtcagctttgcagaaagtgcttccttatggagtggttgttagttgactttgccagacagcctctgcgttttcattctctaacggaggctggcaagactttgtatagagatagaaacaccaattctagtttgttccttgagaaggaaggccaagtgactggttttctgaggctgtgtgtatctcccaggcacaagcctctgtccccaggagagcctgcacgcgtggcaggacacatttgtggtggggctttttacgctccctgtcatcactttttatgattttctcagtaattccttttctttactgaggaaatgaacacacataaaactggaaaaacgagcaaagaattacataaaatctacacaaggacttcctggcaaaaagcttcactaacataatagatttaagttcttacaatcagtggttcccaggcctttgaatttcatggaccagaattttttttttaagtgaagaattcaacatagaaacaactattatttgttctttaaaaacatttttgaaaacctcactcaaacaaataacctagcaaaactgttttataaaataacgcctggctgggtatgaggactcatgcctctaatcccaacactttgggaggccaaggtgggaggatcacttgaggccaagagttccagaccagcctgtgcaacaaagtgcgacccccatctctactttcaaaaaataataaaattaaattaaaataatgggtattttaacaccaaaaagaagagttttgcctagacagcctcccagacataagaacagacactacatccaccatttccctttttttttttttttttttttttttggcggagggttaaacactcactaatatttaggaattagtcctctgcaatttttcacttgtcctgataaaatccagattttacaaagtttaaacaccacaaaaatcacagggctgtctatagaaggaagaattcctgttactcttagctgaatattcccaataattctttgactttctttctttgtcttatcaaaccaatgagaatctccaggcatgcatgttttaggtcaaattaaggaaacgcccctatgcctgatcctatttggaatttccatttttactcatgtatgtcccacgacaataaaattattgaaaagcaagtgccaccagtgtggatgcatggtctccacaaatccactcttcactgaggagatttccccacatccactaaggtgtgggtcgcctccagctgcagcgccatacctcatgagatcagcagagctcaggctgaatagcattcctcctttcctcctctctactcacacttcctcagaggctatccagcatgataatgaagaacacaggtggtggggtcagacagccactgactacctctgtcactctggatgggtgaccgtcctctctgagtatcacttcctcctctgtaaatgagaacaatactgctcactgcatagggctgcttgtgtgagaacagcacgagcaggcccacatggtgttggaaaaggccccgacgcatagcaagggacaaatagtgctggtgattgacactagcccctgccaggctcttgggcattaggaatccatagtcaagcaatgaaagggtcctgccctcatggagtttacactctagcaggaaagacaaatatttaataatcatgcaaactgaaattagaactctgataggtgatactaagaagggggtaaaggtgttcctgaagcctggggtctgggtctgtctgtggagatccaggataagccaccactcctgaaactttaaagatgagtaggagttaacaatttggcacagggagaaaggagcaggggtccagggagaaggagctcacccttccttccttccttccttcctcttcctttttcctaaattgtaaatgtcacctactctaaataaggcagtgtcttaaagaacaacctaataatctatgtactggtataaaccttaaacaaagttcaaatttactccaatgcacaaaaattcagttaatctctatgaaacaatcaaggatggcattatattctagaattcttctgctggccctcctccaaagcgacatatgaaaagctgaagcagcatacatttagcttgtttcacagaagaatacttatcttctaagtgcacaaagtaaaacattagaaagggattcagtacagaatattaaaactctgtatttttcaactgcctgcactgaggaaagatagaaaatctatcccacaaaaaagtatgagtttggaccagtttgtttaaatttaacaaaacaaagttcatcatggctgatgaatcaatctttgttttgagtccctatttttacgcaaaaccgcactttgcccgacagcatgagctacttgtgaaataaacacttcaagcctcaaatttcaaaggagttataagtatgttgggggcagcaatgcaggaataactttcccaccccctggtcactatcaacttggagaaaaattatttccaatttgccttctactttgtacccttgtggtgtctcagatttcacagtccctgaaggatgtgctgtccgtgcactcacaaacaccccactctggccatctccactttgctacagatcacagtctctttgcttccagtaacttttctctatgttccagggtcacaacccctcctcattatccccaatttccttggggtaaatttctaagaagtgtctttataccttaaatccttgtttctttttaaagcaagaaaatgctggcatgaggtcagatgcaaatcactttgcatcctcaaagcaactaaatattgtcccattgtagagatgggatgtccttaccatagtgacagtgacagcatactctctcatggctccctgcagagtccttggaagcgatgtgacaggttttcataaagagggaagagaaaaggacttaaaacactgcctgcaggagcctctacacccttattactttctgggttattgcctcatgaggaaaaagaaattcaatcatttgtcggggggaaaaagtgtgctttttcttttcaaagtctacccttttatgaaatatttaagcaaacatttatttacttctaaaccaccaggaaaagaaagaaaagcaaccaacatttaacttcacagaagaaataaacatttcactaactgttatacctttaaatttgttttgatatacagaagatcatgaatacagtcatctatattttcctagtcagtgcaacaaaaaataacactcactaatagatcagaaaatggagatgacaacacttaattccagaatccaggaattttttcccatagtttcctgtaatccctttaagactctaaacaaagtattctaccttttttctttaagaaaacaaaacgaatttcatgcttatttgatatttctaataaatgattttaataatagactaagccaaaaaggaagctggtctatattcattaagaaaaatgcaaccataatcacatttcgtgaatggacaactttcacatatccacactctcaatgcctacaaagtttaaatggaaagatggatcgttcaggaaaagcgttgagagcagcatccagacctcagcactgccctcacactgagcccttcaaaaggacggcacgaggggccaggtgcagtggctcatgcctgtaatcccagcactttgggaagccaaggagggtggatcacttgaggccagaagctcgaggccaccctggccaacatggcaaaacctggtgtctactaaaaatacaaaaattagctgggcgtggaggctgaagcaggagaatcgcttgaacccaggaggcgggggttgtggtgatctcagatcgcagcactgcactccagcctgggtgacaagagtgaaactctgtctcagaaaaaaaaaaaaaaattagccaggtctggtgacacatgcctgtagtcccagctgctagggaggctgaggcacacgattcatttgaacccaggagatggaggctgcagtgagctgagattgcaccactgcactccagcctgggcaacagaatgagactctggctcaaaaaaaaaaaaaaaaaccaaccaaccaaggatggcaccagggaccactttgtagggtgtaaacaacaaattgctcagcataagaaccattttgaaaacacaatgaaggaaaacctgagatcaccatgcttcactgggtctccagggcccagacagaggtgacgcaccaggtgtgcgtgacgacgtcaccctacaacctttagtccaccttcatgctccagccactgcctgcagctgcgcccagacagcacctgactgcagttgccgtgcctcactcactttccgccttcatatgcctcatacactgccagctcgtgggacgcccatggagactgacttagccatccggctcatacacaagcctgggggagcaaggcagctggctcagggggtcaggcttgactagggagaaccagtcttttgggcagatgcctttgaggcccattcgtcacagctccttggaaggtctgcagcagggtccacaccgggtagcttgttgaggtgaccagccgcacaatcagggacttccgggcatggctccatgtcttgataacatgccagtggctagaacactcctgagcaaaagtatcctgtcagcagatcacgtgttccctgagaaataaactgctgctgagaagctactattaataacagatggcggacagtttgctgtgatacctggactgagtacctcggtgcctctgctgtctctgggccatctggatttctaggtgtgactgtggcagacgtgtctcgggtgcagaggaaatggaaacaagatggtcctgcttctgaactcggcctcatgccctcatgccccaagtctgaagttcttttggtctcctcttctgtacttctggaagcttccactagtctcttaccatgctcacatgaactaaaagccagatgcctaaatgactaacatgataaaagattggcctgtaaggccacagtgacaaatgtcacctgaaagacgaaggggaaataatttgcattgaagggtgcgcttgcttatcctcaccccttggctcatccaagtagcagaagagtttgggttgcatgaagcttccaaccattcaatgcaggctgagctccacagcagtgcctaggggagcacagctcagattgtgctgagagccacctctcttgtctcacaggtcccatccctgggctgaggctctttatcgaggaaagaaagaaatgtcctgtctggcctcacacacctgaaagtcgagaagcagaagaatggccgggtgcagtggctcacacttgtaattccagcactttgggaggccgaggcaggtggattgcctgaggtcaggaggtccagaccagcctggcatggccaacatggtgaaaccccctctctactaaaaaatacaaaaattagccaggtgtggggccgggcgcggtggctcacgcctgtaatcccagcactttgggaggccaaggtgggtggatcaggaggtcaggagatccagaccatactgactaacacagtgaaactctgtctctactaaaaaatacaaaaaaattagccaggtgtggtgacacatgcctgtagtcccagctacccaggaggctaaggcaggagaattgcttgaacccgggaggcggaggttgtagtgagctgagatcccgccactgcactccagcctgggcaacagagcgagactttgtctcaaacaaaaaaaaaaaaaaaaaaaaagaagcagaagaacatgtctcatgcacacttgtgcttcctgccccctcccacacccaagggaggaggatggtgctcatgcagaagacatgtaatctcttcttccagagttttttgttttataccagcctatctcttacttcccttgttcggccagcaggataaaaatcaatggacatttctatcgccaacctgctgcagctgcttctcagaaccaccatccctttatgtagaggaagagagaggcaatttaaaatggaaaagggagaactgcgaagaggaaggaccaaaggtgacttctccctttatccttcctgaaggccaaaggttggagacagtaaaaggaaactttgctgggtttgtagaggcaaagagggatattatggacttgaaagaacttttcagatgcggttggttacaagaatgaaaatcaggcagcaatgagccaaggacactcagcaatgccatcagcagtacttaattccacaaatagagttatcaggtgactataaggtactcagagaaaaggttcatattttagatataaaaagatttatctcttgggtctaagaaactacatatttcaaagagaagaataatcagcttataactaagaagacagactcaagaaatatgagcagtgaagaagataaatggggaatactgaaagttttttgaatttgcatatttaagctggtgataagaaaataagaattgtgttatttcatcctttgacgaaagcgtccatgcatgaccactccttccataaggaagccctggtacacacagagcctagattatccactgataaccccacaccatctcaacgaagctaaataaagatggagaagaaggggctttccacctctcaccagctggcctcatccagtgtcttcaggaaaaccagcctcctaggctttgactggacttccccatttgtgagatgagggagaaaactcaatgacctctatatcctcttcccactctgcaatgtggtgactgaatcgcatgatggatgattacatggcctttacccaatcccctccttactgttactgtccatctatttcgtctttcctgcctcattgtggagatgctgcaatgtgccactgtggctgtctggactacatttcccagaatcccattctctccatgtctcccattgtggtgcactataaataagagaggttcttaggtgggatctggaagatgggctgaagcagccacccttcattctgcagcttacacaggctgttgtcatctacagcctgggcgttggcatcaggcaacagctgggcctgcagctgtgctgtgtcccctggcctttcctcaacatctctgacccagggccaggtgtgcttgtttagcaccctggtggggaaccctggcttctgcaagaccccagtaagcccagaggcaacaacagtgacacaagttccagcatcagggttgagattttcttgctctcccccacttcatatcaaccttctcttctccagagcctgccatgtggacttcaagctccagcatccaatgtgagacaacagccttataaacactgcttgatcagccctcacaattgcagaaggtcaaatccctataacaaagctgcttgtatatatgatcagacatatgtgggttggaaccttgaataaacctcttaaatggggattgtaattgtgaagatctcataggatcactgggtggtttaagggagatagtgaatgtaaagttggcatggaatgcacagtaaatactgtgttattattaactaaaaatcccagttaccctgctgagaaaatctctctcattttttcatagctgtagaatcaagcgaagtaggcattttgcctatgtcgtaccagggactaagctaacagaaccctggctccactctaaacctaagagaatctaatcctatttttattagagaccagaacatagtagctaacaagtacttaacctctccctccaaggaaatgatggcgaagccaaaaagaacgataccaaactggaaaccattgatttcagtaagatatttcactgtcactgaaggaaaacatcattttaatggtggagtttgatatccacattaaaagacagttaatcgagagacatcatacaatagagctatttgggtagagtacttggtgaactgaaagcctaatacataaattttcctctttcagctcttactaatgaaaaaagttattcaaagaagtatttgagatggacttaaatatcaaaaccatacttcttacttttttaaactacttaatacatatcgtgttccaaaaagatctaagtatacaaaattagagtttttctcatcagagaattaaatttaagtccatcaagaaacctcaggctttctgatctgtacagcactttttggtctttttatttcagtctcaaatattttgaaatggtattaagttgtgtccaaatgacacagtgggccagtggctgggggagggaggtgagacctgaatgccaagagcttggggaaccattgtttcccactctattctgatgtccaagctgacacccacagcccactgactgtctcacctccagtgtgccgtgtgagccacctggcacacacacacttcaaagccagatctcagtgtgatacctaaagagcaaacgtcatcttggtcctcagagccatgagcccttgcagattctctgccagtgtcatctttctttctcactgtcactcaattttaaaacactgccgccaagtgttgttcatctttccctgatggcactcagcaccatcaccgacgtccacaggtgcttccagacacatctccactgtgcctccagcctcctcaccaggttctcaccatcccacacctggacagcctgtgacacagccggtccggggtcaccaactcctgccccctttccatacattcattcacatatgatctagtcccctcccacatacacttcactatactatctttcactatataaacctttaatgtggccaggtgcggtggctcacagcactttggaaggccaaggtgggtggatcacttgaggtcaggagtttgagaccagcctggccaacatggtgaaaccctgtctctattaaaaatacaaaaatagtcaggcatggtggcgagcacctgtaatcccagctactcaggaggctgaggcaggaaaacagcttgaaccccaaaggtggatgttgcagtgagccaagatcacataattgcattccaacctgggcaatagagcgagactcagtctcgggggaaaaaaaagaaagaaaaaaacagtatagattaaaatgattgattgtagagaattctgctggtagaaaagtaaatttatacttgcatgagtaacttctacattctttgtaatggattttacataataggagcaggtattttgtgacagtaataggcccactcaagcagctggatatacagctaactctttatcactgttagggctgaaatgaaacttggtttacttcttacatggaaaaaaagtccttttcccaaatatcaaatatataaacttagattcatttagaaaagttgactcctcagtagataataaatgtctcagatgaaacaaatctctctctctctccttaaacacatacagaataggaaaggcttatacacatgcgtgcaaattctggctcctcgcaatgatcctgagtgtgttattttccatttaagccttggtttttctccttctaaaaatggaagcaatgatatctatgtgacaaagctgtagagaagattaaattagacataataagtgcctagcagaaaagagacactttagacgcaattgataaattgtagccataattatgtatatgaaatacttgtaactataagcccattttccatgttgtttattccttcaaggctacacttgtatttgaatgtctatctgccactgtcctggtttacagcaaaatcaccttataatgaagaaagaggctgccatgtttcgaaacctcctttaggtggaatccaatgggaaataacttataaatacatatttttattgtatatgtaacagtatatttttagatttatcttagtgatgttgtaatggctaattgtataaattctgaatcagcctcacttttccttttaactcagttcatatatcaactcttcagccaatggaaatctcctttatagggtgtggcataaccattaacctccctttgtgccccatgtaatttgactataataaatttcactatactgtcactgctttgtgcatagtagatgctcagtgaatattcagtgaatttaaacttggcaagtagtcaaagagaaagaaattattttaagtaactaaacttaacaaaacacctaactacgcttccggaaataggtaaaagaactaaagattacataaagtatcaggtgttagaagtctagaaaaacataattctccaaattgtgattgtcaaaatgtgagcccagagataaattcccatgcctttgcatatgagcaaattggctctacaatttttacaaaagaactatggctctgcactgttggactcaaacgccctttgtgctgcattttcattaattcaaaacacttagaatcattttgcagagcagctcattttgtgcagcagagggaggccatgaattatctgttgtgcctgaataaagctctgcaatgttgagccgtgtctttgctgagtctaggcgcctccacttcttacatgccatgcgaatgacacagtttgaaaaacacaaccaaatgtacacagtattccatcttctacgaaaagcataaggggggaggaggaaaagaggttggttaatggaagtgagtatagatagaaggaatatgttctagttttcaatagcacagcagaattcctatagttaacaatcatttattgtatatttcaaaatagctagaagatttgaaatgttcccaacacaaagaaattataaatgtttgaagtggtggatattctaaatgccctgatttggtcattacatgttgtatgcatgtaacaaaatatcacatgtacccataaataagtacaattgttatatgtctatttaaaaaaggaaaaaaacaccatttaaatagaaaacaacataaaaagaatgtatacatcctttacattgatgagatctctaaaccagttgtgttcagttccacctttgaaccctcagaacaagggatttgtgcttattgctacttacttgactctacctggtgttcagtctattgtgtacaagtctcctgtacatcttatccttatacccaactctataaattgtaagctccctgaagaacggagctttgtcctgtccttcctgacacaggcaacactcaacatttgatgtctatctagtctacgtaactatctcttccagcagaatcattttttttctttctttccttttttttttttttttttttttgagatggagtttctttcctttttctttttttttttttttttttttttgagatggagtttcgctcttgttgcccaggctggagtgcaatggtgcgatctcggttgactgcaacctctgcctcctgggttcaagcgattgtcctgcctcagcctcctgagtagctgggattacaggtgtgcaccaccacgcctggctaattttgtatttttagtagagatggggtttctccatgttggtcaggcttctttttagaacagtccataaactgccgcctttaagtgactgaatcctggaaataagtgtcaaaaaacctaatgtgtatccatgaaagtattacagtaaataacatgtaataatgtgtatatgagaaagaaattgtattattctgtaaggtaaaatgaggtttatgagaattggacagtagccgttaactgctgttttattatttatccttcatgtataggcaagatgctactgaaaatgatcattgtctaggtatgactgaaaaaacaagcatgttcattcattcgtttgctcatccatttattaaacaaatattttaatcatttcagcaacatgtttgtgttgctgccaaagagaaattagattctaacatgttcaacttaaaaagacttcagtggctccctgttgtctctgggagtaagtccaggtcttctgcgggatacgtaagttctttcctgatctggcctctccctgtttccctgtcttatctctcatcacgcccctacttccaccctttattgttactgtcttgtttcacaccctccatgcctctgtaaatcttgtctctgcaaggaatagttttcttctctctcctaactcctatatgaccttaaagacttacctgaggcaactctgtgccctggtaaatctttcatattattcaaatctagagcagctgttcctcctctaggtacccacagcatcctgggctttcctttgtcatagcatttgtcacacctcttcaaatctgtttctttatctctcttgtccactagactcttgcaggccgtatgatactcttatctgcatgcccagtgcctagcatggtacccagcaaattgtaggcaaccaatacatatttactgacgactgaataaatgtggagactggggcaactatgacaaagagaacagacaattaactggaattcaggagacccggacactgtcttcaaaggttgaaagacttttggaaaattaatctttttgtgcaactcctggcattagctaaggtggttgtccaaagcattccttagctctgtggctacctgacattttctaaaagtgacaaagttctaatgtgtctctagccgagaggaacagttacagttggcacttaaaaacattatttgtttgcttagggagacattctgtatcttaatttcagactacttatgacaggtctctgatacaatgtatggagtgtcaaatatatcatcttttctaggttttaataaaaagaaaaccttaccaaaaaaaaggttgccttgacaatatatctatagacaatatctgaattaataaactgaccatttattttcttttctagttaaggatgccatctagaacaaggacttggtcatgacaattggaaagccatccaatggttcatggctcatggcactcatattagcaaaggtgggttcctgtcatccctaccctgcccttctcagctcaggtgcacatctcctcccatcacaccaaacagccacaaacagcctttctcttttcttctttttttttttttttttggtgacagagtttcactctgttacccaggctggagtgcagtgcatgatatcggctcactgcaacctccacctcctgggttcaagcgattcttgtgcctcagcctcctgagtagctgggatcacaggcgcccgccaccacgcccagctaattttttgtatttttagtagagacggtgttttacatgttggccaggctggtcttgaactcccgacctcaggtgatccacccgcctcagactcctaaagtgctgggattacaggcgtgagccactgcgcccggcccaaacagccattcttactgcacgtctatatggtggagttaactccatttctcaggaagacggacggaatgagtattctcaacagataacagattttcataggctgtgaaaccttagtaatttgaacaatagaagaatgacctaagtcagtagagtctcttttcttacaatggcttaagtgctttcagacacaaagaactaaataaggcatgctaacaaatagattggctggtgaatccttatctttttcttaatgaatacacaatatgtaattgatatgctatctgtatataacttgaatgtattgaaagaagggccttaaatgtacctcaaaaactatgtttctctaggtatatttaatattatttcttaaatactattaattttattacttacataataaagatgttttaggttgggtgcagtggttcatgcctgtaatcccaacactttgggaggctgaggcagaaggactgcttgaggccgggagtttgagaacagcttgggcaatatagccagaccccatccttacaaaaaatttgaaaaactagccaggcatggtgttgaatgcctgtagtaccaacaactcagggaggttgtggcgagacgattgcttgaatccaggagttcaaactatgatcacacctctgtagtccagcctgggcaacacggcaagactctatctctaataataatagtaataaaaggtgttttaatatccctcctcccccaagctccaaaagataaattctaaactagtggagtttggatcagtgagggttgatggggaaaaatgtaaatatagcagtcttttcacttcaggccaggcctcgtgaaatccatatctttaaacttcattatgtttctaaatcccttttttcctttttttttttttgagacacagtttaactctgtcacccaggctggagtgctgtggtgtaatctcggctcactgcagcctccacctccctggttcaagcaattctagtgcctcagcctcccgaatatctgggattacaggcatgtgccaccacgcctggttaattttttttttttttttttattagtagagacgaggtttcaccacattggccaggctggtttcaaactcctgacctcaagtgatccgccctccttggcctcccaaagtgctgggattacaggtgtgagccaccgcgcccggccatgctcctaaaactctaacctgtgactctggaatatgtttacaaggaagctcaagattgaggacactgcaggccatctcaaaatgatgtcagagggcagaaccaacgcttacattaatagaattgctggggcactagttgccttgccggagtggcacccttgaagataagaaacaaaatgacagctcgcaccaagtattcacccttaggccacacagataaatgtgcagcaaacctcttcaggctccacttgtctggagaaggagacacatgatatattgatgtaatgtgggaaaaagacgaattaagtaattttaaaaattattttaataggtcatctatctagaaagaatggcaaagaggaagaccagggtgggtgggcaaaatgcaccattttgtttgttaagcaacatcttaaaaggtgcagttaaaatatatgtacacttcctcaaattaagcaaacatcatcattaggatatttcagatactgaaactgatgagaggcatcccacgcccctcttttttgagacaaggtctcttctgttgcccaagctggagtccagtggtgcgatcatgtctcactgcaaccttgaccttttgggctcaagcgaccctcctgtctcaacctctgaagtagctgagaccagaggtgtgcaccaccacacacagctactttttacattttttgtaaagatgaggtctcactatcttgcccaggctggtctgaaactcctgggctcaggccatttccccaacgcctcccaaaatgctgggattacagctgtgagccaccttgcctggctgaacagtacctcctgagatgaagcaaggtgtgggcaggcttcactaaagggcagcattacaacagggaaatagtcatgcgatatgtctaaagcaaattatcatgcctaataatatttctttcagttgaataattacaattcattatggctcatttcttatcattaatattttcatttaaaattataaatgagatgatcacataaaatgaaaaactgactttaaagttaaaataacacacgcttttcctcaggaaaagcgtgatcccagcattttatagaattggaaaatatttgggtgatgatcaaatccaatatcctcatttcacaaatacataagatactcaagagtctaaatgatatttcaattttatccaactagtttggaataaatccagcagaaccagtgtctctggatccccaacccagtgtttccagaacaatattctgtgttacataattttatatttatttggcaaactacattttaaagttaaaggatctaaatatagaaatagtttcgtatattatctttcttaatattaaaataaaatagaatatcttgtattgtatttggtggactgtttttgaagcatcaaatttatgtattaataactatggatcatgtattattattcctcaatggcgaatttggcaccctacagaaaatagtcttcatttctttttttttttttttttttttttgttggccggggggtgtttttttagacagagtcttgctctgtcacccaggctggagtgcaatggcatgatctcggctcactgcaacctctgcctcccgggttcaagcaattctcccgcctcagcctcctgagtaggtgggattacaggcgcccaccactatgcctggctaatttttggtattttgagtagagacggggtttcgccatgttgggcaggctggtcatcaacccccgacctcaggagatcttcctgcctcagcctcccagagtgccgggattacaggcatgagccaccgtgcctggcctatgttccttcctttcaaagaaacattcatatttgaatgacttgactacatagaaaccttgaagaaaattccaaaatgtaggaaaattacaggccatgataacataatttaaaacataatctaataaaagtataaccaagcaataggaagatagtttagtatttaaaccatttgaatataaaagccttttaacctttggtcaacagagaaaatccaattatatttaccattatctaaacgtaaattaagtgggaaaatacctacaatgtgaatgttgatacagctgaactcggaggatccgaacagctttcagatattgaaaggagagaagacataacctaaacttacccaatgtgggtaaacaggagggtgatggggcaagtgaagaaggacaaggctggaacatcatgctaattctaagtcagattacaaagtgtttcaatgccgtgcaaaagaaatctgaattatttttagatgacaaaaagagcacatcagaattttttaagaagcagagaaggacttcttggcaacacagctgactgaattgagaagggctcttcttcctgctccaggcagaactactggaaagagagacagagaggacacagagagagagagagagatcacaaaggcagagaggaaggcaggctgacgggaaactccaggggttggaaaggcagagggaaggccaacccggagtggtgagaacaccagctgactccgcatcagcctagggtcctggtcccagaccctgctgtcaaggctgaaggatggagctgagcatacttgctaatacgagacacgtgttttagggcctgcaagaggcagaaagctagatctgagaatctgtgcataagccatgaccctggaagacacacttggaaaaggggtttacaaaacttcacccaaataagtggcaatgaagcccagggctctgggaggataaaaacacacaaaaaatgttataataaaagtagtaactaaaacagtgacatactggcatagggaacagataatagatcaatggactggaatagaagccctacatagatatgacatcttggtgtacgacagatacagcattctgtattagtagggaaggatagagtcctatataaatgagacctaaatgtgaaaagcaaagtgttaacatttaagagagaaatataggagaatgctttgtaacattagtataggaaggctttattttaaaagttcatgaaaaaaagaactgatacatttgtccccactctatttaaagcatctgcacgtttagacaaactataacccaagtgaagacaagccacaaactggaagaagacaccactgataaaagattagtatccaaaatgagtaagaaaactgtagaaatcaatatgaaaattcaaaaaaaggcccaagggaaaaattgaggaaagacagaactaggcagggcacagaggaggtaacctgaagaaccactggccgtaaggaagatgctccacctcagcatgaatcagggaacgctgaggaacatggcaaggctgccccatcttatagccattttattgtggaaaaatctaagattccgaagatactaagggagaggaaaatgcagagcaatgagcacttccataaactgccagtggccacgtaggagtttatttgtatgaccagatagagagaaatgtgtaaagagctactaaggtttagtattcacatttcactggacctagcaacttcgtacctatgttctaggggcactattttcatatgttcaagtaaacacgtacaaggatttttaatgcagccttatttgtaattgcaaaaaatttggcaacatacaaaatgtttatcaacaggacaatgattacatgcattgtggtagtgtcataaaaaggcatggcatgcccctattaaaataagcatactagagcaatttttctcaaaatgttgttcaggaatagcagaatcagcatcacctggaaacgtattaaaatgtaaattcgcagaccccactcaagagctactgaatccgaaatgctggcagtgggacgcagcaatccgtgttttaacaagctcccttcccccatgtcaggttgagagcagttatactggatttacctgtgtccacatggataagcttcaaaaccaaaatctgagccacaaaagcaactatacaatacaattaacataaatcttaagaccataagtaatatatggacagaaaggatatatgccaactttaggagggatgaaggggtaatagaaatagaagggagaggatttcaaatgtacccataatatgtgatttacttgacaaaatgatatgaagcagatctggaaaactgtgagtatttgtcacatcagcgtgataagtatagaggtgtctgctagattattctctgcatttttcagttagttttgaatatttcacaagcatactggcacagccaagtcagtgtttctgtaggataaccacattgtaagggaaggtgtaaggcaggagagatgggaggcaggggcaacaagttcctatattgcttcagttacccagcaaaggaagggagctttaactgaggtctcagttttctaggacttgatcctccatttggtgctgggagtgaagaaaaggggcagccaaagaagattccaaaatgtgcagctatatggaatgaaatctgaatctgagaagaaaatgtatgtcctcattcaatagttggtatttgataatagagacagcaaatggtggtaaggcaagatgaaaatatcactgacaacagaacccttgggaaaataaagaggaagcaaaaaaaaaaaaaaaaaaaaaaggaatgcctttagaggtaggaagaaaaaaggaagcaaaagaatttctactgaagtcaagagagttttacaatggaaaggatcatgtggtagagaaatgtctagcaagctaaagactgagaagagacatgtgatactaggaagagaatttgattattacagtcctccctccagccccctgaaatgcttattttataagagatcttggagaaagtctatttcattatttgaaagattaaatgtgcgatatggaattggcaacagcaaatatggacttaccttctaagatgttctgagacaaaacataaacacaggggcagtaactggtgattaaagtttaggaagaggtgggataaaaatggaatcatgatcccgggtgaaagggtcagctttgggaaagatgaggaattcttgcttcgggagaagaggtaaggaggagatatcaatacagtgggaagagatgacgagatgagtttaggaaagttcaaggagcaaatagctccatccagcaccagcttggaggcaagagcacatcacaggtgccttcatgcccttaagcgcatcacagtggacttaaggggccgaggagaagagacaaggttggcactggagaatggaaaatggggtttgctaagaaaaggtcaaagaatcaccatcccatattttgaggaaattagggacaaaaatattttatataatgagtgagcatagttatttcaagtagcctgatggcagaacaggagagggtaaaaaagacctgggttcttctgaaagtgaagaatgagaaggcaagcactccaatatttgcattatctcaacatacaatgatctggaagatatgctagagccacctccaaaatatactgaatttccatccattcctctttcccctctagttcttcatgctatgatttctcacccagaacaagacagtagcagtaactattctcatttccactatgctggctccctaagactcattctccctagaagccagagtaacttctttgaaacgcaaatcgtatgatttcactcctatgcttaaaaccatccaatggcttctcactgtcctagaatgaaatccaaagatggaccctgggaagcagaaaagatgacaatcaagagttcttcctgtctctcaaaaaaagaaaagaaaaaaaattatatatatatacgcatattccttaaggttaaaaatacccagttcgctccttttgccagcaccatattgacagcctcaaattctattcaatgattttgaagaataaatgtttttataaaacttaagtaacaaaaagatctactacacaaattaaatcactgttaagtgtgaactaggtaaattaactgataggaacacatttacaaggtatgtataggatttatgaaagcctatactctacttttcctctaaaagactgatttttaattatattatttgagtgatcatttgatctatgtctgtctcccctgttggagtgtgagcttcaacaagacgaagatcacctctatctactttattcacaggattatccttggcattctgcacagatccgacatgctgtaggggctcagtcaatactggatggattaccgaataaatgttagttaaattactgaatactcaacgaagtagaacagaaaaggcttgggcagagtcccaggcaggatgaaggactgcagtccaaactctatgattaagaaagtatgagacttgctatattagtcaattttcatgctgctgataaagatatacccaagactgggcaatttacaaaagaaagtggtttaattggacttaacagttccacatggctgggaaagcctcagaatcatggcaggaggcaaaaggcacttcttacatggcagcggcaagagaaaatgaggaagatgcaaaagcggaaatccctgataaacccattagacctcctgagacttactcactactgtgagaacagtatgggggaaactgcccccatgattcaaattatctcccaccaggtccctcccacaacacatgggaattacaggagtacaaatcaagatgagatttgggtgggcacacagagccaaacaatatcacttgcttatgtcacattatctttctaagccttatttatcttgtttagcaaatgacataacatgatctgcaaaagcaaatgaaaacgctgtagtgtcccattatcataagctgtgatgactaacaattacatggaacttagagtcaatttgttttctgacacactaaaagtcctcagggttgaagaaagcaacagcatctgccatttcattttctgagaggcatcccacataaagcaaacaatgtcagtcacctgccatctctctaaagacccagtgtttgtaagccatgaggccccagggttaggggctctctttaaggcctctcagactctttaaggactttcaagcctaagcatttttacccagcagcatctcagaagcctctatctaatactagaaataagacagaagctatataagcccgggaggttgaggctgcagtgagccgtgattgcaccacttcactccagcctgggtgacacagcaagaccctgtctcaaaaaacaaaaaacaaaaaacaaacaaaaaacaaacaaaataaaggaagataaagtttctttacaaaaagaggcagagaagacttcatagagatatttgctattcaagtgagaatgctcagatcttctcatgagcacaaatccattatcaaaataactaagaatctaagaatgaggaaacaccactgacctcagtgacaagtcattaaacttcaaataaatactcatgatgctttgcagatatcattgttgtggccaataacaaataaaatttaacccagcagctttaatgtcacagcccttctattttttaagtgggtatttctacaaacatatccattaaaccccgagtttgcctcaaaattttaaaacacaattttaaaacatttactaccatcactgagttgttcctttccaacctggtatccattagggacccttttgtttggtttggcacagacagcccattctatacatactgattaagattttactataagaacatttcttacaggcaatccagtatatatgaccaaatttgtatattttatgttgccatattccctgaatatttaaatgaaaagcctcaacaaaaagaggatttgaaaaaatgtcaatatgctaaatttagctgatcttaaaaacaagcctatcttagaacattctctcaggtaaatcatgcataattcatagatttttcccaaaacattatatacacatccatgcatctcaaatcattaaaaaataaattagtttgaaagtgacaatagtcaaataccatcctgggatagaaaagttacagagatagcaaatgtcttacattacaaaggatgtacctttgctatccccagagcagtattttacgcagacactgctgtataaaaaagtcattagttgttttattacatcgttctgtttatttatttttaataaaaatggtgtaaatcattaaattattctgaatttgaaaggcaattcccactcctgctggaagctagctgaggactggatggccctgctgttcctgcttgcgtgaactatccctcctggtgaattatacaactagttaatatacaaaagaaaataggcaactcccatttggcatgtcattcttttatgcccgagagctcacttcacatgcaacaaatctccacagcagtactgaaagggcctaatgaaggaacacagtgatttaggtcagcccagaaaggctttgctttcttcagtgaagagtgtcttgacagaaagcattttctccgatgtaacattacagcttggaatctgccaaaacaacagtcggcacccaacaccgacacctctacgttcactaaatagacgtttttatttacttaatccaaaaccagagtggtccaaagcagttagataaagttgagtattttcctcttttgcaattgtaattgaaattctgttggttgaataaaaactggaacttgcctttctgaggaatgaattcatgccacagaacttgttcagaatttggaatgcattttccatatgatgatggcaggtgctttctcacgtgtgagagggcgacactcctaggtaagtctggccacgatcaaatctctgtattttcttggcatgcagcccttgtttagtggcctccttggccagctgcaccgaggaagcagggactgctctctggggagcagggtgaagacatccagctctgagccctccagggcctatttataatagaaaaacagcctctgttcccttttcaatgcaaagtactttctcatatcaccttaaaacttatttatactgcaggtcatgcacaatggctcacacctgtaatcccagcactttgggaggccgggcgagcagatcacttgaggtcaagagttcaagaccagcctgtccaacgtagtgaaaccctgtatctactaaaaatgcaaaaaattagccaggtgtggtggtatgcgcctgtaattccagctactcgggaggctgaggcaggagaatcgcttgatcccagaaagcagaggttgcggtgagccgagattgtgccactgcactccaccctgggcaatagagcgagactcagtctcaaaaacaaacaaacaaataaaaaaacaaaacatatatacatatatatatatacccactgaacaataaaattttcctacatttgggaagaaaagtaggtttcataaaggaaattttaatgaaacaaccatttataaagaccaatagcatactgttttccactaatattttttcatgattgagatcttaaagtttttctatagaaaataacccagtaattttacattttaattatgtccccttttatatgttttctttgtgtctgcctaatttaatattacttttttttttcttatcaggcctggaagctaccactctttggtattacttactaattgtgtttgtagcacttactgagatacattagctcaaattgaaatggcaacatgaaatgcaattatgcctacttatagacattctagatgtacatgtaccatattgccttaaagtgcagtttgttttacctgctagaaaaactgtgaaacaggaacacagacatgtacacagaactgtacagaatacaaaaaaaaatgtctacagtgttttcctttctcacagttttcatgtgatttagacattaaatgtcttatatgtaaattctgcaactgtagaaaatgtagataattaaaagggaataggaaatcagaatctaagccatcatttaggttctctatattgttcatggactattaataatacatgtatacgactaaagagatcatactaataaagcccatggtctggggagagtaagggactagtactcaccccagaccactctaaagaccaccatctcattcttgtattaagactccaaattggcatccctgcacctgagtctaaccagccccccatgatacgtgatctacagctttgtatagaaaaaaggacacaattctagtgagcactgtttcttgaaaactgcacttcacataaagagattttaatttttaataatttaaaagtaatggagattacactgaaaatgatgatgtctcaatgaaaataagcctcagctaatacaactcacatggagttgtatacaatggagagttatttgaagcacaacaccttatatttatgctgtgttagtgaaatagcacagaaaggttgatgaaaagtgttcactgcatgccaataagccaaacatcacaggaagtgtgtaaatggattaggattcttagacgaatctatctagcacagcaatatgtaacaaattaaagtggaagaatgaaaatgttactatcatcactttccttacagcttctccttactaaaaatgggttgtgtcatttcttattacaacaaaagattttcttgatggggatctgctaatatggtcatgggaggggtggaaatcaagcattaactatggaatttagcacaaagtatacctttactcacaaaaggggggaaaacattttagcatgaagattgcttggtgcttatgttgcactgctaactgcatattctagaaataattaatgctagtctcaattaccagcatgcaactcacattttcagctaaatcaataactgaaataacaacaagggagaattccccttatattatgaataggttctcagccttatttaagcatcagaatacctgggagtcacaatgttctttgcagttattgttatacctagtgtccgtcataggtgttactaattttgtcatgcataagtggcaacaatgttattacaaaaatcaaaattatgagcatgcacatccacaaaagcagtaagcaactgatctaagtatgactggctgcctctatgctgtactgtgatattcgtgtgtgctatctgcttgcttgctaattcctagctacactttattaacaaaggtaggtttaaaaacaattataggataaaaactttaaatttggaatatattatccatttacttatttttcctgaaaaatgagaaaacattgcaattattcaattatagtgataaaagatcagtctagcatacggtgctatgcacaacagtactaactgttggtcagacgtaatctttgccttcgaggtatttccagtctgttagggctggcacaaatcctaaacttttaaatatgtttctcatatagagcacagtagcactgacatgggctacttggctcactaaccattgaagatgaagaatgcttctcagggaaaattatacctgaagcagttattaaaacgagagcctgaaaggaaaggtggaaattatatccttggcagaggaagcagcatgaccaaggcaaggagacaaaaaaaggcattccagctgggcgtggtagctcatgcctataagcccagcactttgggaggtcgaggcaggcagatcacttgaggtgaggagttctagaccagcctggccaacatggtaaaacttcacctctactaaaaatacaaaaactagccaggcatggtggtgggtgcatgtaatcccaggtactccggaggctgaggtgggagagtcacttgaacccaggagggagaggttgcagtgagctaacaccactgcactccagcctgggcaacagagtgagattctgaagaaaagaaaagaaaagaaaagagggaaagaaagagagaaagaaggaaagagagagagaaagagaaggaagagagagacagagaaagaaggaaggaaaaaggcataccatgggcgggaagccaagtgatagcttttcatgactggactgtcaaagttcaagacgagtgactggagaaggtaactggacataaaccagacttagaggatggaatagcaattatgaattgggagacaaggcaaatgttgacaattttaggcatcaggtagtaaaactgtcctcattcttttgaaaattaacctcgctgggcacagtggctcatgcctgtaatcccagcactttgggaggctgaggcaggtggaccacttgaagtcaggagctcgagaccagcctggctaacatggtgaaaccccatctctactaaaaatacaaaaaatatggtgatgcgtgcctgtagtcccagctacgtgggaggctgaggcaggagaatcccttgaacctgtgaggtggaggttgcagtaagccaagattgcaccactgcactctagcttgggcgacacagcgagactccatctcaaaaaaaaagaaaaagaaaaagaaaattaacctaaaaactaaaataccaggaagaacaattgtgtttataataattccccaaactaattataaattttgcagtagacaaaaaaatataaaatatgaaaatagtaagtaaaatagggaaacatttcttaagactaatttcttctctttcaaaccctcttggttggttagtttttaccttccatcttgttgaaattgactttttttttttctgaaaaagtaaactgaatcaaattcaggctaagcttaatgctaccaatttattttcaaagacagataataaggtcacgtagggcagttgtggggaaaggttagaaaaagtgagtcgccctgtatgataaatgacaggctcaatgcatccgttccttccagaaaccctcaacacaactggctagcttttaatgtaatcagaagatatccacatggtctttctctctgtcctcttctcctcacttggtgattttaagaagcaaaagtctggccgtgatggctcaagtttccttgaacacagcacaaaaagataaatgccagtattgcacaggaggagaatatacagaacaagagttctcagttctggccaggcatggtggttcatgcctataatcccagcactttgggaggccaagatgggaggatcacttaagcccaggagtatgagaccagcctgggcagcagagtgagacccatctctataaaagaaaaaacaaaaacttttcagtcctgatgactaaaaccatcaaaaatgagactatattttagactaaaattagactaaaactataatttttctttaattaaatctattcatgtagtataagtggttaatagaaagtatttctgatttgtaatattatattgcagacattagattgatgtttaaaattgcaaaattgcaagagtgatatacaaaaaaaaggaattattctagacaactagagactctcctatatttaaaatttaaaagcatggtattgaatatcctatttaggaggcctttgacaactatttttactttttttttttttttgagatggagtttcactcttgtcacccagactggagtgcaatggtgtaatctcggatcactgcaacctccacctcccaggttaaagtgattctcctgtctcagcctcctgagtacctgggattacaagcatgcactaccacgcccagctaatttttgtatttttagtagaaacgggatttcaccatgttggccaggctggtcttgaactcctgacctcaggtgatccgcctgcctcagccttccagagtggtgggattataggcatgagccaccgcacctggtgacaacttattgttacttctaatggtttgggagaattcaaattatattagtaagtattttagaaataaaaagccatatagtcatgttaatatgctcataaaatcagaagaaatataaagttgataatcaagaaagggtatataagtattggtagatgtaagtgttggtaatataagtattggcaaagtattggtaagtattggtaaaactaatttctaacttcaatgttaagaaaagcaacagtctttgaaatgagttggttatcgggtacattgtagattctggttttacttattcaaatttttttttttacttgaatcagctttctcttcctatcccccatctctaattatgtctaaatgttcttttctgttcatggagttattaaacaaataaacaaactctctgggagcccttgaccctaggggataaagaagactgagttcttctttcttcctgaaaagtactagaaagttcctaaaggagctatgtctgtactactaataggctagggccgcatgtgactgtcaaaaagggtctctataagaggagtcccaggaacgccctgaagtatcaattaaaatgcagctgtttggtaccacttgttcctgcggaaacttagcagtggagggtgtttcttaccccagtaagctgcttctttgcgctaatgcagcgattgctgtgcctgagggcagccctccctcccagtcgccagttccgtctttgcactgcatgttctctctgatccttctctgatccttccctccttcacagctgatgactgaattcatctttgacgtgtggtccctcaactcaatgtaatcttgcatgaaagttcaatatctgccatctggccaggtgtccacttatcccactacccttgaactcccagctccttctccctaactcctctgctgagtgccttgctgtggccccagatgttgcaccatacacatctgcacacctatccaatgaagcagattaagtcccacccacttccactggacagaacagtagtctcttacatcagacttagctagattcctgtatcactactcggttatattatattatttgaaaacatttctggccaggtgtggtggctcacgccagtaatcccagcactttgggaggccgaggtgggcggatcacttgaggtcaggagttcaagaccaggctggccaacatggtgaaacactgtctctactaaaaatacaaaaattagctgagcatggtggtgcagcctataatcccagctactcaggaggctactcaggaggttgtggcatgagaatcacttgagttcgggaggtggagcttgcagtgagccgagatggcgccactgcactccagccggggcaacagagcgagactctaccatgaaaaaaaaaaaaaagaaagaaaagaaaagaaaaaagaaacatttcttattgaaacattcctcacttgcattcagtgaatgacatttatttgatgcctactatatagctggaattctgctgagcatagtagttaaagaaattgctcagatatacacttgcccttgaggagtaagcaaggcagtgactatctaaaaagtgaggcagaagtgtaaataaatggataaaagagaatgtcctatggtggaaatgcagtgaaaacaggaggtaattcctccttaatggcaaggttaaggatggaggggatgccaaggaggctctcaagaatacagatatcttcctggcttacatcaacagtttatacaaattgctgcattttagactcttgtggggagctttaaaactcttgatgtccaagctgcatcccaaagcagttaaatcagaatctctcggggtggggtgggggagggctggggtagaacccaggcattttttttttttttttgagacggagtcccgctctgtcgcccaggctggagtgcagtgacacaatctcggctcactgcaaggtctgtctcccgggttcaagccattctcttgcctcagccgccggagtagctgggactacaggcacccgccaccaggcccgactaatttgtttttttttttgtatttttagtagagacggggtttcaccacgttagccaggatggtctcgatctcctgaccttgtgatctgcccacttcggcctcccaaagtgctgggattacaggcgtgagcgactgcgcccggccaatatatttttttaattccctaaattaaaaattattccatcgagcagcaaagcctgagaaccagtgaactagatcattgcgtccttgataaaataatcttacactaatcttagttcaagagcctggcaagcaccatgcctactacatgttcttatgtgattttggcattgaatttaaaaaactgaatgaaggaatcattctggtaaactaaaatggacaaaaaaactgggttttatgttatctcaaaaattgtctacatcatatattatattaaccaacaatcttttagactttaatagtagaagctgtagttatgaatagatttatgtataccatgaaaaaaatgtacggtagttattctttcctcaattgtcattttaaacagagccatttatttattaatacacttagctggatgctataagtgaatacaattagtaaaagtgataaaactaagtttatgcacaactgtgaaaaatgtgtggtagttgttttaaaaacttgttttcataggtcaagagcttacaatgcattctccatgaaacagactattcattagtttgagaagataaaacaacacatttatggaacactcacatggtgagctaatcagttaacagtcttactacataaaaattacaagaattttcattaacaaaataatagaaaattaaaatgtaacattaatataagcacttatcattacattaagtagttctatatacacacacagacatccacacttatgtacacacaaatgcatacatttacctcactgctatttataattatttaacagtaggttagcatatttattgatatattttttgagacagaatctcaactgctgcccaggttggagtgctgtggcgcaatctcggctcactgcaacctctgcctcccaggttcaagtgattctcgtgcctcagcctcctgagttagctggtattacgggcgggtgccaccacgtatggctaatttttgtttttgtagtagagacagggttttaccatgttggccaggctggtctcgaactcctgacctcaagtgatccgcccaccttgggataccaaactgctgagactgcaggagggagccacaatacccggccagcaaatttaaataatgagaagcaaatagtcctctaatagtaactattgcatttagcatgtttcattctaactctaaactcacaagacatagacatgtaagtttagtaccctagaaaacacagctacataatttgaattattcacaacacttcatcacaacaaagaaattactaaatttgccatgtatgtgtatactacacatggagtagtttcacaaagcaccattgttacttacgttatttcatgttttaaattctgccttcatagcatggactttcagctatgcctcatttaaaacttactggctcgggggctcatgcctttaatcctagcactttaggaaaatataaaaattaaccaggtgtggtgacgcatgcctgtagtcccagctacttgggaggctgaggcaggagaatcgcttgaacccgggaggcggaagttgcagtgaaccgagatcgcaccattgcactccagcctgggcaacaagagcgaaactccgtctcaaaaaacaaacaaacaaaaacctactggcaataagggagggtcagtatttacgaagtgactcatttaaaatacggaataacttaaactagtacaagagtaggcatgctgtcggagtacagatgccagcgaattaaggctctgtgctgccttccatgttccaaaggtagcttgagcgctagtgtgtcaaatcaattgagcattcagggctctgggccagttactagtattagcctatgagggctcttggatagctttattttgggctttgtgtggtcaggaggtgccccagccacaaacactttgagaaacaggccctattcttaggtgatgcttagatgaagtgataatgtattattaatagttttgatattaacatatgtgagattttgtatgtgtgtgtatgcataaacatagttcagactgatataatactgacttctttctgaggccatggaattataaataaagaggcccacatgaaacaaacccatctcatttattctatttcccactgaataaatggcacttagtccaaatgcatttatttttaatatatctgatgcttaacccatgaccaaatggactcaggaaataaactgtcttccttgggtaagaagaagagatcctatgttttaaaggattttacattgtttttgctgtaatttcatatatgaaggaaatctaaaaactattcatgatttagattcattcatgattcacaaattgcattctgtgaatcaataaaataattgaagatatcaaaatatattcactcatgttaaaaaatacggctgatggttgagcacagtggctcatgcctgtaatcccaatgctttggaaggccaaggcaggaggactgcttgagaccaggagtttgagaccagcctggacaacatagtgagaccctcatctctacaaaaatatatatatatttttaaatatggcttagtgtggaagaacacatttttggatttgcaaatcagttaatgaaagccactgatcatttaccttccaaagaagaatcagacatttctaagacatctacactatggtacacttcactggctactattttagtttaaaaaattaacataaatttcattttattagctgatgtttttagtataagaaccagttgcactaaaaatcagtagcacttataatgaactctaagcattgtaaatggtgacttgacataatttagcattgagatgaattcagggaaacatttttcttttgctgtttgtttgtagcatctcagatctcccctcccaactcctctctgtccaccagttccctcttgcccaagtgctgctattctcttggtcactcataatcatttagcctgtgaaatttattctctatttacaactggctgctacatcactacttctgaacctcttgccaaatattattacaaaccaatgaatttacaaaatctgttcaaacacaaagatgggcaagagagactgtattgtcttacaattgcctctgtgttccttaagatttagtgtattttcttccctgggcacaaatttggtatttacttcactatttcaagtaattacttacttggttttgtcattcaaatttttaaatggaaagaaaatgtctaaggcccttagtttaaaaaaaaaaagattaagagtgtcagaattattctgatccaatgactttcgctaagcaaatctttttaaaacagctcaaatagtatgagcattttacaaatgagctttaaacatccttaatctaaattgttcttaacttctgaatacctagaaaactactatttgcagcttaaatataaacattcatgccagactaatgcagaaaaatctagggcaaatccatgattaatatttttttccagtttgcaatatccagctctatttaagaaagggccttaatgaatgctgctgtaataatttaaatagaaaattgatttcatttttgcattctcactgtcatttcaatcagaattgtcactatcactcacatcttctattcatcattttgatttctatctacactcatttcacaaatgaaaaatacatcattaaactcatcacattttccaaaactataagcaagcacatgaaatcctctcttctttgtaaagaactgccaacatgagagggcagactctagctagtaaagcaaaggatggatggttcaaatttatccttgtaagttatggctgcatttaaatttaattgtctataaactaaagggtgcttttctccctctggataaccttaaatatttcaccatggcttattcaaactactgtgaaaacttaaacatatattcctcatgattacatccattttggtctttagaagaaaaactagcagagcttaaatgtattataaccccttcttggacacacgatgttaaaaaactcagtttgttggaaaaaacatattactattctatacacacacaaactccatatagtaattccatatatttacattataagcatattatatatgtgtgtatgtgtataacgtacatatatataatgtatgtattatatgtatttatagtgtatatttatagttttgtcaaccaaatacttactgtttaaggaatatggtttaagcacaaaatattatatggttcaaattgttaaaaaatcacagcttacttaataaaagattaagaaaacctaagcaaattgatcataaatattaggggcaagtaagcatgaatagaattttaatttaacatctttattttgactcagtattattgttttcaaatcataggaggtttgacgcaatggaatatcaaactaagaaacacttagtgagattacttataaagatgtaactcactttttattcgatgtccccagttaatgcttattatcctcaacctgatagttttctttgagtaagaattatttagtgctagaatattaatacttgtatgatcaattacaattttattttattttgtttttttgagacaagctctggctctatcacccaggctagagtgtagtggggcaatctctgctgactgcaacctctgcctcccaggctcaagccatcctccaaactcagcctcccaagtagctgggactacaggctcagacaaccatgcccggctaatttttgtattttttgtagagatggggttttgccatggtgcccaggctggtctcgaacttgtgagcttcagtgattcgcccgcctcggcctcccaaagtgctgggattagtggcgtgagccactgcacccagccttacaatttgattttgatgacactagtcaacagtaaacacaacaatggctattggtctataccatcatgataaagcagattaaagaatatttggcttttgtttgctttgttaaactgtttctaataaagtgagcaagttttgttttaagtcacccattccaatgaatttgctacgtaggctgctggtcagcacaaaccatgatggggcaggtgaacaccttactccaagagctattaggtgagacacacctaacaacatcactgggtttttctcccatgctctaaagtctttctaacactaaccagaagtactacatctgttacacaataaatagtcctctgtcctataacactgtgagtcagatgaactgatcagaaaaaaaaaaaaaatcaatgtttacagagttataacttcagactaaacaacaacaaaaagaaggcatttcagttggaccatagagccttgaaaaatgtaaatgatttaccttcaaccctgaccattccagcaaataaccccaatcaactcttgctcctcaaattttccttcctcttctattttctgttgattctattaccagcatcgaaaccttggagtcatggctcatgccttcctgatacagtcacatccaagaagctctaaagcccaatggctcaactgtgttccctcctctccatttctgctgttacctaagttgagtgcttataaagtgatcagaggagcaatttagaattcatcaaattaggaatgactcttgatgacgaaattacagatgaggcagtgggaattcacaggagagtgggaattcacaggacagtgggagtcaagggagaccaaggacaaggagatgagttcatggcttgttgtttagatattagatgtgacgagctgaaagtctcaatggaagcgatggaaagtagaaatagtataaaagaaaccaagaaagaaaaactccattgggctaggtacagtggctcatgcctataatcccagctctttgggaggccgaagtgggtggatcacctgaggtcaggagtttctgagaccagcctggccaacatggtgaaactccgtctctactaaaaatacaaaaattagctgggtgtggtggcgcacacctgtaatcccagctacttgggaggctgaggcatgagaatcacttaaacccagaggcagaggttgcagtgagctgagatcgcaccactgtattccagcctgggtgacagagtaagactgtctcaaaaagaaaaaagaaaaaatccattggttattacaacagatttgtttatggggtcaaaaaatctatgaagtttggctgggcatagtggctcatgcgtataatcccagcacttcgggaggctgaggtgggaggattgcttcaggctaggagttcaagaccagcctgggcaacatagcaccaccccatctctaaaaagaaattatgtttaaaaaacaaaaaattatgaggatcaaaactataaggataaagaaaaggaagagtaaggatagtgtgagtgtgaataagcacaacggctagatttcaaagcaaatccagaatacgggctttgctggtgaccttggagaagttacttaacctttctgtgcccccgttataactcagatgtttaaaaaaaaagaaatggggttaacaaccctatatcctatggttcttttgaggattaaatgaaaaacaaatatgcttatgaagtactaaaatcacattattagtgaatttaaaaatcttttagccctaaaatttgattttctgtgtaggagctattgtaaccctggatatttttaatcaacatattttatgctacaatatacctaaggcgtcctgcttcaggatgaccacatccaataaatattcaacaagcatctgggattgcacttttaataaacgtctctgtgttgaaagagaattcttatcatttggaggagtcattttatttatttattggccttggaattacttcagactgttgataattctgattttggtaatagtcttgggtgagaaaattgttcaaggactaagagtgacctgtcatggtaacaacagtctgtgaattctataaaatataatgcatggaccttggtttggagaagagcaatttactttagggtgtattcatccataattctcttctcttgagcaactttcatttttatgtgaattctttacaaagtcaaaaacaactgatgcattgtcttagctacatacaattcatttaccagcacctaaactatggaactgcagtgacttaaagggctagcttaggaagactaactagtttgaggtaagtttgcaaactaaaacaacccactttttgatactacatcaaaaactgctttccaaatttttagtagaacttctcttttaagcagacagtataatcattttatgaaggtttttgtgtcctctaaaaagaattcttgtgttccaaactctcccaaggttataagactgaagtcaaaactatgtgatgtatactggccccatgtacacttttccatgtgaaatatcactgattcttcaaaatggaggttaaaatgtaagtgactgatctttcctcagagaattccagaaacaaatatgctttcctactctccaaagacaggaagatgagcaaagtgagaaataaaatgtcaactacttcgatcaaggatgacacctgagtgggaggccccagcccacacctgggctccaagcgccagttagtcctgcttagtcctagctctgcccctttctagctctgtgaccctgaggaactccctccaccaagaccactctgaccctctgtgtgtgtgtatttgttctctctgtaaaagaggaacaataacctcttgccaggtgctctctgacttcatctccagctgctgtcccctgggttcagctcactccagactcacgggccttcctgctgcccggtcctcccacccaacctcccctgagcctgaagggcctctgtacttctttcctccccctgaaatgctgggcccaggctggccacatcgctcactccctcagagaggccaggcttgatccaaatcccacctgccccgtgaggcgtggcctcatctaaagtcagaaattggctccatctcctcgactccctcccacaattccaatttcccattctgccttacatttctccttagcacttatggccaatacactatttaacgactgtgtgttctcttccttccttaattaaatgcagccccacgagtcagagattttggccaattttgttcacttcatatttttaggatccagtatagtgtctggcatgtagtaatgcttaaaaaaatctgtggaataaataaatgaatgactcttctccacaaggttgtcaaatgaatgagatgtcatcggttaaatcgctaagctgtaaaacatatgattcactatttatttttaaattgttaatttattattattctttggagacagggtctcactccattgcccaggctggagtgcaatggtgcaatcacggcccactgcagccccgacctcccaggctcaggtgattctcccacctctcagcttcagactacaggtgcaaaaccacacccagctaatttttatatttcttgtaaagctggggtttcactatgttgcctaggttggtcaaaatttctgaggctcaagcgatccgcctgccttggcctcccaaagtgcagggattacaggcatgagccactgcacccagccttttaatttattttaacattctgttcatgaaataaaatgtagatgacaaactatcggagtcaaggtaaaaataattaaatagaaattagttataagaactataatgcagaacctccacaaggctaagggaaaaaaaaaaacaactactacaaaatacttggtatcattagaagtaaaaaaaaaaaaaaatcagaaaacagtcaaaagcttaaaaatgaaccaaaggtggccgggcacggtgggtcacgcctgtaatcccagcactttgggaggccgaggcgggcagatcatgaggtcagaagttcaactccagcctggccaacatagtaaaaacccatctctactaaaaatacaaaaactagccgggcctggtggcgcatgcctgcagtcccagctactcaggaggctgaggcaggagaatcatttgaacccgggaggcggaggttgcagtgagccgagatcgcgctttaaaaaaaaaaaaaagtactgaaggtttgtggattaaaccagagctgtgacctctggaccaaagtaataaaagtccagcccatagcctggtagaagatagctagatggaagaaaaagaaaagctgcataagagaataacaacaggcccagagaggcctggagacagaggaaaacacagaggattagattttcagaagctgtggacttaagcaataaaaagtctatcaaagtgtaccttgttgatgtatggcacgtggctaataattcctaggttagccctttaagacacattgaaagatgggtcactccctaagtatgacatgatgaaatgaaactgtgtagaccatcaagcaccaggggaaaataacctgtgtgaggcttgagcttttctaagagagaaaacaagataaaaaaataaaaacaaagcccacaacacaaataaacaggatttactctacaaaacaaagctcacatttgcatatactaaggcttgttctctgcttaatcgaaggtaggaggagccagggtgattggctctctccctgagaacttgaactttgcttcagagggcagtttctagcaaggatgagcactgtttctgatctgaaaccgggataaaacataactgagtatccacagctcagagcaagaccgacaagcaagacgcatagttacagtgagtgtatgatagagctaatctgcattttaaattcgcacataacagtcttcgaaggtatgcaaaaaccgttttcaccaacaggaaaatccaaaataagtacattcgaggatttttttttccacaaaataaaatagttacaaaggttgaataaaaaattatctaagtgaaaatcacttcatactgggaatataaatctctggttctttggtaaataaaattaacaagaattattcaactagaactatcagcatataggtttctaggtttctagatgaacagtttactaactgggtcacgtataaaggtcaaaccagtttcttcgttacgactggttaaaactgatcgaataaaaaacaaatctgctatcagctgataaatactaactttaacaaaggctcagtacatgtagacatggtccatgtgtgttttaatttttaaaaggagtgaggagggaataggagaaagcaatatagctctcatcagcactttcttcccatcaggcgctttacatacagtcgctccttttaatctcatatccaccctgggaaggagaattaggacattacagttaagccacctgcccaaggccacattaacaagtgacaatggctggttctgctggatccagcctgggcctccttccaccaccaatctcagaggcatggcccaaagagacagctcagtcttcaggaacaatcaactgaatttaatatttactcagggccaggtgtggtggctcatgattgtaatcccagcactttgggaggtcgggggagggcgggggggcgggaggggtgcggggcggcgggtcacctgaggtcaggacttcaagaccagcctggctaacacggtgaaaccctgtttctactaaaaatacaaaaaattagccaggcgtggtggtgggtgcctgtaatcccagctacttgggaggctgaggcaggagaatcgcttgaacccgggaggtggaggttgcagtgagccgagattgtacctctgcactccagcctgggtgaagtgaaactccgtctcaaaagaaaaaaaaaaaaatttactcagataaaccaaacaggaagtacaaggcaggactcaagacaagttataatagaagagcaaagatcagtaagaaataaatataaataatagttacataatttacagaaaatagtcattaaactgcattcaagccaagatataaattacttagaagattctattcacaaaatattttaacttctccttgaaggttagtattgtcttatttagtgtaaatttaaagtatcatgtacgcaacaccacagaaaagatactgtctggaagctaagacattactaattaaatgcaaagagttgatatgaaaaggaagtaaaataacctagaagatggggcacggtggcaaggctgaggcagtcagattgattctacgagtcctgaagtttgaggttacagtgaactatgatcccacagcgccactgaactccagcctggatgacagagtgagatcctgtctctaattaaaacaaaacaaaacaaaacaaaacaaaaacctagaagagagtaacagcaccatactcagctttctcagctttttacttatttattttttttggagacggagtcttgatgtgtcgcccaggctggagtgcagtggcgtgatctcggctcactgcaacctccacctcctgggttcaagcaattctagtgccttagcctcccaagaagctggactgtcatgcaccatcacaccgagctaatttttgtattttcagtagagatggggtttcaccatgttggcctggctggtctcgaattcctgtcctcaagcaatctgcccacctcggtctcctcaagtgttgggattactggcatgagccactgtgccggtccatacttagctttttttagtgatacatttatactgattagtttaattctaacttgatgggaaaaaaattagtagttgggaatgaatgtataaaaatacttcattcaatagttacaattattcattacatttaaaatatccttacacctgaagggaactagaaaagcatgcctatatattctaaatttctttttctcctccacactctccaaattcccctgccaaaacagaatattgatattacaatggaaaattataaagacgatatactatgaaagttcttaatattcattcattctgagtttcttaaaatgtatagaaagatggcccaaacacctctgtgttctgcagcaggcaggtctatgcaacccacccgccaagttcgaggaagctgagctgacccatccagtctctcgaaaagaaacatttaatagggacttacggacagaagccatgtctcaggcagcagtgaggccagatagtggattcctgtgctgctacccaccacacccagggcttatataccctaggaaaggaatgtgtaggacaactgaagtccatccctagggaaaggcaagaatgctacatcaacctatgtaagggcagggtttatggtcaaggttgttttgacctaaggccaggatttatagcaacagtagataaagtaaaaatcttaagctgggcgtggtggctcatgcctgtaatcccagcactttgggaggccgaggcaggcagatcacccgaggtcgggagttcaagaccatccttaccaacatggagaaacccccgtctctactacaaatacaaaattagccgggcgtgatggcacatgtctgtaatcccagctactcaggaggctgaggtgggagaattgcttgaacctgggaggtggaggttgcagtgagccaagatcacgccattgcactccagcctgggcaacaagagcgaaactaactcagtctcaataaaaaaaaaaaaaaaaagtaaaaaagtagaggcattcccaggagttaattattagttaacatgattagcatccaagatggatttgcctggaaatggaagtgggatggggcggagaattatcttcatttgtatcacttgaggaatagctgagtgaaaacttgctgtaggcagctgggtactcaggttagactttgaagactcacttaggggctagatttagagaactgccgcttaatggctcatagtcagaagtcaaagccacattgaaattaaacagactgccataaaacagtgtggcctagttgaaagacaaagaatctgaagtgagaagttccgggttaaagtccgagacccaccattaccagccatttccttgggtgaatatttaaatctccagtctcagtttcctcgtctgcagaatgaagaacacagtctgcctccctgggagcagaaatacatctaccacttagggttgctgtgagaatgcagtgagaaaagcactggaaagcgtcttatgaagtccaagtcatgcatgagggatcgctattagcagcatgtttaatggaatatatgttctcaattcaaatgacagagactcgcatcctaaaatttaaagaaaagtaagttaaaaagtataagcctggcgcagtggctcacgcccataatcctggtactttgggaagccgaggtgggtggaatgcctgagctcaggaatttgagaccagcctgtgcaacatggtgaaaccctgtctctactaaaatacaaataattagcagggcatggccgcgtgtgcctgtggtcccagttacttggtagcctgaggcaggagaattgcttgaacccgggaggcggagattgcagtaaaccaagatcacaccactgcactccggcctgggtaacagagcaagactccatctccaaaaaaaaaaaaaaaaaaaaatgtacaggccaggcgtggtggttcacgcctgtaatcccagcactttgggaaaccgaggtgggtggatcacctgaggtcagtagtttcagagcagcctggccaaaccccatctctactaaacatacaaaaattagctgggggtggtggtacatgcctgtaatcccagctactcgggaggctgaggcaggagaatctcttgtgtaaccgtcaaggggttcaccttgctcgctgcctagacagagccgattcatcacaacaggggaattgcggaattgcaatagagaaagagtaattcacgcagagccggctgtgcgggagacctgagttttataattactcaaatcagtctccccaagcattcagggagcagagtgtttaaggataacttggtgggtggggggaagccagtgagccaggagtgctgattggccagagatgaaatcataggacccggagctgtcttcctgcattcagtcagttcctaggtgggagcacaagatcagataagccagttaatccatctgggtggggccagctgatccatcaagtgcagggtctgcaaatatctcaagcactgatcttagaggcagtttagggagggtcagaatcttgtaggctccagctgcatgactcctaaaccgtaatttctaatcttgtcgctaatggtagtcctacaaaggcaatctagtccccaggcaagaaggaggtctgctttgggaaagggatgttacaatcttgataaactgtctaagtcataattttgcaaaggtggtttcacttgaacccaggaggcagaggctgcagtgagccgagattgtgccactgcactccagtctgggcaacacagccagactctgactccaaaaaaaaaaaaaaaaaatgtaacaaaacttactttatctacatttggccacagtgttgtaaaccttctaacattctttacaacagcacctaaggcaacgacaggttcttagcgtcaaccacatcttcactttggcctacagcaaaatatatttcccctatttacccaaatggaagaagtttcccctgaattgtgtttttaaggtatctccccccaactcctctctccagatagcacaaatccaagtatgtccctagactcccaagagctgcttttatggactataaaactagcaacctagctttccacaaacatctttactgctattagtgaaaatatgcacttatgatatatgcacgcacacaagcatattcctgtcaccttacagagctaagtctacatcacggagacgtgagcacacatctcatagtgcacatcgttacacatccccccaggggctgacaggcaggggcttggttttatctttgcttcatctcttgcactttaagagtcccttgggtagtatcttttttgtgctcaggtttgatatttcttactcagtctttatgatgtctgactgaaagctcaatggctcaagatgtcctcgagggtgctaatgtttttatctctgtgtcctagcaccctgcccactctgttccctacaaatgttgagtgaattaacttccgtctgaattaataagaaatgtaaaccacttgtgataaaaaataatctatctcttccacacaaaaggtcagtgtaaatctggattctgaacacagactagattgaacaaagatttcttatctgtatcggaagcaaaactgagtatggtgttttgtacaaggaacaaaggaaatagctacacctctcctactgtagacgtcactgaaaaagtctgtttctctccctggggggatactgtaaactcagtagccagcactcaatactgttgccagaagcaggaactggaagtcatcattctaagtcgcctttaataaagcagaaaagatgcaataatgtcttggcaatgtcagttcccaaacactgacaacctaaactacatcttctggccctaggtgcttatcggctgtactgacgtgcttcacattttataatgttggtaaaatgagggaaggcctgtggctctcaaattcttgtatctgcttagctaattccaacccattattgtaagcagcaacaacagaggaaggacagtctctcaagactgagcactcatgttttacccagttacaatgctattgttctctgggtgaatcagttttaaagtaaatacatttatggctgggcgcggtggctcacgcctataatcccagcactttgggaggccaaggtgggtgggtcagttgaggtcaggagttcgagaccagcatggctgacatagtgaaaccctgtctctactataaatacaaaaaaaagttagcagggcatggtggcaggggcctgtaatcccagctacttggggagctgagacaggagaattgtttgaacccaggaggtggaggttgcagtgagccaagatcgcaccactgcactcaagcctgggtgacacagtgagactccgtctcaaaaaaagacaaaaaatccatcttcaatagaggcaatgtggtgcattacaaaggggatgagtgaaaacaggctggcttcaaatgcgggttttacactttaccaactcagtgatcttgcccaaaatactttgtctgagcatgtattttctatcttataaaaagagatatatgccgagcacacacctgtaatcccaacactttgggaggccgaggcgggcggatcacctgaggtcaggagttcgagatcagcctggccaacatggtaaaaccccatctccactaaaaatacaaaaattagccaaacacagtggcacacatctgtaatcccagttacttgggaggctgaggctggagaatcacttgaacccaggaggcagaggttgcagtgagccgagattgcaccaatgcactctggactgggtgacagagccagactccatctcaaaaaaaaaaaaaaaaaagagatatgaaggaggattaataagacaaatgtacataaaatatttcacacaggcccacatcatgaaatcccagatgttagtcatacatcatctgcctaagtctttgaatatttggggcatgcaaaacaaaccaaaaaggagttgcctattgaagaaaaggcaaatgtcttgacatgatgttcagatcttatgtgattcttcgccatcttacgctagcaggttgatgtctttgtcttcccccacagctctactccagttgaaccggggtaggcgtactctctaagctacttcatgtctctccacttccagaagcttcttcctgctggtacctctgtccccatctctcaggactccatctgccatgaccctttcatgattccactgagaagttacttttctttttcccttctttgaacatcgaaagcatgctgtgcctctttacggtagttcttttacaacttggcacggtgctttgcaatgtaatcacttgattacaagtttcattttcttcattagaccgcacactccttgaagtttatatggctttattttttgcacagagtagttattcaatatacactgactgaatatattttaaaacttcagggagtaattaaatcagccaaagtaaatttagtctacacatacatttatagaatgtacaccatctccagcctcagacaactgcactcaagttgcccctttcccgagccactttctggctaattgctaaacatgtttccaccagatctgcccctccagctgcctgcagctccagtagaggctgtgtggagaagagccatgcagactgcatctgtaaggtcctgcctgtgcactttccgcttcccaaatgaggacagagagcactcctgccagctaccaggcagggcccaatttctaaactctgccttgaccccctgccttcccatcagaggagaagcatccttacctaagaacactacttcttcaatgaccagtcttccttccccagttctcttccttccccagtcctcttccatccccagtcctcttccatccccagtcctcttccatccccagtcctcttcctgggggtatgagaaaaaactcttaacaggtgctggctaaagggaagcccagggtctccaagatctatatctcaccagagtccttcacagcagtgccagtcggagttggctgtgttcatgttccccaagctatcacttgctcggtctttctgcagctcagaggggatggctggactaccaatcctaatgggttgggacctttctgcaaactccagtctccccatctgccctggtcctgccttgttagacagttctcagtttgagttcagataacttttagagtccctggttcctattataatacttaatattttgtccaatgtctttcttcatcatatatatgcatatatatgtacatatatacctgaaaatacacacatatataatgacctcatgcaagatcatctgtctctcagagtacccatttcctatatatgaatagatggtgtgtgtgtgtctatatatatataaatcaaatgactgttttgtatttatcccactcaatcatccatattcataaataataatatttctctagcattccagaatcaaagttaaaatatggcatgaggaccaggctcactgcctcatgcctgtaatcccagcactttgggaggccgaggtgggcagatctcttgagctcaggagtttgagaccagcctggcaacatggagaaactccctttttaccaaaaatagaaaaaattagccgggcacggtggtacatgcctataatcccagctactcaggagactgagtaggaggattgcttgagcctgggaggcagaggttgcaatgaaccaagatcgcaccactgcactccaacctgggtgacagaatgagaccctgtctcaaaaaaaaaaaaaaagaatttggtctgagcctggtcagcactggtctgatgtactgaaaaccatctcctaaacttctctctccaacaacaattaagtaccttatttacacatcaaactatagcaaaaacatcaatgacaagtacaacatctgactgttccatgaagatggtaggactgttcccaaagctttctgcttacaacttaaggccaaaccaaagagccgtggttctcctgcactaaaatggtttcagcctatttccagtcatgctgctttactaacaaactataatgaactactgtaaaacatgtgtgctatacttcactcagcaatgccttcactataagatgttgaaaatctgtgtttctggatgcataaaaatgacaagcagaaggtgttattttctattctaagggtccagaacaaaagaatgtgctttcattgtgactaaggaagtattctgcacagaccaatataatcttctactcacaatgtttccagttcctttgggtacctggtgtcattttagctctgagttatgtattaaggtcacctgctttaaaaaaaataaagacaacacatggaactcagtagagaaagtgaagtttcttgctgcatctccttcgagccatcttccctgcttgtctgtagggattccactgtgctatctcacctacctacctactcctctcattgccatcgatgctgtgataccggcaaacttctttatggctaggccttgctgtcagtgagtttccttaatgatgaaggtctctgctacctgagcagaaaagctcaagctcagcttggtccatgacattcatatgtggagtgtcatgagtttacttttaaagaactgcaagaaatatgaataaacacatttttttgaagcctatgttcaattacagcacttcaaagatgctgtaggaaaagctgaagtataacacagcatgcaaagatgcattgatttctttctccaaatcacatgtaacatatgtaagtctatacatatatgcatacatatatatgtacaccaaagtttaagaaatagatggttgttgaccaattgtatgtttttaaagagttttctaacaattatattagatattttataacttttaaaaatttacttcgaaaagattctcataaatctcccagagaaggcttagaaggctggcttcaaactccagttgcctgaactaggtacagagaaggctgagatgacagcagtttctagccctggctgcacatcacagtcacctggggagctttcaaaactattaaacagcaaaatatctgacacacagtagctaatcaatacacggaaatttctctgttttcccttccaccctatatccaatcccatatttcccaaaatgcctacagagcatactctgccatctcactagcacctcactccgtagcctaaagcttccaacaagtatcaccacatgttcccgcttctttgctcaggcccagtgagttgccaggggtttccgcatcacctatattttatgcctgtttcttcctcgtgttccctgtcacctggcataatggtcttgaactgtcttcccactttaggcccacagtttcctccctgcagcctgggggatctctccacagtgcacgtgtgatcgcatctttcccactgccacctcctccaaggcaatctgccggcagggatctccctgtctctgtacttctgtctccatgttcccctttctgggaccctatattgcaggcaaacagaatcagacagaatgtgtgaaatagatgactcctgcaatcttgtcctgtccctatttctacatcagcttcctgtagatgtttcctctttcccatctcctgttctctccaccagcagtgtccatctccatgtcaactgttcccttcccaaggcccttgtcacttatgtgtatgtgggatgctttaatatttataggaagacttgtgttggtgaaaacacaagtcatcaggttcattgtgggatttattcaagggcttgccttctctcttaagtctacatttgtggattctcttcttaaactacattaccccaaacacccagtggacagctacgacattattgttttgttttgatactggtataaatatagtcatcttctcaactgaatatatctcttccataaaaattcatgtaagagcaaaatataatttcaaaagtcaaagttggaaatacccaaatacctcggcgggtgcggtggctcacgcctgtaatcccagcactttgagaggccaaggcgggtggatcacttgaggtcaggagtttcagaccagcctggccaacatggtgaaaacctgctctaccaaaaatacaaaaattagctgacatgatggcacaggcctgtaatccaagctacaaaggagactgaggcaggagaatagcttgaacctgggatgaggaggttgcactgagctgagattgtgtcactgcactgcagcctgggtgacagagccaaactctgtctctaaataaataaataaaattaaaaaaaagaaaagaagtatctaaatacctaaaggcaacacaacttaaaaaaccatcattattcatcatactaaaattacatgtcttcatgaaaaacaagtggcagaaagtttggtgtgctatgtggtgcagaaattcatccagtagtcagtcctgcccagactgattccatgtttttgtattttctcatagctgaaaatattaaatccagacagaatctctgaggcaacgaccgcgtgtgggaagtcagcctatttaacttgagatcaaccgatctacagagtatgcacatggctctcttgtaaagaggtgagaaaagatttcaaaaagcactgtcgtcagcagaaaggacctttacagccagatgaagctctggttgttttcagccactttcctctgctggggaaaaggcacattaaaaagacacagctgtctatttcagtgtacacatgcttggtagcatgggtgttatttactgataaaaagcacatgacagcaattttaaaacagggcttgtcctgtcagtcaaattagagaggcaggatgtcctctccaagtgattaccgtgggggcccacaatgtggcggcctgccaggtcaattacagcagggctgtgaggacacatgaagaaggatcgccttaattctaaacaggagcatcagtaaaatagaaaccaggggacatattaacacaatgaacaataccttaagactgtggctttggctagagctgtaaaatgtatttatattgagtgtttctccatgtaaacattttttttttaattaacgagaatgaatgtataggaatacaattgcaaaataacatttgtatatttctggagaaaaacatttctcaaaggaaaattgggatgctataattttcatctcatcaagaaaattagacacatgggtaaattagcatttggaaacctgaccaatgatatttcataattgttcatgtccctgatatgtcaatttgccttccatttctcctatactaagattaatttcagtttcaaatgtccttgtcattttttctcctctctattgcacctacagcttctttgtctacaggaaaaaatattaagagatcagcagcatcagttggaggatttacatcatcgactatctgaataccagggacacattcctttgttttacactcatattccaggagtctcatggaaatgcattaaacatcagacaaaaaaatgtaggctgcttgaatcgcagcttaattgtttaggaactagatcctgatagtgccccaataacagaagaaaatccctattcacatctacgtagagaaaatactgggctgctgacactgaattttgcagctatgcgaaatttaatgctgattagtaaactctcaaattaaacagtgaaagattataaagacacatgcaaaagatgtaaattaaacccaaaatatcagaaataccacagtcataatttcccacctacctaaagagttatttctcaaaaaaaaattgttgcgaatttattttattttgttttgttttgagatggagtctccctctgtcgcccaggctagagtgcaatggcctgatctcagctcactgcaacctccaggttcaagtggttctcctacctcaacctcccgagtagctgggattataggcgcccaccaccatgcccagctaatttttgtatttttagtacagacggggtttcaccaggttggccaagctgctctcgaactcctgacctcaggtgatccacccgccttggcctcccaaagtgctgggattacaggcgtgagccactgcacccagctgaatttattttattttttattttttattttttgagatagagtcttgctctgtcacacaggctgaagtgcaatggtgtgatctcagctcgctgcaatctctgcctcacgggttcaagcaattctcctgcctcagcctcctaagccaccatgcccggccatgaatttaaataaattcaaagatcccattaatgtttattacaaccccaataatataggtaggcagaatacaatcctgaaaaaggtgccaaaagttgaaacaatgtaagtcaactcagtttccccaagttaaaattataagagtatattaactggctgggcgtggtggctcatgtccgtaagcccagcactcagggaggctgaggcaggtgatcacctgaggtcaggagttcgagaccagcctggccaacatggttaaaccccgcctctactaaaaatataaaaattagctgggcatggtggtgggtgcctgtaatcccagctactctggaggctgaggcacgagaatcacttgaacccaggaggcagaggttgcagtgagccgagattgcgccattgcactccagcctgggtgacaagagtgaaactctggctcaaaaaaaaaaaaaaaaattaaaaatgatactaaagaccttagaatttctggacatatctgtccaagtatctgtcacgtgtcattctcactatacagaaaacaatctctaaagtcattgatgtctacatgtctaaacttttcaccatttttgacatcttaatacttttaaattacaatccaagttaaaagggcaatgtaggattagaatagaaagaggtgaggattcagaaatcctcacatcaatttcacaactccctgtacgatggaggcctctcttccctgattcttccttagggttttcaaacacggagtccctcctaggtgccagaggttgttctgggctcaggcagtacaatggtgtataaagctgccaaaacccttgccctcatgtggggagacagacacgaggctgagtaagccacacaatctgttaggatggtgatgagtgcgtggtgcatcatttcatatagggtgatcaggaaggcctcaagataaggtgacatttcaggaaggcctaaaagttgaggcatgcatcatgcagataactggggagagccatccagacagggagggcaaaggcaggggcacagggccaggggccagcaaagaggccagtgagaaaagggccatcctaggctctggactctactgctgctgggatggatggccctggggagttcttgcagaagaaacataagccaatcacccaaggtgactgttaaaatgaaaatccccaggcctctcaatctggacttctgattcagtaggtttgaggcccagggattaagatttcttagtttgcaggtagttcagctgagagtggcccaaagagcattctcagaaacacatttctgaatccctgatagtttggcatccctcctctatttccttatttttggtcagctgccctctacaacaagcagccatcattttgcagccgtttagcgttaaacaactaggagagagatgataagaaggaataccctaagtataagagttaaaaacgaagccacttagtttttgtctagcaagagagtctggccccaatatcttctgagctttgctgacattcagtgattggcttgtaactgacaaatggttgaattctatgagtatgggcgtcctatgactatcctggtcattgatttgactaatgattcctgtgcccttgggttgactaaaacgcaaggctgttgtgtttggtgagtttgttaaggtgaaggtcaagtcaaatattgactgcagaagtgatattacagatacccaagttcccaggttgcggaaggtaagagaattcagatgacagggattacaggtgcaaagaagtagtccaatgatcctaaatattttcagttcaagtgcttcttttagggatattacttagtatttcatctcttttcctttgatgtctagataggtattaaatattgcagcaatgaaaacaactgacatcaggtgcattctctctacattattttatttaatcctaaaatagccctgtgaggtaactactgtatgggttaaccaaagcccagagatgttacttgcccaagagtcacagggctattaacaggcagaattgagactctaacctatgtctgattaatccaacacccatgtcttaaccactaaaatatactgctccttaaatctataagaaacatacttgccataaatgttttacatacggcatttccacaagagagcttaatattgagatgctggttaattatcagagacagcgtgatgcatgaggaacactagttttggagcaaaacagatctgaggctcaaatcatttgaccactgaatagcaaatgacttaataggcctgagcccccaaaccttcattcatagagaacattatgtctctcagaaatttaagtgagaaaataagtgcaatgcatggggcatatagcacatagcatagatactaattccttccctactgacttggaagcaaacactgaccatcacctccacctccacctccacccggggcacagagcacagcactcgcgcaaacccccaacagagggtagagggtcatctcggttgggcttgggcttctgtagcggggggctcactgctccgccgagtgccctaaccactgatggacacctccagcccctctgagggttcttcctcctactgacccaatggtcgactccccccaggactgcttctctgaggcaacactgagcaaactgactgctctttcctagtgacagtgccactaataactgaagacagtcagttggtgtcccctggtctttctttctctaaattaaacatgtccacttcagtcagaagtccctctgatcacaatttccgaacaacacagtatcctaattttcctctgctgggaaaactctagtttttctgtgtcctttaatgccaggaccagggccaaaaattgagattgacatattaagccaagaatatgattggactattacataggctaatctagaaaactcaccttgataatcccaggcttcttggctaatcttagcgccttggcccagagcagtcacatcggcaaaaaattcccgcccacttctcctcccagttccacccctcacagcagctgctcacatctttcctcctcccttttttccctccgaggccctccctcagcctctgtttcatctcttcaggaatctcctcttcccagcccaatcctaaacccaggtagcctttgttctaaatttgtataagtgtgttctaagttcctcgcctccccagtcagccagtcagctcggcaaaacaaaaggaccttcccccaaaccagctctccttattaagtagaggaggagagagttctgtaatacttgtaattactcagaccctgtcacactttaagtaactcagcctaagaccattattatacctgtacttcataccgctggctgaccctgagcttgtggtcaaccctgagtcctagagctttcatcatcttaactcctgcccaggccaatagatagcctcaatcctgttattgcatacagtcatgttttggaaagctaaacaaacaaaaaaacatggcaaggtgcaggcccagcaaaggggccaatgagaagagagccgtcctaggccctggaccctctgaaaggtttctgactatgaaacctttactttcatcccaggtaagtccaattttggtttagcaaaatcaaaattcttcttgcagcttattgcaatcatttcatttttgcttctgttatctcttgtactctactagctctccttttcggatttgtaccttctgtgaatgtggtatgactttatgaggatcatggacaaaaatgttgagaagaaactaaccaaggaaaacttttgttgcatggataaatacatagatgcatataaaacaggcagtacataatggatacataagcatataagatgctcataaaataacacaaccctgaggacacacagagatgccaggtaacatcactgcactgagtctaatagtctttagcactcccacacgagcaaacctggctgcaaaatcatgttacacagcaacagaggaatgctcatagcacagaattaaatagagattctaagtcatgtgagggggcagccaggaaaaagggatgtttatgttatttaagtgacaatgaaagttaattatacagcacaggagactagaaaagctttatttgacgttgcagacttttagtgaccacagaagcagttgtaggtattaaaatttcatccatctcagtgtcatttatttactttgccagataatcagtgatcttgcatttttatcttctcactttaaatgtatgcacagaatgttctctcctatgcgatctcacatttattttattttttatttactttattgttgatttttttttttttttttttttttgagacagagtctcgctctgtcacccaagctggagagcagtggcgcgatgtcgactcacggcaacctccgcctcccgggttgaagccattctcctgcctcggcctcctgagtagctgggattacaggcatgtgccaccacgcctggatatttttgtatttttagtatagacagggtttcaccaggttggccaggctggtctccaactcctgacctcaggtgatccacccacctcagcctcccaaagcgctgggattacaggtgtgagccaccgcgcccggcctcaagttcattttaaaatctgaattgtcagctgggcatggtggctcacacctgtaatcccagcactttgggaggctgaggtggacgaatcgtgaggtcaggagttggagaccagcttggccaacatggtgaaaccctgtctctactaaaaatacaaaaaaaatgagctgggtgtagaggcaggagcctgtaatcccagctacttgggaggctgaggcaggaaaatcacttgaacccaggaggcggaggttgcagtgagccaagatcacgccactgcactccagcctgggcaacagagtgagactccgtctgagaaaataaaaataaaaaaatttaaaaaatatctgaattgtcctggtattccatccagtatcaggcttaagttgtcaagaagagataccagtcttgatttctgtgaactgccagaattacacagaaatttgctccacttcccggaaaaggcaaataaaacataccaggattttaggtggtgcaagtaagttgcttgccagagcagccatggctacatataatttgcccaattcccatcaggcatttggttatttaaattttaagcatgcttgatacagcggtcatattaaccttccttatatatgaggaaaacatttcaagttataattatgttaatggtattctaatagtatttttaaaaaattatataacatttattactccgaggaaattaatgtcagatgacactaaaataattaagtttgaattaatcacagattatatcactttgttctcttcaacttttaaacatgtttgataattataatctaacaaaggaaaaattaatagagaaaataagtctaaaaattttctcctccgaattggtaattgggggaacaaaagatgtgggcaattagcaaatgaatatggtgcttcaagactgaagaatttaggatatgtaacaggtgacttagttcagggttgttcctagaggtaagaagtatcaatagaatttaagagtctacactgttcattctatcagtatatcttctatggcacacaagaagcaatggttattcagttatcttaatttcttaagttataaaagttaaatttgagccaaaagcaattaccatgtaaaagtgtatgcagtttttttttttttttttttttgagacagagtctcactctgttgctcaggctggagtgcagtggcgtgatctcagctcactgcaacctctgtttcctgggttcaagcgatgctcctgccccagtctcccaagtacctggcattataggcgtgcgccaccaggcccagctaaatttgtatttttagtagaaacagggttttaccatgttggccaggctggtctcgaactcttgacctcaagtgatccgcctgcctcggtctcccaaagtgctgggattacaggcatgagctacagcaccaggtcggtgtgcagttttgaccttgttatttgaccaaggaaaatttagccatttgaaacaaactcttttttttttttaagactgagtttcactcttgacaccctggtgcgatctcggctcactgcaacctccccctcttgggttcaagctattctcctgcctcatcttcccaagtagctgggattacaggagtgtgccaccacgcccggctaatttttgtatttttagttgagatggggtttcaccatgctggccaggatggtctcgaactcctgacctcaggtgatccaccctcctcggcctcccaaaatactgggattacaggcgtgagccaccgcgcctggcccaacacacactatttcttacattaacttgatgtctcctttcacctaacagaagcaaaatacacgcctaattgaaagacagtcagtgtgtcagactgaaacaaccaccaccaaacaaccaaggcactgatcaggaaaacagcacttttcccttgattctgactttttttctcacatacctttatttgcattattcataggttttatcagaggtttatttccttgggttaataatgaaacatttttcatttgtttccaccaaggggcttgctattctactattgcttagagcttcgggtgtctccatatgacaaatgccaaacatatgccaatcacaacattcaactggtagcatatgctgaatttcccagacgccagatccagtcaggaactttctggtttaatgagtcttgcctattatgtttctggtacacatcattacagaatttttccccatctacttccaagaactagaataaaccagaagaacaaaacaaactacaacaaaaccataataaatcctctcttcgtttatcatctatatgtcacatacgaaattagttacactagcagcatttactgagggcatggcaagatttactaagtcttgtttctcatgttacagccaaattttatcaaagttgaaaataacaatattttacatccatatagttctttgtattatttatttcaaaggactttcagaacttttacctaattggatatttacaaaaacccgtcgattgaagtaggcagcaattctttctcccacttaatagaggagataaatgaagcccagataaattaagcagcgctcccaatgtcacagttagttattattattatattattttttgagaaggagtttcactcttgttgcccaggctggagtgcaatggcacaatctcagctcactgcaacctctgcctcctgggttcaggcgattctcctgcctcagcctcccaagtagctgggattacaggcacacaccaccacaatgggctaatttttgtatttttagtagagacgggggtttcaacatgttggccagggtggtcttgaactcctgacctcaggagatacatccactttagcctcccaaactgctgggattataggcatgagccaccgtgcctggccaacagttattaacagggccaagatccgataagaagttgccttgaacctcacatccactggtctcccactattcctcattaggctgtgccaaggacacaaagtcagcagggatcgagacaccattaacctccctcctgacactggaaggtggcccctacttcctctctgagttttttgtttttgtttttgtttttgttgagacggagtctcgctctgtcaccaggctcgtgtgcagtggcgcaattttggctcactgcaacctccacctcccaggttcaagtgattctcctgcctcagcctcctgagtagctaggactacaggtgcacgccactacgcccagctaatttttgtatttttagtagagatgggtttcaccatgttggccaggatgatctcaatctcttgacctcatgatccgcctgcctcagcctcccaaagcgctgaaattacaggcgtgagccaccgtgcctggtcctctctctgatagttttttaaacattcagaaaaatgtgaatgcatacttaggtttctgcctatatttcctgagagaaaatcatgcctcaacatcaaacgcaaagatcagtcttaaatctggacccaggaacaggaattctcctaattaagcacataatcccatttatctctctagaaacaactgacattcaaataatgcttcatttcgtttgtaaatactagttagatggattgtaatacaaaccaaagagacattaatacaattgtccatttcctttggaaggatggctatccttcctatttaagctaaaagacattttcatttgaaagccatttgagcttgagctgcaatgagctcaggtgcaaatttcttgatgaacgagtctaataatgacacaaaatttcaaaaagaccaagagctatttcatggattatttcctgtggcaatcatctcaagttaaataacttgacattttagaaatggcattgggtaaataactctcgggtgcttttttcactggtccgctcactccccttatcttcctgctgactaaggaaggtaaagggtatcctccacaggaggtgggaattcttggtcctttgaggtaaagggatttcccatcatatcgttccatctgaggctgttatggactcaatcttcccctcacatttatatgttgaaatcctgcccccccaagatgatggtattaggaggtagggcattcggagggttattagggcacaagggtagaaccctcatgagtgggattagagatcccagaagctagctctgcctccttcctcagtgtgaggacacccccagaagacggccatcttcaacccagaagacggccctccttcaaacccagaacttgcggacacctgacttccagcctgacttccagcctccagcagtgtgagaaatacagttctgctgtttataagccgtctatggtaatttgttacagaagcccaaactgaccaaaacacaggtttctatgaagtttgttttgagaaacagaaaaatgcttggtagttctgctattggttatcatttctcagacattataaaaattatgtcaacagcaccctcgacatgttatctctggacaaactgatgtgcttctagaattttgaatttatttacttaacttttattattagcgattagtttctacacacgtttgcaaagacggataaaatcagagccctaccattgagtagataacagcctagcaggggaggtagaaagacaaaactaatagtaatagaatgcgataatctttttttttttttttttttgaccgagtcttgctctgtggcccaggctgaagtgcagtggtgcaatctcgactcactgcaaccgctgcctcctgagttcaagtgattctcctgcctcagcctcccaagtagctgggactacaggcatatgacaccatgcctggctaatttttgtacttttagtagagacgaggtttcaccacgttggccaggctgtctccaactcctgccctcaggtgatcatctgcctcggcctcccaaagtgctgggattgcaggcgtgagccaccgcacccagccaataatctctttaatagggattaatgtaaaacaaaaagaaaaagccacacagtggatgatgaagctaaatatgtctcaccgtttgtctggtgttttatagaggtggtaaaatttcagttggtggttcctaataatatcaccttcacaatagaaaataaagatctatgtgcagataggttaaggttactccagtgatcaaggtagtgtaaaggataaagtaagaatgataataataatgagtatgtagctaaaagtcaaggattgtaaaatatcacagtagcttcggcctttaggtggaacgaagcctgtcttaggtaggatttcctagaagcagacactaagtggaagtgaattattaggaagggctgtcccaagggagaaagaaatagagcgtctgggggctagacagggaaaggaaggaagcccaacaagggtgtgtcattaggtaaattcttatgaagggttattttggctcattgctacaagagaactctagagacacttctcagagttgtcccgtttgggggatgggcagatgatgagagttgggagaaggaggagctgaagtaaacacccccatccttgtcagtctttggttaaagactctcctaggggtatgtaagtcaccaggcgaggctgggctctacagctacttggtaaagtttctgagcagtacagcatctgttacaggcccatttcagaggagttggttctagagtctattttattaatatctaagcatatgttaggttttaaacagaaagcgtcaagtctctggtggatgtgcaataacatcacaccatatttaagttcttacaaagatgtagaaggaagatgtgggtttcagaaatgttctggaaactagaaacacttccctgtgtgtcatgctgcgacggtgccatgtcacgcagcccactggagtggcgtgtgaggtaatgacattgacttcaggtcctggtgagaagactattgctaggaggcatctggctggctggtggctgctcatatcctacgcatacccacctgacagatctctaggattgaaacagagaatgtatgtatgactaagcataacagcaaattttcttctgtatgtaatttcaagacccttcttatcatctctcttagtgatctagtgatctgatgcttgtaataggccttcgtgaatattcctcacttcaaagtagtctgtgagacacacatacaaacgagattctattaacaggtctgccagtgaaacagcccaagtagcaaatttgatagagaacacgtacttgggcatacaaatcccaaaactatgtactaattccaccaggtataaatctcacccaccagaccaacgtctgaaaactatacccaatttccagtccataacaagttaaatggaatttaaggaggttcgttaaagtgttataaacttacaatataagagctacaaaagaatatcataaacaaataatgagaataactccttttctctaaatatacagttattcagagatttcttttgttcttagagaattgttgtcagtcttcctgattataaaaataaagtcttgttgcagaaaattaggcaagtacttcttagcatttttcccttttcctttttcttttggatatgccgttttattgaggtgcaaccatatataaaaacatacacaactcctaagtacatggttgagtttttataaagcaaagaaacctgtgtaagaaccacccagaagatggtttggtttctgttgagggcagagtaagttcatacagaagctccggcctcatcgttgtaacatgtatttgtgagctacttgaagaaacagaccatttcttctcttgtcctccacaatccttgaatatttcatttgttttggagattgacagatcaagttattcattcattaacaattattaatccctactatgtgctcagcagtcagtgtgtgatgatgagacttggagtctagtggaagacacaggtaatacagaagcaaatatacaaagtgttcactataaaatacaaaatgctagggaggaaataaaactgatactgtggtcaagaataactaggtatcctacctagaaaaaatggttagagaaataaatcagagatgagatttagatagaaacttgaataaaaagaacacagccatgagaagagagaaggaaaacacattccaaacaaagggaacactgtgaacaaagtacacaaatccggcttgttgcacaaatggaaaatcaggtgactaggcgttggtggccataggtgtgagtcggacagcaaagacagagaccaggccagtcatggctatactggccaggagagtgacttaaagtgctaagtgcaatgtagggggaaaaaacggggttttagcaggaaagtgaagggaccgatctacgttttaataagagtaccttgaacactgtatgagcgggtggcgagagacaaagcaaggtgccggcaggttatcgcggtggcaatggaagatgtactctggaggtatatcaaccatttctgtggatggattggatgtgggagtgtgggaggtgcagaatcaaaatccatcaagtctttttacttcggcaattatgtggaatgagttgtcattcactgagatggagaagattcatggagaaataagtttccatgaaaaaaagcaagagtttagttttgaacatattacatttcagatgtttgagaaacatccgcgtggagttgtcaggtaagtaatttggataaatgagacgggagtgctgagaggagagctgagctggagatataaatttgggagtcattagcatatagatggtttctaaagccatgggaatataactcaaggagaagatagagaggacgtggggccaagctctgaggaccttcaaccttcagaagttgttcaggttcaagccagaaaaggctcaaaacgctaagcagaaagaatcgtagatgtaggagaaaaaccaggtctcagaagccacgaaagcagagtttcaaccagagggggtggtccacagtgcccagtgctggagagaggctgcgtaagaacaaacgagaggagcatctaactgggcttggcattgcccaaagctgttggtgatgctgtctcaggggaggaaagattaaatgggaagggaaaatggggcaagaagtgaagtgagtggggtccaggtaagttctttaagaggcagacgctcttacaacacaatgtgcattggggaaatgagagaagacaataaaggagagaggggaccagccaaaggaacaacctctttgatgaggcagaggtgggtgtccagcacaagtggaggcctttgcatctaagaggagaaaggacgctttttctcaagaaatggaagacaagaaagtgagtgctcttggtgtcaccttcttaaattgcagtaacatataaggcaaagtgagcagccggaaagaaagaggcaggggagggtgggaggagtgggaggtcttattagaagcaagggatagatatagggggggtgctgtagagagtgggagctcatacctcaggaaaccgggtactgacaaggagggaagagccatctgctgatgtgaacttacagtgtcctcggtttacccaaatgtttactaccaaaaaaaaaaaaaaacaccctaaagcttcaagggaaagaaactaaaacacagaccaccacagtcatttaaagctatgcatttgctcaggaagtgcaataaaaagcgtgtgggtaactgggcgtggtggtgggcacctgtaatctcagctactcagaaggctgaggcaggagaatctcttgaacttggaggcggaggttgcagtgagacgagattgcatcactgtactccagtatgggcaacagagcaagaatccatctcaaaaaaaaaaaaaaaaaaaaaaaaaaaaaaaaaaaaaaaaaaaaaaagggtaaaagtgagtggggaaaaggcagctgaaagaacatgagtgaaatgatgaactttggaatctcaggtggataaagacaggagtcatggcaggagggctggggaaggagagaaagcggcgagggactcccgtggaggttaacacagcaagggctctgcaagcaccgcagctgtcgctggagacgcgaatgcttcattttgttattttggaggtgaagtaacatctagttcgactctgttacactgagagtgttcgatgagaatagagtagaagaaaatgtcactgaagatgagcagatcaatgaatgaagatacaggatactgaggggaccattcatgtaaataatgagttgccaagaaaacggacagaatggccaggcgcagtggctcacgcctgtaatcccagcactttgggaggctgaggcgggcggatcacctgaggtcgggagttcatgaccagcctgaccaacatcgagaaaccccatttctactaaaaatacaaaattagccgggcgtggtggtaatgcctgtaatcccagctacttgggaggctgaggcaggagaatcacttgaactcgggaggcagagtttgcagtgagccgagatcgccccattgcattccagcctgggcagcaagagcaaaactccatctctaaataaataaataaaaaagaaaagaaaacggacagaatttggagaactgggggtggcagacaggacagataaacatcctcagtgaggtggcggggggcaggaggttaacagatgacagtggcaacacggggtggggggagcacagcgcagcgcaatggcatgaagatcaggggcttttactagagccatgggaatggcagcttggctggtgttgaggaggaagcatctcatggccttgccggagccaggcgtacattgggacggcctccagagaaggcgaaagacccagccaaggccaggtcaccacagaaatgttctaaaatgagactgagaatttaacaatggggtttgtgattgtgggaaaaattccaaaagcagagtgtatcaactatcaagaaaaatgatgaaatatacttatttggggggctttatagaaaggaggaattctgtgctacacctattatatatctaactcaaaagtcacttattcagttccttttatacgcaatggactatgcttctaacagacttttcagccacatgcaacaaaaaaccaagtaggaagggcccataggttggtgcacaggtcagtatgtgataccccaacgcaaacacatggtaaatgactggcaaaagtcaataatggctatatatattatatatggaggcatttatacaaagaggaatatatagaaggaggaatttaaaatcatgtctagagtaatataatagatgttaacaatcatgataatagtatttcaaagtatattaaacaaaatggattcatttctaacccaaccagtaaaatattctttgaaccaagattttactaggatgccaaatttaaaagttaaaaaaattccagctttttgagtaatgagcaatttcagtcatcaataaaattaatgaaaatgagagagcaaattacactaatccattgggtaaagaaaaacttaaaacattacccaaatagaagctttcttttctattgcttttcatcagtaataggtatcaactacatttaacaaaaacactgttgctgagataactcaccctcttggtttttaaatacactcaagatatgtcatgtttcaataaatgatgtcagcgttacactgtgtgaaaaaaatacaaaaaaaaaatttaagtttcatctataaatattattccattgacatttcataattaaagtttctaaagaatgaattcaaggccggtggctcacggctgtaatcccagcactttgggaggccgaggcaggtggatcacctgaggtcagaagcttgaggccagcctggccaacatgataaaacccagtctctactaaaaatacaaaaactagctgggtgtggtggtgtatgcctgtaatcccagttacttgggaaggcgaggcaggagaatcgcttgaacctgggaggtggaggttgcggtgtgccgaaatggctccagcctgggcaacaagagcgaaactccatctcaaaaaaaaaaaaaaaaaagtgagaaaacattggagaacataacttgattgagtgagaaggaaatggcagcttagagcagaccctgaaagcagggaggcagctagctgggcctgatctcctgctgcagaaacaggcaatacatccgtactgtgtgaagcccctaagtttgtcactatttgtcatgcagaaacaggtaagtaagacatattataactcggaaaaaatctcaaacctgttgcacaagaagttatttaccattgtaagctctctgcgaaatgttttggaaacccaagttgagaacagctttgatcagaggcaactgaaggcgggcagaagaaaccaagcagtaactactcagctggtgtgtgtgtgtgtgtgtgtgtgtgtgtgtgtgtgtgtgtgtgtgtgtgtgtgtgtgtgtgtcagtttggcagacgccttctttttttttcccctctagtgcatcatgttgaaactgtagctaatgccgggcgcagtggttcacacctgtaatcccagcactttgggaggccgaggcggggggatcacgaaatcaggagatcgagatcatcctaaccaacacagtgaaaccccttctctactaaaaatacagaaattagccagatgcagtggcgtgcacctgtagtcccagctactcaggaggctgaggcaggagaatcgcctgaacccgggaagcagaggttgctgtgagccgagattgcaccactgcactccaaccaggtgacagagcgagactccatctcaaaaaaaaaaaaaaaaaagagaaaaggaagctgtagcttagaacaggagaatgcaagtgattattatcaggaattgcatctgtgagggaacctgaggactcaagccagcccagcagagggcaaggcagcacagggcatgagtcattctcctgatgctaccttcacaggatatcagacaaaggaaactgagcacctgccccatttgatgaaataaagcagataaaagataatacatttaaacaattagatgtgtatcttttatatccaagcaatattgtacagaaaggcaccacctctaccttatgacaagtgttactacccatactcaggaaaccccgatgttgccagcacagaagccaggacaacagaaagctgaacaattccttttgcccaatgtgaacatctccaataaggctccagtttggaagacttctgaaggcctttcaaattcataataaatgctatgaactgccacacttaatcccctgtattctggctgggccagctgttataatacaccaccccacagtcattgctgcttggtagtcgaacaaacacgctggagtcagaggccagagtccttcctcatgccaccagcttccctgagcctagtcccaacaccattccccccagggcactttgctgtggcctcactgggtgtgcccacgtggtcttgccctgaaccccaatctgtaatcagcaccagctcttcaggcgttgaccataaaaggcactgaatgatggtggtgtttttttgttttctgttttctgtttgtttgtttttttgagatagagtcttgctctgtctcccaggctggaatgcagtggcatgatctcactacaacctccacttcccaggttcaagtaattcttatgcctcagcctcccgagtagctgggattatcaggcgcccgccatcacacccagctaatttttgtatttttagtagagatgaggtttcaccatgttggcctggctggtctcgaactcctgacctcaagtgatccacctgcctcggcctcccagagtgctgggattacaggcgtgagccactatgctcggcggatggtgctgttaacaacagtatctatccttgacaatatagggcttcttctgaccacctcaaagatgctactgcatcaggctttaccaaattcttctcttgttacatgagtttcagctcaagaatcagatcatgggggaagcttcaagagcagcaaaacttgtaatttttgcccagttgccctacaagaaaataaagttttgactcttaggcataatcaccatggtgagaacctatatattaatatctacacacaagtatctatatctctccttttaaatatactctttagatggctgctccttacgacaaaggttttatttggtgatttgatgataaaaaaaatcacttttctttatggtgactattatgccatcatctttactaacaagtatattatcaggaatctcaaagaaagtggcattcatgttatagccttcattacttcaaactattccggattccccatattattttacatattttcactgacttttaagcaaatgctttaattttccctttttttttttttttttctgagacggagtttcgctcttcttgcccaggctggagtgcaatggcgccatctcggctcactgcaacctccgcctcctgggttcaagcgattctcctgcctcagcctcccaggtagctgggattacaggcatgcgccaccacacctggctaattttgtatttttagtagagatggggtttctccatgttggtcaggctggtcttgaactcccgatttcaggtgatctgcctgcctcagcctcccaaagtgctgggattacaggcatgagccactgtgcccagcaattttctacttttttttttttaatttcttagatggggtctcattctatcactcaggctggagtgcagtggagtgatcttagcccatcacagtctctgcctccaaggctcaagcgattcttctgcctcagcctcctctgtacctgggatgtgccacaggtatgtgccacacacccagctaatttttgtatttgtggtagagatggagttttgccatgttgcccaggctggtctcaagttccggagctcaagtgatctgcccacctcagcctcccgaagtgctaggattacagcatgagccaccgcgcccagccaacttttctactttaaaaaggcaattggtgaaacctcttctctactaaaaaatacaaaaaattagctgggcatggtgccaggtgcctgtagtcccagctacttgggaggctgaggcaggagaatggcgtgaacccaggaggcggagcttgtagtgagccaagatcgtgccactgcactcctgcctgggcgacagagcaagattccgtctcaaaaaaaaaaaaaaaaaggcaattggtaagttgtatgaacattttgaaactcaaacatttttgtgttaccaggaaattcactatagagagaatgaaaactacgactatttgtaaataatactatgacacagactgcgacaggccactaggctgatttgcaggtaaaatttttgttctatcaaaaccttaaaaaccacatggacacacacacagccttccccagcccctgccatcccatcacacacccttccccagcccctaacatcccatttgtggatgtaactgacatataggaagacagcccatagttatcatttaggttcaccttgtccctggaattgtgctacataaagaaactgagaagcatttctacaagaaagctacgggtcacttgtgaaaagccccaattcatcccagctgaggcatttatcttgttggaatcactggtaaaagggaaagccttgtctcttaaagactttcagttatagaggctacataaaaagcaatggccaccacaaagcttaaacagataaactatccattttgtgtcttctcctatacattagtaattacttttaaaaacatctccacctgtaccttagcctcttattcctcaccagtattccttaccaataagcaacacatatcctactgatattttgttgatggagatagaaattaaataggtggctaattcttcttcacatacgagaaaggaaagttatggaatgaaaatgatgtctctaaggtcctaaatttttcaaactagtgccacctaatctgtgaccatggctaaattctcttgtctcagctttcttccatataaaatgagttgtctaacaaacagtaagctcaattaacatctgataccattattattaaactttttctatttatatgtatttcattctcagttaatatgatgacagaaggggataaacataacttatcaacgacattaatatgacttctttcccctactacattcgttaataaagaggttataattaggtttcaaagacagcatttcattaaggtgatttcattcagatacaactatttgcatataagtgcaataaaaaccttagaagtttctatttgactatgttagcttcataagtagaaataatacacatgctttatgcttaggttaaaaatcagcctaacaatatattcatgattagttcaaaagagcagacatcaattacctataagtttataactgtcaacacataacaattacaaattagaaacagagtaatcaaagtcaggtcataatcaatgtccagaaggtcaaagacatgcagaggccaaatgcatcttctaagtgttgcctggatcaatgtcttatattttacaagtgtaaacatggaaaaatcaagttatttttaatacacttaagaaatgaagtgatttttaatacatcccatatagtaaaaacataaatttgaactaatgtcataacacccttctggtgtccttttcattaaaatgcactaccctaatcatgtttacaattgatatttctctgaagtataaattacagattgtgttaacaaatttgcaaaatgtggcaaaaatatccattgccaacatatattcattcaagtcaatcagtgtatacttaatgagtgtcttctttctccagaaactttactaagatggaaagaaggctttcaattaaagcccagagagagagaggcaaaaaaaaaaaaaacccaggtcattataaaacatgaaaatctgtgaagttataaagatgcccactgggtatgagggtgataacagagatcatttccaggtaacagaaaagactttataaaagggtcatgtctgagttgagccgtaactgaggagtatttgaccagatgggactgaggaaggaaagacgatttgcagcctaggcgatcaaaggagcagggcgacggggagaaatccatggagcgtgtccaactacagtcagtctggtgtgagatgctgcagtcccaagcgcatggagtgatgaagataaagctgaggtctccaggttgcggagagccttaagtattaaggggcttgggctttattctttgggcaatgatatttactaaacagtttcaagcacaggaatgccatggtcacatttttcattgtaaaagaacatgcttatagcagtggagtagatattgaagagaaagactgagcgaaagaagaaagccaatgactatctagtttttaaaagataatctagtgagatgcagacaagatggtagaatagaaagctccaccgttcgtcccccgaccccgcaaggacaccaagttaacagctaatctacataggaaaaacaccttcttaagaaccaaaaatcaggtgagcactcatggtacttgatttccacttcatatccctgaaagaggcactgaagtgatttaaaaaaacaaaaacaaaaacaaaaaaaacccgtcctgaatctgctgacaccacgcctcccttactgggggcgaagagcatctctgggcactaggggagggagaacacagcaattgtgaggcattaaattcagtgttgtcctgttacagcagaaaggaaaaccagaccaaactcagctgatgcctgcccatgccagggggaatgcagatccctgtggtcggaacttgagtgcctgcaaaccttgccacagagggctacagcactctgagtctccaggtcaatgtgaaaggcagtctaggccataaggactacaactattaggaaagtcctagtgctgaactaggcccagagacagtgaactgggggtgggagggcacgtgacatactgagacactagctgggacagacaagggagtgctggcatcactgctcccctaatcccaggctgcacagttctcagctccagaaaagaccccttccttccacttgaggagaggagatggaggagtagggaggactttgttttgtatcttggatactagcttagccacagcaggaaagggcaacagactgaattgtgaggcctctgttctaggccccagctaccagacaacatttctagacacactctggcccacaagggaacccactgccttgaaagaaaggagctggtgccagcagcattcatcacctgttaactgatgagcccttgggtcacgaataaccagcagcaatatccaggtaccacgtcgagggccttgggtgaggctctgggacatgctggcttcaggtaccagcacagctactggggtccaaaatgccaagtgtgctcttggggtccccagttccaggacttgacccttggatggcatttctggacctgccctgggccagtgggaagtccactgctctgaagggtgagtcccagaccaggtggcattcactacaagctgacttaagagcctttgggccttaagggaacatcagggctagtctggcagtactcctcatggtctggggtagtggtgattacagggtgaggctcctctgcctttggaaaggggagagaaaactgggaaggactgtattttgtgttttgagtgtcagctcagcagcaataccaggttgatgtctaagacttttgactctagttcctgacccccagatggcacctctggacctacccagagagcctggcagacctcactgccctgaaggggaaaaaacaggcctttatcacctactgattataaaaccccagggccttgagtgaacataggcagtagccagggagtggttacagcaggacttgggtgagactcagccctttgttggcttcatgtctgactcaacaaagtcatagtggtggtggccacaggggtgcttgtgtcactccacctcaagctttaggtggctcagaacagagagagagaaactctttgtttaagagaaagcaagagagccgggcgcagtggctcacgcctgtaatcccagcactctgggaggccgaggcgggcggatcatgaagtcaggagatcaagaccatcttggctaaagcagtgaaaccctgtctttactaaggaatacaaaaaaattagccagacgtagtggtgggcgcctgtagtcccagctactcgggaggctgaggcaggagaatggcgtgaacccaggaggcggagcttgcagtgagctgagatcgcgccactgcactccagcttcggcgacagagcgagactccatcttaaaaaacaaaaaacaaaaaaaaaaaaacaaaaaaagagaaagcaagagaagagaacaagactctctgtctggtaatcaagagaattatcacagatcttgtccaagaccatcaaagcagcacctctatgagtctgcaagaaccacagcattactgggcttggggttccccctaaagtagatacagcttagatcacaatacccaagtcctgttaaatatctagaaagcctttctgagaaagatggctacaaataagcccagacagtgaagactaaaataagtacccaactcttcaatgcccagacaccaaagaacatctgctagcatcaacaccatccaggaaaacatgatctcatcaaatgaactaaataaggcaccagggaccaatcctggataaatagagctatgtgacctttcagacagagaattcaaaatagctgtgctaagaaaacacaaagaaaattcatgataacacagagaagcaactcataatcctatcagatacatttaacaaagagaatgaaataattaaaaagaatcaagcagaaattctggagctgaaaaacacaattggcatactgaagaatgtatcagagtcttttaatagctgaactgatcaaggagaagtaagaattagtaagcttgaatacagactatttgaaaatacagagtctgaggagacaaaaaaaaaaaccacaataaattatgccttgcctacaggatctataaaatagccttaaaagggtaaatctaagagtaattgggctgggtgcggtggctcatgcctgtaatcccagcactttgggaggccgaggtgggtggatcacagagtcaggagatcgagaccatcctggccaacatggtgaaaccccgtctctacaaaaaatacaaaaattagccaggtgtggtggtgggtgcctgtaatcccagctagttgggaggctaaggcagaagaatcgcttgaatcagggaggcagaggttgcagtgagctgagataacaccactgcactccagcctggcaatagagcaagactccatctcaaaaaaaaaagaacaaaaacaaaaaaaacagtaattggcctattggccttaaagagaaaataaaggacaagataggggtagaaaatgtatttaaagggataataacagagaacttcccaaacctagagaaagatatcaatatacaactacaacaaggttacagaacaccaaggagatttaatgcaaagaaaactacatcaaggcatttaataatcaaactcccaaaggtcaaggataaagaaaggatcctaaaggcagcaaaaggaaagaaataaataacatacaatggagctccaaaacatctggcagcagacttttcagtggaaaccttacaggctaggagagaatggcatgacatatttaaagtgctgaaggaaaaatcttttatcttataatagtgtatctggcaaaactatcctttaaacatgaaggagaaataaagactttcccagacaaacaaaagctggagaatttcaccaatagcagacctgtcctacaggaaatgctaaaaggagtacttcaatcagaaaaaaaaaaaaaaaaattaatgagcaataaataatcacctgaaggtacaaaactcactggtaatagtaagtacacaggaaaacctagaatattataacagtgtaactgtggtgtgtaaactactcttaccctaagtaaaaagactaaacaatgaacgaatcaaaaataataactgaaataacttttcaaggcatagtgagtacaataagatataaatagacacaataaaaagttaaaatgccaggggataaagttaaggtatagagtttttattagttttctttttgtctctttgtttatgcaattggtgttaagttgttatgaggttaaaatgataatatcaaaccaaaacaacacacagtggagacacaaaaaagaaaaagcaagaaactaaaacgtatcaccagagaaaatcacctctgctagaggaagataggaagaaaagaaagaaggaagagaagacaacaaaacaacgagaaaacaaataacaaaatggaggagtaagtccttacttataaataataacattggccgggagcggtggctcaatgtgtataatcccggcactttggaaggctgaggtgggcgggtcacctgcctgggaggtcaggagttggagacaagcctggcaaacatggtgaaaccctatctctactaaaaatacaaaaattaaccaggcgtggtggtgtgtgcctgtaatcccagccactccaaaggctgaggcaagataattgcttgaacctgacaggcagaggttgcagtgagctgagatcgtgccattgcactccagcctgggtgacaagagtgaaactcagtctcaaaataaatacatacatacatacatacatacatacatacatacatacatataatgaatgtaaagggactaaactctgcaacaaaaagacacagactgggtgaatggatgaaaaaaacaagactcatttatatgttgcctacaagaaacacacttcactataaagatccacatagattgaaaataaagggatggaagaagatattctatgctaatggaaaacaaaaaatggcaggagttgctatacttatatcagaaaaaatagatttcaagacaaaaactataagaagatataaaaaggtcactatataatgataaaggggtcaattcagcaagacgatataagaactttaaatatatatgcacccaacactggagcacccagatatattaagataaagcacatggtattagagccaaagagagagataagcctcaatacaataataactagagacttcagtaccccactttcagaactggacaggtcttcaaatagaaaatcaacaaagaaacatcagacttaatcttcatgatagcccaaaaatcagcagcatttctatatgccaagaattagtagaagaaaataataataaagatcagagcagaaataaataaattgaaatgaaaaaaatacaaaagatcaataaaacaaaaagttggtttcttgaaaagtcaaacaaaatagacaaatctttagccaggctaacaaagaaaaaaagagagaagatccaaataaaaccataaatgaaaaacgaaacattgcaactgatactgcaaaagttcaaaggatcattagtggctactatgagcaactatatgtcaatatattggaaagtctagaagaagtggacaaattcctagatacatacaacctaccattattgaaccaggcaaaaaaatccaaaacccaaacagaccaataacaagtaacaagattaaagccataataaaaaatcttccagtaaagaaaagcccaggacctgatggcttcactgctgaattctaccaaacatttaaagaagaactaataccaaccctactcaaactattccaaaagacagaggaggagggaatacttccaaacttgttctacaaggccagtattactctgataccaaaaccacagacacatcaaaaaaagaaaactacaggccaatatttctgatgaatattgatgcaaaaatcctcaacaaaatactagcaaactgaattcaacattacatcagaaagtgggatttatccctgggatgcaaggatgattcaaaatattcaagtcaatcaatgtgatacatcatatcaacagaatgaaagataaaaatcatatgatgatttcaattgatgctgaaaaagcatttaataaaattcaacatccttcatgataaaaattctcaaaatactggggataaaaggaacacatctcaacatatggcttttattaaaagccataaatgacagacccacaggtagtatcatactacatggggaaaaactgaaagcctttcttctaagatcgggaacatgacaaggatgcctgatgtcaccactgttattcaacatagtactggaagtcctagctagagcaatcagaaaagagaaagaaataaaaggcatccaaattgtaaaggaagaagtcaaattatccttgtctgcagatgatatgatcttatatttggaaaaaccttaagattccacaagaaaccattagaactgatacccaaattcagtagagttgcaggacacaaaatctacatacaaaaatcagtagcatttctaaatgccaacagagaacaatgtgaaataaataaaagaaatttttaaaaattccatttacaatagccacacataaaattaaattcttaggaattacccaaagaagcaaaagatctctataatgaaaactataaaacactaatgaaataaatcaaagagaatgccaaaaaaggaaaaatattccatgttcatggataaaatccaatattgttaaaatgtccatactacacaaagcaatctacagtttcagtgcaatctctatcaaaatgccaatgacattcttctgggaaatagaaaaaagaatcctaaaagttacatggcaccacaaaagacccagaatagccaaagttatcctaagcaaaaggaacaaaactgaaggaatcacattacttgacttcaaattatactacagagctattgtaagcaaaacagcatggtactggcataaaaacagacacacagagcaatgaaacagaacagagagccaagaaacaaatccacacacctacagcaaactcatttttgacaaaagtgccaagaacatacactgggaaaaagagtttcttcagtaagtggtgctgagaagacaggatatcaataggcagaagaatgaaactagacttctatctctcaccatatataaaaatcaaagcaaaatcgatttaaaaattaaatagaaaacctcaaactatgaaattacttcaagaaaacattggggaaactctccaggacactggtctgtctgggtaaaaatttcttgagcaataccccacaagcacaagcaaccaaagcaaaaatggacaaaggggatcatatcaagtcaaaaagcttctgcacagtgaccaagaagcagcttctctgctccttctggaatctctgcctggttcaatccacttgcctctactcctgcctccaccatgtccatcagggtgacccagaagtcctataaggtgtccacctctatgggcagcagcagcttccgggggtggcctgggtggaggctctggtggggccggcggcatgggaggcatcaccgccgttgtggtcaaccagagactgctgagcctccttaacctggaggtggaccccaacatccaggccgtgcaggagcaggagaaggagaaggagcagatcaggaccctcaacaacaagtttgcctccttcataggcaaggtacggttcctggagcagcagaacaacatgctagagaccaagtggagcctcctgcagcagcagaagatggcttggagcaacatgggcaacatgttcaagagctacatcaacaaccctagggggcagccggacactctggtccaggagaagctgaagctagaggcagagcttggcaacatgcaggggctggtggaggactttaagaacaagtacaaggatgagatcaataagtgtacagagatggagaatgaatttatcctcatcaggaaggacatggatgatgcttacgtgaacaaggtagagctgtagtctcagctggaagggctggctgacgagatcaatttcctcaggcagctgtatgaagaggagaccttggagctgcagtcccagatctcggacacatctatggtgctgtccaggacaacagccacttcctggacatggacagcatcattgctgaggtcaaggcgtagtatgaggagatcacccaacctcagccgggctgaggctaagagcatgtaccagatcaagtataaggagctgcagatgcaaagactgagatctccaagatgaactggaacatcagccagccccaggctgagactgagggcctcaaaagccagagggcttccctggaggccaccatcgcagatgtcaagcagcgtggggagctggccattaaggatgccaacaccaagctgtccaagctggaggctgccctgcaacaggccatgcaggacatggcgtggcagctgcatgagtaccagaagctgaagaacatgaagctggccctggacatcgagattgccacctacaggaagctgctggagagtgaggagagccacctggagtctgggatgcagaacatgagtatccatacaaagaccaccagcgcctatgcagatggtctgagcttggcctatgggggtctcacaagccctggcctcagctatggcctgggctccagctttggctctgacatgggctccagctccttcagctgcaccagctccaccagggccatggttgtgaagaagatcaagacctgcgatgggaagctggtatccgagtcctctgatgtccttcctaagtgaacagctgcgacagcccctcccagcctgcccctctggtggctgccccagagcctgggagggaggctgctgtgcagcggagcacagggaatgggagacccacctgaggctcagccctagccctcagcccacccacgggggagtttactgcctggggaccaccttgcccatgccttcagctacaaaacaactcaactgcttttatttttttccccccaaaataaaacctcagctagccctgaaaaaaaggcttctgcacagtaaaaggatacaatcaacaaagtgaagagacaaccaaaataatgggagaacatatttgcaaaccctgccaggggattaataatcagaatatacaaggagctcaaacaatgctataggaaaaaaatatataataatctgatcattttaaataggcaaaagatttgaacagacatttctcaaaagaagacatacaaatggcaaacaggcatatgaaaaggtggtcaacatcactcatcatcagagaaaggcgaatcaaaactacaatgagctattatctcaccccaggtaaaatggcttgtatcccaaaagacaggcaataacaaatgctgtcaaggttgtggagaaaagggaaccctcatatactgttggtgaaaatgtaaattactacaaccactatggagaagattattttttagttttgaggttcctcaaaaactaaaaattaagctactatttgatcctgcaataccactgctgggtatatatccaaaagaaaggaaatcagtgtatacaagatatatctgcactcctatgtttgctaaagctctgtatataatagttaagatttggaagcaacctaagcatccatcaacagatgaataatgcataaggaaaacgtggtacacatgtacaatggagtactattcagccataaaaaagagtgagagccagtcatttgcaacaacctggatagaattggaaactattaaataagccaggcagagaaagacaaacatcacatgttctcacttatttgtggaatctagtaatcaaaacagttgaacccatggacatagagagtaggagaatagttatcagaggttgggaaggtagagggaggatgggagggaaaaaaatagaatgaataagacctactatttgatagcataacagggtgaccacagtcaataataacttaattgtgtattttaaaataacttaaagagtgtaattggattgtttgtaactcaaaggataaatgcttgaggggatggatactccattttccatgttgtgattatttcacattgcatgcctgtatcaaaatatctcatggctgggcacagtggctcatgcctataatgctagtactttaggaggctgaggcaggtggatcacctgaggtcaggagttcaaggccagcctagccaacatagtgaaacccctgtctctactaaaaatacaaaaattagatgggcgtggtggtggatacctgtaatctcagctacttgggaggctgagacaggagaatcgcttgaactcaggaggcagaggttgcagtgagccgagatcgtgccattgcactccagcctgggcaacagagaaaaactcatttcaaaaaaaaaaaaaaaagcaaaacaaatgaaaaaaagcaccttatgtatcctataaatatacacgcatactatgtacccacaaaaataataattaaaaaagataatctagtgaaaagatgattcaggactgatcagaggcaatagttaggcaaaaaaattaaaactgctttgacaaacttttggcagataaaatttgtgattggttgaatgtaggcactcagtgagaagggataaaacagaaaactctagtatggaggactgggtagatgtgacttccccacacgagaaaacagccattgatttaggggcagcaatgaagattttagctggatgtaaagtacccgtgggatgtccaagttgagggagccaggagcaaggtgcctgagctggcacttcagggagaagcctggcatggagctaggaggcaggcaacatatgctcaacgaggaaagagcccagaggtggcatacaggataaacagcaagagaaatatgaagagaactaggaaaatgcagataagtaactgcactatcaataaaatattaaaccacaaatgtgagactcattgccctgtcatgttatctgagaccaatacattcaaaagcaagtataataaaggtacagatgacctgagagcacagaaatgcttagacaaatttggaaaaaaaaacaaacagacattccagatgcaaacctaggattgaacaattagtgtatctttgactatcccccatctcattacccatccagcctgcatcctggcacctagacttgagctctggccctctattaccccctttaggtactgtctcacctgtcccaaatgtgtctttgaatgtccacgtaggttctgaaggtggccttcagtctgtcatgctgaatgagttaaattttccaggaaaatccatatcccaaattattgcttactatgatctcctgcataatgttaagtaacttgggttttactctacatgcttccatactgctacagaataaacactcagcactcgtgaaaaagaatttatggctacagaaaacatatccaagacttacacaagaagatttacagctaagccctgacattaattggctttgtaatccagcttagctcctcttgctccagctgtcatctgcagaatgaagataatggagcagtgaagttgtcacagcatccgaattactatcctgatgggccaggtgtagacagacatccttaagtctgtcactagagagagcaaaacgtcttcatgggggcaatatcattttacagtatttggggcactgaaatattcctttcagagtgtccttactttactacaaaatgtcctaccagggaaagaaaaatattatcaattctattgaaagaaagcattaaaggaatctcactagctctttcagtaaaatcaatcaggaaatcatgaatgataacacttattatgcagacatacattatccatccactcctttaaaaatatttatagaaaatttaggttcctgtggctgtgaaactattctcaaaaaactctgcgtaacctaaaaacaaacaaaaccccctggggctcttccctttgctccccagtaattctcctctgcatttttaatatctgtgtgtcaccccctgtcattaataaagctatcaacagtcagtaaaaggcaacagaagtgtttcattgaaatcttaattgccagacatacagaatatcttaaaaactgtcctttaaatgcccacatttctcaaaatcatctcttaattttatttacaattacatttttcactttctgggtgctccattttccatttttagaatgtcttatatatttgggtagattccaaacagaaaatgagttccaagccttggactgaatcactcattccaatgggtgatcctaaaactgaaatgcaggcttacctcaaaaactaagacctcccagccctcactctgtgcatgcaagcttccaccttttttcatgcaagctccccaaggaggacactgcctctcgtgcacaggcaggcccaggagctgatttggagatctttctggctctctgtcgtctgcagactttcagtgctcccatgcatagatattggtccccttcctgaggatcataacaccttcgagttcttccatcctttgaaacctcctcgttgtgacaacgttccagctagacccagcttgcttctactaagtctgttctgtttactgtctcttttgttataaaattatttactcattttattttagtgatgtgaattaaatgggtcatatatgcttttgctagtaatccaagtgatattgaggtttctacattttaataatgagtcacatcctctggtctaccaatgccacttccatcacccaccccttcctagttaaaaatttggctagcatctttccgtacttttctcttatttgtacaaacgtgaaatacatttacataagttcatttaaagggaatgtataacttattctgaattatgatttatatattctgaattgtgatcatttatgtaacacaaagctcgctgcttgcagagtagaattaacaagcgtgaggcctgttagaaagaaagtgactttattaaccaaaactagtcgtggggaagtggttggattcccatccaaagcaactacttcaaattttggtggggaaggaaagagtttaaaaagggagaacttgatacgaaaggcatgccagaactgtgctgaggacgatgcctgtgcatcttgttccagtggctatcttgggtcccagtccacctggtacatggtctggcatcatctcaacagtggcggggctgctgattagccctctgaggccatctctggaactctgcagctgggtctccaggcttggtctgtctgtctcaagattagcccccaaatcttcaaagaaggcacataattagatgctagcgtacagttagataaataagaagggagtatatctggagaaaaacggagggacgtggagtctattttaaggctaaaggaaacaggcttctgtagtttgcttcaaggttacatcttgaaacccaagagaaagaggaaaaaaaaaagttttaaaatgcattttgaggttatgctgcccagttacatttacatcatgatattcttaagccaaccatctttttaacgtctctttcatagtatggatattccggtttttattctaccatttcattactgatggatcttcacattgaatatttcgtcactagaagcaatactgctacttatttcaacgtgtatcttggacattcctgtagttttatttctgaaggctaaattctcaaaataggatggccgtttcataggaaatgcatatgtacattttgaagagatcataagattgctatcccccaaaatgttgaagtaatttattcctctatcaataagacatatagcccctatttcttcaacagcagtgaatgatactaagttgttttttttttttgctgatttgatagacaaaaagaggtattttgttgttttaatatgaacttgcttgattccagtgaggtcaaatggattggttgttttattttccattatgtacactagttgttctgagtggacttggcaacagtgtagttgagttttcccctttcacattttatagattagggatgttaatcctttgttttatgcttttcaaatattctctcccagtttatggtccatcttttatttctatttgttatttctttcaccatacataacatttcagtttttatgtaatcaaactcatcagtgttcttggtaatggctactaggtctcctctcctccttcagaaggcctcttctatgccatggagaaaatgaggctcgacgtccctcaaattccaggccatgcacctggatctgcatctatcttcatcttctgtcagtcttggagaaagcgatgtcttctggtagaaacagaactacctactgtgttcttcacctcttcattgcttcagacaaaagactgcaaaatgacctctgcatggtcacacccagtaaaccatttttaaccctgacctttattgctcattctacacaggtgacccctctgatgatttcataggctctcacttgtgaattcctgaagacatcctggctgtcctcctctccctccagcaattgtatctcagcttcctgagagcacatgccgcttttcctccgtattttcccttggtcttttttcatttaatgcagtcttacttgttgaccccctagctcccaggacttacagtttagtctctatgctgatacatgcagacttgacctccatgcttgcctctctagcacattcccagatttctcagctccagacccatttttatacagactacacatccacaactgagcctgtcatcaccatcagatatttggtgtctaaaagaatggccagggctacatcccagtcacacaggctataggtctcactgtctccatggactcctcaacactatttgtattataaataaacaccataggatttgtgccctctagacccatgacaccctatattccagaacaagagaacaatcggcctggaggttttgcttggatctcttgtacactcttgcaacagtcccccagcagcaactctccagtcattctccattcagttttgcattctgtagccataaaacctgggtcttgactgtgcctcttcccttggaaaaatcctatcttggttctattggtttataatgaagttcaatctccctgtaaggtttaggagaccacgcatggcttgaatcttacttctttcttcaaccttggttctcactctgcttccttctgcctcctcactctgaccatgtcctctcttcagaaaccatatcctgatttccagtttcctgtctactatgttctctctcacctatgtaccattgaacatgcagttccctctgctgactcagtcttaaagtatgatgggaaggctagagcatcacaaaaatgcctggacagttagacacaattattaataaaagtcaaatctcaaaaggcatgctgtctattaatacaaacactaaatgtaaacaagaaaatttcatattaggaagatgaaatcaacgctgcattaccactaacttgaacaaggggtgggcaatagacacagaaatgaaattacccagtgttgaacattcagattgactttggaatctcacaggctttcctaaaaaaacacttcttccctttaaaaaggtactactggcttggtgcagtggctcacgcctgtaattccagcactttgggaggccaaggtgggtggagtatttgaggtcaggagttcgagaccagcctgaccaacatggtgaaaccctgtctctactaaaaatacaaaaattagctgggcgtggtggcgcatgcctgtagtcccagctactcaggaggctgaggcaggataattacttgaacccagagaggcggaggttgcagtgagacaagatggtgctactgcactccagcatgggtgacagagtgagactccgtcaaaaaaaaaaaaaaaaaaaaaagggactacttattgtacattttgaataaaagacgaattgagagcgaggatttgatgcccctcacggcatcttagtgactaaagatttaccatcagggtgggctcagtttctttcaggtaaatgaaaaatggcaaaaataatgcctttcatttctaaacacgaccataaagataaaacataaaaaatgatgacagatttgacgaactaaatctttaaaatgtctgtatgccaaaacatacacaaaaacacacatatgcaaattaaaagataagtgagtaggtggagaaataatcataaccaaagagagttatatcttcaatctataaaaagctctgataaatatgaaaaagataaatacccccaataaataagcaaagatataaacagataacttaaaaaaagatgatcaataataggaaaaaaatcaatcaaatcacatggaaaagaataagataacagtttgaattctaaaactggcaaaaatgggccaggcacggtggctcgtgcctgtaatcccagcactttgggaggccgaggcacgtggatcacctaaggtcaggagttcgagaccagcctggccgacatggtgaaaccccgtctctactaaaaatacaaaaattattcaggtctgatggcaggcacctgtaatcccagctactcaggaggctgaggcaggagaattgcttgaacccgggaggcggggggtgcagtaagcggagatcacaccatggcactccagcctaggcaacagagcaagactctgtctcaaaataaataaataaaataaaataaaataaaatataattggcaaaaatgggccaggcacagtggctcacctataatcccagcactttgggaagccaagagagaaggattactcgagaccaggggtttgagatcagcctcagtaacatagtgaggatctgtctccactaaaactaaaaaatttagccaggcaagatggtgcatgcctgtagtcccagctacttgagaagctcaggtgagaggatcactggagcccaggaggtcaaggtttcagtgagctgggatcacaccagtgcagtccagcccaggcaatagagtgagactctgtctcaaaaacctataattaatttaaaaaattttgaaaactaaataaatacaattggcaaaaatgattgaaaggaagctaacttcaatattgatgagggtgtgcaaacatatgcactcgcaaccactgatgacgggaacataaaaacccattcaaaggctgatatatggatattctctcaaccagcaattcaactcataggggtttatcaagaggaaatatttggacaaattaaaataatatttagccactaaaaatagtaatccacaaccaaaatattaatggtactgagtgaaaaacatgtacaaaactatgtgatatatacaaacatatatatagtataagcctctgttttaattaaaaatatgaaaattaaatgtattaaatataatgtattaaaaatatgttataaaaggttatgtgtgtgcatatatgcgcatgcctaaaatggcctcagaggactttgcaacaaaagtttaacagtctggggccgggcatgtgaaattaattatcgtttttaaatgtttctagatctcatacatatttaaacaaacagcataaatatttcttataataaaacagcaatactattttaaatgtctgttttgaggacaatgtatttaggaaaattgtatatagaacaggaaaggagtacaagcatggaaaagagggaagtcagtgttaaattataaaacctgatcacacactctatttgttcatcatttagaatatacttttcaaatggtttcaatacaataaagccttaaatgttttgctctaagcattcttgatttgatttttcacacatagtatattttaagggctgttcatttgactgcatttggttcatttaaattcatctcatcaaaatgcaaaatttctaagagctattttatcttcaaaaaaatcccatttaagtctaacttatgtcatattttttcttagaaaaaggaaaacaaattttactaaaagtaaatgaacttaagttccaaaagttcaaggttgacacaaaagtaacttaaacaccataagacagaaaaacatactggccttcaattcttattcaaaaagtttatttacccacatatgtttctttagtcatcagtctacaaaacaatttgaaccaatttttcctatcttttaaaatcttatgttacatattcttctttgacatagcaaatgaatgttgagccttttcctggaaaaagaaatcaaagcctgtcattgccatgtgcccctctcctccaatcctgcgactcccagtccattgaatctatctgtcacttagtttcaagaatatgacattaaacatgctgattcctctacttagaatgacttttcaaatcttttatcttccatgcccagcaaatactcagacccaatactccttcaagacccaatctaatcaccttatctctagagactcctaatcactgtagtggagggtgcctcaacttccttcagtggacaaaatctacatgcaacaagttcatgcacacacacacacacacattcacacacagaaattgacacacccactttcacacacatatccagactcacacagatttacacacaaagttcacacacacagattcacacagattctcatacacactttcacacacatatccagattcacacacagatttacatacacaagttcacacgtgcacagattcacacacacagatacacacatacacacaaattcacacagatttacacaaattcacacacacagatacacacagattcacacacacatacataaacacacaaatttcacacacacaaaatcacacagattgaaacacacacattcacacacatttacaaacatataaaaattcaacacagatttatacacacgttcacacacacaattattgggcttatattgtaactatctgttgacatgtctttcttctctagcagactcagcttcttatggaatgccctgtttgcatgccgacatatacacagaacctccccagatgggtgataccccacaacacattccccacaagagtttgctgaattgattaaacatgacctatcatgaacgttatcattattttagattattttctcagtataatacaactccttttaagatccagtcccatagatgtgaagtgggctgaagagtttggagttcatatgacacaagacactggactttcggtgacaaggaaccatggtatcagatggtgctttgaaagtaacattggctgcacacagtggctcatgcctgcaatcccagcactttgggaggctgaggcaagcagacggcttgagcccaggagtttgagaccagcctgggtaacattgcggaaccctatctctaccaaaaaatacaaagattagccaggtgtggtggtgcatgcctgcagtcccggctacttggaaggctgaggtaggaggatcacatgagcccaggaaggtggagatttctttgaggagtgattgcaccactgcactccagcctgggctacaaagcaagaccctgtctcagaaaaaaaaaaaaaaaagtaaagaaaataacttcaaggagggactgagaattgggagcaatttaggtgtgaccaatctagcatggggtgacagggacctgtattaggaggataacaatggcaaacagagaaaaaaaaaaaaatctgtacgatgccccccagcaagtgtcaggaacaggcaagaaaatattttatgaaattcatctggatgtgagaaggtccatgaactgtgttggacaatacatcaagggaggcaattaggcaaggcccctttcccacagaaaccttgagctacactgtttatatgtggaagcacacaaacagcaaggagctgggcacaggttctcagcaggctgatcaatctgaggctccatcagtgctccctctgctgtagaatcctgagcgcttgctgagtatataacgcctttgccacttcttcagagattcctcccctcgccccaaagtgtaagacagacatcattcagtggcatgtactaaaaatacaatggaatgtctagcatacttgctgaattgagaaaacattaatatcccaggctcctcgggtaccagaatggagtcaatgctagaaaccactcttctgagaaagagtcaaaagtgccacagcaggttcaatgagggtgtcaccactaagttaagatgctgtcacaaggctaataaaaagattaaacgtattaaaaggagaactgatactaagacaaatttgatttcctttccccaaaagaataccaagcatctgagatataggaggttaagtgaaggtcaaaagagacagttagattcattcataagcaatttacttttcaggagagattttgaaagattatttaacttagaatgaatagtaaaatattcaaggtagttatatggcaattaatgaaaaagtggaaatgaatattaaattcctagctcaccagtgtcatggtctaacaagaaaaggaaaccaatttctaattttcccatggaatgacttacataaagaatttgtagatcttcatatacaaagacaaatatttaacttaggccaggtgcggtggctcacgcctgtaatcccggcactttgggagggaaaggcgggcggatcacctgaggtcaggagttcgggaccagcctggccaacatggcaaaatcccgtctctactaaaaatacaaaaattaaccaggcgtagtgacaggcgactgtaatcccagctacttgaggctgaggcaggagaatcacttgaacccaggaggcagagggtgcagtgagccaagatcacgccactgcactccagcctgggcaacaagagtgaaactctgtctcaaaatatatatatacttaacttagattttaagagtttttctcaactaatagagttaggtaaagtaaattacttaactgaactatctgcacattttcccctaatttatctttggaatatagttatgagaaggctggtcaaaaccaagacacaaaggtagaccccaaaaacccaacagggagagggggaatcatgttttccctcacatgacctctctcacaaagggctataaaagccaaaaatttaaacagacttagataaaaatttgaattatttccaaatgcagagtgctaaccactatagtcaagtcatttaaattccctgtggttaagtctcttatctgcaaaacatgaacatataaatctctttgatgacattattaagcatttcacacattacatatccatctgagaagacagcactgaagcagagaagtccaatattatgtatgcaaaggatgccttgcaggaggaaatcctgtcctccttcagttctcactgatttatagatcctaaaatgtataaaaacaagcattaagtatttttaaaatggaaaacaaaatacactggaatgagaatgtttatccatgtgactttgcacatatgaaagctgaataaatgttctgtatcatccagttatttcagtttcaggagttaaggatactgaggataaaatatcctgattatggtgcctgcatttttgtgttcacggagttatcctgtcatatagatagcctaagggtctctgaaagaaaagatggagttacgaatagaaatttatttctaggaccaaattcaagttcaaatttgcatgataatatctgcagtgctttattcctcttaaaacccaagttaccaagctcttaaactcagctctctttgcattttaatgaacagagtccaagtctgatgcttaaatggtttgtttttattttaagcttttgaatcccgcataagacctaccacagtgctaggtactcagtgggtctctaaaaaacttattggctgtttttaaactgtaccttacatgtctctgaattataacacatgatattaaattcagcagcaaggaaaataagcctttaagttcttactttgctatgcttccttgctatatggaaagacagtgtttatgaaaatgtgattgctatggcttacatgtctgtccccttcaaaactcatcttgaaatttggctgccattgtgacagtgataggaggtaggacttttaggaggagatagggcgataatccccaagcggatgggattaataccattataaaagggtaagttgtgtgcctttttatctcttggcccctttgcccctgccatttgaagcctctttgatcccctcgctcaggaggacaggacggcatacaaggtgccaccttggaagaagagaacgaccttaccagacacaaaacctgctggcaccttgaccttagacttcccagcctccagaagagtgggtcaatacatttctgttctttgcacattacctagtctgtgatattctgttatagcagcataaatgcactaagacaatgaccattctatgtggcaaaggctagaaagaggtatagggtttagagttagcttctgaagtgaccagctaggacagaaacactgcgagaaattctttgtgaatcatggctttttcattcctggagtcacttttccttcgataaacaaacaaaactccacctgtgaatataatagtctcatatccaaaagggctggctggtgctgggagaacaggatatatactcctgaagcctttccttaagtggtagaatcattcttcactgatgaatccaacaattattcctgagattgatgtgttgatttagcaatgctctatcactcagcatctctctgtttatgcttttcctctcccagagggcagccattctaaagagttatccctctctgcaagtagcgagactcataaactctacatgagcatatttaaggacttccaccattcaaatgaaaaaaattaccaaatagcaaatgatcctataaagaaaaaattttcaaatgaaaataaaacaaccctcagaaaagccatacaaaaatataacccaccactatcctctgaaacctttggaaatctctgctgtcttactgaagtacttggagttttaaatgcagtttactggctaagactgaaaatagctgggcgcggtggctcacgcctgtaatcccagcactttgggaggctgaggcgagcggatcacaaggtcaggagatcaagaccatcctggctaacacggtgaaaccccctctctactaaaaatacaaaaaattagccgggcgtggtggcagatgcctgtggtcccagctactggggaggctgaggcaggagaatggtgtgaacccaggaggcggagcttgcagtaagctgagattgcgtcactgcactccagcctgggcgacagagtgagactccgtctcaaaaaaaaaaaacaaaaaacaaaaaacaaaaaacaaaaaaaaaaaaaacactgactatatttacatatgcctggacagagaacatagaacactgtacacaaaacattatctgatatacctttaaagttattcttaaccaacatgagggaaaatctgtcattagtcaataaacaaagtcaattgctgagaggaacactctgtacattcagaaaaattagaattcctgccttgcccctaaaaagaatttaaacatagctgctactgattagagacagggtatttcaaagtccagccaggaaaaaataatcagaataattccccttgctcctagatccaggagtcagaaggtgaatcacaagcaaaaaattcattaatttatgcttgtatatcatgattttccagctctctaaattaagggaaaaaagccagccatacaatgaattgtgggcatatcctataaatggattttcagaaatattgtcaaagttcttcaaattaacttttcaagaccaattcaacaaatacctttctgggtttctttcttttctttctcttttcttttcctctcctctcctctcccctcccctcccctcccctcccctcccctcccctcccctgtcccatcccctcccctcccctgtcccatctcctcccctcccctcccctcccctcccctcccctcccctctcctcttctcttttcttttctttttgagatggagtctcactctgtcgcccaggctggagtgcaatggcttggctcactgcaacctccacctcctgggttcaagtgattctcctgcctcagcctcccgagtagctgagattacaggtgcctgccaccgtgccaagctaatttttgtatttttagtagagactgggtttcaccatcttggccaggctggtcttgaactcctgatctcatgatccacccacctcagcctcccaaagtgctggggttacaggcatgagccactgcacctggcctataaatacctttcttggactatattagaaattaactttcatttttatcgtaagtacttttaactctaaaataaaattaatatcaaatcacagtaaacatttaagcatatctaaaaatgagtggttatgggggccatgtcctccgacagcaaactaacttcccttacacaccacatttgtcccgttacccattggctgcatttagttcttctaactgcacccaattcctatattctggaaaattctctggctccattcatttattccatagatatttactccaattatctcaagggtaatgcagggcattagtgtttacaaacattcttcaaacctgtcataattctattcttctcttatttcctgttagcagttatttacatgcgtacatatgaatgattaaaagatataaaaaatgctcagtaaatgttggtaattatttttgattccacatttcagggcaaatatactgagtatttcatagacttacattattattattattattaatttatttatttgatatggagttttgctcttgtcgcccaagctggagtgcaatggtgtgatctcggctcactgcaacctccacctcctgggtcgaagccatctcctgcctcagcctcctgaatagctgggattacaggcgcgtgccaccatgcccggctaattttttttgtgtttttagtagaaacagggtttcaccatgttagccaggctggtcttgaactcctgacctcaagtgatccacccgcctcggcctcccaaagtgatgggattacaggcatgagccaccacgcccagccaatttacattatttaacacatcaacctgattaataacatctccaatattacaaaagcaaaagctgggtttccataggataagtaactacctcagtgtcaccaaggcacccaatagaggagccaggattcacccccatttagcctgaccctatgtgctgggtaataaggggaaagttgtatataagttcagtagacaaaattaaaaggaggtacctttgggaatgtcataataatgcaacgtacctccttctaactacgtgataaagcattataagtatctagatttgataatatcctgatattggcatctccgaagttattgtgtttcaatagttagcattaattcgaaactaaaatgtactctgctaatgctatctgtgagaaaccactaaaatgttctgctatgattgtcagaaatatgtctttatatgttcatggagagggcaaaggtacactatgaacactactgactgagacacattatcaccccattaccatgttctggttggtgagtaagtgtcctgggaatctcagaagagaaagaggtcctgtgccatcctctccaatatgactatgagttaaggtcatagcaatcaggacttgaaatctaccacgaggggctataagccggttcgtaatttgacagctgctgcatattaaatctaatatcaagagccaaacagtatttctaatcaagtaaatggatgactttttcccttgaaacagaaaaagaagttctgtaaacatgtgtttgaaggacacagaaaaagagagagagagacagaataaattaggccaaaagatatatgaactgttaaagcttgcaattaagacacttgttcttgattatttaaagaaatgagttcagttccatcaacactgaccgagtgccttacatgcccgtgataggcactgtggcaggtcctactaatgcagacacaatgcaggcatcagtgctctattagtccaatggtcatgtgaaaggtaagctatatagttaaaatcaccagatccaagtggaagaaggctgtgacttattcacctcgctattttaataaagaactacattttaacaaacatttaattaaaatgtttttataagaacataacataagcacacagtagcatttattcttatttttgcttttttgagatggagtctcactctgttacccacgctggagtacagtggcgcaatctcggctcattcaacctctgcctcctgggttcaggcaattctcctgcctcagcctcccaagtagctgggattacaggcatgcaccaccacattcagctaatttttgtgtttttagtagagacagggtttcactatgttggccaggctggtctcgaactcccaaccccaggtgatctgcccacctaggcctcccaaagcactgggattacaggtgtgagccaccacgcccagcccacagtagcatttattaaaacctggggttacagttgtcactgacataaagactagtctcacttcttgacctggtagcaactatcaaaaataaaacatagagtctcgggaacaaatggtagtccttcccccttacagaacaatggcaataaatatatttatgataatataatagtcataatgaaaataaacattactgtgttgttatgcaaagaataggttaatctgatgattatacatgcataatatgtgattaaatataagcataatagactatcagttaggttgcagtgatttacctttaagaatatcaaaataaacctccttgatgattacaaaatgactttcctcataaagaagcacagaaagaaagtaatcttgactagcaaaatgaaagctttactcatttgaattatcatgcagaataaagggagagaaaaatgtatctatgttgcaaggagattatacatctttcataacttggctctcaataatacaaataactagaaattttcatattttctttgggaaaaaagttacatatcaacataaccatacttgaactaagtgagtttttgagttttttttttttttttagatggagtctcaatctgtcacccaagctagagtgcagtggcactatcttggctcactgcaacctccgcttcctgggttcaagcaattctcctacctcagcctcccaagtatctgggattataggtgcatgccgccatccctaactaatttttgtatttttagtaaagacagggtttcaccatgttggccaggctggtcttgaactcctgacctcaagtgatctgcctgcctcagcctcccagagtgctgggattagaggtgtgcaccgcggcgcccaccggaacaaagtgagttttgctgtgagaaaggccaaatttcagtaagaaataggatgatcagaatgtaatattcctcacattaacaaaaaaaaaaagcaaacaatattaaactaggatttctaaaaaacaactgagtttcccaggaaatgggaacttcataacactgtccagccaggtgggcactatgtccaggcagtgtccctgtgctttgtgcggtcctgctttgctttattagagcagagctcatttttcttttttttggagacggagtctggctcagtcgcccaggctggagtgcagtggcgccatctcggctcactgcaacctccacctcccaggttcacaccattctcttgcctcagcctcccgagtagctgggactacaggcgcccgccaccacgcccgggtaattttttgtatttttagtagagactgggtttcaccgtgttagccaggatggtctcgatctcctgacctcgtgatccacctgcctcagcctcccaaagtgctgggattacaggcgtgagccaccgcgcccggcccagagctcatttttcatcaccattaacgtacagtgccataaagaaagcttctgggtggcacctggcacacggtgggtgcgcagtaagttgcagctgtcattaccgtcactatgagtgtggaccggatgaaagctgaggtcaccatcctctcactctcttccactcccaccagctctcctccccctgcaaagcaccccacctttgggcaccatggctcatcaatcttgtactgttatgctccagctgaaattctgggatttctgacaaactgtatgactgtgatgttttatcttattacaaattttagtgttctttacatagtcccttatgccataaagcaacacaaacacatacccttgagatagttcacatggggtcatacctacgcagattttaaaaataccaccactagacttttttgcctttttctcctttgtttcattgtaaatatcttcaatctctctctctctctcaaaaatacaaaaatgttacaagaaatttaaaaaaaataacactgatagctcctaccatccataaacagatatattcgtattttgctttctttcttcccagtatttttcttcctcattcacacttctgggaaaagaaaggatagtgactgtatgtttaaacagctgtactcataagtacactttttttttgtcttccctttttaaacatttaactttaaatttaacttttaaaatttaatatgtgttttttctgtgtttcagattatttgcaacgcattcaaaacacatcttttcatggtgtaaccgaataataatgaatgtggctctaagccttcccagatactcataacagcaacatttatattaaaagtagagatacacttaggcttattgttgatatttgcatttgtattctcaatactttcgaccattactagaaatctggtcttgcaactctgtttgttttctcactttaaaacctccctggccattataaacatatattcacatattgctttatgtttttgtttctgtcatggtaatactgtacttgacatttgtatctccaacagcatctggcacagtattgtgcacacagtaggcattaagtaagcactttaaaaactgaactcacttaagggatttcaataaaagggctaactcgttggaaattaaataatttgtgaatgagacaccaagtaaatgtattagtcactttctgacttgatataattttcacgtaagatgtgtgtgtgtgcatgtaaacacatgtgagcttatctccaaaagtgccagatgtctttatctttcttctcctttcctttaaaataaaatttatatgtttttaatagcaaagtaataaatgctcattatggaatttttcatatatatggacaaaaaaggacttttcattgttcatgtctaatagtaatatattttaggaataatactaaccttctgagaccataaaatttccattcagattatttttccaaatgaaaagaaagtatctgagagaaaaattttaaatacctgctgataaacatactaaacgaaaagcaaaagtaatgaccttaattccaactttgtatcaaccttaatctatctgcaaagttagccatctttcttttttttattaagatagtgaaccaataaagcagaaaacaagtggctagtacaacatatttcaaagcatccattgatcttgcggctttcttgccactttccatctgaatcttctgtccaccagtcttgaatgggattgcaacctaaatcagtttcactaaagcccacatcacacatagacagctggctctagtcttaatgaagactaatgaaaacaatgaaagccacaatgaaacccgtaagaaacactgacataacctacagactcatcaagctttcatcagtactctggaatacttttttattatgagtgaattggtgaaaaaacaaaacaaaaacaaaacaccgccatgacccggcacagacgcaacgtgtcacttaggagcacatactctgggcacacaacagcctcatgatgatcattctggcaacgtgggaatggctggccccacagactatcctctccaggcctcgtatcaactagcctctcagcttgggagctactctagttcaaagtcaccaggtctgatgatatcatagacacaggtggtcactgtctcatggggggccctcctctgaaggaacaggagccagattcctgaatggcgcactccttcccatcaggctgtgctcaagatgcatcaggctgagattaggctacaagccccagatggttgttaggaaaccattacaaatggctccaaatttaaggatagaggcaagggacagaggtaggcaaacacagctaggaatacacaggcagaatgatactttcttttttttttgtaagtgtcacatcagaactttgtttttctttataggtacatttttgttagtatcatctaaactggccacatgtcgtgttctgctttgctaagtgctgagtatcctcttcttaatttttttaaattaaatttaaaaaatttttcacggatacataatagttgtacatatttatggtgcccatgtgatatgttgttacgtgcattgaatgtgtaatgatgaagtcagggtatttaggacatctatcacatcaagtattcttaaacgatgcaattgtaagattattcttgtgaagaaaaaaatgactaaaaggaacatttaaatggactcatgttcatctcttctgtgtactctgaaaattttaataccaaatatcacctaatatataagcttttttttccacaatcaatacaatgggtgggagggggttcaccttgaggtattgaatacattaagaatttaggttaaacttcagttaagctaactcagcagtaatttaaaatgtttctacaatgaaggataacaattttgacaattatacagcaagtgtgaaataagtaagtaataataatcctttgtaataataataatcctttgtaataataatcaaaattagtgatattctgacccacattcaaattcctatgtactgaactgctagaaaaaaaaaaaaaggcatgttaggaaaaagaagagattccaataatagcagttagtatacagcttcacagtttacaaagagtcttcaaaaccagaacctcatttttttgtttgtttgtttgttttgagatgttgtctcaccctgtctctcaggctagagtgcaatggcaccatcctggctcactgcaacctccacctcccgggttcaagagattctcctgccttggcctcccgaatagctgggattacagacactcatcaccacgcccgggtaattttgtatttgcagtagagacgaggtttcaccatgttagccagctggtctcgaactcctgacctcaagtgatttgcccgccttggcctcccaaagattacaggtgtgagccactgcagctggcccaggacctcattcttgtaacagctctgtggaataggtaggctatttataatccaattagatgtatttatctttgaactcattaaacacaatttatgaatacttgtttcagggatgcattttctggcaacctcttcagattcagctttatgatgaatatctggttacttgtccccatttgggttctgtggggatttgtacagtccagcattgtgccgatcagtattggaactgctcatcatgtacctactgacttatcacctgcctgcttccaaacaccactgcttcagaatctgcaaagagtaaaacagacacaaccaaaagaggtgtgttcactttttgccctgtacattagataaccacagactggatatatggttatttgatggagaaataaaaccaagtaggtaccctagttctcttcaaccttgacacaacagctttatgtagatgtcaacaaaaattttaaaagattcagaaggatcaaaagagtgggacatagaaaaggatcaacattaattttaaaaatatactttattataagaaaaaaataatgtgtggtgtacaagctgtaaaaggatgaaatgtaatgcgatctcagaatgtatgtcaaagatacttccaaagtcagctaacacatcacgattacaaagcccacaggacataacctttaaatcctctgaacaatcacagacatgcaaggcagggaccatttacagaaggacactacgcgaaatgatgacaaccagaccaaggagagacaagtgctgctggatacgatgtcagctaaagcattaactcttctactgtctgaatgtggaaagcaattatatacgaaacagaattaggggttaattaggaagtataagagcacagcccaggaatatagaagtaaagtcagaaagacccagaggcaagtacaatcagcaaagctatcgagggcaattgggcatctttctagaacaactggttgcatatgaaagaaacagaaaaatttaggttcactaatcaatgacaggtgaaataaactgatcatatgcaactggatggcacgtctattttgtgcttttgaaaagaacctgagaagcccttggtggaatgctacatatctggaaaacaatctatcaatatcaataatgaaagccattccatcaaacttataaactttatttatatattcctcatgtgaaactatggcatcatctctctggactttacacagtacggtttatcactgaaatctcacaatacggttccactgggttcagcaaacaaagggcctattttgtttctggaccagatctcttgccttcaagttgcttgctgggggctagatgtatgaagataatgaggctatgaaagggtgtgtaccaggagccagcgggcccagaggaagggcaactggctcaaactcaagggcagtcacacccaaaggagagtcaggatagggcagggacaggaacagcttttagcagagaaaggaaaattttggtagatattaaaaaaggctaatgtcgcttttgttaagtgtgtttctagataatttattctagaataatctaaccattaaaacactcctttgggccaggcacggtggctcacgcctggcctaacactttgggaggccaaggcagtggatcacttgaggtcaggagttcgagcccagcctggccaacatggcaaaagcccgcctctactaaaaatacgaaaaattagcctagcgtggtggcgtgcgcctgtaatcccagctactaaggaggctgaggcaggagaatcacttgaacctaggaggtggaagttgcggtcagcagagattgtaccactgcactccagcctgggcaacagggcaagactctctcaaaaacaaacaaaaaaaaaactacccctttggaagagtagtcttaaacctttttgctcaaattcttcatgaaacaattctgagaaaatcacatgccctttgcatactttaagtacaattaacagtattttatcttacatataaataattacaaaaatgtagtttagatgtaaagactgcaaattctaaataaacattttagaatctcctaaatatatccaatggatctcaattcatgatatgatatccactattattaattttaaaaatacatgaacaagttccttttaaaagtctggacattttacagccttccccttcctcttttctgtttgaagtctacttctattggattttattgtaatatattttgattcttcaaaatctttcattgttcactccatatacatttctgcaacaaaaaaatatgtatgacttgcatggtaactgaattacataggctagtttattagctagaccacttagaggaatttagtatgaatgaaatgaatatgtcatccaagttcactgttagttacagaatgttcacatgctcaaattgttcctatgatgttaattctaaaaagtacagtggtcaaagcctgaaatacttcctgatgtgactgaacatgatattttttggatattatgtagaaatacttcctttgcttttcctgtgctatagttaagctcttcctttcttagagcttattttctctctgaataatctttcagaaaatcacctgagctgggcgcggtggctcacgcctgtaatcccagcactttgggaggctgaggtgagtagatcacgaggtcaggagatcaagaccatcctggctaacacggtgaaaccccatctctactaaaaatacaaaaaattagctgggcactgtggcgggtgcctgtagtcccagctacttgggaggctgaggcaggagaatggcgtgaacctgagaggcagagcttgcagggagctgagatcgtgccactgcactccagcctgggtaacagagcgagattctgtctcaaaaaagaaaatcacctgaaacataactatgatatccctcatggcaacaaaaaattgttcctgagttttctttttttctttttcttttttctttatttttttttgagactgagtttctatcacccaacctggagtgcagtggtgcaatcttggctcactgcaacctccgcctcccgggttcaagcaatcctcctgcctcagcctcccaagtagctgggactacagatatgtgccaccacacccggctagtttttgtatttttagtagagacgggttttctccatgttggccaagctggtcttgaacccttgacctcaggtgatccacctgccgcagcctcccaaagtgctgggattacaggcgtgagccactgcgcctggcttgttcctgatttttcttgaggtttggctctaacaattacagttattgtttttttttaaatatctttagtgttgctctatttgaataattttagtgttatttttaaatagaaataataatttcactgctaatccaaaagtaaataaaaatcacttttccaaagataaaaagtaaaggagttaaggttgaacatgtgttcctctctgaactagagttctaataacacctatattatcaagtctacttacttttaacaggctccatttgagttactaatgctaatgttaatgaataaataaaaagtttacaaatagattcatacttcatagcaaagaaaataagctcattgaatattaatgtcataatcaagttgtacaatgtatacttttaacttaatccaaaatgccttcacaatttctaacaagtttgctgtagaaactcagatacatctggtgaaaaaaaaaaattccaaatttaattgcctaacactgcttgtaataataagactgtaacaagatacaaagatatcaagaagtcaagactgtagacatctcaaagcaggtcaaataacaacatattaaaacccccttttaaaaatatgtggaattctaaataacttataggcataaaaccacttattatctgcccccttcccgtgaaatttttgaaatcataagacaatggtttatcaatttttctttttcttttttgtatttccacaagtgacaactcagcaacttgtaaatgtttcacaattatgcttcaatactttaaaggtaggctgcaaatacgaaatatttctttattattttctcgctaatcatgtccattgagtgaaaggaataattgttaccatgtgatgtttcttacttcatatttactataatttgataagtagatcaatattatatttcaagtatttccattaagtgtgcaacacagatgctcaaaaggtgaaaggcaataacttcctaggcattgaaataaagcaattgtcttctctgtgactcattctttatagaaactaaagcagaaagcatatgatcaatgttcctgtagtgtgaattttctaccataaaagaaaatgcacacattttatattaatggtggaaatcaggtatctgactatcctagaatagctacccaaatctacccttttcatagaacccaataggcatttaatcttaactacagtcatattgagaggcatggttttaaaattaggacagcagagaaagcttagattctcctggcgctaaagggtgaattatttctaccaggggcccagagaaagggactgacttcccaaggaaaggaagcttcatgcatggggaatccgatccccgccacctcctacatacaagagggtcacagaatattggtgcagaaagacactatactagttccgggtttcagacacacgtgaccttcaagaaatgcagggctcctcccaagtctaaatagttatcaaaaatctaactttaggaaatgttagtgaactagttctagtaactaaaaataaacgaaccattaaagcatgctttcttttatgctactacagtatttgtgttaatttaaacttgattttttctcttaacctctatggaaatggacaaaagatacaatgttaccttatatttatatgaaatgtacgaaagttaggcaatgcttccttatttttttagaatatgtggaaaaaaataaacagggctactaggcattttctcctaggccaaacctggcaagtcgtctattttcctattctccaggataatttaacagactttaaacttttctactattttagatgtattttacgaggtggaattaaaaatgaacattgaaaatggcataactgtttcatatccttaaatatttttcccaactcttctttgaaatggttaattatgcacataaagaatagttttgattcacagatttgactctgctgtgattatatatttgaagacctttcttattatgtgtctatattgtatgaattttgcttgtaatacagtaaatacagttttgtctaattgtttcatgcctaatgtttctgacacgctatttatctgttttgaaatgcaccctccaatcttgattcttactcccaacagacatagattgaacttttatcatatacaattttactctgcacaatcttgatcactattcagtaatatgtggcaatgttaaactccataataacaaaccagggcctggtcccccacagggtgacttccactaagtcctttcaggttacaaaggaactgtcattattcctgtgattataggtaaaaataacctgcaatagaattcattcctagataatgactagtattattttacaactgtctcttttcatccagacataattttcatctagaattataatatattgagcattttcaatggtattttacaaaaaacaagtttttatctgaattaaaattaacgagcctttatctgagttaaaatagaatcacgatggaaatgaattcatttcactgtgaattaaccaacatccactgagatcaaaatcaccatctgtgttgccaaaggaagtgtaatatttgtgcatcagcattttcattttaaattttaactttcttataaatttctgagaaattgttttaatcatatcatggaagtctactatttgaagtaacaaatatatgggccccttcaggaaaaaataggctcctatgcaatcgtttttatttcttaatctactgaaagaaaaaatcttgagtttccagatttttattcatttatatactatttcaaccagccattcaacaatatttgatctgagggtctagtacatgccaggcactcacaactgtgaatacagaagtgaaaaacacagaaaaattgctcctcatggagcttacattttagaggagcttttggaagatgaaaaagataataatagcaagtaaataataattagttctataaataacagaaaatatgaagcctaagaagttcatgaaatagaaagaagttgttgcaaggctgggcacggtggctcaagcctgtaaacccagaactttgggaggtcgaggcgggcggataacctgaggccaggagtttgagaccagcctggccaacatggtgaagccctgtctctactaaaaatacaaaaattagctgggtgtggtagtgcatgcctgtaatcccagttactcgggaggctgaggcatgagaattgcttgacccgtggagacggaagttgcagtgagctgacatcacgccactgcactccaacctgggtgaaagagtgagattctgtcaccaaaaaaaaaaaaaaaaagcaattgcagaataattaaatgattaaatattaaatgattaaatgcaggccaaaggactaatcatgtgcccttccctccagacaaattacagtacgttcaagaatgtaggtatcactccttccctttctactcctatactgaaagagctttgcaagtttcacatattattttatgaggtcccagtatacatcctaaaaatgtaaaaatcttttccagtttccatttctggacatatgatcaattaaactgtaatccttcctgctacaaaacaccagaaaagctggctcggtgataagaagcattttcaaatgttgaagtcatttataaaaagaaatccccaggcagttaagaaacaatgagtggacacaaaataagagctaacccagaagataatgacacttcccctaaattggctagtcccggcaaccagtaggcttgaaagctgtgccctcaaaaggctgtggccttgatggtggaccaggaaagtccacccgacctcacaagcaggacaggttgaatttgcgtgtcttttgtccagaatctgggcaagaaaaatgtctttccagataacagaatggggttcaaattgacatactttcaggtccagacatccttaaacagaaaaaataacaacaacaacaacaacaacaaaaagcagtctcaaccaaataatacgcccggcagaggcaaactcgaaagcatgctggagaaagatcctgtcaaggcaggctgcgtgggttattcagtgacagagcccaggtgaagatgggctcacaagtgaaaacgtcagggtacacgacagcacacgtggccattcttcccgaagatgtcaatcagaatatgggcagaactctgtcagcgtaaatatgaagcagaattcacgctcactgttttatgcttgatgcctaatttcaaccatcaacaacaatagtaacaacaaaacagaaatgatgaaaagtcttctagaatatttacaaagcatatacttcactagtttctaaaggtggaaatcctaagagtcctaaaattattaattcagttaataaattcatccttgaagaaaccatgtatccaaataccaggccaggtaacaaccaatttttaaaatctatttttaattgatgtttcatttatgtacagcaaaatgtacaattcctaagtgttcagcctaataatcttttatacatttatatacccatctcatcccaacacagatcaagatgaatgctttcatcaccccaatagcttccttgtgcctctttccagtaacagcgttccctaactctcagcagtaacccctttcctgacttctatcaccaaaacgtggtgtggcctattccttaacttcatgccatcacgtggtatactcgtgttcagttcctttcaaccagcatagggttttgagttcaaccatattattgtacatatcagtagtttattttttaattacagactaataacccatgatttgattgtgccacaaattgtttattctttcttttgttaatggacatatgagatgtttccaatttggggctattatgaataaagaagatgtgaacatttttgtacaagtctttttgtggacatacacacttacatctcttaagtgtatacgtaagagtactaagtcagatcccataccccaaaacgctgttctgatttattttaatcacagatggtgatgtggtttggatccgtgtgatttggatcacccaaatctcatgttgaaatgtaatccccaattttggaagtggggccagatgggaggtgcatagatcatgggggcagtttctaatggtttagcaccatcctctcagtgttgttctcatgacagtgagtgagttatcgtgagatctcattgtttaaaagtgtgtagcccctcccccttctcactcttcctcctgctatggccatttaagatgcacctgcttccccttcgccttccaccataattgtaagtttcctgaggcctcccaagaaagagaagcctctatgcttcctgtacaacttgcagaaccataagccaattaaacttcttttctttataaattacccagtatcagacatttctttatagtagcgtaagaatggataacatagctagtatcttagtacattttctgttgccataacacaataccgcagactgggtaaattataaattacagaagtttattgggatcccagttctagaagctgagaagtccaagaacaaggcaacggcacctggtgagggcctttttgctgcatcataagatggtgaagggcacacatgtcaagagggcaaaagcatgcgcgtcagcttgggcctctcttcttctaaagccgccagtcccatcatagtggccccaccccgatgaccttatctaatcctaattaccctcccaaaggtcccacctacagtcaatatatgaatttggggatttggtttccaaaacatgaacttttgggggacacattcaaaccacggtaaatgggttttgttttagaaattcatatgtataaaagtataaagtatgtaatatttgtttaaggcttctcttactccgcatgatgatttctgaggttcatccattgttgtgtgtataattagttcgttcctctatcttgctgctgatgggcagtcttgcacaagtacttccgtggacatatgttttcgtttcttttaggttagagaggggccatgtttccctttcctcgaaccctcttcccaactttctctcataagacaatgaatttaaaatgttttctgaagtatagctaggatcttatataaaaaacaattgtacttttcatatatgagcagtacatttttatatatgaggagtacatttttatatatgaggagtacatttttatatatgaggagtatatttaaagggtgaatgctcagaaaatattaataagacacccctagattttactatacatattgcatatttatcagattttcagggaagaattgtgattccatcagtgtcatttatgaatttatcgtatctttaacaaactgcaagttttgacaaggcagtgttccaatctatcatgtgttttctcacctgaagactcatttattcaacaaatatttatcaaacatctattttgtgccaaggattgggagtacaggaacacacaaactattcactccgtagttgaagagcagagggtgtggtacagctaatacagcaggcagtcacatacatccccatgtcataaatgctaggacgggtatccccgcatggtgcccagggagcgtgcaggagagagcacctccgcgtagtcccaaagagtcagaaaagaatccagggagaaacaacctctgggagcaccctgggtcctaaaggctttagccagatgaggtggcgttgagagggagagaagagagaagagaaggcaggtaagggttgtgggatggacaaggcagaatgtttcaggcaaacagagtgtcatgaattaaaagctgggaagcaaggggaggcatcaagtcagtaggagtggagagcagcattgaaggtgagggtaatgaggggaggccacagaggtgggtgaagccagaacactgtgtcttgcatgtggttttggagaattaagagtttgttgtgaaggctccaaagagccactgaggagttggggcagcccaaatgtgtgatttggaatcatcattctcactgcagtggggacacagagcggtgtgggacaaagcaggaacaaaaagacacaaagacacattaagagtccattgtaggtatctgggttagagaagttgttggtcctgagctatcatagaagtgggctagaaagtgaaaacccatgtctattcctttacctgtcttctacaacattttcacatgcaaacaaactaaaatgtatttaatcataagaaaatcaggtaagctcttttcaaaattaaaatataagcctcaaagcaccaatgggtctcaaaagcagagagtggccttttagaaagcaatgggggaacaaagttcgcagctaaattggtgttcttggcttggcgatgcagaaagtaagaggctgcaggacggcaaccatactaagtgtgtcacatcctctccgcctggggttcttggctgacattacccatcacaaggaccgcacagggttggtccaactcccaaaccccagaagctccaggatgcattgctattatgccaacttttagttttcacacaaaacaaaggattttttcttttggttcgtggggtgtttcttatgaatgaattgtgtataactcagggaagagttccctatctgagtatattactgttgagtgacagatttctcagttgtgaattattaaggttgcagagatacctctaaaagtggcaggtaacaactaaaaaacaacagtctgcgaattcctacatattttgctactaaatgacatcagctggagccatagtcctcaggccttaactaccaaaaaagttgaggaaatacatactcgctttctcttcagcttttcccctaagccagaggttggcaaactacagcctacaaaccagatgcagcctgctattggtttctgtagagctgtgctggaacccagtcccacccgttcatttacatgttgtctttgactgcctttgcatgagagcatctgacctgagtagatgggacaaagaaccttacggcccccaaagctgaaaatatttaccacgtatcccttaccaaaacacatgcaggtccctgctctaagcgatgctgaaaaataacatctaaagtatcctgttttctaaatttactgaaacgaataacaatgatcaaacattgaaattgcaaaagaaaagttttaaattccccaaagcaacttcccatatcttctttttactgagatgtataaaattcatgagctgcttgagagagtagagcacgctggaaaccacccgcacgtgccatccacagatgggaagggctgtcacatttctgaaagggatcctgcggaagctgattaaactgttagaaaaccatttaagggagatctgccagaccccaccaacagactcagattttagaggacagatatttcagaggagtttcatgaggcatttaaaagaagttcagatccttaacactgcgaggatggataccaagcagaggctcacgaacacttttcagcagagttattaaccaagtcaacacctccctctgttgcctgacttgaatgcagagacaggtgtgtgagttcgacctgaggaccacactgcaccgcagcaattgcacctgtctgaccacagcaacctttcctctcttaacagtaaagcttcatgtactccttgtacatggcaagtacctgctttcataaatcagggcaagaaatggcaaatctatcttaatttccacctcaaaaagaatcactgagcaccgttttaaagggtctcagcactgatccccttgggtattctctgaggcacctgtggtaatccttatttgtttcgcagcctgtgctgaatgaaaaccatccaagtcaaataccttgctttcccctgtagcttcccccactcagtttgccttccagggctaagacagcatgaagcacagaatattgattggaaaagcactgcagactcttcgtaaagccagccaaattatcatctaccatatatgttcccacatgtaataagaaacctgattgattcataaattttagagcatatttctagaaattaacaaaataaaatcttttctgggtccatgtttttcccccacactcatcccctacatatgaagtctctggtgtgtcagctcgtgtgtgacagacaaacaatagccttttccccacaggccctgtttctttctctctcctttttttttttttttttaacttagaccctgccattcattttcacctctgacagtaaaaccccaggacaagattgtcacaaaaaggattatctttcagatcaatggtgaaattgatttgaaaccccactatttatcagcctccagcaaaagtgcaactggttaggaaatatgtcctttcacactcatgttatgctcagttcacccaggcagcacttcacttcatttcacataaatgcaataacctggccttttacttaaaattaagtcattttccacatagatttctatttttttgttagaatatatgcaaaatgaggattcatactccaaaattacttgcatgtatttctaatcataaagtatatatcacttgccaaaagtgatcttttcattatccttttataggtgatagagaatcctttacttctagcttaatataatagaccaggtatagatgattttttcagttaaattttctaaccctgaatatgaaggctaaaatatagactaaatggaaagctccagtaagaatagagaagattaactaactactttcatcctacttctcaatatatttttggtctcccacattgattcccatattaattcccttaccccaaaacccaagagaaaatttattcaaattaccgacaatgttacttgcctaagagttattttaaccacagagtccaatagcagtgaaattttatcaatatcaactaggtaaaataaacccagaaaacccagggtatcaattccttggtataatttaaataaattaatttaaaactaaaattctagtctgtctattcagtaattcaaaacaccctaagaactcaaaatactaaagacaactgtgtaagtgatttttaataggttgatataattcattaagaaaccaattaccacaggtaaaagttaaagaaacagtgtaagagctcttttagcaagaaatgtttacctgtatacttatatagacatatatgtgaagtactagggtaatgatttattatacccaaacagcaaataaacagctaaaaagaaaacaaatatgtcaaaatgatatattcatatcacgtggccttgtacaaacattttacaatgtctagtgtacaaattttaagttccttaagccagaaataaaagtagacaaaaatttgccaatggcttctattttaagtattcatatttaagccaactatttagactaatatgtattttctcataaaatttgactatattcagtgacaaaaattttatgtaaccaaaatgccactgaattcaaatgcagagattcaaagtttattgttaatcttagattccaaggccatacagcaaaacctttcatccaagattagatttgcatttaaaaagatcaatgtgcctacaatgaacagaatgtttgaagaagaagcaaaatagatgtgaacaaacaaattcgtagattaaccactctatcatcttttgcctctcactgaattacagatgctccttaacctatgatagggttacatcccaataaacccaataaacaaatttaaaataccctaagttgaaagtgaatttaatacacataacttacaaaatattatagcttagcacagcctaccttaaacatgcttagagcgcttagattatagcccacagttggtcaaaattatctcacacaaatcctatcttataataaagtattgaatatcttatgtaatttattgaatacgatattgaaagtgaaaaacaggatggctgtatgggtacttgaagtaacgtttgaactgaaagtgtattgctttcacaccattgagaggtcataaacttgttaagtcaaaccattgtaaaagccagggactgtctgtagttcagtcaagaaaagatgattgattggactagggatagtgatggggaagatggagagtcacagatgggaggaaaaactgacaggacttggtgatagatttgatattgacatgaggaagagagaagttgcaaggcagattcccaggtgaacagttgagcagtatagttatttattattttttgagacagtctcactctgtcaccaaggctggggtgcagtggtgcaaccttgcttcactgcaacctctgcctcctgggttcaagtgattctcctgcctcagcctcccaagtagctgggattgcatatgtcatcacggctggctattttttgtatttttagtagagccaggttttcaccatataggccaggctggtctcaaactcctggcctcaagtgattcacctaccctggcctaccaaagtgctgagattataggtgtgagccatggtgcccagcccggttatttattgaaacaaaaacactggaagaagacccagcttgggagtgggtgggtgggagaagagatcctgattttaattttacacgggtggggtttgaggtgccttttgagacatccaaatgtagaagtcacagacacaaagagatctctgggtctagactagagattgattcatgaatcatttggatactgctagttatgaatgccatggacataaatgacattggtgagagaccatctagtgagcttccaaaaaagacaggaaaacacatggccagaaaagtagaagagcttgtgtcaccaaagcctgaagaaggatgatgctggtgctggatgttgctcaggtggcactggtaaacttggtagaagtgaatactgtggagataagaggttagacaacatactaatattaggtggagacaaagcaagtgagaccagaagcacaactttacccattccagaggtgttactgccaaggtgggaagagagtcagggttgtttccaaagagagagagaaattaaatgagtttttttttttaatgggggaaacctgggtctgtttaaaaacacatggaaaacatcccactgataagatgaggctgaatataaaagaaaagggaggataatcaatagagttaactttcttaataaactagaagtgatgggatacaaagcaaagcaccagtgggagatttgccttaggatgcaaggaagcttggatgggtttaggtaggtttatttgcttggtatcaggaagatgagggagtttccatatgttacttttcatttcccatgtaaagtaggagaagagttcatctgccaagactgagcaggagtctggaaaagagaagggaagaggtatgaaactgttgttgtgaagactgggaagaaaagctgatcagagatgcctagcaagagatgggacaagcagtgctgagagctcatttgaagctggtgttcaaacattaacatagagccaatttgtcctcttgggcgtctttctccaacatcttgtggctgcacaggttgaaaggccaaatagttgggttcttccaagttttgtgtttttacagaagacagcaatgcaaagattgaaaagcaaaggtagattctaggcctactctaacacagagcataaacaatggtgttattgaagttatggaccagggagtcaggtggagaaaagaaaaagggaagactgacgtatcgggagaaaatacaggagtcaatagactggaggtcctaatgtagtcccaaaacagtcccagtgacaggggttgaaagcgtaagctggagtatgttcactggaacaggtgaatataccgacaaagtcaggacgttaatgtaggaccctgtggctcaaggacaggaaaggaagcagtgagaagatgggaggtcaaggtgtcggatgctaaatctcccaggataatgggagaggttcgagtatagacagagattacaaacaaggtgtcaactcttctgtgagcaagaaagaatgtggtgatgacacaggagactaaaacttgaatgacataaacctcaaatgatcatgttttgcaaaaggttaaaggacaaatagtcaagaagcagaaattcagagtaaaaatgtcaccaatcccaattcttggccctgggttagttggatgagaatgtaaacattcatgacttgaagggacacttccaggaaatgggaaacctcagatgtgagccaggatccagctaagaataagagaggaagttaagaacatagggaggcatgctggttatggagtggaagtctcagtagaaaaatcatgcaaaacatgtgtgggtggtcagaagagagtacacagccctttaggactgaagggacaggagggtatctactggggcatgggacaggagggtatctactggggcatgggtcagtagcacaggggagaaagtctccacgtttcctgggagtggatgagcaaaggcctcgcctctctgccagtgaggctctcttcctgagaagagacagtgtgctggcagcaagcactggttctgcaccaccatctcagcttcttcacaaagaggaccaacttccagatagaagagaaaaagaagctagaaagaaacataaaggcaacctcatcaaacccctttcatgtacagaagataaagtgcaggcccagggagcttaactgaccttctcagggtcatgcatttaggaaaggggcaggactaacttgagctcaagtcttttggtacccagaccacaaaggtttctgatattccatctcttcctgacctcgccttagactgattcactgcagacctgaagaagtaacccacgaaagtgggaattaaactggacatttgactcaaaaatatttttataaattagaaattaaacagaaaagaatagcaacttcatatagtttataatcagaagaggagtttgtggcttttaaaaggtaaaaagagtttattttacttacgatgctaaatttactcctatagttatgattcttcattgtcctgaaagtcaaatatcactaacactgatatcaaattgactgtgcattggcctcaaactgcctttttaggtaatctctcattattgtaggatcaaaatcaacattttagccaagcttcaacacaaactttggatatttaaattcttatttttaaatttacattattctttatgaaaattgactactatatttaaaacacataaaatacattaaacaaaataaaactaatgctctacaatgattttattgccacagaaatcttatttatctttgtgtaatctatttcactaggttagtaccagtgattctggcaataccctaagacagaataaatggtaggcagctgtgacatatcacaactaagcgttcttaaacgcataacacagacattaagtaaaaaacaacattagggcgattatacattaattacatggatacgttttggaacaaaagtaatttaaattgcattttccatagtgatactttgaaaattcttaccatttcatgtatgttttgaaatcatttgagatggatgaaatgtaagagaaagaacgctcttacaacaacaacaaagctcatatttacatagcatgtactctgtcaggtactgttataaatgctctgcaaatatgaactcaacccttcttcacaacaaccctgtgtgctaagcactgttgtccccatttagtgacgacaaaactgagacccagagagggtatgtaaatcatccaaggtcacacagttggttagtggtagaggcaggatcagacctcaggaggactgcctccaaaatctaggctcttcaccacatgctatggttctgtcctaagcaggattttatttgtaaaaatagctctagaaatcttactcgctaataagtttataacgaatgtgctgctacgctgttagaggtcactattccaacatggaagcaaccatgtcctgctacgattcctcaccaggctcacatattgtataatattaacaagtaacgttaaactataaaaccatttatacacaaatgaaggatttcttgtggtataatagtaaccatagcaacaaagtaagatgggtttgcaaagtgaaaagtatcctaaggcatttgatgccctcacaaaaagctttctctcaatttacaagaagatgtaaccagtaacagcaaaataatagtaaattttcaaaacagattatattgctatctagattagcaatatttcatgttagcatttttatttctaaaagaacaaggggctatattcaaattgctcccatttacatctctatagcaggaatccttaattcattcgagattttatgataaattttgactaaggtaacattttttaaaaatcatgatatgtacataggttcaatgacaaaaatatgcaattagaataaagttgtaacaatatcacatgcatcctacataagtataatgagtagaaatatatacttagcatacaggagaatcataattatctttagatttatttccctaagaaatagattttattttttgtatatcagaactgattgtgaagaataggcctcactggagaaataatgtgttgaatccttttgtaatatctattggcaaaggaactatacaattgcttaagtaaataaatattaaagactgctagtaccatatatagaattaataaagaaagaaatattaagggagggctctgcttttgctacaggggtttctcgagccttgttctcttcaatgtatatcaatgaatggataaattaaagtagcttattgcttttcaaatatttggatgatagaataagaatacaaaattcagattgctacaatgtgctgatcttattaagctgaagtttaatagaagtaactgtgctagagtttcgaaaaacaacatacaactagcagaactaaggagatttggtattaactgacaacagcttccatacaaatcaacagcttataaccattcacagagtaaatattatcacaggtgtatcaagggtgcattacactcagaaggaaggagccgctaacctaccctacactatcacatcacacctccagtacaagggcattgtatttcaagaaggacacacacactgagggacatttacaagaaaagtgccaggatgatggtggattgttaaaataatttcatgtgaggtgtgtgtcacactgagaaaggtccagttccacttgagaagtttcctgaggtcagggactgaccacatcttagttttgtcatcaataccaagtatgcagtagactcaaggtaaatgtttgttgtacaagtgaagcgattaataaatctaaatgtgcagaaaaagatacttagttatgacaagagtgtgaaaatcttcaaatacttgaaggagtgtatataaagaaatgatacagcggggcgtggtggctcacgcctgtaatcccagcactttgggaggccaaggcgggcgtatcataaggtcaggagatcgagaccatcctggctaacacggtgaaaccccgtctctactaaaaatacgaaaaaaaaaaaaattagctgggcgtggtggcgggcgcctgtagtcccagctactcgggaggctgaggcaggagaatggcgtgaacccgggaggcggagcttgcagtgagctgagatcgcgccactgcactccagcctcggagacagagtgagactccatctcaaaaaaaaaaaaaaaaaaaaaagaaatgatacaaattatttataataatagaacttaaacagaacctccataatagaaccaggaccaaagtgtggaagccacgggaaaacaaatttcaattcaaaagaccatctagtcagggctgtcctaggatggaatgttgaggttcctcatcttggaagggatcaggccggacgaaggtttagacatgttaacactggggaaaatagctttctagcgcagtggaaaccaggggcagagacatcgcggtattgaaccagatttctctcgacaagttaagatgctgacttgctgaggctctgtttggtcctagggaccagatgcagtgagccgagatcgcgccattgcactccagcctgagcaacaagagtgaaactccatctcaaaaaaaaaaaaaaaaaaaaacagcaaaaaacaaaaccaaaccaaaacgttgccttaaactgaagcatacacatcaacagcataagttcttccaggatgatgatgaaaggacaaggcataaaatggttacagtgtccccagagttacgctttccagacgcagccctaagtggtgaaaaatcgtgctcctggagctccctagggagggtgcagcttccaggagagaggctgcacctgcttctggcccacagagggcaccttgctgctcacacatttttatactactggatcattcaattgtaggtttgcaactagtctcttcccaccaacctataaccccttggaagtaaaatgtttaaaatttccactaaccctgaaattttgttactatcaaatattggtttaaaagactaaaattaataccaacaagacataccaattaatcctgacatgttgcctatgagggagatactatcattattatttccactttacagattaataaaatgcaatttagaaatataaaataacttccccatggtctctcagtttgtagcatttggactaaagctgcaggatatccaactccaaaactcaaggttcagccatgatgataagatattccttgcacttagaagcactgacattaaattaagagagagaatgaataacagcagctttaaccaaccaaccaaagtaaacctgttttttagggaatagagaataagtcttgattttttaatttaagggaatttgtgtaatacccaatgagataaatttcaatcctgtattacaatcagtttgactcatattatcttgttgacaaaccatagatttgtaataattctagaaaaatgcctctgttgtgtttcaaactcactacgtcactttacaggcagccacaggtgcagttgtttaacggtgagctgcctgtagagtataaccaagacagctgaactctcattgcagtttactgtaagcttgaagataaataactcattttgcagcaaatgcttctacctcttcaccaacaattacaatcctttagtttttcaatgtacataaagagaactcccctaagaaaaaaatgaaaaaatatacacaaattttgaaagtcatccttcctgagtaggtatccattgtaaacagaatggctgataaaatgccttacagactgaaacgcaagatgaccaagcatgaagatttaagaaataggagtaacaaaaataaaaacaccatataactaatacagtcattatctcagaaataaatgtgtattgcttagcttgaagagtcactaccaaaaaggtcaagatcttaaaagaacaggtactgttgcaatcactgagagggttccaggaaatatacagctaatatgaagaaacaaaaagaagagaaaagtcctgaggttagcaggactagtggaataaatgacaattatttaagaattctgattatgtattctgtaaattatttcttgcatttataaatactgtatttgtaggagtcaaatgattctgacaatattacttttgtcttctcctatagtaatattttaatcataaactaacacctcctaaacatgtaagagatatctgaactttttaattaattaaatcacccagttagttactaggtgagttacctgagtgcctctagggactcaggagatggcggtggcaatggcataaatgagaagggtaagtcatgagggggaagttttgtgccataaacctgtaagtgcaaaatcaggcaaagggccacattgtctgctttacatgccattttagtgtctctctaaaaaatattttcattgcccttgtaaaataatttatatatgttaacttatacatacacttcaatatatttgtgcatcaaatttcaaaagctctagaaccctgaatatatttaatgtgtgcctttaaatttgcattacacctcaaatatataaatgtcaaatatgtacatgaatttttaaaacataaaaatatttttaaggatgccctgtggtctaaatcaaataaatgttcacgaagggaaaggaaggttaggcactagactctactaggccacaacacgtatctgagctttgcctatgaagttttgaatctacaaaaacaacttatctattttccagatttgtgaactctaattgatgaaaactcaagtctgtatttttttaaaaaagaaactgaaagataactagcatagaaagagccatatacacagtttagttggttttgctactgtttatattttgaaaagcaaagattataggcaatgctccacactgtaaataacaattactctatgtctaatccatttctatgcattgagaatagaacacacagtcaagatgtgtccatggtggctttttgctttattctcaccaattaacaggtgattggatatgacagtaattagacacctcagctggaagaagatcattatgtcttaatgagaggattaaaaacaataaaaatgtgcttattgcaaaatatgagcacataccttaagtagcaatagtacaatttattttgtctccaagtttattgtgctttgtcagcccatatcaaaaaaaatttcccaccaacatgtgacttagaaaattacgcaacctaagcatacaattaacaatttttggtgagtcagttctatgttttggcttattttttttgataatgttcactagtgcttctctgacaagttacagttgccacataatattataaatgttatactggtacatttcacattcacccaaaatttcagctatatactcagcagtatacctgctatgtagttcaagataccatctcaaatttaacttcctcaatttccatgagatggattttttttttagacctgcacacagacctatgtacacccttggcaggcactcacagatgcagagtgactggaaggagcacagaaggtctctgatgcaatgcacatgccaccccagcaaggtcaaaagtctcctagcaactcttcttcgggttagagttttgtttccctaaaactgatgtttaattgcatgtgccatctgtaaaggacagtattaatagctaacacctcctcttattccaccattaattaattatcaaatgtgccagcattgagatctgctttacaggaactgaaaaatacagtgtaaaatcaggacaggatagaagagagggacgaagaacgacttgcaaaaccctacttgtcaggggacatgtgggtaaaaagttttgttcattcactcacacactctttcagtcactcattcagaaggacttactgatcacctgttatccacattggcagagtatataaattaatatttaaccaaggtaatcattctttagtcctaaaccaagaagatgctctcataaacattatgtattattgccaatttggaagtaaaacaattctatacccgtatattcaaaaccatgagctgtcacccaggaacctcctaactcatggctcttaaacctataaatattagggtatccaaatgtatccttctctccttcatttaagagacagaatagggtttccctcttttatttaaggcccatttacccatatcctctggacactacccctgaccccactgccttctgaagactttgtgcattatcccatagtagttcatggtagagtatttatttgcttgatagtaagcccgctggggacaagggagcttgcctactttattcttatttctatctctagcatctaacacaccttggcacacaatattaagtcaatcaatccttgctgaataaatagacttagcaatgtgcacaacttctgccccaccccgttgctatcactgtaattaccccattaaatgccataaatattatttataaaaagaataaaacttacactgccttccagtggtaagcatataattgttgcatgacactctatacaatgatacccccccgtaatataactcactacacagtttttacactgaaactgtatccttcttgtattataaaggtgaaatggtatatagccaagcatatctgagcaatggtatggctttttcttgctatcttctatcaatcaatttatttgtacagcacaaaattgctactcctctgaattgaagcaggagaaagccttacataatataacactattctgatacatcttgacatatacattatgtaacagtacttttcctttgctatacttcgcaatataatcgagaaatgctcttttaaagtcagcaacatcagcaggaataagacttttaaatgaagctcctaggaagacagaattctcacacttaaaaacaaagtatttattccacaggaataaatattacatgttttctgaaattgatcaactgcagtgatcaggtaacacttgcattgttaagcagtaagaatgatttcttaaaaattattatttaatgtcatggcattttaagttagatcttaaaatttttaattgataataattgtacataattatgggtacaatgtgatattttgatatatgtatacattgtagaaagattaaatcaagctaattagcatatgcatcacctcaccctacttaccattttttgttgtgagaatatttaaaatctattcttttagcagtttagaaatatataatacattatgattaatattattttttgagacggagtcacactctgtcacccagcctgaagtgcagtggtgtgatctgggctcactgcaacaaacacttcccaggttcaagctattctcccacctcagccgcccaagtagctgggattacaggcacctgccagcacacctggctaatttttgtatttttggtagagacagggtttcaccatgttggccaggctggtcttgaactcccgacctcaagtgatctgcctgctttggcctcccacagtgctgggattacaggcatgagtcaccatgcctggccatataatacattattaactatgatcagcatcccatgcaattattccttctgtctagctagctagaactttgtaccctttgaccaacatctccctatttccttccactccagcctctgcttctatgatttcagcatttttagattccacatacaagtgaaattatgcagttatctgtctttctgtgcctgacttatttcacttagtataatttttatctgaaaaataatttttttttgttatggtcctatgatgaaatataaaaccatagtaataactaacaagtaatagtactaccaggagtactaatactacttaaagtttattgagcacttactatattcaggcactttcctaaggggtttcaatgtattagtgcatttaaaactcagagcagccccagtaacacaagaataatcattatcagtatttattcttccctaggaacctgaggtgcagagatttgaaggaattttcccaggacggcagctgataagtggtagactgagggtttaaacccatgctgttagtgttaaacattattctttctttagtgtctttatactttcatgtgaataaaaataaattactattacatgcctctttctgtctgaaactgaagtcattttttaaaactgtttggagcacatttcagaataggaatgatattcaggatcagccactcaaatttcaatattttaaggaaagggtcttatgaagtgtgtattcaatcttatcaatgcatggataatggtgagctatctggcaactgccaaaatcctactactgtatgacttagaaataaacaactattttaagcgctacttggtaactatgctgccaaccagtttctacactgcctttataggaaataatgtactgtgatcaccaatgactctgtttataataaatcaaatattttataaatttatacaattatatggaaatcccagacacatttctcctttagaaaggcaagcagaaacaaatctatcccgtgttcaggaaagtaaaggttttcttcgtgagtacgctctgaatctaaataagcctcagtccaaaaagagttttactgcagactgataatcccctaggtttataataaaaatgctgacagagctttagctacagcataacaaatgaaaggccataatgttcttctgtcagaaattcctatttatttccagtgtcctaacagatgggctttactgccttgaaactcccccccaaaagttaattgcttgtctatcaaaaagataaacatcttgttttaggctttggggatattacatgtgtagagaaaaaccaatactcgagcaacacattgtgtccgaaatgcattcgcagtaagagagccatactctctcagggcatcagagtaaggaacagctggatgactccaacttcttaaaaagtacaggattctctgcatagtgacactagcatctataatacctagattttagtataccaataaggattgatttactgccacataaatgactataataactttacaaaacaaacttcaaaatgaaggtgaaactcttttagactcttgaaatagtgcctcaagcaaaatgaaccttaaacatatctaatccagtatttttcctttttttttttttttttgagatggagtctctctctgtcgccaggctggagtgcagtggtgagatctctgctcactgcaacctctgcctcccaggttcaagcgattctcctgcctcggcctcccgagtagctgggactacaggcatgcaccaccacacccggctaatttttaatttttttttttagtagagatggggtttcaccatgttggctaggacggtctccatctcttgacctcgcaatccgcccgcctcggcctcccaaagtgctggaaaactatgcgtttactactttagctagtgtacaatagcatggggatctcattctccaaagagctggtttaaatggaaaatatgtagacagcctcttaactaatgattcgcattaaaaaggaaaattatgactttaacacatgcgtattggtgccactaccagattgcacgggaaatgaacctgactgaatctggacatttttgtgttcttagaatattttacttacaaatataacagttgtataaaaagtaataatacagaagtgttggtatctatcctttcactttttccactcacacacacacacacacacacactaccgcagataggcaagcaggccgactgaagcatgttgaataaatcatacttctattcttactgttctgctgcttttttcactaagcaatgtatgatggacatctttgataaaggcctcattcattctgacgaatggacagtttccattttatacatattctacaatgcactttattagttaatgagggtatcttctctctcacaatattttttataaacagaaaggtaatatttgcacatgcattaacatacatgacattgcaatctgatatgcttaaatacatattagacataccaaaatatatcaaatacatattatttcttaactgctttgcacgtgcattctgcttgtcttctatggaagataaagaattgagggatgttatacccattccctccttctttcctattctacctcctgacttctggcatttgtattttacttttatctcctcaacaggttatcatttataacttcaagtaatatatatttaagctgtcttgttgacttatcaaccttaagtcaacatctttttcagtgaaaatgaggaactgctgcgtagacacttgattccactttttccgtgttctgccaccttctggttattgttaattacattattttttttctaacatcaagagaataatttagtctccaatgctttgtgtaaaatttgattctaaaaattaaaactcaacataagcaacatttctagcattatgactactgaatactattcattgcaaaatgtagtagtgtaattagatccttagggaagggattttcatccaacactaatgtgctgctgcataagaaagagttttgaaagtttcaggccttcatgtattatctttttattcccttttagttctccatttagtttcagttttccctttaatttatattcagctatcacttctcctgtatatcatccttttactcattttttttgggttaacacccaacacatttgcatatagatattctttttaatttttaataaagatggggtctttctatgttgttcaggctggcctccaactcctggcattaagcaatcctcctgccttagccttccaaagtgttgggatgacaggcatgagccactgtgcccagatatatattttttaccaatctttgtatttccggtgtgtatgattaaaagttgggaatagaattctatatttaaattaattttctctcaggtctttgaagacactgctttgatagcttctcggatccagtgttgttgatggaaaacataatgttagcctggttttcattcctttgcagacaatctattttagtctcattggaagcttgtggcatcttctttattttgaaatttcatcaagatatctccacatatccagctttgatccagcccgcttgccagacttttacatctgtctattgatgcctatggtaaattgagagcagcaatggccccaatttgtgcctagctttggaagagcccttcccgggttctctgggtttggccacataatttgctttggcccatgggacagtactaaaggaaagtaagtagcgacttgaaaatgcccctgccttggaaattgcactcctgctgctcttaggaatcctgctgccaagagaacaagtcgaggttagcagggtgatgaaagacacatggctcagctcctcccatcaccacaaagatcacagataacggcatgtgagttcaccttctatgagctaatcccagccaatcttccactgaccagagaaacatgagtcagttcaggtggaaacagccacactgcccacatcagaagaatcaaccagccgaatcagacacaagctaaatgaatggtctttgttttaaatcactaagttttgaagtcatgtgttacataacaaatgttaattgacatagactatttcttgagcttataaaatgttgtcatgaaactttattttctgcctttcattgtcttattattttgtattaatcagatgttggacctactgactctattcactattgcccctaactctttaatgttccatttccttatctttctgttttaagtgttcagagttaatcttcaatttatttatttattttttatttactgagacagagtcttgctctgtggcccaggctggagggcagtggcaccatctcggcttactgcagcctccatctccgggttcaattgattctcctgtctcagccttccaaggagctgggactacaggtatatgccaccacgcctagctaattgtattttttagtagagacggggcttcaccatgttggccaggcttgtcttgaactcctaacctcaagtgattcgccctcctcagcctcacaaagtgctgggattacaggcttgagccaccgcacccagcctaatcttcactttaagttgaagaaaaaaacatgtttaggcatcaacagttccctttccattatttggtttaatacatttttactgtgataatcatacttttaatttcctggaaatttcttgttttgattgttcctttttcataacagcctttacagctattatttcctttcaaattctgtttttttttttgttttgtttttttttggtagcagagtctcgctctgctccccaggcgaatttttgcatttttagtagagacggggttttgcaatgttggccaggttggtctccaacacctcgcctcaggtcatctgcccaccttggcctttcaaagtgctaggattataggggtgagccaccgtgcctggccttcctctcaaattctgctgagggtattaattagacacctttttaaaagtttctggtaatccctgaattgtacatgaatcttctggtatcggttgcccttttcattcttctaaatacagtttttccctaaatatctgattgatgattcttggatctgataatcctagttacttttctaagtgaaaaatgacattgatttgtatgggtaattcatattgtttcatctgcactgtgaaatacatgatcccaaaaggcttcttcctggaatgaaagacatgtcaacactcagaacattctgtgggtttcatgagcggaaaagcaggcaggcaggctggtgacacccatgcctgccaagacagacaagttttattttacacgtgaaatgctttatgaacctcccttttttacacgtgaaatgctttatgaaccgccctcctgaacacctttcccacttttccccaatgctcaatgtaggatttcacttcagagaaacaaaacaaaacagaaaacaaaaacaaacaaaaaaaaccttttccattgttttaatgctaccatatgagaaaagagaattaagctagtgtgttgaacctgctgacttaaactggaaacccagtcattaggcttcagcctcaacctcttttttttggatcttgttcgttagcttcttcgggtcataaatgcctcatgctgataacagaattcactcggttttatttttgagagaatacattttgagaatgattcatgtagggaataatttatgtgtgaagaataaagtttccaatatagagatcttattttaaaaattggctttttttcttaatttcagagaattgatgacactttttaaaggatttctgaaatcagtgatcacttagatgaatgttgctattatctgcacacattgctacattaaacgctccagaatttaaagttcgtttgagctttctgacactaaataatatttcgttttatttccaaacttatgaaagcaacataggcccaaaaggacagcagtatattaaaataaaataaggttattttccaatgagaatagagataaatcattttcccaaggagagttcaccaaagctagagactggccgaagaaaagtagccctcagcttcaaagatcaagctaattttaaaacacaacctatctcctgcttcatttgtcttaaatcttaaggctgttgtccaacaggtcatggcagtcaaaagaactgtcatataaaatgtacatctagtaaggccctctctatttttattttaaaacagtgattttaaaaattttggtagaataacctaattatcaaataaaagcttatagaaacccacatacctacacatatataaaaaaactgaagtacagttgttttgcttgagaaggctgaaggtgggggcagagatgcttcacagcctagcttcattcagggtcctgagataccacaaagacaccgtttttctcaaacaaaactgaaatctgccaggcatggtgtctcacacctgtaatcccagcactttgggaggccgaggtgggcggatcacctgaggtcgggaggtcgagatcagcctggctaacatggtgaaaccctgtctctactaaatatacaaaattaactgggcatggtgccgcatccctgtagtcccagctactcgggaggctgaggcaggagaatcgcttgaacccaggaggcggaggttgcagtgagctgggatcatgccactgcactccagcctgggcaacagagtgagactctgtctccacaaaaaaaaaaaaacaaaaaccaaaaactgaaatctactcttctgttacgtgaggagaacaatctgtgtctcatatttaaaatttacaagtatagatacatttttcatgaatatttattaaaaacaattaaataaaaattattccattaactcatttgtttaacatttccatgtaaccacagcaatgcaaagcactttgagagctgcatgggaggtctaagacatggtttctaatatcggagttcaaatagaaatcacatcggaagctgaagccacattgtgtggtgctcacttccacagcagacttgtacagcttgaagtatttaagcagattaactgtaaaggaaaaggaaaaatgttacttagctgcatcttaaaagactcttgggattcaaacaatctataggaggaagacagctaacacaccagcggtagagaaaacacaaacatttttgtttgttcggttttttgtagagacagggtctcctcttgaactcctggcctcaagggctcctcctgccttagcctcccaaagtgctgggattacaggtgtgagacaccatgcccagcaaggacagattttcaagaagagaacacagcagggatgtggtaacaagaggacatctgtgtaactgaagtggaaaataacatatattggagcttgaagggaaataaaattaaatacctaagtgaggaaaatacaattagtgtttcaaccatctgctaccacttcctactatgcccttccttctgggaaggctctatttcccttcttcactcaggtaaggctcttgcataagtgacttgctttggccaatgaaatggaattagatgaaatcactgtgatgtctcttctctctgtcataaggctgaacgtgctccagatagaaccagctccatcagcttctgtcgtggagtgagggcaacttcagccgtgccactgcaaactcacgatgagcgtgtaactgagcgaggaataaatcagtgttgttgaagcccctggatcaattatcactgcagctcagacaatcctcactgatacaatgcttagtaccagatgaaggatgacgttaaagtgaggactgatgtctatctagtgtaggtttataaacagttttcatttccaaacatgccttttcactcagtgactttaacatggggatgggtgatgctgaacttggtcttgtctagccttagtttacatggcggcatggcagccagtgctcatgttcaggaacctaagatgagaaggcaagtgtcttcagggtttactcaatgtcactttctcattaagacttaaccatccatttcaaattgtaaatgagtcccttcctctttttttctactctgtatctccctcccttattgtctttctccacactacttcaccaccatttgcatgtgtgtgtgtatatgtatttatgtatgtgtgtgtatcatgtatatatatgtgtgtgtgtgtgtatatatatataaacttatgtttgcaaaaacatatctaaaacttatataaaatttatctagttgcaaaaacctgaaaattaatacacatctcatagttcctttctgaaaaattatgatctctacatccccatgaagaaagtaagacaaataaacaaagcactaggaaagttactccagttacttcattagcatgaatttgcaagaaagacttcagtctgctttctttaacagataaaatatatcacagttcaggcagaccttgacttacgctaactcgacatatcttgactaatgaatgacttatttacaactgggtagagactaggaaaatccccacatatgctgccaaatacaataggtatcgctggcaaccaaatcagaaccattcccctgcctcacaaaatgatacttaggttaagtgcaatcattgattagtgcaatatttctggtagatttggggttaatctggtttttgcatgctggatggggaatttaccactgttatgttctttcatgacaaaacaaatgtgatgttttaaacaaaaacattttctaatgcatttgtgtaatgtttccatttgaaaggtagagaatgactgtgctatatttgcaaaacacaagacctctcagggacagcataatacttgcacttccaaaaagcttttcccctcaaaggaagacactgtgcccttgagaatgactctcgaattaatcatagaggaagaactttcatttataaattactactcttacatttcacagatgaaagaaacagaatactttataatatttaaaaaaactatctggatatggtggctcaggccgggtatggtggctcaggcctgtaatctagcactttggaaagccgcggagggtggatcacttgaggtcaggagttcaaaatcagcctggccaacgtggtgaagccctctctactaaaaatacaaaaaaatagctgggcctggtagtgggcgcctgtaatcccagctactttggaggctgaggcaggagaattgcttgaaagcgggaggtggaggttgcagtgagccaagatcatgccactgcactccagcctggacaacacagcgagactctgtctccaaaaaaaaaaaaaaaatttaactgagcataagatgattaaaatatagtcccttcacatgtctttaactgcattatattcaataaaatattcattttaaaatgaaaacttgaaagtaactgaccattcaaattttgaacaagctgaagaagcttcaaatagcagataattaccaatgttttaaacgtagtatgtcctggagggaatccaacatcaggataaacaaggcaaagtctctgttctacagaattcaatgcagtgctggagactgagatgcaaccacataatcctatcatctcaaactgaacttcaaggagggagtaactaactatgccctgaaaatgatggacaatttctaagagggcttgatacttgggctctgtcttgaaggatgcaaggtccttccttatgaagaatctaccatacataatagtgcagaggtgaaaagaaagcacattcaggaaacagtctgtgatggcttcacccagaatagagggcattcaatgacctggaagatgttttaagaggttattcaaaaatatttactatcaactcaatgtttgtcataggaaatgattttgtatagaaattatttccccagattgtgaagagctctacgctgcctactttggagtttattttataggtaatgaggagttatcagtggcttgtaaacaggagactggtaggatcaatttctttttctttatttaaggaaggtaactggagttggaggcgagggagactggtgaccaagagattagttaataagcaactataatgactgaggtgagagatgatgaagggtaaaatggggcagttaggcagggtgaacgcaggtgaagaaattatcaccatacacaatggtgtggcgaaacaaataggtggagagacacaagaatctgcaataacttttaagaatttataacttaaggaactgtttgggcatattaaccaataacaatggagcaactagagatgatcagtgggcagttttgaatactaggagagatgtcaagagtcatcacaggacaggttgtagttgaggccaggtcaagagtctaagatgccactgtataggatatagcagtaaaagaaagaacaggaaaacaagagacctaagcagaggaaagggagacatcaaaccactcggtatcactcgagtgatagagccaatgaacatgggctacagggagtaggacacaatgtcatgaggtcgacagaagaaaatacataaggactataacagtctttagaggtagcaataaggaagtcattggaggaaaatttgagagtttgtggggttagaagccagactgtcatgaaatcaggaatgggaaataaggcagagaaaaaaggtcgtttctgaaagttttgatgatgaagacgcagaggaaacaaggacagttggttgagggtaaggtagagttgaaaattaaggtaaagggaacttaaacataactgtatgacctaaagatggatccagttaagaaatcaatgatagaagctataattgtgaggcaaagtaagacagaaataacctcggagatgaagaaaggaggccacccttttttgagcattcaatgtgtaccagatgttttgctgtacactttcagatgcatttcctaaattagctaaatattaccaataagtaggtatcagtatccctaatccatagtcaggaaatgatggagtagaaaggtttattaaaattggaatatctcagaagtgaagatctctatgtgaaataggagacaaatcatatgttccaacagcattaggaatcaagtagtgaaaatggcagagctcccatattgaatgagaaagtgattcttggcagataagacaagaaaaaaaatattcagagtgcatggtaattattgaataataacaaaaagttaacctggaatgattgcattattttcaagcactagctcaaccataagtgtattcttatatataaggtctaatgaatgctttaatgaacaatagcttttcattttgccaaagatacaggaatatggttcaaagtaatgttacctacattaatcctcactagagtttaaccttaacccagtgaaggttaataaggttccctatttctataaggaaactgtactaaaataatgtctcgtactattttacaattattttattatgtgaaaactccatgctgggaatcactaccaaagactaatttaaaactaattatttcagcattaatctggataatgatccataatgaatgaaaaatgaataatctgacatttcaggggttccctactgccccaattcatatacaagaaaatgcttttgctatgcctttcatacatagattaaaccacaatctaaaatatcccaaagtgttgagatacttacaaattatattttagttatttatagactagaatgcataaatctaagtttcaatgctgagttaattaaggaaagtccaattttataacattatttttgcatgtggaaaaataactaatacataatgcttgaccatatggtctgttagtccttttgctaattacctacaaatcactacacaggttttacagctgctatatattattaactgtagcatgttttccccaaagattttattcctctcttcatacatttttgttttaactatgtacaaaacaagttcgtatttttaaaagagtcaattgcagaagactgaatacacaacatatatatatttaaaggaatgatgctttacatttaaattaatgttaattaattgataaaagtttcagcagaccaaaatattgaataattttcttttagtcaacattttaaaattcttcattaaagtctggtagcctacgacacgcaatgctgcagtcaggcattaaaatgttgtaataacagtttctgatatagaaagcaattagctgtttaaaaaaatgatgtatttcatataagccatatctaatttgggacatgtgctttaaacaatgttagaattaaatctgaattttgtcacagaatctagaataattattatgttttaaaagtataatgactgaatagcatgtcagagaaaatggcagaaaattaaaattgaaattgaagtatataattcccaataaaatgcttgcttctatcctcctcagaatactttcattacattctacttctttatccaattggataaactacctagctgcagtgtaaaatcctactgggccaggattatgactgattcatcacatgcgtcaactgtgcacgatggtctgcacaagtaggtgctaaaggtgtttgctgaaataaaagatccatacttttcgaatcaaacaagttcttactcttacggtgcacacattgatttaccaccttagtcatacagtaatagtgtataaaagccaaaaagattactgagtatataaaataattggtatctgaaaggcccttttaactaccaactataaattcttccctaagctttatactgtcctgccaagctaacaggttttcttcgtactaatgctgcacagatcttcagaaaagctgctatcaattactttgatttcccaggctgcccaaactgctaatggaatttagtaattagagttcttttgaaacaatcccaaatctgagcattctgcctgattacaagcagccatcgacattaacatcaatcgttgacaacgtaatatacattggatgtgccagaggtaatcattatctaaaatcctgtttctagaacatgacttctatctagtgaagaacatgtaatggggatttaagattcttctacctccaataactgattctatcatgaatcttgtatacagcattcacaatcagaagcaaagatatctttatctgtaatatttccagtcaatttcatagaaaagagccttgaattctgtcaccattttaagaggccattttgtccacatcttccctttcaccaaaaatgtaatcagatatcaatacattgtaagcatgatactgtcttacacttgtatttggaagcaggttcccaagttgatgatgagcattcagaataataaactttgcaaccagaattgctaacttgtaaagccaaaaatcaacaggaagcaaaatgagtctgaaaagcacaaaaagtaaaaaattttatagaaccatttgcccacagatcaaaaggaattttgatcaaattgactagtataactcaggaaattacagttattagtccttaagcatttccggtagaattctcatcttttccaaagcttcactcaaatacaacaggtcataagacctcacaatcttctcggaacactaatggagctgccacagtatttgaaggacatggtcatctactgtgtacaatgtttctggaggaaaataaaacttttagagcagagtcatctgtattaggtatcaatgagatgtcaggccacctcaggaatgactgttccactacagtccatgtgcactcaaatatattaaatagtctataaattcaatgtcaaaattaaattgcaactgtcaataaacacaaatagaggactggtttattacttctgttatattaaccagcttttccaactaaaaactgcaatactaactctgcgttctgcctggaattccttataagaagggtgctttaagaattgatttttagtgatgctgagcattttttcataggtttgttggtagcttgcatgtattcttttgtgaagtgcctgttcatgtcctttgcccatttttaaattttttttattgtgttttgcttcttgatttgttagattccctataaattctggatattaggcctttgtcaaatgcatagtttgtaaatatcctctgccattctgtaggttgtctctttagtctgttgataatttcttttgctgtgcaagctcagtagtttaattcagtcccacttgtttatttttgttcttgttgcaattgcttttggggacttagccaaaaaatttttcccagagccaatgttgactagagtatttcctaagttgtctttcagaattatgatagtttgaggttttacatttaatctttggtccatttttagtttttttatatagggtgaaaggcatccaggttcagtcttctgcatacagccagttaatcaacagataaatgcaaatcaaaaccacaataagataccatcttataccagtcagaatggctattattaaaaagtaaaaaaaaaaaaaaaagatgtggcaaggctgcaaacaaaaggaaacgcttatacacttacacactgttggtgggaatgtaaattagtccagccactgtggaaagcagtctggagatttctcaaagaacttaaaacagagctatcatttaacccaacaatcccattactgggtatatactcacaggaaaacaaatcattctaccaaaaagacacatgcactcacctgttcatcgctacactattcacaatagcaaagacatggaataaactcaggtgtccatcaatagtagactggataaagaaaatgtggtacatatacaccatggaatactacatagccataagaaagaatgaaatcatgtcctttgcagcaacatggatgaagctagaggccataatcctaaatgaattaatacaggaacaaaaaaaagaaatactgcacgtttcacttataagtgggaactaaacattgaacacacctggacataacaatggacactggggactatgagaaggaggagggagggaggcatgggttgaaaaactacctatcggctactatgctcactacctgggtgataggatccataccctgaactatagcataacacaatattcccatgtaacaaacctacacatgtactcctgtatctaagataaaagctaaaattaaaaatataaattaaaaaaataaataaaaagaactcacttttgtgtaactgtaataagaaacagaagtaggtagaaaagacaaaaataaaacttgaaatgatacagaaaaatatgcccaagacaaaaatccagtttgttacaataatatagcaaatgtccttagatacaaatgtaattggtaattctaatataatacaaaataatcaggctaacttctccattacaagtatattttataatcattttcctgctggaaaacataagcaaagctgaaattcaaaggatttgttcagtacaatcccttgtgaaaatattttttcatttaaaatattaaatagtgttaagtttcaatacttgtcatatttaatttatactttatgcatgtattaattttgaatgtatctttagtacatatcttttaggattcattgctattccttacaacctagatgagctataaaatcaccaggctaaacctttaaaaaaaaaaatgtaggccgggtgcggtggctcatgccttaatcccagcactttgggaggccgaggtgggtggataacttgaggtaaggagttcgagaccagcctggccgacgtggtgaaaccccatctctactaaaaatacaaaaaattagccaggcatggtggtaggtgcctgtaagcccagttatttgggaggctgaggcaggagaatcagttgaatccaggaggcggaggttgcagtgagctgagatcacaccactgcattccagcctaggtgacagagcaagactgtctcaaaaaaaaaaaaaaaaaaaaaaaaaaggatccatttagtcactgggaagggaggacttataactcctaaaactccagtttctagagaaattcaattatgtataaaaccggatttccagaacttcacacatttggctgattttctagttgagaaatcatgtgaattcacacaaacctggaggttgcagattgcctgagttttgtcccacttgctgaatgcagaggcccagtgcaccccatgactggtgtccccagaacagtctctttccgtgggaccctgaatgtgcctgggatgacagaataacatgaggtgggggaggaagggaggagagtttgtgatgtgagggatggcaggatgaagcgagggagggaggaacgtgtgtagctagatgagctaaacaagagactaacgactggaaaactatttttcaacattgccctagacattctaggtgtgagggaatttaaataatgtttaaacattaatcacttctaaataattagaagtggaaaacagtaaaggagaaatgagacagttacagagactgctaagtacatgaaaaatataccacacggtcttgtgtcaacaaaactaaccagcattttacaaaagggctccagtggggatgccatttctttaaaatagtgactcccctgaaacaaaaaagccaaagttcccagaacagcctgtgcattcacctctccatacctgggctttggctgttctccagggttggaatgcatctgcaggtgtggacatctaccctcacaggcctccctgtctaacccaggggccagcaaacattgtctgcaaagggccaggtggtaaatgtttttggctctgtggcctcctgatgctgctggtttctccctcctcctcctcttccttccccacccttaaaaaatggaaaacccaggccaggcatggtagctcacacctgtaatcccagtgctttctccaaggcacaccctgaggactcaaaccacagctgctaggaagctccctgttctgctgtttctaccatagctgtgatcacttcccacagtaaggatacagtcccatacactctcctgcctctctcctccagcatgaatgcacacttcttcaggcagagctttgatgtcttatttagcttgtatcaccagccactagtgcaatggctgacacgagaagagtgatggacatttgctgttgttgctgttattgtttttaagacggagtctcgctctgtcaccaggctgagtgcagaggcgtgatctcagctcactgcaacctccgcctcccaggttcaagagagtctcctgcctcagtctcccaagtagctgggactaaaggcacacgccaccatggccagctaatttttctatttttagtagagacggggtttcaccatgttggccagcatggtctcgatctcttgacctcatgatccatcggccccggcctcccaaagtgctgggagacatatctttatttaattaaacattcttagactccagttttctcacctgtaatattaaacatttatgttccttttaatctctaaaattccctaatttcacttttgagaagttcaaatactgtatcttacctcaagtatttaaataatgagtttaattcttaattctgcctataccaaagaacaaagtatctttttacttgacttgatttcttcctttcatgcaggacagtcctgggtgctcacaagagtcaagtttcacacacaacagctcacggggtaacagccttttatatatttttcacatgtggaaaatgaacatagacatgggtcttgagaagggtaatcaactgcattctgagctaggcattcaatttccaaaataataaatttcctctatctttagtctctgttcccttcccctctttctcattctgggtattttaccagaaaattagaagtctttaaaatcaaatcagtgcaatgaaatgtttggcttttagggtgaaatcaccaatgtgattatatggcaggatcccacatactcaaaaggttcaaatttgactttgcttgattttatatgagactgttagtgtttctgatgccatttttaccctgaaattcaaatattctccaagagtagaccttatgtcgtagctttgttaacattatttcatcttgttattaagttttcttattttattataataatattattaattttcattactctaagaaattatttcttaatttggttgacatttaggtctttcaactgtcattatgatttaagagtttgttgattctcagtggtaatcatataaaaaacagttccaaggaaaacaatttggtgatgattaacagcctctgatgattccaccaataattgtacacaggcagatctgtcacttgacacaagtgagtgcctcagtcacatgattcgcttccggtttgggggcttggtagcctggtctattttgtgtgcactgctctcaaccataatggcacgaggcatgtttggagaaaaagcctcccaaatgaaaaccattatggcatgaggcacgtttggagaaaaaggcttccaaatgaaaataactacttacaaatcatccttgggttaaggaattctgtaaaaattaaaatggttctgttctcctgagtgctgtgactgaaaagtagtggaaattataaaaattaaatattctgaaggcacttgccaaatatcagcaacagctatatattacttacatagtaatataatttgcccacaaaaaagttaatgttaaattgctctaattttcatatactcttaatcttattattggacaatacatttgttttttcttttgcaacaagtcagtagaaaaaaaaaaaatcttagtgacataaatttttgctttaagcccaacatgaaataaatagcaccaaatgtttggctaaaaatagctttgaaatttttgagccatctccacctcctgtggagcaatgtgggggagaaataaaccaaccaataaataagatctagttctgtttctaaccttcccattttacaaatgaagaaacttggcacaaagagggtaaagagatgactgaaggtaacatgccttgttaagggcatcttaatggaatatattagatgaactcaggcaaatctatgttcctgctcaagatcactagagaagttttgtttctgttctccaagttttcacattaacaaccaagagacagtgacttgtgtaaacagtgacacaaaatgcagacatttggtgaatgaaacggaaatgaaataaacacccataaagaagcaaaacaactgggcatggtggctaacagctgtaatcccagaactttgggaggcggaggcagaaggatcccttgagtccaggagttcaagaccagcttgggcaacatacagagactcagtctcatctgggaatggtggcatgcacctgtagtaagtcgggaggccgaagtgggagggctgcttgagcccaggagctcaaggctgcagtgagccatgacagtgccactgcacatcagcctggcaacggagcgagattctgtcccaaaaaaaaaaagatgtggccaggcatggtggctcacgcctgtaatcccagcactttgggaggctgaggcgggcagatcacaatgtcaggagttcaagatgagcctgaccaacatagtgaaaccccatctctactaaaaaataaaaaaaaatagccgggcgtggtggcgggtgcctataatcccagctactcgggaggctgaggcaggagaattgcttgaacccgggaggcagaggttgcagtgggccgagatcacgccgctgcactccagccctggtgacagtgcaagactccgtctgccacctcctcccacccgcccccccccccaaaaaaaagcagcagcaaaataaagttagagacatccaccatcagattgagatttcaggaggtcaaacttgcaaatacacacactggtgcatacacacaactccagctgatgaggagcacaaccaaatattgcttaccattctaaaattctaaacagtagggagagatcaaagtcttacatgagaaacccctgagcacagctgacaggagctggacatacaggtcttcagccagtacggaagcagggctcgactttgaccttcactttgagtcccatggacattccttctatccacacagaatttctagcttgaaatcaggaagaagtaaaaactttgacctcatatttgacttctgtattctcttttccctattaactctgactatcataaaatacaattaaattaaaattatatcttaattaaaacaataattttaccaaatccttgtaaatttggatcattagatgaatgagaaacttgcttttcaccatttagtttcagaacttctttaaaagtcactatttcaaattacttattcctaaatttactttgttgatactgattttcatgcattcatttccaattatggttgaataacaggaaatacaaaaatttttctgcataaaactatggccctaaagcattgaacgccaatgaatgattgaagctccttgaagaaagcatctctaaaagccctcaactgtcaatcctacaatataacgaaggcagatgacattctcagattcctttatatagtttctttcatagtttcattttttaaaaaaataaaagaaatgctgaaatgtgaagttccttttcagcatgcaatttgttctaatgataatgtaattcctctatgtaaggagttccatattatttctttttctccacactgaactgtaagacaataatattatccctatgtttattactaccccttcaactttatgaagcacaaaatgcctcctttcctgttttcttgacgtacagaattttgcttcagtaagcctaagagtttttttccctagcctgtatacgcttgttctgtgccaactcattgtaaaggagccggtttgaaagcttatcaccattaattctgtgactttccaactctgtctccctggtaacagaagcctacaattacgagacaagaacacaaaggatttgccaaattatctaaattctaatactctaacattttatacccttccgcctcccatccatgcatctattgtttttcccaagtctaaagcaatggtcttcatgttagcttctctatcttcagttttcctctggccaagtcatctaaaacacgcattccagttgaatcttttggaaaccttaggactgtcattcttccataaaaaactttcactgcgccccaaaactctcagagcaaagtacaagtacttccgtttggtattctaggatctctatgactgctaactatcccttttttttttttttttttttttttggcagagttttgctcttgttgcccatgctggagtgcaatggcatgatctcggctcactgcaacctctgcctcccgggttcaagcgattctcctgcctcggcctcccaaatagttgggattacaggcacctgccaccacacccagctaattttttatatttttagtagagacggggtttcactatgttagccaggctggtctcaaactcctgacctcaggcgatccacccacccgcctttcatacatatctctatgcttctgtgactttggccactatacgagctaggtcaagtttgccagtcttcctgtgtcttgctacttcacattgctataaacattcttaagtaaacaaagctctgttttgaattaaacatttccaaagcaaagtatttcactagcttcctgattcaccgcatgcttatccctaacaagtatgcttattccttaggattctccacagtcaatggcgccatttccccagttgctcaggcctgttaaagtacgagtttcaacaaagcaaaatcatgattcctatgtaataaaaatcatgtctcttatgtaaataaaaaatgaatgtgtgtcaaagatcttatacacttagtaattaatgaggaagccagtaagatgttaaaaccagttgaaattaaaatttgaagaggtaggtgtttaaaggcaattttacaaagtaattttatggtaagatcacctggttagatatattaataaaatgggataatgtccaacagggcaataaactataatttttaaatcatcttttccaccagatagaaattatctgtatctctactagacaaaaatctgtacattcaccccttctcctacaaggttttacaacacccaaagcaacagaaaatcaaaggtaaaagcctacactgaacggaaaaacactcagtagttgctccatttttgtttcagaaaacttttctgatattctaccccttatgattataaataatcctcaaagattatctttaaagaaaaagtctagcctcattaggtttggtctaattattcacatggatgcaaggcaacaagagtcctaatcaaacacacaggcctcgagtttgatctgaaaatctagagccttatagtattgagcaactatgaaagattaagaattttctgggtagatttttcatcagaggtctcagatttgatttttattatagtcctcatatttttttatgctgagtgtaggagactcagcccaagacgttttctccagcagattttatatatacccataaatctgggtgaattcttctcttcttgatgacttccaaattctctaaggcctctgatctggtaagaaatcataccttctgtgaagctgatgctctgtaagccaagtaccaagtgccaagccagggttcttgggagactctgtaggcactgaatccatacataactagtcttgagaacaggcttccaactaagaacttgctctttaatagggggcttttcacagctgattaaatgagaatcattctcaaatgcgatattgcttgcacaattgatgtttccaattatgctctgataaaaagagagcaagattcttattgaatcttacccaaataactatattgccaagtcaagtcacaaatcttagtaacatagctgtttctgaattctaagggatgagtgagaatgagataccactaaaaatgtttcactgcagtttaccaaagcatagtctattaaactgaggcttagagacagcttgggaaaaaggagaaagggtttcctcatacaaccataaataagagagcattccaacaacagcaacatatctaaacaaataaccacaattaaattagtctcatcagttcatttagtccttagtaattaagttttattctgctggatactgctttcataaagtatgtctgctgctggactgaaagaagtcctggaaatccttagtcactgatacagtctgcaagttgtctaagcaatacctgtttgtaaggctgtgcttgacaattccctgaaggggcaatggttcataatgctggtacaggcctttccacaggttctgaactcccctttgctaaaggtataaactctagcctgaagcttatagcaaagtcaccaggcaaacatcagaagggaaaagagctcttgcttgatggtaagactcatggcgaaggtcatattccaggaacagtattatcacagcaggcaagagtaaatttcttttttgggatagaggacataactatttcataagggtttcccctgagagagaagacatatgatggatagcagaggcactgacaatttccagggtcttctcaaaatgtgtacactctataaaatatttaaaaaaatgaataacattttacttatacaaatttaacctagtgaaggttaagcatctttcctgatttgacaactatcttcatacagttctcacaatagtttgaggtaattaagacatatggaacccatgaaacaaacccaattatttctagtattcttttacttataaagtgaaagaataatctttatgaggccccctcaaaacacaaagatagcattagatgtaaaagacattttacactgaaattttttttttctaaatttgcaatcaaattgtagaaggcaaaaatcaaagtgttgtcagaggaaatttgctcactgaattaggatggaaccatgggggcatgagaaacagtatctggttacctatttaatcaacgtggcaaacagaagaaggcacacaagtaccaggaaacttcagttctttactagtgaggaactttggctcactgaacttcgtgtttgtttacatttatttatcttgttttgtttttgtaaataatcaaggacatgataaggtccacacaaagttgagatgcagaatccttgctacttaggcagattactctgcaggtaaagaatgatcttttgtcactccatccgccctctgttaactctaaggccaatttatcattttaacatagagaagtcattttctagttttgttttaatgtgaagtttggcagtaaagttttcatgagctccttttatttttttatatcttgtgaataattctatcaaaactgaacagaatttaccaaaaaattaacacgtttcattatttctttacagattcagatattataaaaacaaggcaaatacaatttgtttcctcaaacactctatagctagctctccacactcattattctcttcatatgctggaatacactaatacttttctttgggactagtcttgttttttatttgtttttgttttcttacacaaatgcacttacacagttgtgttccttgtcataattcctccttgtgataacagtagtcctaatttttagcagatattacaacttctatttcatagacaaagctgggtgggagataactgagaactgtcatagacagcattttagcagactagcaaagctcaaaaatacacaacacataccttcctaaagccacattcatcctttttgcacattcttaaagtgacaaaaaatgaacacgtttaatgatatgatccataaaataagaaccaaaaatattaaaaaattaacatttgcttaatgttagttcttataatgttctatcttagaaattattcagggatctaaaataatactgattaattagctcaatttaattttaatccaaattttgaagttactctgggccttgaaattatgtttaagctaacattctataaaacataatcactgttataaaatcattggtcaaaactgtaattcaatatatttgaaaacatttcataatctcaaacattatttagaagtaatattatctttttggttagcaaaccaatataagtatagtagtgtcgaaaactcagactaagtagttgcttcatgagaaaaatttaaatcttatgaagaatataatatagtatattatacttaaaattgaaatatcatagaaaagttatataacttttttcttaagaaaaatgattaaaccaatctaatcaaaaattcacctcatgtgaagtcttaaattgtttcttttttagtagtttctgtaagaatattttaagtctagtacaatattaggagatactctgaattttctaaatttcttatattgaacataatttaaatatgaatatttactgaattcattgtaagacatagtatgattgaagaatataggatatggtggattgcgacattttaaattatgggtttaaaagttttgtatatccttatctattttattttctaagacctaaatattaatgcactgacacaataactaatcagaaataaaagttgacatagacataaagacaccacgggtaataagaaagaacaagcagccgggcgcggtggctggcgcctgtaatcccagcactttgggaggctgaggtgggtggatcacctgaggtcaggagtttgagactagcctgggcaacatggtgaaaccccgtctctactaaaaatataaaaattaaccaggcatggtggcgcatgcctgtaatcccagctattcaggaggctgaggcaggagaattgcctgaacccaggaggtggaggttgcagtgagccaagatcatgccactgcattccagcctgggtgacagagcaagactctgcctcaaaaaaaaaaaaaaaaaagaaagaaagaacaacaagcatatttttcactatgtgtaattattttaaatgagctgtcacattttaaatttacctagaaattagaccatttgcaggcccatttcggcggggaggcagaacgacagaaaatcatacacattttccattaatggactcttgctgtgggaaagggtgagctgtcctgaagacctctatccagtgttcataagtttatcactcacctctaataaaaagcaatcactatgtgaatttatagaaaatattaatttcatgtttatttttagcctatgaatatagtggctttcattaatatacaatgtatttttatcatttctgaaaggtttttatccagtgttttgctgaagctttttgtcttctgaagtacactaaattttcaatttaataatttagttcagttaatactcattttacttcgtgtagtaataaattattcaacttattattaccttgtggacttccataatttttcaaattgtagtcagcaacactgtctgcagcagattattaagtaaaaccatatatagaaaacatacatttaatctttcttagatactgtttcatgtcttgctaaacagcagctttggggccaagcacagacggaaattctcccaagcccagctctacctcctctctgactccaagtaggttgaacgctcccactttcagcacattcagtcttttggcaatggagatgcacaagttgcctggaatcataaaaggctcctcggcttgcctatctttctagttcccaggaccctgcctgtgctcctcctcctcctgccacccagatatggctactaagccccaccctcacagtccacaccatcctccaggcagagtgcaccccccatggaaggctctgagctggagaagcacacaccaccagtccagaccacacttggcagtagcaatcagggtcaaaggttaacatgtacttgcaggataaaaatggattctgtcttatactcagtatctaaagatagggctggtgatcaccatcactggagccatcatcactgccagcccgcacagacctaatccctccctgggagaatatgtatctgcagcctaaagtctgaagccttttcccaaagccttaaccttccataaaaaataaccgttgaatattttcagaaaggcaggcactccccacaaaaaagaacaagattcccataaatacggtggtgtatcccctagctggccctaattatagagccccaattttcttagtaaacttgtagctagctaagtaccactaggcaatgctaacctgatgccatttatgaaaaataaatttcagagatttattctgtatgtgtgtatttaaaaatctgaaagcaatacggtatactgcaaagaatatggtttggaaatcctatagatttggttgaagtccctgcactgacactaaatagctgtatgttattggaaaactaccaaaagcttatctaagtaaggcttagaaaaaacagtcaagttattttcatgattaataagatgcatatagagaacttagcatagctcttagaatatagtaatagtcatagtttattgagcaattgctattaatattattgaataccatttcagtgtattcaacttttctttccgtggcttattaatagagtatctacttaactgcatattcaattccatgtctttatttttcatattataacattgtccatattaaaatggctttatttacaattttgttgactactattctattgaatactgacagcctaattttatgaaggtctgtgacctttgctatcttcctaacatgattctttacaggaaattacataaaatatcaaaaaaaaggaaaagaaatattgtaactattgcagcctcattcatggaaaagacagggtacccaaactaaaaatccaagggatgaaatcttcaaggacaccagctgatttttgtgcatcaagaagcaaacagtcactcagttatgcagctgagctatggcaaaccttacctgtcttacagaagacagctaagagctacaataaaagaggtcaattgcagctcttctttcatagagttttctctttcatagcatggaaaaaacaaagtcagggattccttaattatttctctgatcctataaattttttgctggcatagttgtttagctgtatgggccactacatgaaatgctaaggaagaaaaaaaaagtgctttttgaaatactcaaaaattgtcttttgaaaactaaattgtgctttcaaggaaaaagtattcacataaaagtaataatcaacaaatcggatataactgatgagattgtttgatagccaccttgcttctattcacgtactctacgtgtcttctcaaaagactcccaccaaaccccattcttgtcatttccagaatgaaaggagacaaattctgaccctgagccacagtgcataaactttctcttttttttttttttttttttttttgagacagagtcttgctctgtcgcccaggctggagtgcagtggcaagatctcagctcactgcaagctccacctcctgggttcatgccactctcctgcctcagcctccccagtagctgggacttcaggcgcctgccaccacgcctggctaattttttgtatttttagtagagacggtttcaccgtgttagccaggatggtctcgatctcctgacctcgtaaaccgcccgcctcggcctcccaaagtgctgggattacaggtgtgagccaccacacccggcctaaactttctaaagcagattccagttttcccaggtaaaatcacacaaagaaaccaaacatataaaataaataaaaggtttttaaaattaaaatacaaagtttttttttttattttttcatagacagagtctctctcttctgcccaggctagagtgcagtggtgtaatcatagctcactgtggccttgacaccctgggctccagggatcctcccacttcagcatcctgagtagctaggactacagatacatgtcaccatgcttggctaatttttttattataaaaatttttttgtagagatgcaggtctcgatatgttgcccaggctggtctcaaactcctggcctcaagcaattctcccactttggcctcccaaactgcttggattacaggcatgagccaccatgcccagctgaatttattgtttttaaatagaaagtacacttgtgtagcacttaacattgcagatacattctgagaaatgtgtcattaggtgatttcatcattgtgagtacgttatagagtgcacttgcacagacccagctggtatagcctactacacacctaggctgtatggtagagcctcctgctcctgggctacaagctgaacagcatgttactctactgcatactgtaggcaactgtaacacacggtaagtatttgtgtacctaaacatatctagacatggagaaggtacattaaaaacacagtcttataatctcacaggaccactgtcacatatgcagtctgtcattgaccaaaacattattatgtggcacatgattgtattataagaaagaaaacaaaaatggctcataagtccacagccaaggacaaaaaatacagaagtaaaacaaatttaactaggaagctgaaaccatacataaagatacaaaataaagagtaaaagcttcttccccttccctctgagccctctccacaaaggtaaacactgagcaatttctcatcattctctctcttctagagagaaagaataataatataaataataatgtaatataatataaagagagttctctttctagaataatgttgatatattaatccaaatacatgcatcttaaaggtagtattttgctaaataaatttataaattaaatttcaaaatatttatgtgcaataagtaaatcaatgagaacaaacaatctgtttttggagaaaaaacatattaggtcagatgtcatggagggctattttagacttaacaaatcttaacactcattttatttgggtattttaatttggttacttaatattacaaaattgtgattcaaacgcatgagcagatgcactatggaaaggtcttaacagccttaaaaatctaaaatccaggaatctaagtgagaggtagttaagaaagtttggctttaaagctgaattattaataatatatagaagctacctgaatcctttactcatacttatatgtcaaacaagaactattcagggctttctggaagtattaaggtcatgtttcaccttcactttttgtggtacaattaagaaagcatgccagagtttgtagtaattcctgccactcaccaaggaagcagaaagtttgtttctgagctcagtctgatcacaacctcacaattttccctactttatattccttttcttgtctctttcctctgtcaccactttatctatcactcctctattgcaaacaatgaagaagtactttctttctagctatataagatcatgttagagctcccagtgctaggtcctagaaccatctctatatgtccacagtgcaaaaaaaaaaaaaaaaaaaaaaaaaaaagtctacggggcaaaatttgttgagtactagaaaagttcctaaatattcccccacatcacccattcccaactaattacagaaaggtcacaatttattataaatcaacaaatatctgaggaaaggtgtaaaaagacgagcgatgtaaaatggcagtattatataactctactgtattaaatatcacatgtaactacttgacaaaggaaagacagacagccttctccagcaagcttcaaaatgctctgcctaaaaaatagattttataatcacgtttttgtaatatctctctgtactgtgattttacattatactaaatgggattccaatggtcactatgtgtttaaagcatggcagcattctttctatatgcaactcctctgaggtaattaaatccttggtgttctttctttttttatttttttaagatggagtcttgctctgtttcccaagctggagtgcagtggtgccatcttgactcactgcaacctccgcccgccgggttcaagtgattctcctgcctcagcctcccgagtagctgggattacaagcatgtgccaccacacctggctaatgtttgtatttttagtagagacggggtttcaccatgttggccaggttggtctcaaactcctgacctcaagtgatccacccgcctcagcctcccaaagtgctgggattacaggcgtgagccacgacagccggccagtgttctctcttttaaatgtcatcttgacagtttgtgagtaagctccttttaccaacaggcactgatctcatagagtgtgcacaaacatacagccttatatgttatgtgttaacttagctgggctctggtgctcagttaggtcaaacactcacctagatatggctgtggaggtattttgtagacataattaccatctgcaatcagttgactttaagtaaataagtttaccctaaaaaacttgggggtcctcatctaatcagttgaaggtcatatgagcaaaaaccacgtttcttgaagagaaggaattgtgcctcaagactgcaacacaggaaccctgtctgagcttccagtctgccagcctgccgcacaaatttcagccttgccagccgccacaaccatgagccaattccttaacatatatgtatataaacatttctttctctggagaaccttgacggatacacatactaaatctccgtcaatataataatcaacaagtatttattgagtgcatttacatgccaaacactgttctagatgcaggtaatataaccatcaatgaaacagacaaaaatctctattttcatggggcttatagtttagtggtactaagatgactagcaaattgttagttaaggtaaccatataattcatcatacaatccagagcacttttaagataagggtgaaataggatactggtaatgattttgccagggcagcatgtctaacccagagccatctcgacaaaccaggatggtacacatcatctaagtctctagtgaaactgaagcccatctcccccacacgaccatgcatctggctaactgtagaaagtcaaaggtgtatgtcattaatcaaagttgaggaacagacttgtagattcagagagatttgggttccaattctcggttacacattataaaaagtattaaacttttactccagcctgggcaacagtgcaatactctgtctcaaaaaaaaaaaagtattaaacttttatgagtctcaatcatgccatttagaaatccatctaatgtgagaactaatgatacacatatgtacagcatatacagaaagaactggaacctgccagcccttcagtaaagtgcatgtaaagtaagtgattaagccgagcagggctggggattaagtggtgcactgaaaactttggtacatgaatataagtctttctctactactttatttttttaacatatgtgaatgtatgtcattggttttaacatttttgaagaaaagacagaaatctgaacattctgcctgggaattagacagcaaagtgcaccagaaatgatgaaatgatggcaaggctataatttagagcacggacatacgtgactctcaagcggccatttatcactgttaagattgctaaaagtgactttaggtttacctttaaaaagtttcatattcattaaactgaattctacaccaatatataccgaagtagaagctgccttaaaagcaggtccaacaatccttctgccctgctggaaactgttgctaggagacgagagtgaagagaacacttcctctccagtgtgaccacaggagctgcaactgctgcacaccctccacaatgcttttgaagcaggtttgaaaactctctgccggccgggcgcggtggctcacgcctgtaatcccagcactttgggaggccgaggcgggcggatcacgaggtcaggagatcgagaccatcccggctaaaaacggtgaaaccccgtctctactaaaaatacaaaaaattagccgggcgtagtggcgggcgcctgtagtcccagctacttgggaggctgaggcaggagaatggcgtgaccccgggaggcggagcttgcagtgagccgagatcccgccactgcactccagcctgggcgacagagcgagactccgtctcaaaaaaaaaaaaaaaaaagaaaactctctgcctatggctgaaacctcagagagattttaacagtctacaaagtatacagatatccctaggtatgatctcaagagtgagaaaagcttccctttgtctcctaatgtttttctccattggcttatcctagagtccaataatctttgtccattctcttggagtcttcctaacaaagatataaaattaagggaactcacagtgaagatgatctattaattctgtgggaggaaggatgaggttactcacatgtaaggacagcatgggtgtgacaactgtttcagaaagcaaagtcccaaatgccccaaaattgtatttatgttcttttgtttgctggtggagagaatgtgagggaatgagaggtcgagaagatctaaggagaggaaagataagaaacacattgccttttctagataggataggccagagcaggagttcatactgaaatactttattatcctgtgagggttagtcaactgagagcaaccacaatatggctttgtttgtttgtttgtttgtttgtttaaactggaaagaaacactgtgtttccttctgattataaatgtaaggctcattacaaacctccattctcctggtacatttttcagaaaacagagaaagtgaaaatctctcaaatgacactgccactgactacattttgatgtacatcttcatcgatgttccctttgcatgatcacacatacacacgtgcacaccgtaacacacttacgtggaactctgtaagtctgaaaataagacaagttccctccatcactataactaatctatccttctgaaaaggagactccatctattcctgtcttcacttcaccagattaccaaatgctctctcaattattgcattttgaaggagaaagtagtttgaggagacacattaacctgaaacaacctcctccgtaccgaattggtaattatttcatactagttacacctcataaccacaaatattaactcctgtaaataagctttttaaggatcacttttagaaagttatactgtgctcacactgacaagatcctcaatatatgcccatgggaagaaggaaaaaagcaggcttctcaggttacgtaagtggatttagagagtgctctaactcaagcaactttaggcagtgctggtgctgacatatgtgaaaagtgtgaataaaattatttcatgataatgataaaaataatatttctaaattgctatcttttttgtatagttgattttcattcactaataaattaattgttataagtagatagttgacttttgcatctttatccctaaaatttcatatgcataatgtgggccacatacttttaaaaataatactcagatatttagcattaccttatgtcgagatttctcaccctcagtactactgacattttgggtcagacagttctttgtcattgaggtagtcctatgacttgtagaatgctcagcagcttaccagacttctgcccactggatgccagtagcacccctcaatgtaacagccccaaatttcttcagatatcatcaatgtccactggtggcaaaaccgccccagttgatctttatatttagggtcacctcatatttgggcatacgtggtgtctagcttgcctttacaaagctggatcctaaggacacaattttataacctgctcttccagctgactgatatgtcatagcgatcttctcagctcattatgtacatactttcagtgtgttcttaactgctgcactgtgcctcattaacaggttgtgtcacaagtgttgtatcagttaacaattgtttccaatttctcagtaccatagtctctatcatttcatatataaattcctttaaatatgttcaattagttccttatattttaagaccaatagtatccttagaattcattttaaatttagtttaaatatacctgaagtcaaaggattaaaaaaagcaatacaacacaatataaggtcaaaacaaatatattttagattgcttattatttatggtttctacccatgccactcttctattagaattgagaccagccaggtgtggtggctcatgcctataatcccagcactttgggaggctgaggtggaaagactgcttgagctcaggagttcaaaaccagcctgggcaacagctgactgacacttcctctttattaaaaaaaaataagaagaagaagaagaaaaaataaatacaaagaattgagaactaaccccccgataagatttattaaaaattccttctaaatgactaaaagctttgctttttcatcagtattctgagcatctttttcaaatacaaaagatataaaacaggcctttcagagatccatatgtaccaaaactgtatagcttctagcatcttttcctttagaaactctatgtgataattcaaaaccaaaaccaaaaatctagtcaatcaatgatttgaagatattttattactagctgtcataaacaattttaagtgaagtctttgggtttcttgctctagagaattctaactgagtttaaaagatttaaaaatcgatgattgcattgtttttggattcaggaaggatatacaaacagtttaatgagactggaaagaggtccaaagcagtttcaactgtacctatagaacttcttgaaagcatttgctaaagcaaatatgtcaagacatgaagactgattaattcagaatgggagtttgtgtttgtgtgtgtgtgtgtttgtgtgcgtgtctgtgtgtgtgtctctgtgtgtataagcacgttctttgaaatattttaaggatttttcataataattttttaaaaatcaactcataatttaataggatgttgcaaataatcttctcatagaaaatcttagaaaatttctctggaattagcgttaccttttcaatagacaaaatgggtaaataaacattattttggtaaattttgtgtatttggaatcttaggtgatagaatttgtttccagacaacctgggtctgatcctcaattccttacattcacattgaattatttatatggttatttaatttttttctgcctaagttttcccttgcataaaagacaaatcgttataatatctacttcacagtgctactgtgagaatagcagaggaaatgtttataaaaattaccttctaaaatataaagccacagtattctaactggttgccaacagtatctaaatattcttcatagtagttaaaacagattaagaattacagtgtattattcctcagtgttgagcatggccccttttttatcttagtatttataaaacaatttcaatgaataaccatttatacacatacaggcagaaacaaaaactgctttctttgttcaacaagtacctactcactggcactctttttgaaggcagagaggactttaggtacttcacataaagtaagtggttttgtatttcacattatttgagcctatcaaaaaccacatgctataggaaagaatgatcttactaaatctatttcagatataggaaaacagaagtgtcgaaagttaagagacttgtttaaagtagtgataggatcaagtctaacagtcgagcttccacatttgtgacaaactactttgctattattgtagctctccttctggcccactgtgaaaagccatgttcatacacatgtttttaacagttatcaagttatggattaagaaatatcatcctatgagatgcatattaccagtatccccatttcatacaaaggaaaactgagggatagagattaagttatttgcataaaatcacacagctgttaagtaacagtggcaggttttgaacccatgttacctgcctgaggagcccgagttcccaaccacgatttgtgccacacacattcaactggcattagataacaacaatctattttactgtatcagaatatgattaatttatctttcttcataatgataaaagattatccaatagcatcttctaaattgacatttatccttcaaaatttattttcaaatcttctgattcattcaagagaaaacaattttttaatgtttactgtattagtccattctcatgctgccagtggagacatacctgagactgggtaatttattaatgaaagatgtttgattgactcacagttccacatggctggggaggcctcaggaaacttacaatcatggcggaaggggaagcaaacacttctttctaaacaaggcggcacagcaaggagaagtgcagagtgaagtggggggggaaatccccctataaaaccataaggattatgggaactacaattcaagatgagatttggttcgggacacagccaaaccatatcatttacttaaaaaaaaaatcataatctttcaaacaaaaataatgctctagtctttttaattaaaccccaatatgattttctaacaattctgtatgcatagttataccaatgtcaattttaataattagaaaatgctattcatctttttcataaatttcatactttaattccacaaaaaataaaaatatacataatttattattacaatatattaatgattttggcattctgatctacaatatagttgttatgctttaaatatattatcacatttgtattgaataaaaccctgagctttatccgccatgaagtctataaaaaaggaaaatcacaattggattaacccatgagtatttaagaatttccttggtagttttttgattcgtaattgtattccaacactttcacaagtaaaccgtagggatttttgcctccagaaactttatctggcagcctagtataactgtgtggtcttccagaaacaatcgtgtctcctttatttttttaagcgtatatacaaagagagagtatatacaaattaacactaattagcaagtcagaaaagcatgtttttctccctagctcttatgagtgttcatatataatttgctccaaaagaaattttagtaagttacagtactgccagaattactttaatttgatggttttaacagggaaaaaaaggaattatggaaatcccctttggaattcaatcacagaaaggaaagattcaattacttggaaggtctttggcactgtgagatagatatacagaaaatgagagccacacttgggtcatcattaactgtaataccatatggcatttcctcctctgagcttctgctaccatctatttacataaaatatgagctgcaaaccaataattacaaacacacatacacacataaatgagagataactatgctgagtgaaatgtaaactgacttttaattattcattaatagtaatttagaatattaaggggcatgacacaatgttatcctcagggtccctatacaccaggaattcacctcatttcagattaacaacccagtataaaaaggcctattaggcccaaattatataaattattcttgaacagaataggtccaatatcaatctatatgattctaaatgctaatctacattcaaggactaaatggcacaaagtagagcgtacatttacaacagtaccaagcacataggtggcattcgctaacaagagcagttacagaaacattctctctactggcaacttttcagctacatatgtattaatttaagagcaagaactaattcgggatatagagaaacacaacccactctcagtacttttaagtcaaattgttgatcatcaaagattctacaatgagctttaagatccttctcaatctgtggccctacgcagccactaccaactgaatggagctggcaggcaagatggaagttatctgacattttatgatctgtgatctcatcttctcccagaaatcaggatgctagtgaatggcctcaccctccatcccattatttaagctaaaaggtgtatgtcatacttgaacctctctttcacatgtagtccacattcaatccgacaattgaattgcctttctaggcattgaatctatcccattagcactgtctctgccatagcacatgaatgcaagtctgtaattacctcctaccattctttcctgtcccctctaacccttgctcctcactgcaatgagagtattagttttgaagagcacatataatcttatgaccaccaccatcccaacacaatcctgaaacagctttacattcctcttgatcttgaacacagacctttatccttaacaagaccttccaacagctggccttccagatgtattccagcataagacatactccttccctctcccccttgacactccagccatactcctctcaatcccaggcacccaccctccaggtactctcctagcacaaagccttagttaggagctttcctcttctctctgctttgttaaacatctactttcagaactcagctacgctgtcccaggacttctactttacagatgcctgtcgtatcctgccaacttgccataagtttaattttactgacccttgaggacaggggctaaatatgtggtgggcttgttcatattatatgaacaccacctagtacatggcctagcaatggtagatgctaaacaaatcctgcttaaaagctagaatgaatgaatgaaaaaatgaatacattgatgcaattatccatagtagattattatatccttgacagagccagtgttacagaagagttggctcctaattaaacagacatattttgtatattatatatagtattctattcatttgatactattgcatttgttcagtattgcagataaattacaaattaactgcagtaataattacatgtgggtatgatcaaaatccccaaatctatattaacaaacttccttaaaatcaaagttgagtaaatttatatcaactttccatcaatatgtgttttattacattcatttaataattccaacaattactaaatttaaaaaaatacaggaaactaagcaacaaaaagttctcttaagagttttcaggacaaagaatacataatgtttcatctgctaaagtagcaccctggcatccaaaagttgtttttgccatattttcaatgataatttttaaaaattacacttggtaaattcaaatggctgaaagaaaacacctgtaataaatctttctcatggaaatccacactgaaaattagtggaagaccctccatattgtagtcagatgtgaacacccctgtcatgactcatgactgctgccatttcagtatggtctggtgtcagaatatagtagggacatgagggttccaggcctagcacaagcaccaaattactggcaaacactgtcactggaggcttgttggaggcttgtttctgcaactcaaaacctaaaatgacatctctgcctcagaggattataggaagaagatgacataggtattttagaattcttaaaaaatataatactataaaatgtcaccagaacaattctgagattttagagtcatttatgacaaggcatgcaaccagattgccaactcttgtggcaaaatcaaacctctgcatggtacaacatccccaaattccacataatttaaccagatgcacttaaaaatcactgcattgcattggtgccacagttttttgttcctatacatttcttacaatatattctactggtcttaaagaagtttgtactgagcaagcatcatatctattcaactttctttctgtagagtctagctctttatgcaaagacatacttaataaaatgcttgtgaagagtcatacaacgagataatatttactcaaaataagacaaataatattctgcactcatagccatagtaacctatgatataagaaagtgtgttagccgggcatggcggctcacgccagcactttgggagaccgacgcgggcagatcacctgaggtaaggagttcaagatcagcctagccaacatggtgaaaccccgtctctacaaatataaaaaaattagctgggcatgatggcgggtgactgtaatcccagctactagggaggctgaggcagaagaatcgcttgaacccgggaggcggaggttgcagtgagccgagacagtgccattgcactacagcctgggcgacagagtgagactctgtcaaaaaaaaaaaaaaagaaaaaaaaaagaaaaaagaaaaagaaaaagaaaacaaaagaaaaaaaaaagaaatagcctgaagatctgaacttaaatcatctacacatcccattctaagcactaactaggtacttacaatgccaatatcatataagtcatgtgaattgcaagtacaactcaagacaaactatattttaaagatatttaagaaggatttttaaatgggtgcatgtattttaaaatgttatgacatttaaaacaagtccacgtcttaccgattttttagtagtaaaaagaagaaataatacattctatcaatatatacctttggaaagaatcaagctgtaaaacactgaaaactcttcaattttcataggtaatagtggctttagggctttcaaagtataactttttatggattaatcatttgcaatctttcagactttgatcatatattatgaatgttaaatgttataatacctttcttagttacatgaattcaagcggctgttattctataattctaaatacaattcatttctggctatgcctaattttacactttatgccttttttcctttaacttaaatatgttgtttggccaacttccagctttggatttttaaggtttatattggaacaagtttcattccaatttgatttgtgacagataacattgtaagctacttttctatattgcctctgaaaaagagctatttccattcctacacagtatacagattaagaaagttaacataagtaatgtaccactataatttgaaaatattcatcttgttcacgttctctagctcttactaagagatttataatgccactgaaacaagaattgatgaattcatcactgtctgggacattttgatcataatcaataacataattttacccttaaataggatttcaattaatgcatatttttcaaagcaattttcctttaaaataaaatgggtttttgtaccatgagttattaacccattaggtgccaaaaagaaaattattctgtctctgaagttctacatcagaaaaaaaagaaatgaaaccaaactctgttctattatacatttcccacaggtacatttcataaaaaattacattattatattttcatcatggaaaatgaaaagtaatatactttcgtaaaatgatagaaccatgaaagttttattagataaaagtgaggacacccaaatgcattgctactgcttggacagagtatatttatcagcaaagaaaacattttcatctaaacaaaatttatttgtcatatcattatgaaacatcaagaacaatattaaaaaccctgtgaaacttatgccaggcatacaaaatacactctattttatgataatcctcctatcctagccatttcatccattattttcctgttctcactactagaatgttgaaagaacacagatttctctcacacacaatacaaaatagcttccttcaacaaaaataactcaaaattcaaaaattattttaaatgtatagtataatcattttattataaagaagtcaccctcatttttttaagcttcaaagcatgtcctctactttactactttctcagaaataagcctaagtattttaccccttgtttcaatcacaattagctggttcttgctaaatgattcagtccagctccttatgaaagcatgcaagaggctcacttctcacctttccttatgcagtgttctctagttctgcccactaaatctgtttcaccatcacactgtgtctttgtatgcaatttcctctgcatcttctccccttcccatgtagaaaatgtgaactgatccttcaaaataaaaaacacacactattttctcgtagagtcttctatgacccccttggataactgcttccttccctatgattccatagctatttatgcagacctctgagacagtgttcaatttgcattctaattatttatctacttgtttgtccttcctacaagagtaggaggctcctggaggtagaactcattggtccttctatcactagtaaccctcaagattcggtacctaagacattcaacaaagtaaagagatgggatgagtgattgctgtccacatggtctgttcattgatcttaaaaccgtcagccccaaagtagggacttgccaattatttagaaatgcctatctaatctttctactgtattcaacttgtgtaggagagttcaagttcctgggctgggtactcaagatgtttgattttcaaattaaagagatgaaatttatgacactaagaattctgggtgctgagcaacaacattcaactaagaaagaacaagggagggccgggtacggtgcctcacatctgtaatcctagcactttgggaggctgaggtgggcggatcacctgaggtcaggagttcaagataagcctgaccaacatggagaaaccccgtctctactaaaaatacaaaattagccaggagtggtggcgcatgcctgtagtcccagctactcaggaggctgaggcaggagaatggcttgaactcaggaggcaaaggttgcagtgagctgagatcacgccattgcactccagcctgggcaacaagaatgaaactctgtctaaaaaaaaaagaacaaggggtcagggagcaattggccaccactgacttcagtatctcaagttgagttaggaacttaaagaacaagtttctaatgtaatttctgtaaaaattctaatgcctaaaatgcagcaggaagatacagagattaaaatcaggttaaagcaaaactataaagacaagtagtaatgaggatatacaaggtgcaaagacatacagttcccacggacaatgaggttagtaggggttggtttgggagacctggcggtggccttattaggcagggtggggaaccctgagcacagaggtttctttactagaagtaaccaaacagattctaaactctgctctctaacacttgaaggttcctgtgtcctggaaatctttattcaccaaacgcagtttgttgctttgttaaatatgacagggttatggctgaagtaataatctacgcgtatctatgtatttaacatattctttagtccctcacacttttcttgaagcagaaaaaaaggcacagagaaacagttaaatgtgaggcagaaataattttttcttttaaaattaaattgtttattaaaatatatcgaggggatacaagtgcaggtttcttacatgcgtatactgtgtggcgctgaagtctgggcttttgatgtattcatcacttgaacagtgaccactgtacccagtaggtttttcaaccctcatcccctcccaccttttgtattccctaatatctattattccactatgtccatgtgtacatgtttagcccccatctgtgagaacatgcaagcttatatatatctgcaataaacatatgaatgaaggtatctttttttttttaataatttctttccctttgggtacatatccagtaatgggattgctggatcgaatgatagttctatttttagttcttacagaaatctccaaaaaggacaatctgaaacctgaaacggggcaacctgtttggaaaacagcatggagatttttttaatgaggttacttttttttttttttcttgttgagttgtttgagttccttgtagattctggatattagccctttgttggatgcatagcttgcaaattttttttccattctgtaagttgtctgtttacactgttgattgtttcttttgctgagaagaagctttttagtttaattaagttccatttatctatttttgtttatgttgcatttcattttgaagacatggtcataaattatttgcctaaacccatgtccagaagagtttttcccagtttttcttataggattttaatagtttcaggtcttacatttaaatcttcaatcaaccttgagttaatttttgcatatggtgaaaggtgtgagtccagttttcatccttctgcatatagctacccaattttcccagcaccatttattgaatagggtgtcctttctccaatgtatatctttgtcaactaggtcaaagatccattgcttataggtatgtggctttatttctggtttctctatcctgttccattaatctatgtgtgtatttttataccagtatgatgctgttttggttactatagctttgtggtataattgaaagtcaggtaatgtgatatgaggtaggaatgattctgttgcacactgtagagattttctgttccaaaggcttgggttgggggaaagggaggcagaagagcgattgaagctgaagggaaaggtgtgaaggaaccaagagccttgacaagatgaaggcagggggaagcatcttgcactgggagaacaagggagcagagtagaacccgacacccagctgctcccaaatatgcctccaccctacaaaacatcaacccattgcctgtgcacaacccaccagccgatggtcctacattccttatcagctaattcttagcagaaagccttttatatatcagggattgctcaaaaatagttcacatggattaattcttccaatgctcacaataaccctgtgaggcaggcaccattactatctcatttcacagaaaagtgtggcagggaagagttaatatcaaggccacagagactgacactcttctaagcaaggaggtgataacctgaccactgtatgtggggatgagcacgtaaggggagattttgtgctacccaggaagaaactgaacaggaaaaaaaaaaaaaggaaatttccctatgagttgggttagttgcagacatcactgtaaagtttagtaaaagccatcttgaaactgctgcatgtccagaggaaacaatcacaaaacgaagagcattttaaatattgttttaaaatgttttttaagacaggtgttaaaaattactatgattagattagaacttgcactggttccttgtagacagaaaataagtgtgtacttccaggaaaagagacgacaagaggagtaaagcaacaagttagattggggattaagtgggcttcagtttcctcacttataaaaaagagaagatagaattgaaacaaaaccaaaaacaacttctatctgaaacctacccccaactcccaagttacatgaaactaaaaagaaaagcccagactttggatggggagaatgtagctgaattcagttatttgctatactggtgaagccccacaatactttttttttcattttattttttgaatttttgaatattttatttcctctaaaaaaaaaaggtggggggatatgtgtgcagaacatgcaggtatacacgttctggtacataggtatatgtgtgccatggtggtttgctgcacctattgacctgtcctcgaagttccttcccctcaccctccaccctgcaacaggccctggtgtgtgttgttaccctgtgtccaggtgttctcaatgttcaactcccacctatgagtgggaacatgcagtgtttggttttctcttcctgtgttagtttgctgaggatgatggcttccagcttcatccatgtccctgcaaaggacacgatttcattcttttttatggctgcatagtattccatggtgtatacgtaccgcattttctttatccagtctatcactgataggtatttgggttggttccatgtctttgctattgtgaacagtgccgcaataaacatacgtgtacatatgtctttatagcagaatgatttatattcctttgggtatatacccagtaatgggattgctgggttaaatagtatttatggttctaggtccttgaggaatcaccatactgtcttccacaacggtcgaactaatttacattcctaccaccagtgtaaaagtgttcctatttctccatggcctggccagcatctattgtttcctgactttttaataattgccattctgactggcgtggcatggtatctcattgtggttttgatttgcatttctctggtgatcagtgatgttgagatttttttcatatgtttgttggctgtgaaaacttttgagaagtgtctgttcatatcctttgcccactttttgatgctgtttttttttcttgtaaatatgtttaagttccttgtaaattctgtatattagactttgtcagatgggtatactgcaaaaattttctcccattctctaggttgcctgtgcactctgatgatagtttcttttgctgtgcagaagctctttagtttaattagatcccatttgtcaatctggcttttgttgcaattgctaaaaccacatgattatctcaacagatgcagaaaaggcctttgataaaattcaacatcccctcatgttaaaaactctcaataaactagatatcgatggaacatatcttaaaataataagagctatttatgacaaacccacagccagcatcatattgaataggcaaaagctggaagcattccctttgacaaccagtacaagacaaggacgccccctctcaccactcctattcaacatagtattggaagttctggccagggcaatcaggcaagagaaagaaataaagggtattcaaatgggaagacaggaagtcaagttgtctctgtttgcagatgacatgattttatatttagaaaaccccattatctcagcccaaaaacttcttgaactgataagtaacttcagcaaagtctcaggatacaaaatcaatgtgcaaaaatcacaagaattcctttatactgacaacaggcaagcagagagacaaatcatgaatgaactcccattcacaatggctacaaagagaataaaatacctaggaacacagccaacaagggatgtgaaggacctcttcaaggggaactacaaatcactgctcagagaaataagataggacacaaacaaatggaaaaatattctaccctcatggataggaacaatcaatattgtgaaaatggccatacttcccaaagtaatttatagattcaatgctattcccataaaactgccattgacattcttcacagaattagaaaaaaactattttaaattatggaatcaaagaagaccctgtatagcctagacaatcctaagcaaaaggaacaaagttggagacatcatgctacctgacttcaaactatactacaagggtacagtaaccaaaacagcacggtactggtaccaaaatagacatacagactaatggagcagaacagagacctcagaaataacaccacacatctataaccatctgatcttcaacaaacctgacaaaaacaagcaatgggaaaaggatctcctattcagtaaatggtgctggaaaactggctcgacatatgcggaaaactgaaactggatcccttccttacacatcttatacaaaaattaattcgattgattaaagacttacttaaatttaaaacctcaaaccataaaaaccctagaagaaaatctaggcaataccattcaggacataggcatgggcaaagacttttaattattctcagtttattctcaatccagttttaagatgtctataagaaaagaggagggagtagtttttgtttctatcatgtgagatacactgtggttagaatgcggcatgctttataagtctgaggatcattataatggtatataaataacaatgagactagtgaataaatatcctggattttccactgatctggggaaaataagtaaatctgcaaagaagctataattccttggaaaacagatgtgaactaaaatatcattttttaaaaatggcattgtatatacaaatgctctgcaattacttttaagaaacaagttacaggactcaaatttcctatctccacagagcgctaagatattagtcctaggagagcgaaatgtcctggaagccaagaaaagcagagaaaataagaacataaattcaggaggtgaattaaggttgttcacatggagtaacattttataatgcttttatgtcaaaaataaatttgagattaatcattttcccacaaaaaatgttgtacaaactcccatttttaaattatgtcaaggtttaaaaatagaacactcatttttaggctatgttggtaattatgttaaagcactacagtacttcaggaaaataattaatacaatgaggtttcttggtactatgagctaccttggtatctataacctgcatattaaaatttaacaagtaagagcttataacaatcagagtttcaggacaagcaaattgactaattcttgtttccattataaacaaacattgaatttacaaggtggaatacagatgacgtattcaaatgagtttacaaagtacttaggattatgaatataaacctacattaataagaagactgaacacatcaggttactgctaaactctaattacttacaaattaatcaagtacaataaagaaaattatcatttgaaagacattcttgataatactactaagaactgtcaagcttcaattatccatgctaattcagaaagctggctaatcctaaacagtggataatttaacaattctttctattggcacagattatatttctgtgcgtgacaaatttaccttagcaatttgtttttcttagtttaatattaaaaacaagtcttgcttccttgctagatcagaatgcaaagccagccagaagattttttacaattttaaacgggttaattaccaagtatataatccacatatacagtatataaaatctaaatgctgtttaaaatattttagttaagctttcaaccacatttaataaatgcatgttaaggtatgtagattatgacaaaaatgataaaaaggatgcaaatttttttctatcactttgaaagtctgtcaaaatttaagtcatataaagtaccttgtgagttattatttcattttacagataaaactatagaaccttcaagaagtttcatgtggagtgactccattatggtaagtatattggtgtcctatatatatatttaaaatatctatcgcaaacatagatcttttgagttccctctttctcacttttctaacagaaaaatatagcatacacagggcatagtaaagaacatggatactggagcttgaatatctggattggaatctcgattcaccacttagagctgagtaaaaataggcaaattatttaacttcttagagcctcagtttcttcatctataagatggggttaatattagtacttatctcttagggttgttatgaagactaaattaaatgatacatgcaaagcagttggaacagaacctggcacatagtaaatactcaatgaatgttaggatttacatagcattaataagcacaattacttattttcaaatagataactcatagacaagagaggaaaaaaatctatttttctttaagagaagtgtcatatacatttctcaatttagcttataattatgttgattaaaacaataacaaaaatattctttgaaccattagagtaataattttcccctggtgtcaaggttaaagtaaggaagcagatatatcctcagtaaactcatcagagtatttcatcaagattttcacagttatatttagaaaatgaaaagctcataattgtaagattaaaatatgaaactttattataaaaagggcacagattttaaaagataagcagagagatttacatgagaaaagtgcagtatcacatctagtaatagtccaacatctactttaccttgtcattgttactctcccggtggaataaacagaaccatgtcacctcaggagttaatgctggccaagtgccaaaggccagcaatggcaagaaaggctgtggacagaggacctgggctatggctagaagagaatgccagagacggggaaaaactgacagggtaagagatgagacgatgaggacagaggtgctgggccagcagttgaaggagaggggagggagcaccataagtggctgtgtatgggggcgcagcagaaccatccacggtcagaccaacacagtgacaaacagccactcaagaagttcctaaagaactcaagcgttgacacaaaaggatgtgatgaacagcactcattcaggctcccactgtagcatcctgtggcctcgatgagtgggtgtggcacctggtcatgagaagtatctaataggtaggcccagggacataaagtaggaacaggaaggacagacctttcagctgtacttctttcctatatttaatggcacctgctttctaggcatttacttcattctgagagtggatgataatgatgatggtggtggccctggtggtggtggtaacgatgtatcttgacttacaatcatggtttccttcccattttgagatagacacaatgattcccgtttgagaatctgaagtaccaagacctagagaggttaaacaatttgcctaaatggcacaataagtaacaggaaagattgagttttgaaatcagtctctaaacctctaaaatccacagttttttttattataccatctactatttcccagtatacctcaccacagaaaagccaccatatcattgacctaaaagcctgaaacttctacttgtgaaacttaaaaagcatgaggacatcttttttttttaaaggaaacatgttcttatgctcttcacatctgaatagattaatagcaacaaattagaagtaaaatgattatacagacacaacatagttgaagacattaagtgttgtatcttcttgagtcacgattgcccccattaaaaaccactatgttttaaagaggactgtttatttagagatctggatggtaagctaaactttagaattaaggaattcagatttaaccctttgttacttgaatacgtttacatatatatttttaaaagcccttcctaattcaagaacgttaccccatttgcaatctctttgccagtctatgccatgacaagcctcatacacagtttccacttttatgtataccagtgactttctggatgccaataattcatacttccccaaaacagatacttgagaacatgaatcatcctagactattaaattaggagtgcactatcgatttaagaataactgacatgagctaatttgcagctattcctctggtatttggccctcagttggcactacaaagttagaatcctaaatattccaaggactggaattccataatctcttacaaatttccaatcttgtaagagattataggattgagggatggcatatttggcatcaatagaattcaaacgtctcaaatattttccaaattgaaaaagtgtccacttaaatactacacctggacaagaaattaataaatcaccaaggaaagcaaatatatcactttagaagcacatttgcaatttttaagttaaactaacagaaaccaaatttccttcctttgtgctgctaaacatttgacaaacctaaaagtatccttggtaaagtggctaataaactaacagaattaaatatcccttttgagtacaactgattacatgtatgcaagtacacactcagaactctatcaatttcaaactgctgtgaaaagtgctgaattccattctttcagggagatagaaaacatttataacagcaacagccctgcagtcacatctttttgtaactagctctaagaacgaaaaaaatctttatgacaataacaagaaaatgaattttcattttaaaaggcagtccctgtgccatcactggctgtcctgccacccagctcctctgaaggcattcagacccttcactggaatgtctcaaaaatcaatagcaatttattctctctttggaccccaagcaacaaaagtaaataatactgtcacctccagtctgcctgcagaacatggtcacaaaacagccttgccactaaaatacaaccttacgcagctctttatctatgctggcgctactgattgtattggctttcgtaggggacaaatacttcagcaaagccacacaaagaggtcaagctcttgtacctcagccagaaagaatgctgggacctgaattaaaaagaagacttgccaccacctaagcttcctgcttcaacaatgtgggttttatggaagaaaaacaagaatatttattttccaagattattaaaactaaggggaaaaatgtaagattaaatataccatatttacaattttttcctatagaatttaagaaaatcatcagatcactgaagcaattggttgaaccataatattttgcagctaaaatctataggtaggcaatttttatactgtctgataaaagtattaatccataagcaaactacgacttaagaattaaagttctactttgataatgtttaaccaagtaggtgatatcaataccattcgattgttgaagacattatatacactctggaatatataaaatggcattttgaagcaacagaaggaatactaggaataaccaagtataatcttatctatttagagaaaaaaggaaatcaagctctatatgtaacaccagaaaaccagttaatggaagaagcaggactacaatcccgtctaacattcttttcactatactgcttattgatgaaaaattacttataggcatactaaagaagagtcaggccaggcgtggtggctcatgcctgtaatcccagcactttgggaggccgaggcgggtggatcacaaggtcaggagatcgagaccatcctggccaacatggtgaaacctcgtctctactgaaaatacaaaaattagctgggtgtggtggcgcgcgcctgtagtcccagctactcacgaggctgaggcagaagaatggcttgaacccggaaggcggaggatgcagtgagccgagattgcgccactgcactccaggctggcaatagagcgagactctgtctcaaaaaaaaaaaaaaaaaagagtcaaagtcattttgatgacaataagccatcatccctcagggctacaaattactccttaagagaaaaagcaagtactttgaaacatttgtgcagtaatcaaaaattccgaaatcatagaagaatttaccagtcaatcataccagaagtatttactgaatatctgctgtgtacttctcactagtaggaaatacgaaaaatatacatacatgtttaggaaatattaaaatattgaatataaaactattaaataaaataaaatattaaatataaaaacaaaaatattaaaatattaaaaataatcagatgtcaaattgtacagtcaaagaataaatggaaatcaggcaggtgctgagaggaggagagaggggaggtaggttggatgagggacagggaggaagacaggtgacggaggcagacaccagggctgcagactgtgagtgctgggaggtgctgcggggaggatgggcctggcagagcagtggtgcccatgaagtaaagtgaagacagagagtggggccagacactggaagctccagaaatcaggcagaaggacttgaacttaatgtggtagagactccagataatatagaattaaccattttaacttggcaacatcactcctattgttttttggctcactcctagctcaaaaaaacaaaaaatacactaaagatgttgtcttattggtcagaaaaatatgacttaaaaatataacaattttttgaaccaaaaaggtgcttcctggaaatttcatttaaataacaaaaaacataccattgtgaaaaaacttcactcaaaacttacagttttctgataaaattaatatcattaagctaagggagaaaacaaatctctgaatccctcatttttattcggtaacattaaccactttggcaaaaaaaataaatgaacactaggattgggaattttgaaaaatcatgtttaacttttgtactttaaagaagatacaatgaagttgatatactctatcttctataaaactatgaggcatctaaggttaatcattaaaactgattaaatattatatttaaaaacaaatactcatttatgttttttcaaattttagaaagtttgtaaattctgtagtaaaccaaaattcttttctctttattttatgcattcattatagaaagttttgggggaaaagtgtgtgtgtgtgtgtgtgtgtgtgtgtgtgtgtatgcatgtgtatagatatacagacacacatgaataatcatgtgaaaacttatctgccagaggtctactctaatatttgttacaggcctctttctgattttaaaacaatctacagcagagatataaatattttacttatcactgtcaatacatatcaaatgtcttgaaatgactatgtcaaggtaacacagtaactacacttataagaatatatcttacagaaaagattgtggatgtggacagtggtctagcaacaggaatgttcaatgaaatattgctggaaagatgaaaatgggaaacaagtttaatagccaagagcaaagcattcaatatgtaagttataaacatattcatactttttcatttttatacatattaaatatagtcactgcccatccatttatttctcctattttcctaattttgaaaaagagttcccagaatatttgcaaattaatctgtaaacactgaatgatagtgcctgccctgaagcccacatgaggtgcttcgaggcagaaacggtgtgtagctggtgcccagaacaatgcccagaacagcacctgccacagaggacacggtcaacaagtacttaacggagtgaaaataaaaagttaactaaggatttgtaacttacactcactcactttgaaaaaaaacagaagcagtttacaacaaagtatgataaaatgtagttttcttttttaaaacagggtctggcttgcaatggcaggatcttggctcactgcaacctccacttcctgggctcacaccgtgctcccacttcagcctcccaagtagttggaactacaggcgcacaccatcatgcctagctaatttttgtattttttgtagagacagagtttcaccatgttgcccaggctgatctccaactcctgagttcaagcgatccacccacctcggcctcctaaagtgctgggattacaggcgtgagccaacacgcccagcctagattttttttaaatgtaaatcaaagtaagagaaaaaaccaaaacatccaaaccatacagaggaagatggaaaataacagaatcaggaacctgagctcatgccaacactcaatcatacgttcaaactttctgtcaagaaaggctacagcaggactgcaagtgtggcggaaggcggcagtgtttaaaatgtaaaacttcagatcaagccagcaggagtcaaagcctgatttcaccagttgttagcactgtaggactctggagaaatcaatgactttttctgggcctccttttcctcccatacagaatggagctcttatgagagcatcaccatagggttctgagattgacaccagccaatccgtgcacagtgctagttgcatggtgtcagaacacattaagagctcaatgtatgccaaatctgttatattcatcattacagctttgactgtatgcaaaagataccattcagttcttccaagctgcatttatttcatagattcaatatttattgagactaaatatttattttaaaacttggttggatgaagccccaccaatgtcttcaaaagcctaacatggaaatggaagaacagaaataccaacatataacagtgactcaggtgacatgcatagaatagagatgtactcaatgttccctgaagtaagaggaggaaatgatggattactgaggggtacggctgtggggcaatatcacattaaaagtgatgtaggaactaggacatgaaagaggagtcagagtacaaccaagtagggaataatggtattggaaagtcattccaggcagattggacaacataactaaggaaactgaggcatgggaggacacgagaagctgatggtggttgaacactgtgtgataggatgctcgtggaactgtgacagaaaacaaaatggcaacattctgttggggtcaatttttgaaggccctgttgtgcaatttggactttaacaagtaagcaaaggagagccagtttgggctgataatgacatcagtgttttagatactaggattatcatggaagacagattggatttagagagtgggaagaaagaatagaggctaaaacatcaatactccaggcaacaactaatgctaggtaataaataatacagactggaaacaagacaagacagtcgagttggaaagaaggaaacagatgccagcaatattgctgagggacagtcagaagaattagcacacaggaaagtcaaaaacgatttcatggttttgaccttatatggctagggcagtgacaaaattaattaaggatggtaacatagaggaagcacattttggggcggcagagaaagaagactttattttatttatttatttatttatttatttatttatttatgaaacggagtctggctctgttgcccggctggagtgcagtggcgcgatcttggctcactgcaacctctgcctcccaggttcaagcgaattctcctgcctcagcctccagagtagctgggattacaggcacgcaccaccacacgcctggctaatttttgtatttttagtagagatagggtttcacaacgttggccagaatggtctcgatctcttgacctcatgatcccccccgcctcggcctcccaaagtgccgggattacaggcataaaccaccacacccagcccatttttaaatagattgaatttgaggtagctctggaaaacaaggaggtgatgatattcaacagaaagatggaactaagacacagaagctcagaacgtggattgagaggtcatctgtgtaatagatgacaggcaaatttacaacaccagggaaaatttcaaggggacagcatttgaagtcagaaggaaaccaaagtaatgacacttactctatcactaaaaagtatgatatctaaaataaccagtatgcaggacttaaaacaactacaacctacactaaaagatagagagaaacactttaataaatgtagagagatactatgtgtctggatgggaagaataatttgtgtagtcatcaattctctaattaatctgtagatttaataaaattctaataaaaaactgtaatatacttttgggaagcttaatgaaattattctaaagtcatctggaaagagcatctgagaataactatttttaaaagagtaatatgaaaggcaaaactgacctagcagatattaaaacatattgtaaaaattcaataatggaatactgacttatacacaaaaagattactaggttagaaagtccagaaatagacaaaagtatgtgtaattattcaaagcataaaaacctgcaatttcaaatcagcaagaaaaaagataactttaatcttttagagaagcaacatgatgagaaagctttttcttctgagttgtgttaaggatgatggaggtcgtctaagcttttcatacttagagaggaagacactagtaacagaaatacaaaagaaagtgttcagttatcacaaagtcagaagtaaggaagttgtggattctagtgaatgtttactactggagggaatcatggaagaaaccaccaaccataatgaaatgatgccttcagaaaggaaagcgccaagaaggatgacttgacaacaatgctagagacagctcttaagaacagatgttttgatgagtttccatacccaatttattggaaatatcaaaaaaaaaatagcagaggtgaaaaaaataaaactttattgtcagagattgggcttgccaaatttaagatttctgagttgtcagttcagagaaatggcataataaatcagactgcagcagcagaaatgtctggccaggatttgggcaggtcaataacatagatttctgaagttgccaaaagaagtgcccaagaattaaggcagatggggacagggtattgaatgatagcttcctccattactgtggaggcatgacctgtggtaaacagagggagagaaaagaaagaaagagatttagctaaatattttgagcttcaactaaggtaaaaagttactgacaacagaatgtgaggctgagatatgtttttatttttctctccacagtgcctaacacacagtacacatattgtaaaagattatctaagaatggctggacgcggtggctcacgcctgtcatcccagcactttgggaggcaaggcaggtagatcattgaggccaggagtttgtgagcagcctggccaacatggtgaaaccccatctctactaaaaatacaaaagttagctgggcatggtggtgggtgcctgtaatcccagctacttgggaggctgaggcagaagaatcgcttgaacccgggaggcagaggtagcagtgggcagagacggtgcaactgcactccagcctggccaagagaggagacaacatctcaatcaaaaaaaaaaaaaaaaaaaatgacctaagaatcaatgcatgtggtaggaaatgctggaaaaaaaacactggagaacttaaagacaaccccaaattctgatcacagggcataggagataaagcagaatgagtagcagccacatgaaggcatcaaggtaagcagcatcaccaaaagaaagcctggctcagccaatgacgacaggtaaaaaggattaataaaaagacagacgggcaagggcagttcaaggaccataacagctgagctagtgatggaagacttccttttgcacctttcgaataaaattatttcattatctccacaaagattcacttccaggtacttggttattctggcctcccaccctctatatccattagtccccaccgtgaaaagcactgtggagaaaaaaaaaaaaaaaaaaaaaacactctttgcacctgaaattatcatatttaatagggaaaaaaatggaaaatattttccaactgttgtttatttctgaatttcagattttgttctcaattatactggcctggaactctgtcagaggtgaatatactcagacccatatgactgatttacactagaaagctagtctgtcgattgctagtatgtaatgcaattgtcaagctgacccacgtttgtataatacctgcatcaactcaggaggtgttggctagcttgcaaattttctttgaaaaagcgcttacctaggcaaaggacaacgtattttttgaaagctctattgaggtctgacacacaataaatcacatatatttaatgtgtacaatttgacatatttggacatatacatatacccataaaaccattacaacaatcgagataatgagtacatcacccccagtagattcttcctcccactttgtaatctcttccttctgcctctccctgacatcctcccaccctccactcacccatttgaattacagattagtttgcattttctggaatttatacaagtcaaatcacacagtttatattcttttgtctggtttctttccttccacacaatgattttgaaaatcatttcatgctgttgcatgtatcaataattcccttttattgttaaatagtattccattgtatagtatacaccaatttgtataaccattcacctgttgatggttattggagttattttcagtctttgtctattacaaataaagctgctatggatacttgtatgtgagtctttgcatgaacatatgttttcatttctttggggtaaatgtctaaaagtagaatggctatgtcataaggcagctgtatatttcactatataagacactgccatactttttcccaaagtggtttctccattttccattcccatctgtcatgtatgagatttccagttactctgtatcctcacccgtacttggcatctttcaaatttcagaattctaataggtgtataatagcatttcattgtggcttcaacttacatttccccaatgactaataatgttgggggtatctttgcatgtgtttacttgtcatctgtatactatctttggggaagtaactgttcagatctattgtctatgttttattgggttgttttagtatttattgagttttgagagttctttaaatagtctaaatataactccttttatcagatatgtaatttgcaaatatgtttctccaagtcctgacttgtcttttcattcttttatcaatgtggttttttactcgtttgttttttgagatggagtctctctccgtcacccaggctagaatgcagtggtgcgatcttggctcactgcaacctctgcctcctaaattcaagcaattctcctgcctcagcctcctgagtagctgggattagaggtgcccagcaccatgctcagttaaatttttgtatttttagtagagacagggtttcaccacgttggccaggctggtcttgaactcctgacctcaggtgacctgcctgccttggcctcccaaagtgcgggattacagacgtgagccactgtgcctggcctttatttatttatttatttatttatttatttatttatgaatgaatgagacagtttcgccctgttgcccaggctggagtgcaatggtgcaatctcgcctcactgcaacctccacctcccgggttcaagtgattctcctgcctcagcctcccgagcagctgggattacaggcaccctccaatgtgcctggataatttttttctgtacttttagtagagatgggatttcaccatattggccaggctggtcttggactcctgacctcaagtgatccgcccacctcggcctcccaaaatgctagaattacaggtgtgagccaatgcacacagcaaggtgttttgaagagccgaatttcttagtgttgatgaaatccagtttataaattgttttatttatgaatcctgctcttggtattatatctaagaaatctttgactatttcaaggtcatgaagattgtcatttggaagtcttatagttttaacatttaagtctattgtttgaaaaaggacattttttctaaatatgtcttaactgacatattactgacagaagtaagtaaccacacctattaatgaagttgcagcatcagcatctcaactattctgggagacaatgtaggccaaatgttccctgatattatgttgataataaccccttctcaaaagggcgaatactttacttcagtatcaataccaaggaaggaaaaactgtggtgtgagagttctgctccctgggtgccctctctattttgcctctgacccatgaaactttaaaaatgaagattatgaggaagaacaggccagtgaggtcagagtcatgggttaaagccttagggtcagcagtctgaggatcttcattttaaattttcccctactgtaactcccttgctcattgtttgggtatatttcctattcaatgttaatgttaaaatatcactgccatcttgttttttctctttttgtttctgatcctatttcctttcattaaaatgttattttctgttttcccaaaattattaaatacatataacacattttcttttcttcctcaaatattattaagtatagatacatatacacttaatatatacttaattaagcatatatatactaaataatatttgaggaagaaaagaaatatatgtttatatgtactatgtacatgtatgtgtgtatatacagatacatatatacttaatatatacttaattaagcatatatacttaatatttgaggaagaaaatacagatatatttatatgtactgtatgtgtgtgtatatatatatttaatatttgagaaacaaattaaaaaacatatatactatatatatgtacacacatacaggtcatgagatcaagattattgtcatagaatccaaatctagctagaaaacacaaaatttaattcccactgcaattttaaccccacagatgagccttgataaagtaatgagagagcaataagtagcttatcttttagaggtaccagatctgtttctagtcctaaggcatttcagtagaatgcttatttcaataaactcacttaatgcaaaagataagatcataaaggcttgtaaatcaattttttttaaaaactaaaacataaattcactagtggagctcactatttaggtaataactctattgaaaacacttttatagagtaaataatcactccttctcataaattcaggtttacatctgtaggctttctttaaagcaatcttcagtgaatcattttctgaccactgtgtccaaaataattttttaacactgcacaaaaggagatatttaatataaactgttttccgaattgtccttattattgttttcacagcagccacaatgtgattaatattggaaaaggcaccattatattcaagcctcactttcaagtagataatattttaaaacataagacacaaataaaacaaagttattgcaaaaagttggcaaaatatagaaaatctctcgtttggcctctcactttcacacgtgtttttgaaaaagattccaggaagactcctctgtgctcaacagcacagaacagcacatgcactctgtttccttttcttcatgaaaaatcgtaagaatgtggaagaaaaatagtttattagcaaaaaatgcagaaatgtaccaaagaaaaattcttttgtaggacttctaactctataagttattaaaatagatacaactcaggaaaaatttatcatgaaatcaaatatgacagaaattaaagaaaacttaaaggtgtgttggatgcctgaagttggtgttgggtgatgaaattgaggcaggagaatagagtctggaggcagggaacctaaagctgtttcacactgacttcctaaaactaaattgaaaggaaaaccctaactttccacacctaagtaacaaaaggaccagagactactccctttgcaaacccccaccttgtctgcatggtagatgggaaatttaaagttacataggagtgtgacctttgtaacttttcccttcagcccctgattactgtctacagccaatcaaaatgattgtgggccaagccttcatttgcatagaagtgcaactttgaaactttagcctctgattgattgcataaagcataaagcaatcaatcagatgtttgcacaggtgtgtgacctttgtaacttcatttcagcctctgaatggtcgttttccaaggtgaacaccaagtggccaatgggaaacctctagggggtatttggacccaagaatattctctatttgggtccaaatagacccaactcccacccgctcccaccctgtggagtgtaattttgttttcaataaatctctgcttttgttgcttcattctttcctttctttgtttgtgcattttgtccaattctttgctcaaaatgccaagaacctggacactcgccactggtaacaaaatgaatatttttatatgtgacagtattttagaaaataatgtgactatacatattcatatacatatacatagccttaaaatgttcataccctttgactcagtaaattttatttatctgaatctaccagagattttcaaaaacaatcctaaatttggaagaatttcagccatacaagtgcatatagtagtgctgtgttggattgcagcagtgaaaacatcccagctatgcaaccacagagaactggttaagaagatatggtattattatatatcccaaaggaatataaattgtcctaccataaagacacaggcactcataggttcatcgtagcacccttcacaatagcaaagacatggaatcaacctagatgcccatcaatggtagcctggataaagaaaatgtggcacatactatggaatattatgcagccataaaaaagaatgaaatcatgtcctttgaagcaacatgcatgcagctggaggccattatgttaagcaaattagtgcaaaaacagaaaaccaaataccacatgttttcacttataagaggaagctaaacattgaatacacatagacacaaagaggggaacaacaggtactggggcctacttgagggtggagagtgggaggactgtcaggactgaaaaactacttatcaggtactatgtccactacctgggtcatgaaattatttgtatatcagatcaacaggcaatcatgagtgcaccaaaccaacatgcaatttacccatgtaacaaactggcacatgtacaccttgaacctaaaataaaagttttaaaaattaaaaaagaagaaaaaaaagaacatatggtagattctattaatttggtagaccattatgtaggtaataagggtacatttgcaaacagaagaatcccaaaatgaaattttcagatacagaactatacaaataaggtatacagcttatattaaaaatgattcatagaattaaaatgactgtgagaatattcagtatcactaaaaattcaaacagtagttttattggagcaacgacattacaataattgttatttttactttcttgtattttgcaaatgttatttaatgaacacgcattattatgaatgcaaaacagctgctatttttaataagagagccaagaaatacaaatatgttcatgcttcttcaacagtgaagcggggaggactttatcttattctaggcctatgctgtccaaaagagtaatcactaaccacagacggctatttaaagtaattaaaattcaaactttagttcctcagtcatactaactacattttaagaggtcaattgccatagtctactagtatcagacagcagagagaacattttcatcgtcagaaaattctactgtgaacgagctgttctagataattggcatgggatcatagaagataacctacaaggaaaggataattcataagatgcaagactctgtagttagtctacactaaaccagcaaccttagtctattaagaaagcctgttctacaagatggactatgctatataaataagtgactcacagatcattagcaaagtaactataagtcattaggtttttggttagtttcctggggatgttattttggtatctgataaattcatacaaaaatcacgtctgttggaagtttatgaatgtaaaaaaactataattactctaagatggaacaattcctccaacatgcagccttcctacagagtaaacaaatttgtctttgtcttataataatcggttgtcttgaggaggcagaaacaggaaacaaaaagacaactttggaaataatactttttaaaacttttttcttttaaaaatttctgggaaaaaaaggcaagaaagaagaaagaaattcatttgaaaaactagctcttcaaaagcagtaccaaaatcacttaggtggataaatgtttaagagtgaaaaaacgtacacctttctttatttgagaaagtagaatagtatgaagaaataagaatgcaattcaccaagccattattaatgaagggcttatctactagagtattttgtgcagttggtattccattacatataatacatttcccattagaatgtttatttaattttcttgatttaccctcatcattgtacgaagatgttccaatccattttaaattaataggctgtcttcatttcaaacatgcaggctggattttactgacataatgtgaacactacaaaaagctgtttatctttgttgaagtatgccaagatcctctgattttttttttccagtgttttctacccttgagatttaaaactgaactcttcagccaggaaaatcaaggcagcagaaagtgtaactattaagatgtaagttgcacttaaaagtgtttcaatgccccatagctttccatacagttcaaaaattatgtctagtttttaagattattaaatgttacttagaggtgggaattttatcaccacagcaattaatatcagtggaaaaccctaatacagcataagttgaatgacaacctttacaatgtatccatttagagagggtgggaaactcaggaaaacaagctgagtatttggagtcagaagttttaggctgattgtcaatgttgctgattctcgaaacttctgtttccttatctacaaaatagagacactgagaatgcataatacatggggttactgttgtcttcatggtacaagttaggacacaaggagcaggttacttattttaaatctgttcactgttagtgaggtaaattattcaaaacaaaaccagaaaaaatgattatgattaaaaaacaaatcccagcaggccagcctccctttaaatatatttaataatatgaccaaacagatctgtaaaatatacaaataagggaataagtattcatttaactaaaaggtgttgttaaatagaacttcatcggacctttaaaatgtaacttaaaagtataatttaagcctagtgtttttcataaacatgtttacggtgtaaaaaagaaaatttgtaatttatatatattgcatctactgtattaagtctgcagcaggactggacatgttcctaaccatgtacaaaccagtcacactgcttaccagctatagaccttgggcaaattactttacacctctgagtattaatgctctaatctttaagatgttgatgatgaaacctacttcatagtgctgctgtgatgactaaattatgccacgaagcatgttgcacagatgtgtactgcaataaatcaatgtacgtttgcagtcatctttacagcacagctggtcatgaagactctcctgagtacatttttgactagagatatactgtgttttaaaacttctagttttaataaatttaaccattgagtagaactgtgctacttcttcaatattcagaaaagtatatatttttcatacaaaagtaaatatatatatataactattaatttcacattagaaatatgaaaagcactccaattcctggaaaatgtcgtagtacaaaggggaaaaattaagatagatgaaaaccagaagtattcctctacacctttaccaccgacattaaaaagtgaaaaatcaattcccttttcctctggtataagcaggtaacaaatggtaaacagtttagccagaaagaagaaaagccaaggaaatccacttactaaaagttaaattcagtgactaaaattatctttcgtatgctcaccactaccaaaatctatatttctagctatgttctttcctgagatccagatatatggacaacttccaagaatcaaactcaacatttctcaaacagagctgagtatttttggccagcagaccctcccctgccataatttgccttccctgtttttccctctcagtggatgtcaagtgtgaaggtcagtctgcgtgtgtctctcttcgcccatcattaacgtgtgcattcaatattataaacacaggaacctctgctttgcatgcaatagagggtaagcaagcctgtttatagcgaacgtccattctgaagggagagcgcacaaattattaaacagataggactcctttcaagccttttaagcactgtctgggttagggatgtggtggctacagcaacataaaaaaaagttaattttaaaatattaaacataatacaaaatggtgacatgatttttctctaaaatataggaagtgatcaatcaaatgaaaaactatattttaagtaaaacttcaccataaatgtcatgatttagccacagctgaaaacttaaagggtcagattcttccagctgaccctatggtgcccagctggctgaacattctgagaataatccagtgcagtggaaacactggacatttaataaatgataactcctgaggaagaacaaggaagtcatgtccacaccagaggtgggtggtgtaacggctgattttggaggagaagtttttgttttgttttgtttttcttttgtggggtgggggtttgttttgctttggcttgagacaaggtaggaaaacccatttggaaggctggaaatttgatatttgatataagagtctgtctggctagaaaataagttcttccagacatcaaaaaggaactaataaataatcagaataaacaaatattggccatgatatatatttaaaaggtagcctagctaggcatgatggctcgtgcctgtaatcctaccactttgggaagtcaagctgggtaaatcgcttgcacccaggagttcaagaccaacctggaaaacaggtatgtggagaaggactaacatatactcctgagaacatctcagaatacgcagagcatgtttttgttaactttttcaaagatcagctggcactccgtagatatatggctttatttctgggttctctattctgtttcattgatctatgtatctatttttatacaagtaccctgttgttttagttactgtagtcttacagtatagttcgaagtcaggaaatgtgatgcctgcagctttgtttttggttgttgttgttttgttttgcttaggctttgcttttttattttttatttttttggttccatatgaattttaggactgttttttctaattctgtgaaaaatgatgttggtattttgataggaattgcattgaatctgtacactgctttcggcaggatggtcgttttaacaatattaattcttctgatctatgattagagttaaaagagcctctttttctttttttttttttttgagacagagtttcactctgtcgtccaggctagagtgcagaggcacgatctcagctcactgcaagctctgcctcctgggttcacgccattctcctgcctcagcctcccgagtagctgggactacaggtgctcaccaccacacccggctaatttttgtatttttagtggagacggggtttcaccatgttagccaggatggtctcgatctcctgacctcgtgatccacccgccttggcctcccaaagtgctgggattaccgtcgtaagccaccgtgactggccacaaaagagtcttttatggagaaatagagaatggaataaagccagataaattcaatttactgctcataaatggccatgcttcttcttaacatggtccccttactgcagaggctatatatctaaaaatgagagaaaagcaatcacactgttgcttatgagcaatctacatgaaatacaaaaattccccttctgaaaaattataacaatttgttattgaagatgtgtatgtaaattttcccacctgtgttacttttttatacaagccaaacctagcaggaatctctaattatcataccatgaggatggcttaacaagggtgttgccagcccacaaatgcaatttgattctcagcatgaaggcaagactggcaatttacaaactccagcaacaagtaactatgaatattaagatcttaatttacacaatggagaactcattgctcttagaataaaaaaaggaacattttgaggatcctgttgctggatgtggagtaaaaaaaattatggtaatgattctgacaattgttgaagcacatacatacctgaatatcagggtactttttagaattattctgctcacaatggggaaatattttacttaaataagcagcctgaatttgaaatcaagtcataaggtaaatgtctcaattacaaatggtactgctttatatatggataaatctcatagacataacactgactgaaaaaaacagacataaaacataatgcatgattccatctatataacgttcaagaacagacaaaaataatctacagtgatagatgtcagatggtggtgactttcagtgaggatattgatgggagggtgcctgagggagtcttcatgacttagaaatattctacatattcatctagatggtgagaacatgggtgtatacatatggaatattatttaacctctacatgtaagatttgtacagttcaatatttgtgtgatatactgcaataaaaatttaaaaataggtcaattgtattagataactaacaaaattgaaaaacagatcaatagtactagataataaatatacaatagtctttatctttcctaaaacaaaatttaactgttactttagtgagtaccaagagtgcacacattcagaaggttttggaacccatctccttgtgtagcacagcattacatattttacatttcaacgtggctacaactcctaatcctcctgtcaagaatcccacatgagccaggctattgataaaacaattgcttctccagtaaagagttttatttgctctctcattgcctatcagcttaatacataggagaatatacttgaaaaggatcaagttctataaacaggactaaatgattatggagcaggcatctttataattgtgtttttacttttttccccccagttgtttctcaaggaatacagcagaaattgaaccataaagcttagcttgacagaaaggcattagcctaccatgctaaaccaaagataggagagacagttatttatgaagaaacactgttccctattatccttctgagattctaaaaaagggctaaatattgatgcatttcaaagtcaccttttcccccacttcttgtattaacaagcaggagtatgttttagatgctcctaatttgtcaagatcaggtgaacagaactgtcgtacagagcacactgctctcattcctacaagggctctgcaaccctgtgggttattaataattcatcggtctttcttagttcacaacaggggcattactcagagggcatcattcttactgaaagaagttaacagcgatgggcagataaacaatgcacaagtcaaagaagaagaagcctcttatgaatttgtgaacactgaagatctgttaaagagctccaactactataggaaaaaaaaaactgctaggtattctttacctaggcttctattgcctgttaggctaaattcagccatctttagaattatatcagttgtattaacacagaaattccttgaaaatcatttaactcttttgtgtgttaacacaggttatactactgggtacgattatgttgtctttattgaattagtttctccaaactaatctttttggcaggaaaatgatgtctacttttgggttccaacagtatttatttatcaaggaaatacatgaagcatcctaatgtcttaatgattgaaaacaagtctccaggaaaaggaacaccatcctttatggtcctcctcaatacacgtagaccctctgggtgaaatttaacacaggtattccaaaaaatttaaataacaggggcaacaggctcagaagcctaaaggcatgaatcacgcaagagtgtaaaacagtagagcgaggcagagtctgcagcctgtgactgcatgccctgcttaaagaaacttcaaaaacaaaccaaaaaccaaaaccaaatactgctaggccaaacatgcctatgtggggtgaccaatttcagacccatagcataaatcagaagtctttattctgaatatatgaggactcagaataggatgtattatgtcctctaaataaaagatattcatgtgggttaaataagagcattgatttattttcttgaagatatattgttattagaatgtactccattatttagaatgtactccattatttagaatgtactcgaatacaaattaagcctctgatttctgaatatcagtaacgagtaacctcgctttagctaaaaacagtaacataaaatttactgagcacttactaggtgccaagtactattctaagcactctgcatgcataaacagacttgaaattctcacaccgattctatggagaaaccaagcaggcacagaatgagaaagcaatctgcccacaaaaacacagctaatgaggctgctgttcaaactcaagcaacctgctttcagagtctctgtttccttgtttactgctcgcttcctcttagttaagagcacagctcatttactccacatgaatgcatcaagggaaagcggtagctttcactcattagcaagactgatataaaataaatagaaactcaccaccaaaatcactacatatactatacctcctaccttagctacaaagcagaggagtttcagggaccaagaaacaaaaggcttggagacaatgagtacagttcctgataacagtagataataaatatcactaggctgagaaagagttaagaggtcaaaaagaggaaaagatgattctataacaacatgccattttcctctcgtactagaaatggacatcttcagagtctttgcttcctttaagatactaactaggtcagatcagatgttcctctttttttcttttactaatggaatgccctaagacagaataaatatagaaattaaaggatctttgaaaaacccttgggtttttctttactgataatttcaaattttaaatgctacagattctataattacagtgacctcactcttggcactgaatgttatgccttcatgctacagtaaatacctttggttatgaaggatatgctgtcctaaaaaatggaatctttactagtaatgttgcaattttttatctgaggtgtttcccattcatctttttcaaaatagaatttcaccagaattaaagttaacatattatttattcatcatatctgataagcatccgatgatgataaggaatttttttcataaatacataaaaatttctttcaacaaatgcccctactatatctaaatatatagttggaaatgtaaagcaaaagcatttcaattagataattataaaagtaaacacattttttcaatttatgcacacttaaaacataaaatgttttagaacaaaatatttcaactaatttgttttaattagttaaaaatacattacaccatctcatagtagagacagctacataacatgctacataatggattagtgtcagaaaatgccaactttttgcataatttcaagaatatattccaaaaacacccccacttaccatcaagatttcaaaataataatagtcaatatttatatgtacctcccattctgtgtcccaccaattatctcattggatatccaaagaaaaaaaaggttctacatctcaagaagtttgaataacccttaaaggatcaaaatgtagtttattttatgaaaggctctgagaattcttgctttgaaaaaattaactttcggtgaaatatattgttttccagttaatgacatacttctcatactcatgcacgattctaatactttcataaacaaatacttagaaaaaagttccatcaaataaccagtgagaaataaattcaacctacatcactagagtcaacatgattcattggttagaaagggaaaggaagacatctctctcttactgaagcagcagtagcagcctggggtaaatctgtcacgcaaatacgttgggctatttcaatgttactcttgttagatcttgcttttatcaggctttcatgtaaataggtagtaaaattttcaaaaaggccatgtgtccatatgcacagattaaaaaaaaaaatcttttgttgtgcagaagctctttagtttaattagatcccatttgtcaattttgtcttttgttgccattgcttttggtgttttggacatgaagtccttgcccatgcctatgcctgcacaatgtgcacatgtaccctaaaacttaaagtataataaaaaaaaaagattagaaaattaaaaaaaaaaaaaatcatggttgtccagacagttgaactgggatttcatttccctgtgtatcaagagacttgtgcagtaaagggttaacttagcagtcttgaggttttcaaaccacacacattctaaagaaaagaaaagattggctcttgacaagctcctgggatataacctctaagtgcttggagtatcctgcctagtaagagtttgcttttctacctggggccttgggccacactagacagttttatgctaacaatgtgatttatggcaaacacccgttctagttcacccagggccctaggtcacactgtatcagaagtttgactacaggaggggctgcagactgagtaactaaagttacccacgtaggtgttccacacctacaagacagaccccccccaacaaaatccttgaccaccaaggctcagtgaccctccgggttgacaatactccatgtgtgctatcacacatcattgctgggagaattaggaactgtccacacaaatccaccaggacaggacaaccagaaactcattcctggtctctccctgactctgttctatgtcccttttacctttgttgatttgaatctgtatcattttgctatattaagccataactgtgtgtataatagctttttataatagattttatgatttctatgagtcctttcagcaaatcactgaacccgagagacaaactagattcttcccattggtatctaggattcaaccagccttattatctgactccttggtcatgaccagtctctgttcagacacctaatatctatcgaaccccttaagttaaatcagcctccagatttcagcagaaataaatgcacagaaaaaataagcccatataatttgctgtagaatgtaaaaagcaacttttgatatttaggccaattacagtaataaacattaaataaaagagactgaccaactgcaaactggactattttcaaacttgttgccaatgactatcctctaggtaagagatgaaggtgcctcacaaattcaactgtataagatgtatgtgcccagcagggtcgtgcctgaagtagccatcctgcctttctaacctatcttgtcccatctatcacctcacaacattggccactaatgctgcatcctcagtagagatgggatcgtgacctacccaaacattcattataaaggtgtaagaatcaaagaagcatgttgtcagctctgcttttggcaataaaggaaaggtttttctcaggttttcctcttcacatggttttgggctgacagtgagcagtgagcaagctgtacttaagagttgtccctaacagatgtgagggcggggacagcattgaatacaatcaccatctctgatggccccctctctaaatgcattaaaggaactcaaactggaaaaggagaattatccagccattaaatttcattctttatgagacaccaatagctacctttttttgctttcaagaaacttgggttatgggcacaaagatccttcaaaatattcaaattatccatcttgaatctcagacaatttttgtgcataataaaagttcaattgaagcctcttttaaagagtcacttgaagaggtacatagtgactaaaataatcattcaaacaggagataaacaggaataagtgaagctaattcaacctgcacatgcatatttaacatgatacacatatgttacaaagcatactataaatatctctgtgcctattgaccttgtgcagctctaggaataaatgctggaggaatttggtacttaaaatgttgaagaggtcaggcacggtggctcatgcctgtaatcccaacactttgggaggccgaggcgggcagatcatgaggtcaggagatcgagatcatcctggctaacacggtgaaaccccgtatctactaaaaatacaaaaaattagccaggcatggtggcgggcacctgtagtcccagctattcgggaggctgaggcaggagaatggtgtgaatctgggaggcggagcttgcagtgagccgagatcgtgccactgcactccagcctgggcaacagtgagacaaaaaaaaaaaaaaaaaaaaagaagaaatatggagtgctggtagacatttctgtcaatagcagcaatcagtagcttaacctctattgcttctctcattctacatggcagagatagcagtgataactgtggcaatccagcagaatgcgaggccttcagaagcagagctaaatatgaggagtagcacacacagtatgtgtctttatggcagctcttaggaaatctgtccatttgcacaggtgctcctagaggcaaatgagcagacataccttgaaccatagtgactctcttaaggttattcaaaattaaactgtgtcactcccaaagagacatcacaatcctggaagaattcagtcacctgtgactaacctgacaacaattaacatacttgaaaattgtataaaactcaaattaaattttaatctttcatacttaagaaagaatcagtaactgataaagaactgtttaactcaatttgaatgtgatttcatgaaaggatacattttttaaagttattcatctggatcacatattcaacagttagagttttccaaaataattccaaagcaggtttcatgctgacatttttaaatcgtaaaagctttagcacagtaggcattgtccttgcctggatgttctgtgtcggatctacattcgtgtttatactgtgctgctgaacaaaacttagcaccacaataattatgtgaatcaagttctagtcgactttgtcagtatgcttttcatctctaaagctttgaagtcaaatcccagtaaatgtcaatatgctcctatcatgtccacacctgtcatctgcagcacaagtcagtgtgatctgcagatagaaatgaggagaaattgaacatattttatggctgttctgcttgaggcaataagaataaagtaaatcaatacttcatgtcatttcctgaaaatactgtattctccaagacatttagccagcacttgcccatttaacaaggacaaaaacataaaaagaaagtttttaactcagaaaattagcacatcaatatttctgggtcacagaaattcaagatgtatcatgcattacttcaaaatctcagttaaatacactctcaaggttggttgctcacaggaagggtaagtatcattaagaaaatctaaaatttcaggaatgaaggctcatatttaatatcctattattcctactaaaatattactaaatttatagccccattaaaaaatgtcaagacatgactttctctgtaaaatgagacctgcaaaaacattatatatctttacttacatggtatatttttctaatttttctatcaatttctatcattttccatcattcatttttaaaaaactctttatactttactgttcaacactatttctgacctttggaaatggatatttcttgactatctacccatactgtatgtacacttaagtagaagaatgtacaagttcagggagcctctgcaatagtcttttgtaatttaagaaataatttccaaatctgagcaaaaataattgggccttggttggaaaatgtaagttacaagtatataacttaaagaatattgaaatcatatttgggaaaataaaaagtatcaatagtaaaatatggtagaactcttaagtacatagagtttggagtccgagaagctagagtccaaatattggctaacctcctattaactactgatcttggggcagttttcacttctctgagccgaagattcactgcttgtacaatgggaacgcacacaatgtacagctgctctgaaaagtaaacgagctctgactacagaaagtgcctggaacatggtactcagcaaatggtattttcttggaatcctataaacaaattggtaacaggaaacatactaaaaaagagagagaaaaacagtgaatacagggcaaaaatgaaaatcattaaaaaggcaaaaaatgtcccggtagcaatgatttctaagtatcataaaagaaaacaactaggaaaatataattagaatgctatatcactaaaatccgtttttgagaccaggatgttcaattcgaaatcctaagaatgatgtgcttccccctgcctgagaaagtgccacgctcaagaaaggaggaagggaaggaattccagtccttctttgcttgtgggttttctcttaaaacttctgtttagaggaggtaggtgtgttcctgtccccttgacttggcttcaaggactagagacagaaagtctactggaaaagcatgtatttgtttgtgaggaaattagatactggattcgatactggattcactacattgtttgttcaaatgatttgtgtcaggaaaaacttttttttttttttcttttttttgagatagggtcttactctgtcacccaggctggagtgcagtggtgcaatcttggctcactgcactcccaggctcaagccatcctcccaagcagcagggactacaggtgtgtgccaccatgcccagctaatttttttaaatcttttgtagagatggggtcttgccatgttgcataagctggtcttgaactcttgggctcgagggatccatctacctcggcctcccaaggtgttgggactagaggtatgagctaccgcacttagccaggaagaacttttaaaaaacaaattgttaacaaatccctgaggttacattactcatccataaatacatcagcatgtatctccaaaaaagtaaagttatttttaagcatactacaatataattaacatatctataaatattaacaatgcttccttaatagcaaattaatactcaaatatattccactgtctcataattttctttacagtttattcaattcagactccaaatatttgcttccaaataatctagttgctgagggataagagagtgggtaattgaggatatagatgaaaaaggtcacatataagtaaaattgttaaagttggatgactggtataacagagttcattaagttattctccctgcttctgtataaccttcaagttttcagtaagaaaaatgttttaagttttccgtaataaaaaattatacagacatacatcaatgaaaataaaaagatagcaataaatataactcacaggtttgagatttttttaaatgacattttaggtcaaaaaaatgctgaaactcagaccttcctagccctgtagcctcaataaacacaaagtaactgagagtagaaagttaatttactttagtaaaaaaagcaagttttaacagcatcaaaatatgagttgaataattaatttttaaaatcctgtattaatgtgtttatgtcaggttccaccagatataggcataaaacaaaccaggtgctgccttttttggagattataggctaacagactcagtgcctgccttctatatatgctatggcgtcaaaagttgggaagcatctgttcaaacaatagtttaggattttattgaaggtcaattaagacttaactgagaaattttaaaactattaaatacatttatggaaacaatttttgcatatctaaccatttttacattatcaataatttgaaaataccattttttagagcaggagtatttattaaaagtaaatatacctaggtctacttcattagtaaaaaaagtaaatattcctaggtctacttcttaacatattcaattggataagcaatgaataaggagtactgagttgaagaagtgaagtcctatctagacctcaggaggtatggagaatacagaaatgacagaatatacaccacactaagctgccttgcctgtttcccttacaaacagcaattagaggagactccttggggacttaacatatttactcctacatatgttaactaaaagcctatgctaatgtacaaaggatggatctcctcctgcctgaagatctcagcagatgtgacagcaggttctggaagaggatcagcatacaaaggcatacgtgtccactggcagatcctgctggttgcctagtctatcaatattgcttttcctttcctccttgctaacagaaccttggcattactgagggtggcaatgtgcctagattttaaccactacacttcccaacttctttcacagccaggactgaccacatgacacagtccttgttaatgaaatttaggtgggagtcactaggtggattgaaaatcctttataaggggacagtcaggctggtttgctactttttccttttacccttttcttcctctttgtcttcctccctatacctctatgtgctggctagagctcaagcaccatcacatgagcatgaggaccccaaggatggtggcttgcaaagtcaaaaggcttcattttcctctttccctggctggagagactgcaagtttctccccaggtgtgtggaccacaggtgctgcagttggccccaggctaaaagctgcagagataagaactgacttctacagctctccaccttttctcctccatgccagtatgcacacccaaccagcatctctgcttctcttcacaatccagtaccttcaagtagttgtttttgtgatatgtccaggtttttattttggagggacatgcattccagtagagcctaagtcccttagtttttagaaacaaaattatttaaatttcactactgagccccaaagaacttctaacatctagactattaataaatggcttcttgatcagagagtgatactcaaaaagccagacccaacaatagagttcacagaaacaacagtccttcaacattttctgaagagctcttcatttccattaaaagggttttgttaatcatttaaaaaatattgttaaattactgccatgtgtgactcatggattaggtgatagctggtactggctttatatagctacagaaacagaaacaagtctatgggtgtcttacatgtcaatatgctttagatcatttcaggtaaagtaattaagcagatacatattgactatttggtgcctaaccttatggtgatgagcaaagtgtggggaagctattgaagaatatgaaatcactcttgcctttctataatcttattgaaaagaaaaaaagactaacaagaaaaaattaatccaaatcaatatataatcaaatgctgaaatatggggaaaaggcaagccaaaaacatctaccaaattatgacaaaatatacaaggctaagactagattaactgaatccactcctcctagatatgctgaagctctgaatagataacatctggtaagctgtgaaacatgaaaagcatatacagttcactggaaatcaaaagagcttaagcttactatgtgagatataatcaagaatatgggttttaatctatgacccattgtttgccaggttctttttaaatttttcattcaaacatcatatattaaacaaaagctaattttaagaataaaagtgtctccaatattttaagtctcaatgactgaaagaatggtgaagcccttcttgggactctgaagacaataccccaaaatatggtgctttggcatactgaaccaaagcaggagccctagggtctctgtgaccttcctctcccggtctctcaatcatctgtctctcccaaaccagaggatgaggctgttctctgaagttctcttgtctacctagaaaccagacccaccaaagagaagtacgttacctttgatctcttcagtgaatttcattaacaagagaaaattaaaactcatatcctagaggaagagactgaaaattaaacaccacacctagaaccctgatgaacttcatcccaaaatgaatattgaatgaatattcaagcacttcacacaaataatcattgacgagctaacttctatcttccatgttcattaaaatcatttagtacaccccacaaaattgcctcatttccctcctctctcctttccctatgaagaagggtatacaagcatctggacctcgttgggttattgggtaatcattctcctgcaattgccccatgcttaggcatgttaaacaaatttgtaagtcttcttctcccattaatctgcttattgtcagttcattttcagcaaactttcagagggtagaaaagaagctttgtccccataccattaataaatatgagtaggaagaaaatgatctgagaagaaaagagatgaggagctatgttccgagcatgctcaatttgtgtgaacagcaagacaatccctcttgtgcccactgtttatagtatgatacaggtgaagtagcgaaggctttgataacacaaacacttcaacattcacatctcaactccacccacttcttagttggccttcagcaagactatgagatctagctcccaagactgcaaaattgggatcacaatatcaaactacaggaatacattttgagaattcagtgacatgattcagttaaaacacctaaccaataataggtattaagtgttaacatctttctttcttgtttctgcttgttctttttgaatgccaaatctgataagcttatgaatctctacttcaaattgacccatttcctaactatcctcaacatcatatgcttatatctatcgcacatcttttactcctattttctatttctctcaacttaaaaaagcactataaaagcacttttatagtattaaaaatactatacatccttcaagatccaattcaaggcctgtccttttggtacataagcaatcatttcaatctgcattaggttttcctttacctcatgacatactttgctattaattaatttacatacatgtcttgcctccccagataaaacataaacttttataaagcagaatctgtgtctaaaattggttttgtttgtaaaggctcggctctggactccctctgagatcaacaaaaacttgctgaataaaggaatcagtggtgctgaccattaaaatctgaggactaatgtctattcagatataccagtcaaagtcaaatttatgaaatgtgatttttgtctactgccaactgctaagaaaaccaaaattcaatgtgattataattgtaatgaacaacaacaaaaaagcagctgttgcttcggactaaaaagcaatgcttaaaagagataatgtaacgagggacttctgtaaaagaccttaaataactattgcacaagaagataagaattaaaattaaattaattaagataatcaattccactattaaaatggaaatgaacttttatcagaaccgtggtagaatcacaagtaagatgtttcaatagttaaaaagtagtttttaaaatttgagatgcattgcaaaaaaaaaaaattggctcatgggtcagcactggaattaaccctataacaacagtaatttacatgaactattaatcattttaaatgtgattaaaaaaatacaagtccagcacacctgttcaccaatcaaaatacctagggcttgagacaatgtagtaagacaacctgtaaagctaagggtcaacaagcttccaagattggagctttcttcactctcttttttttttgacatcagtgtacaactagactcaacattcaacatgtcaattatgtcatcatcactaatctttcagtattagcaaaagtataacttcaaaaactcatttccaataggaacacacacacacattcacatacatacacacacacacacacactcacatacatacatacacacacacacacacacacacccccccgacaaaatgaaaccaacagaagctcatgaaagcatatagggaatagtttcatttatgaataaaatgtttccctgtatcttctattaaaccaagggttttaaaaatcaaattaaatcaaaatacaaaaaacaatagtatattgtttttgtagaactaaacatctcctttaaattgatatgtctttaaaataggaggtgaaaactatcgtgacaattgttctacaagattaaattaggagaaataacttaaccaacattttatacattaacatttatttaaaatctgcatattaatgaacttcaagtattgcaaacttggcaggatgttgaaatcaatgttttcagatatctatcatgatatattgagtctctggtttacttgacgtttttcctttaaaaataattttaagtagttaagcaatgtaattcctcttattttcaaaaaaattcatattctacttccttcatagatggtcactgtaaagaagtttaaactctaattaacagctaataatatgcagatagcagatacacacaaaagcttccattaaacaaaacggacaaagaaaactaccatttcctgattttctccctcagccctccctacctactatcttgattctgcaaacagcagaataaattaaagttcctttcttctacatcaactcctttgtcctctcaaggttgcctaatcatattcatctcctaaaatgaagtaagaaacatttcaaaagctgtattcacattaaatcaactttctgattcgtgcattgcaggaataaagcaatgtaatcacatcttaaattggtttacagcaggctgtctaccttatcctacttctcaggattgatgaaatgaatagttttaaaatagcactttttgaaatgacaagagaattaatagtgcataattacctcagtgttgacaagtgagagatgtttaactccttaaatgagctctcctaatgaatcagtgtcagagaaaggctccactgcatgtacatggttgattgatatctaaggggattgatttaaccataaaggaataccgaaagccagtttttaaagttatttaggcaaaaaattaaatgaatcaatttttacttaatatttggaatatatttacttaagactttaccataagctttgatagtattctaggtgttgattactaggaaaatcttattttacattgtatgagtccactaaggaacatttaaccttttaatagagtggcaacaaaaaaaacttactttagtattggactccacactacataaaagtgaaaattaagctattggatttaaaaagtagtacagagagttcatttctgacatttatatttaaagactgtaatgaagacaactacaatacaatgacgtaaatctccattttaacgaaaacttttaatacatgtaaaatatgtataaaatattaccataccatgttgaacttttaatatttatatacattctctttctaattcttgtcaattaacatgtgatactgttccattctattttaaatcctgtgggtaaaaccaaaacagattgatatttctaaacacctggaattgagaaaactgaacacggtctcagcagtagagctgtgcagttgaaatgtaacacaagccggctccaacttactcttcatttttccatgtctttcacgtataccagctgcctagcttgagtgtgtgtcaggcacggggctaagaactttctatttaattctggagattcctaagaagtagatcatactatccccattttgtagatgaggaaggctgtgcacagggaggttcctgtcccacagtcacagagggtcgtgagtagagcctgattatgcactaagacaactggaatgcatagtccacacacacactggttggcaaatatatttccatgtagattatctttaccggattaccactgttttagctatcagtgaaggtgttagattgtgttgttattcctttatcagttcaatatatttgggagtcaactaaatgctagtactttcccaggtgctgagactacaagcgcatgacagagatgaggcccttctcacgtggagaccacagacagcatttgcagggagggggatttgctttgtaattaagcgccttagctaagagacacaggtgcaggagatgcacaatttggacacttagacaaacattcttgacctggtacccgctgagcctcagtgaaagagtgagggtaaagtgtgaggacaatggcagcctgagctcccagcactaacacaatagctggagctggccatgccctccacctgggcagcaggggactataccaccaggctcaggtggactgcgggggggttgtaggcagaatgtgcagcctgggagtgtggcactctatgggaacgtctgccttaaccttcctttaggaagccaaagcctctgtgctggcactcctccccaggtactaaccctgtcacctctcccccagactccttagaagattgagcaccagggatgaaaccaggtcatcaccaatcaaattcctggcttcactgttctatcttgggtttctttaaaaaataattagatacatgaatgcctcagtctgttctattaggtgtacttaaactatgtgtcaaagctcattggaatatttcactgatgccttaaaatgtctttagcagaaatgcatttgagttgcaaacatgcaccttaaatgtgacttcccagggacaatcagctaagaaattttagttaatgttacaatttataaatatttgtgaataaaaatgtgttctaaattaaaaaaccaagtcttcattgactcgtctaagaattagggatgatgaaaactacttcttaaggaatactgaatgagttattgtagctagatgggtccggtgggctctaacacacagcaggtgtgcccgaggatggtcacatctgaatcgtgaaacaaatggacttcggattttgtttatattataaaaatctacaagaaaaacagtatttttcttaatcagttttaaactaagtcaaataattttgctgcatttaccaagtgtgtagagatttatattttaaaaatataagaagtgtagcttcaatggtaaacatgtattttatatattacttcgtaggtaatgttcctttgcttttttaaaaaaaattgctatccttagctcagaaataaaaaatgttaaaatagtaagagactttagtaataactactaaaaactggctcttccaactttccaatatctatgatggaaacccttcacacctgcctgatgtgtcagacagacacaaattggttgtttgaggggtcagaccctttcttagactgcctctcccctcctcaccccttaaagtgatacccttgaaaatcccctttactgtttcagaagaacactgttttagaagcagctataccaccacatcatttacactcacaatgccatagatgtaaatgtgagacctcagggccaggccaaatactccgggcctgaaatcctactctttccatcaatatgcccttaatcaagaggaatctggtagagcttctgtgagaatacaagttcttaagtgtaaaatctagatgtcccattaagcaaacgataccagtcaaggaactggcttttttgagctcttcctaaaaataatgagatttggaggacagccatcagtcatggaaagacatcaaacactgcatgaagacctcttgaaacctggttccacaagaaaactagaaattaaaataatgcatttaatagctcataaagtttacaagattcttatctgctctgcaagacagaaagaatcaaatgattttcttggccagggagaattcaggttcaatttttaagcccctattctgtaaccctcagtcagccctgtaggaaggtaattatcagggctagagggatagttcctgctgtttcctataagtaaactcaggagctaaattaaggtacttagaggtaaactctcagggtgtgcagagcttggctgtttgactcccgtggattctggagcaaagcactaaacacttctatttattcagagagcaggtagagaatagggcagcagaaacacggctttctcagacacctccgccagcccctgctaatcaacgggagtcacacagctcacaatctcttgctatggttttaaaatgcaacttttaatgttatttcattgtggtgtccttgtactgaaaagcatttattatgtagtttcaaatttacctgaaggttaaaaaaaaaaaaaaaaaagaccacagcaggaaagctgccattgtgagaaagaaggacataaaattcaagcaatgaattaaagaggcaaatgaaggaactcttttcctctattagaaatagaagaaacagattgtgctcgtcttgcttagggccaacaggcgcactgcatggaactcagccagcttcagtcacaaagctcacttaggagttctggtctgtgaaaagaggaaaccagatgggctatttactttcaacaagataattctggaggaaattgttatatgtcaaagaaactttttagcttcatctgctattttagcctctaaactgattcaggaagcagaggggagggttctgttaggaaagaaataagagaattggggaaataaaagcaagcgcagtgcaaaaggctgggcggccatgtcgtccaagtgcataagcttcctggactcatatcctcactctaaccttggacaagcgatctgacctcttggtgcttcagtttcctcctgggtaacatggggaccacaatagtgtcactagaggttgtaaagattaagtggtataaatatcagtacttaaaatacaacacacacatgagcactcaataaccatcaggcattgtttttatctatttcattttctcttctatttgcaaaacataaagggaatgtatcatagatatagatcaatgactaaacaattcttaagaagacactaacagctaaatgttatattggtctactgattatattgaccatataccactgatggaatttgtttgaaaacaacttctcttttgtttggctaccacaaaaagtaaaataatccagataattttattcttggatcaaaaatttcaaagagattttcttacctcaaaattaagaaagatagcttttaagaaaagtagctgtagagtgaatatagaaaagttaattaaattctaagttaaatttctaatacatataaaggatgctttctaatgagaaaaaagcagagtttccccagcaaattgtaaataacttggaccaaaatcaagataattcttatatgaatatactgtggaaaaggtatctagcaacctcatttttaggatgtacaatatctaaatattagttattaagcaaaaactgaaagtattcaaattaagttatgtgaccattaggcatccaacttaacctacttttattttacacttgtactattgctaaataataactgatgattccaagagaataaacaatactctcagaacagagtaatacaaaatatgttcagtctactgtatttaccatggcaggaaaaaggacacacattgttagaaggattattcagcatgaaggactaaaataaaaaatagttgcctggttatctttgtattgattttaaaaatttcacaaatattctatttcattgtcacattagagaaacagcatcactattttttttttttttttccgagacacagtctggctgtcacccaggctgcagtgcagtggcacgatctcagttcactgcaacctccaactcccgggttcaagtgattctcacgcctcagcctcctgagtagctgggactacaggtgcaagccaccacgcctggctaatttttatatttttagtagagatggggtttcaccatgttggccaagctggtctcgatcaaactcctggcctcaagtgatccaccttgccttggcttcccaaagtgctgggattataggcataagccaccatacctggctaatatttgtatttttagtagagacagggcttcaccatgttggccaagttggtctcacactcctggcctcaagtgatctgcccaccttggcctcccaaagtgctgggattacaggcatgaatctgccaccactggattttcacttttttgtgtaacacattttctttctgtaaggggaaaataaacaaataattcattaatttaattttcaaaatttatttatggctctgataaacataaaagccaacagcatattttaaagctattttgaaaatataaaaagaatggttactatgtttgatttttcatatggctagtgactcaatccagctgtgccccaagaaaactgaatgaatgttgatgataaaaatatctgaaaactgtatgagaaaccacatagacatatatgctaggaacttacagattttatgtcccaattaaggcctgtgaataaacggagatgagtattcaagataatagaagtagaaatcatatctttgtcttaattaccatttataaagttaatataaaataaaatttccctaagtattgcagaaaagcaaacatagcaagacaattttacattgtcaataaactggaaatgggcaggaaagctgcttcctttgaaacaacctaacacggctttcatgacactgattcttaacagtgatgaaacattaaatgaaacatgaaattgattagcctctttctcttctatactccaaattttctcccactttgaaaatatctattatttcactaactcaaaggccaaaaatctaatagcgtttgttactcattttcgaccactggcctaaccccattccaggcaccttcagaaataacactgcctttctgccctgacatagagtcagagacctaaagagccttgttgggagagcagtcttccctgggcctacatatcttactgcaggggcccccaagccgcaggccataggggtccgtggcctgttaggaactgggccacacagcaggaggtgagtggtgggcaagcggagccagtaaaccttcctctgtatttacaggtgctccctatcacttgccttaccacctgagctccacctcctgtctgatcagcagaggtattagattctcaccggagcgtgaaccctattgtgaactctgcatgtgagggatctaggctgcaggctccttatgagaatctaatgcctgatgatctgtcactgtctcccatcacctccagatgggactgtccagttacagcaaaataaactcaggggccccactgattctacactatggcgaattgttatttcattgtaatatataattatttcattatatattacaatgtaataaagggcacaataaaggtaacgcacttgaattacacttgaaaccaccctcctcgccctgatccatggaaaaattgtcttatgaaaccgatccctggtgccaaaaaggttggagactactgtcttactgggtatgccaagacatcaagggtctgaacacttttttttttttttttaataacctgggctacttctcaggttgctttcgcaggtgagagatgaggcaacctctccccttggacaaacagcagactgacttactgcttgttataaaagcagtgaattccccaaactcagagttccttagttgcaatgcaaactcactcattcatagcatccatccggaccataggaattgaaagcaagggcaattgatgccaatatgctggtgctcatgctgcttattgtgccaagggtaataaaacgttttctttctgacccggaagtctcatgtcttctgccagtaaccatgaaacagtaactggctaaaatgtatgagaaacgatacacataccattagcttccaaatagggtaagatgatatctcagacctgacagttttggtgaaggaacatagctatctggagaaggaaggaaaagtgtccagagattgggtccaggaatataaaaaaatctccctggaatctgagagcgaatgctcttgcctaggaggtggacagtggggtgtggtgggtgggaataagggtccctactgtcctgtgtgctaatgaggctaagagaggcaagattgaaatgagtatgtaaacggaaccgtggatattgctcactcattctcctccacgggttggggtgttatcatgacaagggggcagcaagaaagacaatgtgggtgtggctgctgagccaggggtcctcaaagctgacacagtgtctcaataataatgacctttttacctgatataggtctttgtgcggaccatcaactttagaagtctggttaagcctcacataggctgctgcttgaaagccacagtaaatgtgccttgttgattaacacggagctgctgtccctctcatactacctgatccctcccttccctctattctgaactcagctgctttaaggagaaggatgactgggctgggtttaagatctccctatccccaggggacagaaagcccctggcaccccctacaaacacacacacacacacacacacacacacacacacacacacaactgtttggtatgatgaggaagaaaggaactcaactgttatgagtccaagttcccattcttcctggcccatggaagaaaggcacactgaactctactaatggggtttagtgcttcccagtgggaaaggggaggtgaactagccttgtaaaggtgccctctgggcttattcaatgtggtgttgtggtagcagctcccatattcaattctataataagaactgatgtattacacatttgcacggcctaatccctgaagtgtcagaagggcttttcatgttccagaactgctgcagaggcccctgcccactataatagcatcacctgtttgatggagctacaaagtactttaaaaaaaaacaaaaaagcagctgttatcctgcaactaagctcttgtggagaaaaatgaacagctgaaatcccattttcaggtgaatctccctaaagaggtgggaagggcctaagaggccttcctggtcaaatggaaatggtatattcaagggcacagtgcatccagccctagcatcacccagtattaaatgaaaataatggcagctacttctttggaggaaccatatcccccactccactactggaaacagagctgctggttcaagaaggctctcagaggttcccatcacggatggcctggttcactgacagtttgatgaagctaaaagccgatggtggtctctgaccagcagcagccaaaaggaccagtcagcacatttctctgtatgagagctctgacccttgtcagacaatgctcctaaagaccaggcatttcatattttacagactcttggactgctgtaaatgacttgtctgctttgccatttggaagactacagactggcagattaaagagcccctctgtaggactacacattttgaaaacaaatcttggctgctgattggtctgagtgtcactgatacagatgcctgcagtaagtgcttattctctgatgagaccaactggaatcaagctgttggtcaaaactgctatttaaaaaaaaaaaaaaaccaggaaaagtcatgtggacatggctggccctgaactattccgctgtgccgatgccaccaacagcatctcccaaacgtggcccttcccctcagacctgtgcaaacacagattgcttcaacactgttccaacctgacatacaaattcataggcttctcctgcctcccaagcagccgtagctaatgccatgtttagcaatctagattgcagcaactcagtgacactatgtggcttaatcaaaccagtgtaatgctgattccaatcaagtgtagcaacaaattccaaactagagtggcctgtgctctctatatgggggaaagtaggccacagaatgtctctccattaggcatgagggttgctttctgaaacagctattatcattgacaatgagacccaagaggggcaagtcattgcaaactttcttgcgcagatcatattaggtagcagacttgtcttgcaccgtctgaattaagacctactggtctccctctgggatttattcatagtaggctgaatcagagattctggtcggggaaggcagagagactggatgaagtcaatactgcaggttggcttcatcctgctgcttaggattttattgattgttgccctaattaaatgctggtatgagacaagttgactagtttggttccaacctctgttggtccgattaatcagagtgactacaggtggcctattcatgtaaaaatttaccaaaagccaagatggggatggatagagacagttttccttggtcttcttatactccctgcatgtcttgttgggataccaagactgcattgtcctgactgctcttttacctgggccatttctcaagactgcattgtcctgactgctcttttacctgggccacttctcaggactgtttatacatctgataaccttaaataatgaagtaatgtctaaccccagacaaagagcataggtactgcttgctataaaaatggaagattccctaagctcagcagtcatcatctgcaatgcaaacctactgcatgcacagcatccatctgggctgtatcacatcaccccgtgagattcaggggcaaaggaactagagtaaatatcatgacgcttatacaacttgccatactatgagtaataaagccccttaatctctgacccatgtctcatatcttttgccagtctccatgatataaacaggctaactcattagtttgtaagtagggtaaaaagcaaagcccagatccaacatgtttatctctggcttgcaccacatagggcatatgatagaaacctagttaagacaatcatccccatacttaatgtccaaacatgaagttacatagctgtcctaaagttgaacctgtcttctgagattatttcatggaagcaagagaaaactattaacatatgaatgtaaaaaccagggtcacttccccattttccaggcctaacaaacttatgaaacctccacataaaactagggttactcacttcagttccggttcctccagagtaaaacccctctgaaggggcactattaccaccacttcaccacactagagtgtggaggagaaatactaagtatatgagatgctgtaatattatagtttgaacggaagggtgatttgagatgtgaaagaaagtgaataagaagtgctactagacatgggcaatatactttttaaattccaaacttgatttcaaaaagtagaatcaatcagtcaaataaacaaaaaacctaccttcaaggaggtggaagaatggcaagaaactggtatttataaaattaggtctctttggccaggctcacgcctgtaatcccagcactttgggagaccgaggcgggcggatcacgaggtcagaagatcaagaccatcctggctaacacagtgaaaccccgtctctattaaaaatacaaaaaattagccacgcgtgctggcgggcgcctgtagtcccagctactcgggaggctgaggcaggagaatggcgtgaacccaggaggtggagcttgcaatgagccaagatcgcgccaccgcactccagcctgggcaacagagtgagactccacctcaaaaaaaaaaaaaaaaaaaaaattaggtctcttttgctacaagggagggaaggcagaaaaagtatgccagattcagggaataaaaagtgttaagaaatatcatagtgttatatcccattatcaaaaatcctacaattagggttcaaaattcaccttcagaaatttaataaaaagactcaaatgtcaccaagtgctttatgtatgattattggcaaaatatttgtctgttagctatacttatactgttttgtaaaagcaaaaaaaaagaacttaaaagacaggatgaaataaccattcagaagcagaattatagaagctaattattaaaataactcagcattatatccagacctctagctgagcagatatcaaaggcaaatcagtaaatattctaaaatgactgctctgtaatgtatatgattaaaacaaactgtgctaaaaattaagaaaattcacattgcttcagaaatttcacattcacttgtctccgtaattcaataaaaataaaataaatggtttttcagaacagccaccatcaggaatgtgacgtttgatcatttctccgccctgctgtgagcaatgaggtaaaggtagattttttattcacaccactctgcatcctcatgggtaagtgaggctgtcggcatgtcccgtgacttaattatgtggtggccctgctggaggtgtgcttgcttaccgtaaacagacgcaaatatctcaaaactacccctgatttacaagaaaaacgttcaagtttaagccagtctttaacacaaaagaacatctttagaacaattgtgaaaaaaatcagacttccttctttgctttgcgtcacggggcctttgtctaaccaggggctgaggagatgcagggacactggtgacagggagggaggggccctgagagcaggcactgaaacaaacctgctcttcccattttttaaaaaacccttcggaataatttaaatgagctcccacccaaattaaattgccttgaggttttccctccaaggcttttggcattataaataccccctgactttggcctgccatgtttcctccatcaatcacggagtagcctagaattaaattgaaatgattggatcaagaaaaatcaaatgttttaacatttagtttcagtaatgtgattacgaaccttttagtgatattgtaattactctgaagctttgagcatatgtttctactgagagcatttcatggagaaaagctgcattagggaaacaagtaaatacagaccccaatgaagcaaaagtgcatttgttgtaaagttaaaagctaaaggtggaaaagagacaaagcatctacgtaatttacaccctaaacctgctgcatagagtaaccacttttaaaaatctctacttcttccaaaattcaaataatttaagcacttccctctaagggcaagcattaaggaagcagtaagaagaaacaacagtaaaggacaagggaaaaaaagaagaaaggaaaaagtcatcgtccttgtgctaggtatttgcatggaaaagatgacagacaaagctctctctcttaaaattaatgaaccatctcctcagatacttaattttcaccaaagtcaaggcatatagttacttcccctatttgttaatttttttctcccatctcaacacctgatgggattctgctaggctaggagccccaaagataaatgaagtggggccccaccccaaaggttaatatcaaaagagactggattcctcaagggacatggaagaagacaaaccggaggcaaggacaaaggtcttctctcctttgaatcacactttcatttaggcaacaattatttattaagtatgagcacgcttattccctcaagaataaggcaggtaagtaaagatacactataaagatggaatgaaattcggtttttaaagtttagaggaaaataactctgtcaagacagtctgaagtacacaaaccttttgaagggtttgtttcttctgattatattaaagtacagctaattgccctaatagtttaaagatcctaagtgggaagctgtgtaatagctccaagtgcttaatttggctactggcaattttattttatatttcaaatttgaattcacatctcactttcagcgacaagacacagccacttcctactgccttagagttcctagcattaagattgagcggttcctcattactcagagcaaaacctgaattctccagtatggcatggaaaactgcactgagctggtcctgacaccctaatctatcatcacctcccactccatgctccctgtactccatcccgtcaactactcatccttcccaacacagcctctgctaacaagcctgccatcttgctggggccagcctctctgtttcaaacgcgctttctttcttggcctgctcaggagtccagtctgttgttaagatccagctcaaataaattccacctctgctgaaggttcccctgctttatcacacaatgaagcgtacctccatgataacatctattattgtcaatggttactttccatgtgtacacagcatcttcactaactgtgacttcctcatttagatacgcacgcctagtgcctatcataaatcctataatttaaggtgtcaataaatatttgccgaatttaacattttcttttttcagcaaaaaataaatgttttcttctttaaaaaccaaattctgcattcatctatttaaaaaatttattccatattagagtttctcctaactgtactaacaatgtataagggaatattttccaaatgtttctgttaaaactgcctcaagaaaccaaattctatgctgacatctgtgagaaattacaagatttcgctctttcgtccttctcaacttaataatttaaaattctaactgtataattttcaaccaacccatattagttattatttacaaaggacaggacaatgttaaactattccagggagcatgaagtgtctaacgctcatagggaactgtcaaatcagaaagcaatatacacataatggttatttgcttccactttgcctgatcatctgttatgtgaagtggtatctcctgtccaaagcataacaaaacttccccttctctacaggatacaaattagcaacctggtacatatcaaattacccagctgcaatgcactatgggagtccaggagaatattcacaccttcttttgccacctgagaaaactaccttgaaaagtgagttatgtccttggctagcttcatcaactagtccatacaccctacccgcctgcgcgcgcgcgcacgcacacacacacgcgcacacacacacacacacacacagactcctcatgtgtaacactactgcattacctttaagtgacctcacaataggcaaaaatcaagttgtagctctctgtcattcttccttcataaggaagtacctaaccatacgttcaaatggtgaagcattactggtaactgtggtggctgaataatgcctccttgtccctgaaacctacgactgtttcccgatatgacaaaagggactttgcagatgtgattaaggatctggagacgaagaggctatcctggtggctcctgaatgtaaccccatgtgttcttttaagaggaaggcagagcaagatttgatggcagtaaaggagaaggcaatgtgaccacagcagcagagactggagtgatgtggccaggagccaaggaatgccagcagcctccagaagtgaaagaggagtctccacaggagcttctattaatggaaggggctagcccagcgaacaccttgattttagtcccttttagtcactttggggctgggcacagtggctcacacctgtaatctgacaactttgggagactgaggtgggaagatgacttgagcccaagagttcaagactagtctgggcaacatagcaagatcctgtctctacaaaaaataaaaaataaaaaaattagccaggcaggttggcatgcacctatagtcccagctattcgggaagttgagcccaggaattcaaggttgcagtgagctgtgtttgtgccactgcactccagtctgagtgacagagggagatcttgtctcaaaaaaaaaaaaaaaaaaaagtcattttggactttgggcctccagaactgtaagaaaataaatttgtgtttaaaagtcactaaacttgtggtaattcgttacagcaacaacaggaactacacaaaaactaatacagtaatctggccatgccccgatagtgtataatattaaagaaagtgaaattatggttctaatgtttgttttcctgaaaacactacttttatgaccagaacatgagcatagtatgctaccattgaaaatttatctgacataatttgacacaaaagtagaatccgttttaaatgtattaccacaatgcatttgtcctgaagattgtgtttataacacattgcttttcagtatttccaaaacattatacgcttaacgctgaagatctgaaaaacacaatcataataaaagaaaacatcccacaacccaaagatataatttgccggtatacttcctgatatttttacatatacaaatggcccctaatgctatctagtttccagttatggtaactaaatggtcacattaacactttttaaaaaagatctttcccaattattaagaactcacacatatttgtccatcttagatcacttaatcatcctatcatcactgttttaagacaaaaaaaatcttattacttctaggaacttcatctcaaatagcatccccatcccctctctgactgactttacctgtataacttgcattctattaagcataagatgattaaattggctgcaaaagccagaagggacttttaatgaatttacacactaagaattgtgacaactatgtcttgatccaatatgaaagtttcttagatgttgaatctccattaaaaattattccagaggccaggcgcggtggctcatgcctgtaatctcagcactttgggaggccgagacaggtggatcacgaggtcaggagatcgagaccatcctgactaacacggtgataccccgtctatactaaaaatacaaaaaaaattagctgggcatggtggcaggcgcctgtagtcccagctactcgggaggctgaggcaggagaatggcgtgaacctgggaggcggagcttacagtgagccgcgatcacgccactgcactccagcctgggcaacacagcaagactccgtctcaaaaaaaaaaaaatttattccagaactgtcccccacaaaacaaaatagagttctaaaatgggcaacaatgcccagaaattgccagaacataaaaaacaagcacagagacttggtataaaactcaagacactgagaataagattatttggtgacttctttgaaatcaagatgatataaaagtcaatacctatgtcagaagctctgcatgtagtgagacacggcagatgccacacacacatacacacacacacacacgagaaagggacaatgaataatggagaaaactctagagagggacaaaaggaagaaattccaattccaatcataggttgagcatctcacagattcctaaatgaacaagagtggaaagcccacaacagatctctacgaaatatcactctctgtatcatatgattatgtctaaattgactgcccaataaaacacatatacttcccatctgatcctatgaattcagacatattcatgtaaaaacgtctttatatattgtcacatgtaattatacaaatttggtgaatatcaactggatcatgcagtctacatttgtctgtggtcaggagcccagagaagcagcacctcagagaacatgacctcacttgtgcttaaatctgtacctctcacactctgggaactcaccagagagctataaaggactttcaggagaaaggaggtcgaatttcaagggtggagagaagacccagggcacagggaatattattcttaaatctgtctaattctccaaggagcaaacctaacttgcccccatcctctagctgcccagagttcatcattcctcaattttgtttcaatggaaaaaaaaaattgtaatcaggactggatttgcctggaaggaaaatgcagagccagagactacaaagatttccattgcagacaattcccaatctagggaatgtctccagtaggagctgtggtgaagcctggtctgttccggtcaggccactcctgtgataaccctcagaaacattacaacccacagtcaagccctgtggcaacaagtaaggaagaaattcacctgttgttcagacaacagctgctcctttgagctgaagaatgaaatattaaattccagcttctgagaaaatcaaggaatgtgggtaagaaaaaaatgaggggacagaaaagagggagtgcaggtagatgtcaaaaaaaaaaaaaaaaaaaaaaaaactaaaggttgacctcagaaacacagatattacaaatgttccttcctatttctccattttattaatacgagcaagtttcaggtgtctacttcctatcatttcatgatctggaaaatggatctactctgcgggtacaataagctttaaaaatgactacgcagttacagagggcttcatcacaagatcttatttatgcactgaaactccaaaaatatctcacaataggagtaactggcgtattcaacaattatgtaaataaataataaaaagtctcaatcaggacaccaatattaactccctaatcaccaattttccccctcatttgatgagggtaggagtagagatgtgcaaaatgggtgaggctgctaactattgaacattctctcctccaaagttaagggctctcatgtgaaactttatgggggcctctgttcaggtcttacagtaaaagtaaattggagagaatcatcaagaagccatcaatactcttaaaaatacacacatctgtccatagatggtctttttttttttttttttttttttgagacggagtctcgctctgtcgcccaggccggactgcggactgcagtggcgcaatctcggctcactgcaagctccgcttcccgggttcacgccattctcctgcctcagcctcccgagtagctgggactacaggcgcccgccaccgcgcccggctaattttttgtatttttagtagagacggggtttcaccttgttagccaggatggtctcgatctcctgacctcatgatccacccgcctcggcctcccaaggtgctgggattacaggcgtgagccaccgcgcccggcccatagatggtcttaatatgtgcctaggtatatgagtcatgcagatatctaagaggaagaaactattctgcactattctgggtgacacgatatccacagctctgatgacattgttctctccacacagagaagaaactataaatagaaccctaagcatcatgttccacatatcaaagaaggagatacaaactatttttggaatacaaataaagctttagtaacatgaaataaaacacctgtcaataagagacattaatctattctacaaaaataagaactttttaaaaagaaatatggcctttaatcagagatgatgtaatgacatatcaaatcaatgtcaacaccctgagaaaagccatctcctactgcacaattaccctgccattctcagtcgaagactgtcctctattaaacattatctggacttctttcctttgttttatggagtgagtttataaacgcttgttctccgtaactagtgatttcaagtattctgttttatctaagaagtacaatgaaggtcatgagaagtcctctattaacactttatctggacttgctggcactagtgtaactattttctacaacgttctatttcataactttctagtactgccacagacatctttctaaaatacaacctgttcataatgctcttttgtagataatggttcagtgactcctccctatcgccaactttaaacctacctccttgacaaagcttatctggtgtgcctgcagcctcaccagatacctttcattctattctcttctctcccctccatgcctgtctagaaggccgccttcacctagttaactcctacttgtcctgcaggaaaactggaatggctccactgggaaacagctggatcttccaagctctataggctgagttttccagtacttccttgtataaacctatattatgatacccacctttcaggtttgtaaatctttacttttctgtaccccttctagactatgaacaaggacctgatgaagggtagttactaaaatgttggctgactctaaaggaggtgctaattgcctcacactaaaaagagggtaagaggtgacatggaaaatttcacataaagttggtgccattggaactggatcttgagtgatgaacagtagttttgagatgttcaacagaaagaaagggcattcagatcaacgagaatcaaatgaacaaaagaaacatgaaaaatcacgtgttgcaggcatgtatgtgtgtgctgatatgtacatacatctttctaattactcttcttctgtggtggtgaaggtgcaatctataccaccaatataagcctaatcagcccaactaggccacaaacttattgggaagaaatggtcatttctatgtaccttccccacaggcaatatatagacaaatacaacctatgtgtacccatccctacccagcaccatctaatacatatggtataaagaaatgacactgaaataataatcataaatacctattcattcaaggaaaaaaggtttctatttggtgaaaaacagacatttgagttaatctgttaagagtcctaggtaattaggaaattactgggggaaaagaatcctattactgtaattccttttaaccaagattctatgctacaggatgaagtaaataagccagggaggtgagctgcaacataaatcagccgactgtcacatgagtctctttaatattacaaaattgagggagagaaaccattcagattactacgaagaaacatttaaaatgagctcattaaatgcaaattaaaacagaaacattgaataagcactgggctacaattaaaggctgcagaaacagcaggtaagaaacaattttcattgatcaaagaactaatagctaacagaataaagtattttgcattaaaactgctttcatgaatatgaagcatttcgaagtaagaactcttttttttgcatttttcaaagaaactttggaggtaggaatggatttacatatcttaatacaaagtactttcattgtatcattttcaggcaatgaaactatgaggtttcaaaaaatgcagacttcaaaaacatcctcagaaatagggccaaaattgtaaagggcaaagggtcattttagagcctttggacccaaggaagaactattatataattacataaaatcttctatgcaaaactttagtagagcctatttttgacacaattttacctcattataaacagaagctttggggtacttaggcatagagctggttttcatcaacttatcaaaatggcagggcaaagagcagtacacagtatattcaactagaaatataaattgagactttaaaattcactgcacacaagcttgaaaacaaatatgcagatgtgtagccaaatggtgaagtcggaatatacattcctgatggcaagggactttttctgttgtgttccctcgtttccctggcacctagagcagttaagggtacatagcaggtgctggaatcactggatctgcttttgcaaaactaacgcactataagatgagaatgagaagttttcttctaaattaatttgaaaagttaaaagatactgtttttcatctgtcaagacggcaaaaataaaaaatcttcgatggcacatgggaggaaatgggcactcttatacacactgaaagggagggcagggccaccaaggacagttgtgcagcttgtacactgaaaggcactacccctagggtgagagagaggtgggggaccggagatccaggaggcgttctgctagtgaaagctgagtcagtctcaggaaggacgtcttttggcaattttcagcccagaggggcagggcagctctttactaccatgttgtattagtggaggctttagataggcttgtaaaattgggcaacttattttggaaaaattttgaaatacctaggaaaatgtaaaatctacaaactctttaactcaaattgtcatacgatttttattttacatctatgcttacatgtgcaagtaaaaagatatggccacaaacacttctgacaacagttgtctgtaaacctaatgagtgcttatttattggtaaatattttcataattagtgtatcctataaaagactaggcaggaatcgctgtggagtggatctggacatgcagatatgtaaattctcaaagagatgctaagtgaaacaaggtatagaagagactatgttccaatgaatggtttttgtcaatcaaaaatcttcttaaaagtctaagacactgaatgtgtatttcaatactgacaacattgttgtatatataaccatgcactctaatatctgctgttactcaaatacctaaatccagttctacagaacatttagaacataccacaaatatccccactaacattccattttaaacacaaagaattgctcatttttaaaaaagtcaaaatatatttttaatagaggtaccaaaaattacatttttctaaattgaattcttttaagcttttctattctgctttatatcatcttgaagtccttctccacactttccacaaaggcacaatttttaaccgacttcaattaaattatgtttctgtagctgcctgggtcagggcattcaacacatcaatcacaatgcaggtgggaaatgtaagtacttttgaaacagtcctcatgccaataagggaatcttcggttttgagaaagtaaaaggaaggtacatgtcattagcagtgaggtcacagtcagtcctgtttactcctattctaccaggaaacccatctttacgtttctccttaaactaagccaggatttaaataaagtggcagaatattattcgcagtaaggttgaggcgggaaattaaagaacaataaaattaaaaagaaagagaaataagttttcctgttttaggctaacttgttccagaagcagcaacaggcacagcctagacccaggaaaagtcttgataatattatctaatatgctctggagactctctcagcactccctcaacacagggagaagaaaaacaaattttcctttgttttacagaatgagtttatagactcttgttctctgtaactagtgatttcaagtattctgttttatctaagtagtacaacgaaggtcataaaaagcctgagtaggcctgaactacagctgcctgggcaccacagagaaggttataggataagcctgtgcccaggcaaacctagaaaacgaacatctgggttgcttggcaatggtcatctgcaatcctgtctttgtcctgcctctgtatccctgctttcacgccactgtaagcttgcttcaagctagcccacctccgtttgtgaagtgtgtataaaagtcaagtactgtctttattctgggcccagtcttttggatgtgagtcagctgggcctgagtacactcaataaagattctcctgcttcaacctgaggtctccctcatactcccgaatcccgcaacaaggtgagtgtaatagttagagaaagcataggcctgaaaggagcaagctttgagaagcactcttacctttaacagaaaatcccagatacatactatttacattttagtgatcactggataaagtctataatgtctttcctggctctgaatttttgtcacaaaaacacaaaacccatcactccaaggcttccttttaatggttttcactttcacctacctttagcactgttcacgacacccaaatcccaaactgaccattcagatgtttactgaaatgtggctaatgaggctgggcgtggtggttcatgcctgtaatcccagcactttcagaggcgaatgcgggaggattgcttgagcccaggagtttgagaccagcctgggcaacattatgaaactccatctctacaaaaactataacaaaaaattggcaggcatggtggcacacacctgtagtcacagctactcaggaggctgagatgggaggatcacttgagcccaggagttggaggctgcagtgagctgtgatggtgccactgcactccggcctgggtgacagagacagaacctgtctcaaaaagaggaaaaaaaaaaaaaaaagacgtgtgtctaatttcagaattaggcaatgcaactagttgaatattttattgcacattgtccatgatcttatatgtaaggcacatttcctagggaaagcaggcatggatttaatcatttatgttgtactgcacacttatttgcactatgtaaaaccatggctggagtgagagaaataacacttttaaaaaccaaccttatattctccatgtcattaccagtaattgataactgtttaatcatcaactccaaagatatttcttccttattggaagaattccagataaaactaaacagaactgtccaaacacatttcatcctaataaagttatttatataatcacttattaggtcataacttataactgagtaatgttctttagatcttaagtgcttgtctttatatagctttacaataaatttgtttctcttaaaattatctgtgcactagattaagttaaattaaaataaaatgtatttaactgtcttcaaaataaggtataggctattttcttcctgtagactgacagcacagatattggaaaatctcttctacttggttttctgattcagttcaaacttgtgcttgcaagtgaatcttacgtaaatgtcacctaaaaagagctcaagaagactcataaaaaatatttttttcgtaatttgattaactttcaagtcattcaccaaaagtcagaccatgctagaaagggaagaaaagttggacaacattcttgttttaccacaaagaccatgccagttagctggcttgattctcccactgatggggagaatgtttacattttaacaataacttcacaaataaacagatgtaagaagtgttttcagtgcataaagatcatatactttataaatccacctctcatctttcttctggacagaccacatctgacttcgaacgtacttactgcaatcaaaagtgttttgtaaaggaccctcctcaggaataaacaagctcactaaaccctccatacataacctggagaaacctccacaataatgaaaccccatctagcactgtttttcaaacatatggtgcatttccattaattttcagggatagcccctaaagtaacttttggctcaacaaccctggaagagaggacctttgctcatcttacacatcaagtgttcatgaacaactctgatgccactaagtttcgttcacaaacttgcacctcggtcgttcttttacaaaaaaaaaaaagaaaggttattttgcaaaaggcaatagatttaatcttggctactatttactcttaatgtttctttcatctcagccctccaatgagaagtttaaaaggaaacatccgagggagcaagtttagatctatctggaggagtttctgtggagccagccaccctcaccaggtgccttccattagagtttaatgctttgctgcggtttcctgaaagagccccacagagagtgggtctcgatgggtcctgaaccgcaccacaaccggccagtgaggtgaggggcgaaggtgaggggcggcggcggggcgaaggtgaggggcggcggcggggagaaggcttcgggaccccacacggtccgggggaccgcgaacgaggagcgggggtgcggggccgcctggcgtccccgtcgaggcggtcttcatgagaacgctcagagcaggggcgggcaggcgagggcttcgaacgcacacactggggccccggacccgcgtcgctgagctggggagcccggcggcgcgggccggggacggcacgggcactttggccccgtcattgacagttggcaccgggggtcctggtcggccgaggcggggcgtggcgccataccggggcgtggggcggcgcagagaggctgtacctggcaggtacccacgtacctatcatggtcactgggtaggtggcggctgcgggccaggaacaggcccatgcgcgcagcggcgccagccgcgcctcccaccagcggctctcctgggttaaatcctccaggcctccccgcccccgcgcccggccctaggaat

SEQ ID NO: 2701 - DNA, 1380245 bp, Homo sapiens; identical to SEQ ID NO: 2700
  source 1..1380245: mol_type = genomic DNA

SEQ ID NO: 2702 - DNA, 1380245 bp, Homo sapiens; identical to SEQ ID NO: 2700
  source 1..1380245: mol_type = genomic DNA

SEQ ID NO: 2703 - DNA, 17105 bp, Homo sapiens
  source 1..17105: mol_type = genomic DNA
agggggtgctcccgggggcggcggttgcccggatgggccgttagtcggggctcagccgcggagtgagcgagggagacgggaggagccgaacccggcgccatccgccgccatcctcccccgccccaccgccatcccgtcccggggagcccctaggcccgggtcccggatccccgcgcacccggccaggtgagtctgggtgaaccgtgcgctgacgcccttttccggcgcgggagaggtggtggcggtggcggtggcggcggcggcggcggtggtgggccggggggaggagaagctgccattagccgccgccattttgtcctcctgctgccgggcctgcttgcccctccccctccggtacctctactccgggacccgcacctccggcagttcattcaggatccgtagtctgcccctaaccacccaccgtcttggcttcagggggtgacccctgcgcctgggtccgtaactccctaccctccgctgcgctcctggcttttcacccccatttgtgggccccctccccggctgccgccccgtggtggtgggccgcgcccgacggttctctcggaagggcgcttttcctccatattggaccccctcctatcatccagcgctgtgttcccccctctggacgcccctcttcgtgtcgagccactcccactctagaatcctgcttttatcccagcatctttgctttctatgttgctcagtcgccctatgtctgctttttcatttttcctgttcctcgtctcctttctcccccaaccccgtttttcttcttgggcctctgcccccttacttcgttgtctacatcctttttttttttgccattcctgtttccatatattttccacctgctttcgtattcattattttctgttagttttggtctattcgctacatgactcttgtattcgttttcccttcatatatttatcttcacagattggcctcctcaaacacctacgaagcaacatccatcttatctctagcttgtcataaagttctttctccccaattttagctttcattctgggcctgtctggatttccctgctttcttccccactatttctcatctctttacactgttcccgtccataaacgaatgcctggtcactctggaatggactgagagacctgtcgtccggcttgcttagggagctggaggtatcgagtaaagaaacactggtgatggacatttttaatgaggataggaaaacgaagatggctctggccttggccctctgttttctggcccatggttacagggtgctaaggtggctccataatgctttttctcagttcttcatatggtaaaacagtatttcatctggaggcgattttttccaggagccaatacaggagcaagtttaggaaaagatgggatatttcaaatacttgaggttcctatagcctgggagtatgtacagccctagttgttctatgaggatttctctggtaccaacccccattccggctgagcaagctcataaaatccttaaactcccagcataccttcctgcaaaccttcccagatggacacgaggctgctgggctgggagcctggggtacagggccctgggggcatgattagggagcttgtgtccaataaacagggaatctaaagtgttgtttcttcttctctgatggaattgtatgcttcttttttagttttctcttgcttgaatttgtcctgttgtaagtctctgaaacgattttggtggagagagaagagattattacttgtagggaattactctttgtagacaggcacaaagggcagagtgtttatactaggaggatgctggatttttacttagatttccttgacaaaggtgtctgggggaaaggagggaacatggcatttgagctatgagggagctaagtagatcatggttgcttgagaagagtgggcagtttacatagactggaggaaaagacaccagagggcctcatatctgagtccctaatgataatgcaatggagtttttaagtttctgttatggtctgtacaggggacagagactgagacacttgctgtctggcccacaggctctggcacgttttgggggaggtgcctgcaggacccaacatactcaatgagcttccagcgcaatgtccgatcgctcggggccgactgccaagggaaaggatggaaagaagtattcctcgctcaacctgtttgatacgtataagggcaagtccttagagatccagaaacccgctggtgagagtcctgcaaagatgcttctgatggttgaaagctaggcatgcatggggcatacgttttagagctctttaaagggaagtggctgtagtagaaataccaaaagactagaggagatttcccaactttacactgggtcctttaaagggggtgtgggctctgggtgaacaccagttatcctcctacaaaggcgtgtctgtggttccctgtctttggacacgtaagaattggaggaaaataaatgtggatttgggaaactttgaggccagcttgcttcttgcaggctcatgatcaaccaatctcacataaaagtattgaatgttacatatctcagccttcttgatagggatttcatagatttttttttttttttttttttttttgagaccaagtttagctcctgttgcccaggctggagtgcaatggtgtgatcttgacttaccacaacctccacctcctgggtttaagcgattatcctgcctcagcctcctgagtagctgggattacaggcatgcgccaccacacccggctaattttgtgtttttagtagagacagggtttctccattttggtcaagctggtcttgaactcctgacctcaggtgatccgcctgcctcggcctgccaaagtgctgggattgcaaagtgtgagccaccacaatcagcgcgatttcagagattattaagggcaggggaaggaatcccttctaagagaagtttggaggaagtaggtaataaaatattcaacatgtataaatgtgtcccaggataggaggccatcagatctcccacatgaggcattttcgaccctctctccgtcttgttctccagttgcccctcgccatggcctgcagagtctcgggaaagttgccattgcccggcgtatgccacctccagccaaccttccaagcctgaaagccgagaacaaaggcaatgaccccaatgtctcactagtgccaaaagacggaacaggatgggcaagcaaacaggagcagtccgaccccaagaggtagacagaggcttgggggacctagagtgatgggtattttaacttgaacttcagggagcattggggcttggtttagtccagccacgtctgagccagagacgaagaggtccctttcttacctattgcaggttccttgttaaatgactaaggaatggtactaaactttagctttttgtcttggagagagagcatgaaaaaatagacaacagcctacaaaggatgacaaaattaatttgtccttatatttgtaaatggtagcaatgggcatgatttcagtcctgagtctccaccagttggagaagtcagggaggcatctcaggtgtgaataaccttcccattctgtcccctcagttccgatgcctcaaccgctcagccgccggaatcgcagccactgccggcttcacagacgcctgcctccaaccagccgaaacgacccccagcagcccccgaggtacctggagaactggaggggtggggaggaagaatggttcatagctgccccacccacatcatttatcatctttctgaacacttccccagaacactcctttggttccaagcggggtaaagtcctgggcacaagccagcgtcacccatggagcacatggagatggtgagtgcagcacttaattggggagctgtgtctgggcaccatgggatgcatgaaccctgcactgtattttcagccaagtgaccttggtcctctttggctaaatcaaggaccacccatattcagtttcatggaggcacatgagcaagtttaagtctcagtcttatatgatggagtgtagtggtgccagaactgacctccttggggaataagcagttattctgtaggggggtgagtttgaaggcgggaaacctgatggtctggtacctgtcagagccttccactttttttttttttgagacggagtctcattctgtcacccaggctggagtgcagtggcgcaatctcggctcactgcaacctctgcctcctgggttcaagcgattttcctgcctcagcctccagagtagcgggactacaggcacacgccaacacacccagctaattttttgtgtgtttttagtagagatggggtttcacatgttggccaggatggtctcgatctcttgacctcgtgatccgcccgcctcagcctcccagagtgctgggattacaggcgtgagccaccgcgcccagccagagtcttccacttttatagcatgtcctcaggaaatgtcttctgtctcctgttctgcatccccatcctaataggtggaagggcatcaagcctactgtcacgattctctcgagaggaatttccgaccctgcaggcggctggcgaccaggacaaggctgccaaggaaagggagtctgccgaacagtcgtctgggcccggaccaagcctccgcccccaaagtgagtggctgccttttggccaagacattacctattgcatctcagagctaggtgctggcttattcaccttcctccccatcactttcagctgtgttcacttgtcctccaatcattgatacctctctctaccttttccaaaatacagattctacaacttggagggacggaggtgggcgtggccctgatgagctggagggcccggactccaaacttcatcatggtcatgatccccggggtgggctacagccttcaggcccaccccagttccctccctaccgcggaatgatgccgcctttcgtgagtcttggtgtcttgtcttggaacgattacactggaagctggagagctaggaatcaggacttagtctttgacctatgagatagaagggagggtgggaggatgattgatagcaggcttaaggagctagaagggtatatgactgtccctctgagcagctactgttggacccttttacagatgtatcccccatatctcccgttccctccgccctatggaccccaggggccttaccgataccccactcctgatgggcccaggtgagcaatccaggtctgggtttgtggctgggggcaggggaagcttattgggggaggagatggttttctagccaggaggctcagtctaggatcagtctcgcatgtggttatacaacatgccatatttcattttcttttttgtgtacagccgttttccccgtgtggcgggcccccgaggctcagggccaccaatgcgcttagtagagcctgtgggtcgtccctctattctcaaagaggataatctcaaagagtttgatcagttggatcaggagaatgatgatggttgggcaggtaagtggatattaagggtcaagaatttggatcttgaaaggcaaaacctaatgaggaaaaaaaaatacagggttatgtgggtgaaaggcagacattgaagtgtaggaagaccaggcccaatggctcacatctgtaatcccagtgctttgggagtgttaggtgagaggatcgcttgaagccaggagttcaagaccagcctgggcaacacagcaagaccccccacctctacaaaaaaaaaaaaattttttagttgggtgtggactgtgcatctgtggtcccagctactctggaggttgtggtgggaggatcagttgagcccaggagttggaggtcacagtgagctatgatcgtgccactgaactccatcctgggcaacagagcgagacttttaaaaggaaaaaaaaaaaagagtaggggaggatggatggggaataccaagtccttgcaaagtggtgagaggagtaagaatgacaagacttcattggtggatctagacttcggagggaaggatattggcattggtagtccatcttgttacatagttccagactacctcccaagattggagggcagaatgcttgggttactaatactcatatttcccctcaggggcccatgaagaggttgactacactgaaaagctcaagttcagcgatgaggaagatgggcgagactctgatgaggagggtgctgagggccagtgagttagggccatcaggggagaagaggagggggtcttggtttgtattttggtaatatactcttagaggagtatattagttgcagctgattttaatttcactgttgatctgctcacagcagggattcccaatcagcttctggtgaggaacggccccctgaagcagatggcaaaaagggcaactcccccaacagcgaaccgcccactcctaagacggcctgggcagaaacctctcggcctccagagacagagccgggacctcctgccccaaagcctcccctacccccacctcaccggggccccgccgggaactggggcccccctggggactacccagtgagtgtctccaataagggattgagagggtcagctgtgggaaattggtgtcagctgagtaattgaagcggttgtgatatagaggaaggggggtgctaaaaatgggctgtgtgaagtgccaggctgcagaacatcctgggaagcttttaaatatctttggtaataggggagtctgggtaagaagtgagaaactgggatgctaatgaggaaagaagaaaaaggagccctgggtgtttgggtttcggaaggagagagggaacagaaaaataaaaagactagggtggctagatagctggatctgttagtatgcatcagtagtccaagctactcagcaggctgaagcagaaggatcacttgagcccaagttcaagaccagcctgggcaacatagcaagacgtggtctcaaagaagaccaggataatgagtttgtcaccacccagagagatcaaccccaaagcctgggtcgttgcatcctgcaagtagcgacagttgatttgttgtaaaagagatgatagaaagcatagtaactgattcccctggccctgctgggtcttgccaattgacaggatcgtgggggtcctccctgcaagcccccagcacctgaagatgaggatgaggcatggcggcagcgacgaaagcagtcgtcatctgagatttccctggcagtggagcgggcccggcgacggcgagaagaagaggagcggcgcatgcaagaagagcgccgggcagcctgtgctgagaagctcaagcgactcgatgaaaagtttggggcacctgacaagcggctcaaagcagagcctgctgccccacctgctgccccttctaccccagctccaccacctgcagtccctaaagaactccctgcacctccagctccacctccagcatcagccccaacaccagagacagaacctgaagagccagcacaggcccctcctgcccaatctactcctactccaggtgtggctgcggctcccactctggtgagtggtggtggcagtaccagtagcaccagcagtggcagcttcgaagccagcccaggtatggagatggggataggtactaccagatgtcagatcactgcttcaaggtgcttaaaggtgcagggtggtaaggctggggataaatgaagtagaaggcagttgttttggtttattggactatcagtgatagtgttctatcatttgtatatctgaaggagggaaggttttgtctggaatcttaggttgtagtctaataccatttcttggcagagtactgtagctcacgcctataatcccaacacttagggaggcttggggtggaggatcgcttgagcctagggagtttgagaccagcctgggcaacaaagcaagaccctgtcggccaggcatggtggctcacacttgtaatcccagcactctgggaggccgaggcgggcagaacatgaggtcaggagttcaagatcagcctggccaacatagtgaaacccgtctctactaaaaatacaaaaattagccaagtgtggtggcatgtgcttgtagtcccagctgcttgggaggctgaggtagtagaatcgctttaacccgggaggcagagatttctgtgagccaagaccatgccattgcactccagcctgggtgacagagcaagactctgtctcaaaaaaaaatcctgtctcacaagaaatacataaataaaaatgaaaactatttcctataggccaagactgaagaaagtactgttgttctaatggtttcatagaaagttaatgccaccaccataggctcatgagaggccatgaagtgctttaatgggtcttaaatgggaggggcttcaatagaatagatgttgaatagaatattttagtcttaagggagctagagatgagacgtgagattcctggggtgttcatggagtgtctattgttggactagatcactctgttgtgttttttccgatgcagtggaaccacaactgccctcaaaagagggtcctgaaccaccagaagaggttcctcctcctaccacacccccagttccaaaggtggaacccaagggtgatgggattggtcccacccgccagccccctagtcagggcttgggctaccccaaatatcagaagtcgttgcctcctcgtttccagcggcagcagcaggtgaaatcaagttgtttaccctctaagggctgcttttcttcctggcttcggtccctaattctcttcataagttaccttctgggtccctttgcttctttgtccagttgtctccattgtcacgccaatttcccctagtccaagttttttctttgctgattcctttgtccatgtgtgctttgagcctctctcatcttgtctttcctcctttcctaggagcagctcctgaagcagcagcagcagcaccagtggcagcagcatcaacagggctctgcccctcctaccccagtgcccccatcaccaccacagcctgtgaccctgggggctgtgccagctccacaggctccacccccgccccccaaggccctgtacccaggtgctctgggccggcccccacccatgcccccaatgaactttgatccccgatggatgatgattcctccttatgtggacccccggctcctccagggtcgtccccctctagacttctaccctcctggtgtgcatccctctggtaagggggcatgggaggagtgagaaacaggaaagtcccctcagtcttaggcattggatattagggtcttactgtgactctggtacgataggttttgcccatcatagtgatgagggaagggcatatgcttggcactgctgagatagctctgttgcaaaaatgggcttagttaagaaataagcagtggttggccaggcattgtggctcacgcctgtaatcccagcacttagggaggccgaggtgggcagatcaactgagttcaggagttcgagaccaccatggctaacgtggtaaaaccccatttctactaaaaatacaaaaaagtagccggcgtggtggcgctcgcctgtagtcccagctactcgggagactgaggcaggagaaacgcttgaacccaggaggtggaggttgtagtgagccgagattgtgccatcgcactccagcttaggcaacgagcgaaactccgtctcaaaaatgaatgaatgaatagcacaactccatctcaaaaatgaatgaatgaatgaaagaagcagtggtccttcatttgccaggatttatttggggtgggttgattctcttgtagggaatctgagtggataaccttgttatataagagcaggcaaggcccggacctactgggaacaagagatggaagagctgacttgaccgcgaggggagatgctttttgggctggagggcttgtgacatgaataggattatttttctttttctttggtttcttcaggcctagttccccgagagcgttcagacagtgggggctcaagctcagagccatttgaccgtcatgcacctgctatgttacgggaacggggcactccaccggtggatccaaagttggcctgggtaggagatgtcttcaccgccacacccgctgaaccccgcccacttacctcacctctgcgccaggctgcggatgaggatgacaaggggatgaggtgagtcttggtcatgagaaatgggtgagttcacagtgaaaggatctaggcctgggagaaaggtactttgggttagtggtagggatagggatgaacgggaaaggagaggctggatggagtggctcatgcctgtaatcccagcattttgggaggctgaggcaagaagattgcttgagcccagcagttcgagactagcctcggcaactggatgccatctctgccaaaacaaacagaaaaatagtaaaagagagtctgcatcataataaagtgttcttttcccacctagttctggttttcctgagatacttatttccattctttctgtctgtctcttcaggagcgagactcctccagtacctcccccaccaccctatctggccagttatccaggctttcctgagaatggagcccctgggcccccaatctctcgctttcctctggaggaaccagggccccgtccactcccctggcccccaggcagtgatgaagtggccaagatacaaactccaccacccaagaaggagccccctaaggaggagactgcacagctgacggggccagaagcaggccgaaagcctgcccgcggagtcgggagtggaggccagggccccccaccaccacgcagagagagtcgcacagagacccgctggggccctcgtccagggagcagtcgtcgtggaatccctccagaggagccaggggccccaccccgccgggctgggcctataaagaaacctccaccacctacaaaagtagaagagctgcctcccaagcccctcgaacagggggatgaaacccccaaacccccaaagccagacccactcaagataaccaaggggaagctagggggccccaaggagaccccacccaatggaaatctttcccctgccccaaggcttcggagggactattcgtatgaaagagtgggtcctacctcttgccggggtcggggccgaggcgagtattttgccagagggaggggttttcgggggacctatgggggacgagggcggggagcccgaagccgggaattccgcagttaccgagagtttcgaggagatgatgggcgtggaggtgggacagggggaccaaaccaccctcctgctccccgaggccgcactgccagcgagacacggagcgagggttcagagtatgaggaaatccccaagcggcgccggcagcggggctcagaaacaggcagcgagacccatgagagtgatctggctccttcagacaaggaggctcccacacccaaggagggaacactcacccaggtccctctcgctcccccaccaccaggagccccaccttcaccagccccagcccgcttcactgcccggggtgggcgagtcttcactcccagaggggtgccatctcgccggggccgaggaggagggaggccccctcctcaagtttgcccaggctggagccctccagccaagtctctggctcccaagaaacctcccacaggccctttgccaccaagtaaggagcctttgaaagagaagttgatcccagggcctctgtcccctgtggcgcgcggaggcagcaatggaggtagcaatgtgggcatggaagatggggagcgaccccgaaggaggcgacatgggagggctcagcagcaggataaaccgcctcgtttccggaggctgaagcaggaacgggagaatgccgcaagggggtctgagggcaagccctccctaacccttccagcctccgctcctggacctgaggaggccctcacaacagtcacagtggccccagcacctcgccgggcagctgccaagtctcctgatctgtcaaaccagaactcagaccaagccaatgaggaatgggagactgcatcagagagcagtgacttcaccagtgagcgccgaggggacaaagaggcacccccaccagtactgctgacacccaaggctgtgggaactcctgggggaggtggaggtggagccgtaccaggtatttcagccatgtcccgcggagatctgagccagagagccaaggatttgagtaaacggagcttctcaagtcagcggccaggcatggaacggcagaatcggcgccctggcccagggggcaaggctggcagcagtggcagcagcagtggaggaggcggtgggggtcctggaggaaggaccgggccaggacgaggcgacaagaggagctggccctctcccaagaaccgaaggtgggtaggaacaaacaaatttattgtggtttaaaaattggaggagggggaaaaagcctgagggaaagataagtttgggtggagtggagattgtggcctgaggggccatgggctctagaatgtcagtaggatttccatgtctggctaaggcaactggaaagcggttggtagggtgttagagtcaagaacacccacctatgtattcattgctggttctttgctttccagtctgtgcatctgtatgcataggaatccttagaaggactcaaaaacacctggactttaatagggaagagaataggttgtaagcagaagttgggaaacataacttgtgggaaaaagtaacgatttagtggatactggagctaatgctctgttttctccagtcgtcctccagaggagcgtcccccggggcttcccctgcctcccccacctcccagcagttctgctgtcttccgcctggaccaagttatccacagcaaccctgctggcatccaacaggctctggcccagcttagtagccgtcaagggagtgtaactgcaccagggggtcatccaaggcacaagcctgggcttccccaagcccctcagggcccctctcctaggcccccaacccgatacgagccccagagggtcaacagcggcctcagttctggtaagctggaggggttatgggtgggaatatctccatccccagagaaggtcaagtgctggagggagcgggtggagaacctggcctagggaccctgctgctgggtgcgtttctgcagggagcaagggtagaagaattgggaggtggagtagagaggaaaagttagggtcagtggcagagccaggcagatgctgaccctttttctctttcccagacccccactttgaggagccggggccaatggtgagaggggtgggtgggactcctcgggactctgccggggttagtccctttccccctaaacgtcgggagcggcctcccagaaaaccagagctgctacaggaggtaagggatgggtttgagattgtgcttcactgcactcttactcgtgaaaattcttctgggttatgttttctctgttttctttcctgtttctttcactgtgtttttactccagaattctcagtattagtctcccatgtgtctcccttgttgtccccacaccctgtgtcaccccactctgtcctggcttcctataattcccaattcccacccaattcatgttttgcttctggcccttctcatctgtaggaatctttgccacctcctcatagctctggattcttgggctctaagcctgagggcccaggccctcaggcagagtccagagatacaggcacagaggccctgacccctcacatctggaaccgtttacatactggtgagtaaagctgagtgaaaggactatggtagaagggttaagaatgagaggggcttctgaactgtcatctcctcacttctcttctggttggtgctcccttctccagccactagccgaaagagttaccggcccagctccatggagccttggatggagcccctgagtccttttgaggatgtggctggcacagaagtgagtgagggtgggagggtgtgtctgagctgggacttttttgagcactggtcataccccccacctgctctgggttgagtctggagctgttctctcacttggctgtcccctttctgcagtttgtatgtgtgcatcagtcaggtattggggtgctttctaccctgacttaactagctccttctccactcctctcagatgagtcagtctgacagtggggtggacctgagtggggattctcaggtgtcatcaggtccctgcagccagcgaagttcccctgatggaggactcaagggggcagcagagggaccccccaagaggcctggaggctcctcacccctgaatgctgttccttgtgagggtccacctggctctgaacctcctaggagaccaccacctgccccccacgatggggacagaaaggtaaaagaccaaaaaaggataaggggaatgtttccaggaatctgactttggccctacctttttctgctttttctctctgcgtgtgtgttctgggcattccaatttggatttccctttccctcccccaatgcactttactgtgtgcccaatccaggagctgccccgggagcagcctctgccccctggccccattggcacagaacgatcacagcgtacagaccgaggcacagagcctggccccattcggccatcccatcgacctggtcccccagtccagtttggcactagtgacaaggtctgtgtgggctggatctgggtatcctgagttgggtggagagaagggaaggactaaaggtgggacatagaggacacatgtctgtcacgggacaatgtctcctgccttcttgtgatcacaggactcagacttacgcctagtggtaggagacagcttgaaagcagagaaggagctaacagcatcagtcactgaggtaagtgggagtaagagtttggtggaaaggcccaagatttctggggaagattgctgggagtgaccagggcgtccaggatgccagacatccctctccacgaggcctctccttcccaggccattcctgtatcacgagactgggagctgcttcccagtgctgctgcctctgctgagccacaatccaagaacctggattctgggcactgtgtcccggagcccagctcctcaggccagcgcctgtatcctgaggttttctatggcagtgctgggccttccagttctcaggtaggccccgcttcccattgcatgaccccttcagtgaataataatttttttctgcctggtatgtatttataatcaagcctttctacgttgcagagttgtgagataccactttgtcacatcatttttctccctactttttgcttctatgggtgggatggtgatcttttttcttgaccacagatactaaagctgtttcaaccgtgctcctctcctgcagatctctgggggagccatggactctcaattacatccaaacagtggaggcttccgccctgggacaccctcactgcacccttacaggtaagactcgatgcctgtggatcacagaagtacttggagatgtgtttcggggagagggaaggggaagacacagttctagggtactagaagctagtggacttaaggcattgctaggactctggcttcctaacagcttttctccccacaatttattttcagatcacagcccctatacctaccccccggcccagcccctccctcagcactgctctctgggttagctctcaagggccagtttctggatttctccacaatgcaagctacagagctggggaagttgccggctggaggagttctctaccctccaccttccttcctctactctccggctttctgccccagtcctttgcctgacacatcgttgcttcaggtaagaggggggcaggtattagatattgggggatagggtagggagaatgattttgtgggggttgatatatttctccctgtttcccgacaggtacgccaggatctgccatccccttcggatttttattctactcctctgcagcctggtggccaaagtggctttctcccttcaggggctcctgcccagcaggtatattgtatcttcacacttccccttcatttgatttctctgtccagttgctggctttgattttccctggttttctgacattcctccctgcccccaacatgcacacccaaatttcttgttacagatgcttctacccatggtagactcacagctgcctgtggtgaactttggctccctgccgccagcaccacctcctgccccacctcccctttctctgttacctgtgggccctgctctgcagccccccagcctggctgtgcggcccccacctgctcctgctactcgggtgctgccttcacctgccaggcccttccccgctagcttggggcgagcagaggtaaggtacaggaactgaggggctagggagcgccaagacttgggagtagggattctgtatttcaaggtaggcagctcatgatttttttcccctcagctgcatccagtggaactaaagccgttccaggattatcaaaaactgagcagcaaccttgggggacctggatcatcacggactcccccaactggaaggtgaaacggaatagggatgtggactttccaagtgcttccttactttggaaccagggtctggatcctaggcttgccttagacgcccttcttcccttaggtccttctctggcctcaattcccgtctcaaggccacgccttccacctacagtggagtcttccgcacccagcgcgtcgacctttaccagcaggtgaaggagaaacccttgtggccccaactctaaattcgagttgccacctgatttcctgtccttccgtctcatcgctgacctctcactgtgactcactgtttaacacatgcctgtcccctaggcctccccaccagatgccctgcgctggatacctaagccttgggagcggacagggccgccacctcgagaagggccctcccgacgggcagaggagcctgggtcccgaggggacaaggagcctgggttgcccccaccccgctgagggagttcctcttgccccctacccccggggcttgtatatagattataaatatataagggggaaaggggtgggcggggaggggttctggggctggggcctcacttcccctcctcccccttcccctggtcccctgtccctggggctgtttgttaaaaaagagtaataaaaggatttaaaaaaaaaaacttcta

SEQ ID NO: 2704 - DNA, 17105 bp, Homo sapiens; identical to SEQ ID NO: 2703
  source 1..17105: mol_type = genomic DNA

SEQ ID NO: 2705 - DNA, 87257 bp, Homo sapiens
  source 1..87257: mol_type = genomic DNA
aaatgacgacaacggtgagggttctcgggcggggcctgggacaggcagctccggggtccgcggtttcacatcggaaacaaaacagcggctggtctggaaggaacctgagctacgagccgcggcggcagcggggcggcggggaagcgtatgtgcgtgatggggagtccgggcaagccaggaaggcaccgcggacatgggcggccgcgggcagggcccggccctttgtggccgcccgggccgcgaagccggtgtcctaaaagatgaggggcggggcgcggccggttggggctggggaaccccgtgtgggaaaccaggaggggcggcccgtttctcgggcttcgggcgcggccgggtggagagagattccggggagccttggtccggaaatgctgtttgctcgaagacgtctcagggcgcaggtgccttgggccgggattagtagccgtctgaactggagtggagtaggagaaagaggaagcgtcttgggctgggtctgcttgagcaactggtgaaactccgcgcctcacgccccgggtgtgtccttgtccaggggcgacgagcattctgggcgaagtccgcacgcctcttgttcgaggcggaagacggggtctgatgctttctccttggtcgggactgtctcgaggcatgcatgtccagtgactcttgtgtttgctgctgcttccctctcagattcttctcaccgttgtggtcagctctgctttaggcatattaatccatagtggaggctgggatgggtgagagaattgaggtgacttttccataattcaggtgagatgtgattagagttcgatctgcggtggtggcagaggcttacaagaaacactaacgggacatgggaaccaattgaggatcagggaataaagtgtgaagttgactaggaggttttcagtttagaacatggcagagacattctcagaaataaggaagttaggaagaaagacctggtttagagaggagggcgaggaagtggtttggaagtgtcactttggaagtgccagcaggtgaaaatgccctgtgaacaggactggagctgaaaacaggaatcaattccatagatttccagttgatgttggagcagtggagaagtctaagctaaggaaggggaagaggaggccaaggcaaacacttaggaacacttgcaacgagggggtggaagaagagcaaggagccagctgaggagaatgagtgtggttggagaaccaccacagcgcagggtcgccagagctgaggaaggggagggaagcttcaggaaggaaaaggttggcagggattttgagtgttaggcctggtgtagcagaaggaacagaagatttagagcagcgctagccaatagaaataaaatgtgaggcccggggcggtggctcacgcctgtaatcccagcactttgggaggccgcggggcggatccttgagctgaggagttcgagaccagacaacacggcgaaaccccggctctacaaaaaattagctgggcgtgggggcgcgcgcctgtagtcccagctgctcccaagcgaggctgaggcaggagaatcacttgaacccgggagaaggaggttgcagtaagccaagattatgccactgcactgcagcctgggcaaaagagtgagactgtctcaaaaaaaaaaaaaacctgttttgtttttcttttggagaaaaggcatacaaatttattagcatgcagactgggagaaccacaaggtgattatccctattttaaattttctaataaacatactattatttatttatttatttatttatttatttatttatttattttttgagacggagtctggctctgtcgcccaggctggagtgcagtggcgcgatctcagctcactgcaagctccgcctcccgggttcacgccattctcctgcctcatcctccccagcagctgggactacaggcgtccgccaccacgcccggctaatttttttgtatttttagtagacacggggtttcaccgtgttagccagtatggtctcgatctcctgacctcgtgatccgcccgcctcggcctcccagagtgctgcgattacaggcgtgagccaccctgcccggccggctatttatttttttagagatgggagcctcactatgttgcccaggctggtcttgaactcctggagtcaagtgatcctcccgccttggcctcccagagtggtgggatacaggcacaagccactgtgcctagccataaacacatttttaaaggtaaaaaaaggccgagcgcggtggctcacccctgtaatcccagcactttgggaggccgtggcgggcggatcatgaggtcaggagatcgagacatcctggctaacacggtgaaaccccatctctactaaaaaatacaaaaaaaaaaaaattagccgggcgtgatggcgggcgcctgtagtcccagctactcgggaggctgaggcaggagaatggcgtgaacccgggaggcggagcttgcagtgagcggagatcgcgccactgcactccagcctgggcgacagagccagactctgtcaagaaaaaaagaaaaaaaatgtaaaaagaggctgggtggccgggcgcagcggctcacgcctgtaaacccagcactttgggaggccgaggcgggtggataaccagatcaggagatggagaccatcctggctcacgcggtgaaaccccgtctctactaaaagtacaaaaaattagccagacatggtgccaggcacttgtagtcccagctactcgggaggctgaggcaggacaatggcgtgaacccaggaggcggagcttgcagtgagccgagatcgcgccactgcactccagcctgggcaacagagtgagacttcgttttttttttaaaaaaaggctgggcacagtggctcacacctgtaatctgccagcactttgggaggccgaggcaggtagatcacctgaggtcaggagttcgagaccagcctcgccaaaatggtgagaccctgtgtctactaaaaatacaaaaaattagccgggtgtgttggcgtgtacctgttatcccagctactcgggaggtgaggcaggagaatcgcttgaacccagaaggtggaggttgcagtgagccgagatcatgccactgcactccagactgggctacagagcgagactccataagaaaaaaagaaaaaaaaggggggcaaaaagaaacagatgaaaccaatgtgaataatttattttaacacaatatacctaacatatttttatttcaatatctaaccagtataaaaatttacttgttttgccctctagagatagtaagctccttaagtaaacagaagtaatacctgattaattagaattcccaaccctcatcaagtgtgtgcttatatagaagaaacccagtaaatgtttgttgattgaaagatattaatactcttgcttggatgagagtgaggaaaaaggtattagtattggcttttcacaacgccttgtacggtttcttgtttaagttgatcaaagcaaaagaaagactgcaggcaatgctaaatataacaagtgatttacaaattaattagacgtaaataatcatttttcattaaaaattagttgtattctgtccatttcctcagaattttagacaatgattttgaataatcatatctcccttatagagttattgaaattaaataacttattgggaaagattctttataattatacaaaggtatataggaccatagtctcatatccagagttctgaaatccgaaaactaaaaggtttttctttttttgctattcttttttttttttttttttttttttttgagacagagtctccctctgtcgcccaggctggagtgcagtggcacaatctcagctcactgcaacgtccgcctcccaggttcaagtgattcttctgcctcagcctcccgagtagctgggactacaggcgtgtgccaccacactgggctaatttttgtatttttagtagaggtggggtgtcaccatattggccaggctggtctcgaactcctgacctcgtgatccacccgcctcagcctcccaaagtgctgggattacaggtgcgagccactgcacctggccaaggttttttataactaatttaacagcaaaatctggcctagttatcgtctttattttctttttttaatgtgatttaaaactattcatttgtttcactatagcttaataatttgtttgcttttctgcttctaagaccctgtaggggcattatataacttctggcatttgcatagtacctttacaaaatccaaaaaaatctgaattctaaacacatttagtcctaaaagttacagataagggattctggacttgcgattctaagtctttgttcgtttttattgcattttctgagccaacataaccattatttaaaaacaagttgctatagtaactctacattacagacctcccccaaactcagcagttcagagcatgtattctcactcagggctctgcttccttgtaggtagatgtgtggatcggtgagggcagttcttatttgtatgccttattctggggcccaggctgaaggggcagtggctatccatgataagcttttctcaaggcaccagcagaagtacaagaagtcaaggccaactgcataagcatagttcaaatgtctggttatgccacatctgctaagattgcattgaccaaagcaagtcacatgatcatgcccaaagacttaggagtgggtagtagactgcaaccaccatgcagccaagcaaactacagagccaagcctataacatcactggagagaggtgtattcctcccttggccaggctgggggagggagtgaatattggctgaataataatctaatctaccacagatggttaacagaggtggagtgggatggaaggagaaaaaaaaaaaatcaccaaatgggatgtatcactacccttgctctttttagcgtctgctgctttcacaaagccttttatagggctggagaaatgatttgctcctagtctcttaaaaaccagaggagtcttttgaggatgtattcctaaagtttttaaattagtttaaaaattttttttattaatttcaattataggctgagcacagtggctcacgcctgtaatcccagctaaggtggtggatcacctgaggtcaggagttcgagaccagcctggccaacatgctaaatgaaacccccatctctactaaaaatacaaaaattagctgggcatggtggtgggcgtctgtaatcctagctactcaggaggctgaggcaggagaattgcttgaacccaggaggtggaagttgcagtgagccatgatcgtggcattgcattccagcctgggcgacaagagtgaaactacatcttggccgggtgccgtggctcacgcctgtaatcccagcactttgggaggcagaggctggcagatcacgaggtcaggagatcgagaccatcctggctaacacagtgaaaccccgtctctactaaaaatacaaaaaattagccaggcgtggtggcgggcacctgtagtcccagctacttgggaggctgaggcaggagaatggcctgaacctgggaggcggagcttgcagtgagctgagattgtgccactgcactccagcctgggcgacagagggagactccgtctcaaaaaaaaaaaaaagaaaagaaactacatctcaataataataataatttcaattataggttggaatttagagttcggttacatttactattggatgtgatcctttaaaaactcaagtagaggcttttccagcccattcataacattagaagttgggccgcctgtccagggagaagctttcaaagtaacactgaggctgattaaatacttttgtaaaataaagaataaatcacaagctcattggcacttgaaacttagcattgcagtgcagatgcagcagaaaatacttgtagcagttttctcagtgaaagagaaactagtcaagtagcttagagacattaaaacaagccacaagccctttgtgctagagatcatggttaaaagtcccctgaagatgtttttccacagtagaaattttgtttatatttatgtctgagagtgaaaaaagaaaatggaatcaataagtaaccatgttctgcaggagtttgaggttttgttgttacattgggatgtagtgagagaagaaaacgtattaattcttttctgttggtactttcttgaattacatttttaataaacttattgtgagattctgaacattgctcctgtgataatttctgaagtgctgatgagtagaaggttttctggttagacttctgttcagcacatctgagcttcgagattatttgtagttctcctggggcttttaaaatctctttgtatataatagataaatgctagtttcccatcagagaaggatttctttttccttttgtctgattgagcaagtgtcttgagattaagaaaatggatgtcagtgaattcaagtgttgtgctctgtcagtttgcagcaggtgaccagagagcaaaaacaccagagtagattctgtccctactcccacctactcctcaattcgggtcccatgaaagatcctcagatctgggtaactgttgttgtttttgttgttcacagggctaagaatgttcatggctaagaatgttaaaaagtctcctagtgtcttttgccacgctgcctgaacagtggggtcattgaccgccatgcaatcctcaattgttttcagctgatactggaccgaaatcaaatctagctttgcctgcccctttctttgtaccagtagcgcttgtttgttcaccaggcctgactgaagacctagccctgttgcctgcctctgcttcctaccgagccccctgtaaagagcagctctcccagggaggctcaccttgtagcattgtgatctttggaagcatcaagggaggcacaagatttctctgggtgaactggaaaagacttgggctgggcatcagaagacttgggttctgcaactggcattgtttacactctctctgtaactctgtgcaggcaaaatctttcaccttttctgagtttttttttacatgtcagtacagattcctttcctcatgaggtttctttaagactcaaatggaagaatagatgtgaaaagaactttgaagatagtattggaaaatgctaaagtgactgctgtgttattgatgatttttatgggatttgtctgagaaagctccagtgtgaccagtttgtaccagcttgtatggtttcttgtaataaccgaacagatcctgttagcatagggtaaaaatggaaactacttcttttaaaatgaccagtggctgcagtggctcaggcctgtaatcctggctagttgggagactgaagtggtagggttgcttgaggccaggcaagaccagcctgggcgatacagcaagaccctttctctaaataaaaaactagccacccatgtagtcccacctgcttgggaggctgaggtgggaggatcgactgaggccaggagttcaaggctgcagtgagctatgattgccactgtactccagcctgggtgacagagtgagaccttgtctcttaaaaaaaaaaaaaaaaaaaaaaaaaaagatttgcattatagcttatctttttttttttttttttttttttgagatggagtctcactctgtcacccaggcaggaatgcagtggcgtaatctcagctgactgcaacctctgcctcctgggttcaagcaattgtcctgcctcagcctcccgagtagctgggactacaggtgcacgtcaccatgcctggctaatttttgtattttttggtagagatcgggtttcaccatgttggccaggctggtctggaactcctgaccttgtgatctgcccaccttggcctcccaaagtgctgggattacaggcgtgagccactgcgcccagccagcttatccttttttaaaaaaacataaatactaggatattgagattattgaaaatgcttttggtgcttcagttttgaatttatacttagagcagtttttgaagtttaagatctcatttacttctaagtaatagatttactagtaatcaaaatcgcttcaaaataccgtaatcctcattgctgtaaactcctacggggcaggtttggagttttataaagaggcaatatagtgtactctgtgaattccaactcctcacttgccagatgtgaccttaagcaagtgaacttctgtgtgccacactgttttcatctgtaaaaggataaagggaatatcataaattagtttgttaagccttagtttaataatgtctctaagttttacatataagtagacagtgtctttcttgtttagtgaataatcattcttattatttaatagtatctctactaaatttattgtgtaagattatactaatcttgtttagtgcgtggtaatcacttctgctcatatttaacctataagcataatatagtttatttatataccatttatttattttattttattttttgagatgcagtcttgctctgtcacccaggctgcggtgcagtggcgcaatcttgcttcactgcaacctccacctcccaggttcaagcgattctcctgcctcagcctccttagtagctgggattacaggcacgagctaccatgcccagctaatttttgtatatttagtatggacagggcttcaccatgttggccaggctggtctcgaactcctggcctcaaatgatctgtgtgcctcagcctcccatagtgctgggattacaggcatgagccactgcgtccggcctacttaccttttatttttgcttgcattaccctttctttgccttgtttcatttggctaagactgtcttgtttacttgctttgcttctgagggattatatgagagttctatgggtttttccataatggagtgtacttttattattttattatttgtttttttgagacagggtctcactctgtcactcaggctggagtgtagtgatgcagtcactgctcactgcagctttgactttcttggctccagtgatccttccacctcagcctcctgagtagctggaaccacaggcacccaccacccacacccagccaattttttttgtatttttagtagaaacagggtttcaccatgttggccaggctagtcacgaactcctggcctcaagtagtaacacccatctcagcctcccacagtgctgggattacaggcatgagccaccgagcccggcctcatgcaatttattgactacttcactgaaagtgaacttgtatggatactcaaaaagtacagtttgtattgaatacatattgtttttgcatcatactaaagctgaacagttctaaactgaactgtcatcagggaccgtctgtattgtgaaatcttaattttgtccatattaaaagacaggaacagggctggttcgtggtggctcacacctgtaatcctagcactttgggaggctgaggtgggtggatcacttgtggtcaggagtttgagaccagcctggccaacatggtgaaacccagtctctactaaaaatacaaaaattagctggacatggtggtgcacacctgtaatcccagttattcggggggctgagacacgaaaattacttaaacccaggagttagaggttccagtgagcgagatcgtgccactacattgcagcctgggtgacagagcaagactgtgtctcaaaataaagacaggaacaaaggtatcgataactcttaagtataggttaaattcccacaaaaatctagttttaaaaaatctttttttttttttttttttttaaaaacagagtctcactctgttgcccaggctgagtacagtgacgagatcttggctcactgcagcctctaattcctggactcaagccatccccccacctcagcctcctgagcatttgggactacagatgcatcccacctgcacccagctaattatttttttgtagagatagtgttttcctatgttgcccaggctggagactgatctgcaactcctggccttaagctctttattttttaagcaaatttgcactgttttcaattaatatgaatttgcatttcgctgatctcatgctagctgacaatgggctgaaggtgaggggaggagaaagatggacatggtacataaaagcatgtatgataaagtggaatgtcaccttggttaaaaatgtgtaatgatttgaatgatacaaatataagtagttaagggttattttgaacttgatacctttgctggaggaaaaattactttatgcatttttgatgaaaaatcattagaagaaaaaaaatggaatatttagaggaaagagtatcctgatgttaaaagtgaaaatgaaataggacattgagaaaatttttttatgtaaatgtgtatatggtaatgtattaattagcgttaggtatgtacacggatttttgccttctatatttctgaaaaccttctgtgaaaaggaagagttgaaatcataaagaattggctgatggaaattaaggtagacaggcaaatgggaatgtggcccccctaggagggtgaactctgagagacacagtcatccctgtaaataaggctgcgccaagatcaaaggagaggtctgaggctgggagtcaggagtcagccattcttttttttttttttttctgcaacctccacctcctgggttcaagcttttctcctgcctcagcctcctgagtagctgggattacagatgcgcgccaccacacccggctaatttttgtatttttagtagagatggggtttcgccatgttggtcaggctggtttcgaactcctgacctcgtgatccgcccgccttggcctcccaaagtgctgggattacaggcatgagccaccgctcctggctgagtctgcgatttcttgccagctctacccagttgtgtcatcttaagcaagtcactgaacttctctggattcccttctccttttgtaaaataagcatgttatctgtccgtcctgccttgggcattgtgataaggataagatgacattatagaattttgcaaaattaaaagcgctagacaaatgattttatgaaaatataaagattaggttgaatttggtcagcatagaaaaaggaatgttgagaacattccttaagattactcagctccctttgctggaaatcagaagtcattaagtatctttgtggttgaaaatgtttggtgtctcaggcggttctacttattgctaaagaggtctaccttgagcttatagtaaatttgtcagttagttgaaagtcgtgacaaattaatacattcctggtttacaaattggtcttataagtatttgattggtttaaatgaatttactaggatttaactaacaatggatgacctggtgaaatcctatttcagacctaatctgggagcctgcaagtgacaacagcctttgcggtccttagacagcttggcctggaggagaacacatgaaagaaaggtttgtttctgcttaatgtaatctatgaaagtgttttttataacagtataattgtagtgcacaaagttctgtttttctttcccttttcagaacctcaagaggctttgttttctgtgaaacagtatttctatacagttgctccaatgacagagttacctgcaccgttgtcctacttccagaatgcacagatgtctgaggacaaccacctgagcaatactgtacgtagccaggtacagtgtcagtctctgaaactgcctttgccagactggattcacttatcatctcccctcacctctgagaaatgctgagggggctaggcaggctttctctactttaccacatttataatatatttggtgaacttcagctgattgctggaggacacagggctgtttaacacataggtgttgatacagttcctacctaattcacatatcaccacctcagttgaagccttctccagcttcccaaggtgtgcagcgcctcatagttcatgttgtttattattttacctatcttgctcttattcttctacggctgagtccattttatttactgtattcattacctaacagttccttttagtgctcagtaaatattcattatgattgtacaatgcaaggataagtgtagaagttctaagggttcaaaggagggattcaggaaaagaacgtaatctgtgctgtcggacaaagagattcctcaccagctacatacacagacatgaaatttgactgcaactctactagctaatcatcataaagtgagagcagaggccaggcacggtggctcatgcctgtaatcccagcactttgggaggctgaggcgggcagatcacctgaggttaggagttcaataccagcttggccaacatggagaaaccccatctctactaacaatacaaaaattagccgggcttggtggcaggtgcctgtaatcccagctactcaggaggctgagccaggagaatcgctggaacccaggaggtggaggttacagtgagctgacgtcgcgccattgcactccagcctgggcgacgagcgaaactccatctcaaaaataaataaataaacaataaataaatagagaaaaagaaagaaaagaaaagagagagagcatggatgtcctgtgagacagttggagtatctataggatttttagaggtggacccagaatagaggaaaacacaaggccaactataagctatccagttgcactaggtgtggggtcagattttcctctgttaggaccagagagcagagctaggaacagtggtggaagttaccaggcaataaggtctggatcaataaaaagaactttctcatagcctggcatggtggtgcatgcttgtagtcccagctactcaggaactcaggaggctgaggtacgaggattgcttgtctaagagtttgagtccagcatgggcaacatagagaggttctgtgtttttttttttttaattttcccacagttatggtacatctgggctgccttgtaggcttgtgtgtacatttcactacaaacagtcacaaaaggctgaaaggccactccagcaagatctgtagaggattagtccgtgaattccgcagttgaactagagcactgaatggcgtggaacttccttttacactctgaagatttaggattcttcacttttcccatcagtaaaattaggtaatttactagataatttgaaaattctttcccagctgggaagttttgatgtgcccagaagctaggatgggcagttgtccaggtttgtttaaaactagaggttctagaacacaggactttcagttttaaaattgggacagtcctgagcagtaggatcaagtcagttgtctaccagagtataatcaaattgaaataattttggatctgactaaccaagtcttattcaattagttgacattgttgtttaacttcgagtactattacagttctatattgttatagttcaaatagaagataacatctaaagcatttctcattccaaaggttaaatcttgcctttagcttcatttcttcaactctaagcaaatactgtgacgagctgctatagcctggaaaatagttttccttttgtgggctgctgtgcataatctcattcatagtaaagggatttgaagtttgatgacagaatagtcagagagctgaagttgtgtttgtttttttagcccaaatatttatttctcaagtttttgttgtgaaatgtttctagcacatacagaaagtatggcacataatgtaataggcacccatgtacctatcacccagctttattaaaccttaacatcttatttgctgtttttttgataagctttttttgcttctattgcttattgatcctacactaaatgaaatcctaactaaacaaaacaagattttgcatttaatttgaaaagagactagttatatgacaaaaaattgcagataaaattgaagtgctcctcccccattctttttcctcttttctcaggatagttactgtcctgaattgggtatttaccatgtttaataaaattgagtattaggcttactataatatttatgtacataaatcgtatcgcattatgtaatacacttggcatgttttaaaactttaggctgggtgtggtggctcacgcctgtaatcccagcaatttgggaggccgaggctggtggatcacaaggtcaggagttcaagaccagcctggccaacatggtgaaaccctgtctctactaaaaaaaaatgcaaaatttagccaggcgtgatggcaggcacctgtaatcccagctactccagaaactgaggcagagaattgcttgaactctggaggtggaggttgcagtgagccaagattgcaccactgcactccagcttgggcaacagagtaagactctgtctcaaaaaaaaaaaaaaaaaaaaaaaagccaggtgcggtggctcacgcctgtaatcccaacactttgggaggccgaggagggcggatcacgaggtcaagagacagaccatcctggtcaacatggtgaaaccccgtctctactaaaaaaatacaaaaattagctgggcgtggtgacacgcgcctgtagtcccagctacttgggaggctgaggcaggagaatggcatgaacctgggaggcggagcttgcagtgagccgagattgcaccactgcactccagcctgggcgacagagtgagactccatctaaaaaaaaaaacaaaaaaaaactttatgtggtttatgtctgaaagttgaagagaatttccacatatatgttagtatatgttgcaaaagagacattcctatgtagaattttgggcattcatgtatatgtagatgcatgtagctctagcatttgttttctcttgtgaatatataaaaataattctgtttacaaacatttggtaggttccagtttttcacaataactgacagtgctgcagtgacatactaattcattagtctgtgtgcacttgtgtgagtttctcaaagatagttgctgtgattggatatatggatcttagaactattttagagattgctaggattcttccaaagtgtatattgcaggccaggcatggtggttcacggctgtattacatctatctcagaaaaataagagaagaaaagcatgggtgatcttggtgatttccccctttcattttctaaatgttctataatacagttatttaataatttaaaaagctattttgaaaaagtaatctcacgctgtcaccaaagctggagtgcagtggtgcaatctaaactcactgcaacctcgacctccttgagaccagggtggtctcaagtgatcctgccacctcagcctcccaagtagctgggaccacaggctcatgccaccacacctggctaatttcttgtatttttggcagaaatgaggtttcaccgtgttgcacagtctggtcctgaactcctgagctcaagtgatccacatgtcttggcctcccaaagtgctgggattacaggtgtgagctactgcgcccaacctaaaatattttatatatatatatatatttttttttttttttttttttttttttttttttttgagacggagtctcgctctgttgcccaggctggagtgcagtggcacgatctcggctcactgcaagttctgcatcccgggttcacgccattctcctgcctcagcctcccaagtagctgggactacaggcgcccgccaccatgcctggctaattttttgtatttttcatagaggcggggtttcaccgtgttagccaggatggtctcggatctcctgacctcgtgattcgcccgtctcggcctcccaaagtttttttatattttttaatgtgaggaaaggtcacaaaagaatagtatgctacctgaggaatatctctggaaagggatcaagcattcgaggttttctgtgatgactgactaaagtcatggagttagaacagctgatacaaaagaaaccaaaaaaggccaggcatggtggctcacacatgtaatcccagcactttgggaggccgaggcaggtggtcaggagtttgagaccagcctggccaacatggtgaaaccccatttctactaagaaaaaaaaaaaaaaaaagtcaatgggtgtggtggcatgtacctgtagtcccagctactcaggagactgaagcacgagaattgcttgaacccaggactcagaggttgcagtgagctgagattgtgccactgcaccccagtgcagtgtgacagagtgaggctgtctcaaaaaaagaaaaaaaaaacccacaaaagctcggtagcatgagatctttgagagcattcttatgttcttattggtaattggagtttatattatgcccttgtcatcaataatagcttcagttatgtttcttagtctccatttgaaaaaagaaatattcgctgggcatggtggctcacgcctgtaatcccagcactttgggaggccaaggtgggtggattacttgaggccaggagttccagaccagcctggccatcacggtgaaaccctgtctctattaaaaatacaaaaattagccaggtgtggtggtgcgcccttgtaatcccagctacctgggaggctgaagcaagaggattggtttcaaggttcacctgggaggtcaaagctgcattcagccaagatcacaccattgtactccagcctaggtgacaaagtgataccctgtctcaaataaatacatagacaaaaagcaaacctatgagctatttaaaggaccttgaggagaaaaaaaataaatgaaatgggtgatctaaatttaaatagaatctgcagctctggttagcctttgacagtgttgttgtatcattatagttatgaatttgttttctcagttgtgttaaagtggagtaaggcaaaaaagaacttgaaatctcaacgacctccagagaaacatgctagcttttgcatgagtaaaatctcttaggcacaaatattaataatatgttaagaaactttaggcttaagcctaacataacagccccataagtgttcagtattatctctaaccagttatgtcaactgtttgtggaaatgacagcctttcttggcattagaggaatggttaaacctctgactccagggaatcacaaagcttggtcagatgctgaatggaattatgtgtgttgttggaagcatgttccctatgattaataaatgttttcaagttttccacttaacttgccagttctttggttaagccactcttctagtcctgtcctacagagcaggcttagagccccacatttgtcattgtagaaattcaaacaatatccattaagtcattttttttttttttgcccattaagtcttaaaggattaatacattttctttccttttttttttttttttgaaacggagcctccctctgtcgcccaggctggagttcagttgtgcgatctcggctcactgcagcctctgcctcccaggttcaagcgattctcctgccttagtctcccgagtagttgggattaacagggttgtgccaccacacctggctaattttagtattttagatagagatggggtttcaccatgttggtcaggctggtctcgaactcctgacctcaagtgatctgaccacctaggcctctcaaagtgttgggattacaggcatgaaccaccgtgcctgccaatacattttcttacaaatattaattattgaaaaaatgtattttaagtaaatattcagactataaatatatcagcataattgaatacattataaccacgtaggcatgttaactgcttacatgcgtgcatgaaatattaagggaaaagggcagaatataatatttgtaaacacaactatgtatacctgtgtgtatatattgaaaaacgttagcatttggggtgtcgtaaaaataagtttctgttttctttataaaattacctaaattcatattcaactacacacaattataaacttaattgcagagctaggtgtggtggctcatgtctgtattcctagtactttgggaggctgaggcaggaggatcccttgaggccaggagtttgagactagcttgggtaacatagcacgatcttgtctctacaaaaaaaaaagtgaaaattagtggggtgtggtagtgtgcttctatggtcccagctacttgggaagctgaggcaggaggattgcttgagactaggaggtcgaggctgcagtgagctgtaatcatgccactgcacttcaacctgggcagcaaagtgagaccctgcctcaaaaaaagaaaaaaatgtgtggcaaaaactgccatgaacaaagtccaaaacaaactaggacaaaggcttgaaatatatgacagatatatcccaatatacatagaattcttatgaaattaaaaggaacatgaacaacttaactcagtagcaaaggttacaagcaatatttatggagtaagaaatagaaatggcaataaatatatgaaaagcctagttgatcagccttactaatagggataaaaattaaaacttcacttcttacctatcagtgagttaaaattgatacactgctgctgaggttgtagggaaataggctttcttgtatgctgtgttctttggagttaagttagtatttatttggaggcaagctcttaattgaatctacagatacacatgccttttggaaataatttagcaattaaatctaacctaatctgatctcacctagcatttcacttctgaaagtttatcctataaaaatattaccatagaagtgccaagaatttttattgaagttttatttataacagtgagaatgtggcagtaatctcaatctttatcattaattgcttatggtttacccagttagtagtgtaaaggtactagttaacagtagggtctcttgactaaacagttggactttgaatctccattctagaacttcttagcattatgatctttggcaaattaactggcctcgctaaacttcagtttctttatctgttaaatgaagtttatagcaattaacttagagttttatttaaattaaatgagataaactgaatgattagtacactacctagcacatacttgttcaataaatattaacatttcttatcaaaattgccatatttaagaatgaggtatatttatatgtctagcatagaatcaaatatatattatcattattattttttttttgagacagggtctccttctatcacccaggctggagtatagtggtgtgatcatagctcagtgcagcctgtaagtcctgggctcaagtgattctcccatctcagccttgtgaatagctgggagtacaggtgtgtgccaccatgcctggctaattttttttgctgttagtttcactttttttgtagagctggggtctcgttatgttgcccaggccggtcttgaactcctgggctcaagcgattctcccgtctcggcctcctgaagcatacagattttttagggcagtgaatctattctgtatgatactgtaatcatggaaacctgtcattatctgtttatacaaacccatagactgtataacaccaaaaagtgaaccctaaggtaaactgtggactgtcaatgtaggttcatctgttgtaacggtttaccacagtggtgcaggatgttgatagaggctgttggaggggttatgtgggaactctgtgtactttctgctcagttttgctgtggatctaagtttgcatttaaaaatattttatggcttggtggctcatacttgtaatcctagcactttggaaggctgaggcgggtggatcacttgagttcaggagtttgagaccagcctgggcaacatggtgaaaccccatctctatgaaataaaaaaaaaagtaaataatactaatagtaattaactgggtgtggtggcatgtgcctatagtcccaggtacttgggaggctgaggtcggaggatgacttgagcctgtgaagtggaagttgcagtgagcagtgatcatgccactgcactccagcctgggcaacacagccagactcggtctcaaaaaataataataataaaataaataatataaataaaaataatattttgaaagaaaagagctatcaagccacaaatgcaaaaggcttcaagttcctatcttttagaaatacatactaaaatatttatgaaggaaatgatatatctaagatttgcctcaaaataatactggagtggcaaagtgagcgggggagtagatgaaacaagattagcatgagttcataattattgaagttgaataaattgcacatgggcttcattgtacatttctgacagtatttgtttgaactttttccataataaaaagttttgtttgtttttttttttgagatggagtcttgctctgtcacccaggctggagtgcagtggcatgatctcggctcactgcaagctccgcctcccaggttcacgccattctcctgcctcagcctccagagtagctgcgactacaggcgtccgccaccatgcccagctaattttttgtaattttagtagagatggggtttcactgtgttagccaggatgatctcgatctcctgaccttgtgatccgcccgcctgggactcccaaagtgctgggattacaggcatgagccaccacgcctggccttttttttaaaatggtcttacaggtaataccatgcatgcttaagtcatcattctcatatttagctaccaagatttttcctttcggaaatccctcagtattctagtaccactttcctctcatttgacacttttcaaagcacctacacactcccttgagaaagatacctttttttttttttgcgagggagtttcactcttttgttgcccaggctggagtgcagtggcatgatcttggctcactgcaacgtctgcctcctgggttcaagcgattctcctgcctcagcctcctgagtagctgggattacaggcacgcaccaccacacccagctaatttttttgtatacttttttttttttaagtacagatggggtttcaccgtgttggccaggctgggctcaaacttctgacttcagatgatccgcctgcctcgatctcccaaagtgctgggattacaggcgtgagtcaccacgcccagcccaagaaagatacatttttaaaaacagctttattgtggtataattgacgtaaaatgtacatacttaaagtatacagtgtgatgttttgatatatatgtatactcttgaaaccaccaccacagttaaaataatgaaaatgtccattacctccagaagtttcttcatgttttgttgtaatctctccttctcctccctgattcctccccatccccaggcaaccatgttttgtcaccgcgcgcagccatttactattatgatactattttatataaatagtatcatacaggccgggcacggtggctcatgcctgtaatcccagcactttgggaggtcgaggtgggcgatgacttgaggccacctggccaacatgaaaccccttctctattaaaaatgcaaaaattagccaggggtggtggcgtgcacctgtaatctcagctcctcaggaggctgagacatgaggattgcttgaacccaggaggcagaggttgcagtgagctgagattgtgccactgcactccagcctgggcaacagagtgagtctctgtctaaaaaaaaaacaaaacatacagactcttgtctggcttctttctttcagcataattattttgaaattcgtccatgttatgtggttcctttttattgctgagttgtataccacagtttttgatctatttacttgttggtagatatttggattttcagttctgaagcattacagatagtggctgttacggatattcatgtacagatctttctttgtatgggcatatgctttaatttatcttgggcaaatacctaggagtagaatatgatccaatatggtaggtgtatatttaacttttttttctatctatctatctatctatctatctatctatctatctatctatctatctatttttaagacggagttttgctccatctggagcaaaggctggagtgcagtggcatgatcttggctcactgcaacctctgcctcctgggttcaagtgattctcctgtcccagcctccccagtagctgggattacaggcgcctgccaccacacccagctaatttttgtatttgtagtagaggctaggtttcttcatgttggccaggctggtcttgaactactgatctcaagtgatctgcctcggccccccaaagtgttgggattacaggcgtgagccatcacacctggccagtttttatttatattttttatagaagatggagtcttcctatgtttcacaggctgatcttgaactccaggcctcaagtgatcctcccgccttggcttcccaaagtgctgggattataggcatgagcctctatgcccagccttatatttaactttttaaggtactaccaaagaactttccaaactggttgtataattttacatttctaccagcagtatgagttccagttcctccacatcctgtcagtacttgatactgtcagtcttttaaattttttagctcttataaaaaggtatatagttacatctcattttggttttaatttacatttctctattgagtaatgatgttgagtttcttttcatgtgcttgtcatcctgatatctttggtgacttgtctgttcaaatctcttgcccatttaaaaattgctttcttaatggattttaagaattatttacatagtctggatacaagtcctctgtaatatatataatttgcaagtgttttctcccagactgtggcttttctttttattaacagtgctttttgaagggcagatttttttttttttttttaaagagacagagtcttgccctgtcacccaggctggagtatagtggtgtgattatagctcactgcagcctcaaactcctgagctcaaagaattcttctgcctcattcttccaaacagctaggactacagatgtgtgccactgcacccagctaattccgtttgtatttcattgattgtgtttttggtgtcacatcttaagaaactttggcctacttcaagttctcaggagttttttcctgcattttcttctggaagctttatagtttcatgttttacattaggtctgtgatccttttgaagttgattgttatacgtggtccaaggtatggatcaaagttcatttttctgcatatggatattcaattgtttcagcactgttttttaaaaaagactattttctccactgaagtgcctttgtacctttgcaaaaatcagttgtccatatatgtgtcaatctgttccatcagtcatgggtcaaaggctgttctcatggggaggcttttgaatttgaaaaactgaaactctatactcattggacaactttatacccattgaacaactccccattttccatttctctcagcccgtggcaatatgctttctgtttctataacatggactacttgagtttttttcttttttttgatgacaagatctcactccgttgcccaggctagagtgcagtggcatgatcttggctcatggcagccttcacctcctgggctcaagctgtcttcccacctcagcctcctgagtaactggaactacaggtgcactctatcatgcctcgctaattttttaatttttttgtagagacgagttctcgccatattggccaggctgatctcaaactcctgggctcaagtaatcctcccactttggcctcccaaaatacagagattatgggtgtgagccatcatgcccagctggctagatatttcatgtaagtggaatcatacattatttctcttttagtgacttgcttattttgcttagcataatgtcctcaaggttcatctatattgtagcatgtgacaagatttcctttttaagggctgaataatattctgtgttatgtatataccacatatctgtgagtagacatttgggttacttccacttcgtggctatactgaataatgctatggtgaaagtggctatgcacatatctgtttgaggtcttgtttgtaattcagttcgtttttatatatactcattggtatttatataaatgggattgctgggtcatatggtagtttaattttttgaggaacctccatattgttttccatggtggctgcaccattttacattcccaccaacaatgcatagtggttccaatttcttcacaactttaccaccgcttgttactttctgttttttggtagtggccatcctaacgggtgtagtttttttttgcatttttctaatgattagtgatgttgagcatcttttcttttttccccccatattacacagatgtagagcatcttttcatgtgcttgttggctatttgtatatcttctttgaagaaatatctgttcaagtcctttgcccatctaaaaaaatctgatgatttgtttttttccaattgtttaattgtaggacttttttttttttttttttttttgagatggagtctcgctctgtcgcccatcctggaatgcagtggcgcgatcttggctcactgcaagctccacctgccgggttcatgctattgtaggactttttaatgtattctggatattaatctcttaccagatatatgatttgctttttttttttttttttttcgatacaaggttttactgtgtcacccaggctggagtaaagtagtgatgtaatctgggctcactgcaacttccgcctcccaggctcaagcagtccttccacctcagcctcctgagtagctggaactataggcactcgccaccatacccacctaatttttgtattttttgtagagacggagtttcaccatgttgcccaggctggccttgaactcccaggctcaagcaatccacctgccttagcctcccaaactgctggggttgtagatgtgagctaccacacccagcctgatttgcagatattttctccagttctgtaggttgccttttcactctgatgactgcttcctgtggtgtgtagaaatttggtgtaggcccatttgtctatttttgtttttgttctttaatttctcttagcaatattttgtaagtttcattgtacaggatatttggggatctgtaagacaaccctcaggttcagtaatttgctagaaagactcaactcagagaatgttttatactcaaattatagtttagtacattgaaatgatatggattaaatttagcaacagaaaaagacacatagggcagggtccaggagacaccccaggctcaagctgtcaatagtcctctcccagtggagttgtgcacacagtgcttaatttttccagcaacagtgtatgacaacacacgtggaatattggcaaccagggaagctggctgagccttggtgtccgggtcacacatggctgacctcagttctctggccccttcagaggccaagctgatactgtgtgacacaaggccctcaccgtagatcacattattagcggaaacttgttggcatgacccaatgcctcatgtaaacagcgcagtggctgtttataggccgggcgcagtggctcacgcctgtaatcccagcactttgggaggctgaggcgggcggatcacctgaggtcaggagtttgagaccagcctggctaacatggcgaaaccccgtttccactaaaaaaaaaaaaaaaaaaaaaaaatagaaaaagaaaccaaaccaggtgtggtgataagtgcctgtaatcccagctactcgggagactgaggcaggagaatcactctaacctgggaggccaaggttgcagtgagccaagattgcgccactgcactccagcctgggcaacaggagcaaaactccatctcaaaaaaaaaaaaaagttaaatagaaaaaggacataaatgaaaaagcactcaaccatcctgataataagagaaatagatattaaatttatgccaagattccatatttctcccatcagattggtaaaaatctaagcacttgctaacataaggtgttagcaacagtgtggtaaagtaggcaatctcttgcattgctgattctctaaattggtgcaatccacagggagggcaatttggcatgctctcgttctctctctcgctcgctcgcgcgctctctctctctctctccatgagaaggagagagagagagagagagagcacgcgaacaagcgattgagtgagagagagagcacgtatctgcagtctcagctgctcaggaggctgaggtgggaggattgcttgagcctaggaggtcaacgctgtggtaagctgttgactatgccactgcactgcagcctagtgacagagaatctgtctcaaagataagaagaatgaggatattctttatgtactgatgtgtagaaaaatctctaagatacatagttaagtggagaaaacaaaatgctgcatggtgcatttactgtactaccatttgtgtgaaaagggggagtaagagtatgtgtttgtatttgcttgcatatgtagaaagaaactttgaaaggattcaccaaataacagtagtaagcagggggattaggaaactaggtatatattaagagggagcttttgtactctataccttttaatactttctttgagaccatgtgaatgttttacctatgtatttatttatttttaatttttgctttgcctgcttttaaacaaataaattgtactttttttgaagagctctatttttatttcctttcgattatcatctgtagattcttatgtcacattttactttaacagcacatttagacagaatacagtctttaaatggaagccgacaattgatttccctggaaaatttttgaagtacaataacatttgattgattgaactttatttagtaagaattcttagcaaaattccctcccaggcacacctacatggtgcttcattttcagtgaactacaaatctctgaaacccaaaactgcaatctaaaagtacaagatggctggactcgatggctcatgcctgtaatcccagcacttcgggaggccaaggcaggaggattgcttgagcccagaagttcaagaccagcttgggcaacatggtgaaactttgtctctacaaaaaattagccgagcttcacaaacaatcttacaggagtcattcattaattaactcaacaaatatttatagagtacaggagacactagagatccagcaaaggtcaataacatgtgctgtcttagagaaaacttatattctaagaatagtcaagtgacaaacaggagctacatcaaataatcacaagtacacttcagagaattaaaaccagatcaacgtagagaaaggcttccttacattcgatagtcaggaaattctctctctaccaggagggaactgagtgacaaggaacagtcaggtgggagaagggcattccagatgaaccagccctgagcggggaactagaaggccagtttgagaaaaggaatggagagaggaggaacagtttgtggtcagagcaaggaccaaaccattttagacttcatgagcctaagaagttttgattttgttatgagcatgacaagaagccattgtaatcgagttttaaacaaaggaatgacatgatctcattttgtttaaaaaaaaaaaatcatcctggctgtagtgtggagaatggactaggggagcataaaagcagaaagaccaattggaagcctattaacagtaatccaaatgatagataatagtggtttgaaccacaaagattatggacatagaaagaagcagatagatccaggagatgttttggaggtattctggcagaatttgctggctgactagacagaggtactaaggaaaagaatcaagaataattcctagattcgggacttcctagaaactgggagaatggtgctgctgtttattgagataaatggagaagacagaggagaagcttagaatagagttctaggagaggtcagagatggagatcaacatttgggagacagaattttctaattccatagtgccgacgattttctattgatagactaaaaatgtctggaattttatatgcagtttcatctggacaataccctaagaggagatcagttataccttggcacctgctaatagccataggaatatgtatatgtagaataaatggtaaaactactgaatgcttaatatgtgccagacaccgtgagatacgtctttgaagtactatcccagtagaatttacaacaaccctatcaggagatactttttttatcaccattttacagatgaagacactgaagttcaaagaggttaaataactcgccccaaatcacactatatagaagagaaatctaaatcctggtagtctgaccccagaacttgggctaattaccactatataatacagtgtcactggggtaaacccaagatatgataacataagttagagacttttaaattccaaatttcacacactatgatttcacccataaaatgtagtgattcagccatagtcttctgattagttggagtaccctatgcaatactttaggaacttgcttcttttattttcatatatatatatgttcattcataaattaaatctggacagccagtgaatctgccatttttgtctctaaccaacacttctgtcacaaaattgtacttttttttgtttttttttgagacggagtctcattctgtcacccaggttggagtacagtggcacgatcttggctcactgcaacctctgcttcccgggttcaaacgattcgcctgcctcagcctcccaagtagctgagattacaggtgcccgccaccacactggctaatttttgtatttttaatagagacagggtttcaccatgttggccaggctggtcttgaactcctgacctcgggtgatccgcccgcctcagcctcccagagtgctgggattacaggcatgagccaccacgcccggcccaaactgtgctttttttaaataaagaaattaaaacagtatttttttccttaaagatggtgtctcactacattccctggctcaaacgattctggctcaaacgaattcctaggctcaaacgattctcctgcgttagcctcctgagtacctgggactataggtatgtgccactattcctgaaaacataatcagttttgaaggtagtgtctgggctgggcgcagtggctcacgccttcaatcccagcactttgggaggccgaggtgggcggatcacctgaggtcaggagttcgagaccagcctgaccaacatggataagactccatctctactaaaaatacaaaaaattagccaggcatggtggcgcatgcctgtaatcccagctactcaggaggctgaggcaggagaattgcttgaacctaggaagcagaggctgtggtgagccgagatcgcaccattgcactccagcctgggcaacaagagtgaaactccgtcttaaaaaaaaaaaaaaaaaggtagtgtgtggccgggcgcggtggctcacgcctgtaatcccagcattttgtgaggccaaggtgggcggatcatgaggtcaggagttcgagaccagcctggccaacatggtgaaaccctgtctctactaaaaatacaaacattaagccggcgcagtggtggatgccgataatcccagctcctcgggaggctgacgcgggagaattgcttgaacctgagaggcagaggttgcagtgagccaagattgtgccactactaggcgacagaatgagactctgtctccaaaataataataataataataataaaataaaaataaaagtagtatccagcgtactacaaagaggaagagtttgtgaatgtgtatgttactgttaagttaaacagtgttctagtatccatctcattatcagccttgggcagggcagggttgagttggctaatgttcattataaaccagatcatccagttggggactctgaatgagcatatgattgcccctttcatgctagacttagctaattaaactgttcatatgacctaaaaggatggctgtggtgccatagaaagaaaacaagttttgaggcaagagactttagtttgattcctacctctgctgttttctggttgtgagatttttggatcagttgcttttgtgttcatttaccaaaacttctcaagacaaaaagaataaatgagataatgtgacagtgccttgtaaataccaaatactatatagagatagctattattacttgtatgtttattgtgaacattaatcagccaatcaagttgttcagacttgtactgctgaacatcaattgcagatataacattcttggcagatgacttagtcacctccttctgtggaagaatagaagatagacagctccttgctgtctatcacagtatgttctggtcccgttggcctcaccttccatataatcatttccattctactgggctttagccactctggtgacttgagttcagcaaaaataatctttcttgatgggtggtatatatatttctaccttttatgctttagaatagtttcctttccatttctcatagggtttggatcttcataactgtttgaagagaaatcctgacctccagactgaaggaaagcacaccatgcctttataacgccagcctcggtcttttttttgttcccctctgtcttagttccttttgtattgctataacagaataccgcagactgggtgatttatttatttatttattttgttgttgtcatttgttttcttcttttttgtatcttttgaaattcttttcattgttgttgttgttttgagactgggtgatttgtttattcagctcatggttcttgaggctggaaagcccaagagtatatggtaccagcagcacctgattatgccatggtggatagacagaacggcaagagagagcttgcttttgtaacaaagtcactcccatgataactaacctactcctgtgataacgacattgcaggttcagtatccctgatttgaaagtctgaaattcaaagtgctcccaaatctgaagctttctgagtatcaatgtgatgctcaaaggaaatgcttattggagtgttttagattttggatttttagatttggtatgttcaacctgtaagtataatggaaatattccaaaatgcaaaatctgaaacacttctggtcccaaacatttcagataaaggatactgaacctttaatccattcatgaaggcagagtcctcatgacccagtcacctcctaaaggcctcacctcttgatactaccacaatggcaaccaggtttccagtacatgaatttttagggggatcattcaaactatagcaccctcctttatcccttaccctattccattagttttaatccccactttgtctcttcctctaatcttcagtctacactgtgacatgataggtatgctcaagtctctaacagctctaaaataacgttttctgtttttttttttgtcttcatttctggtggggttggataagaaaagtttttcaagttaaatcactctctattgcaagcctcttccaccttttttttttttttttttgcttcgaagaatgattgcctttaccttctcagttctcagttattttccagcacattatgattttatgaccttgatacagaagggctgggctcctggctaaattccacccttaaacctggaactgcaaccctaagtgaaaacagctaaccccattttttttcccacccaaatgttgcctctttggcctgccatgcccctatcctgtgctcataaaaatatttcagctgggctgggtgcggtggctcactcctataatcccagcactttgggagaccgaggcaggtggatcacctggggtcaggagttcaagaccagcctggccaacatggcaaaaccgtatctctactaaaaatacaaaaattagttgggcatggtggtgggcaccataatcccagctacttgggaggatgaggcaggagaattgcttgaacctgggcggcggaggttacagtgagcccagattgtgccagtgcactccagcctgggcaaccgagtgagactctgtctcaaaaaaaaaaaaacaaaaacaaaaaagatttcagcagctgggagaacaatataagcagctgacgtcagggatataaatggctgtgtgttgggaatacaagcagctgattgtcggaaatacaagccactgagtgttggtgatacaagtggctgagcagcgagcagagaatcaggtgagcgttggagactatggatgggacgtggctaacttcagatggtgcagctttggagaataggcccagccggagatggcctggcttcagggaaagatcaccttcttcccataccatccctttttcaactccccattctgctgagaaccacttccatcgtgcaatacaatcttctgcatatactacccttcaatctgttcatgtgatctgattattcctggacactggaagagaacctgggtgccaagaggagagggcaggggctgccaccctgaccctccactgagctggctggcacctggccatccccgaatggccgcgttgaaggagcattgattgtaacacacttggatgctgctgcggggccgcatagagcctgcgcctgccagagaggagcaactggctggttcccgcattcgtttgctctgattcccacactcactcactcgcttgcacactgcctcttgcaaggggtttgagtgtgtggtggccgagtaaacgagccacgctccgagccatgagggggtcaagggaattatccagtctcatctcaatccgacttccctcttcactgttttacttttgtaaaacccttgatgaacttcccattgtcaattcagggtctttttagctctcatcctgccagactgttgataacacctctgatttgtgctccacttttggcttctgtgtcatattgattcctgagttttcttccttctcctctattctcttaatctcgttttctggttttctcccatcacctgctggttaagcttaggggttatttacacttctctccttggtcatctttttactgtatttttccctccacagctatttcatccatttctgaggcctgagatttcatccatttctgaggctatagagaccagtgacttcctctgactcttctgagcttgaaattcctattggtaactgccattggacttaactgcctggttatatctctaactaaagtacttctctcttccagcctgtttatcttattgtgttccattgtgttccttatctctaccaatgctagttccttatgctagaaatctcattcattgccactcaatcaagtttgctaaaaacgaaacatctgattgtgtcacttattcaaccttaccaatttttttttttttttgagccttgctttgtcacccatagtggcacgatctctgctcactgcagcctccaccacccaggttcaggtgattctcctgccgtagcctcatgagtagctgggattacaggcatgtgccaccatgcccgactaatttttatatttttagtagagacggggtttcaccatgttggccaggctggtctcaaactcctgacctcaagtgatctgcccaccttggcctcccaaagtgctgggatttcaggcgcctggcctgttacttgattatatgctaaacaaggggtggattattcatgagttttctgggaaagaggtgggcaattcccggaactgaggatccctcccctttttagaccatacaaggtaacttccggacgttgccatggcatctgtaaactgtcatggtgttggcggggagtgtcttttagcatgctaatgtattataattagcgtatagtgagcagtgaggataaccagaggtcactctcctcaccatcttggttttggtgggttttggccagcttctttattgcaaccagttttatcagcaagatctttatgagctgtatcttgtgctgacttcctatctcatcccgtaactaagagtacctaacctcctgcaaatgcagcccagtaggtcttggccttattttacccagcccctattcaagatagagttgctctggtccaaacgcctctgacacaaggattttaaagtcttattaattaaggtaagatagttccttgcatatgtggtctgaaatcacagaaagctgaatttgaaaaaggtgcttggagctgcagccagtaaacaagttttcatgcaggtgtcagtatttaaggtacatctcaaaggataagtacaattgtgtatgttgggatgaacagagagaatggagcaagccaagacccaggtaaaagagaggacctgaatgccttcagtgaacaatgatagataatctagacttttaaactgcatacttcctgtacattgttttttcttgcttcaggtttttagaactcatagtgacgggtctgttgttaatcccaggtctaaccgttaccttgattctgctgagaatctgatttactgaaaatgtttttcttgtgcttatagaatgacaatagagaacggcaggagcacaacgacagacggagccttggccaccctgagccattatctaatggacgaccccagggtaactcccggcaggtggtggagcaagatgaggaagaagatgaggagctgacattgaaatatggcgccaagcatgtgatcatgctctttgtccctgtgactctctgcatggtggtggtcgtggctaccattaagtcagtcagcttttatacccggaaggatgggcagctgtacgtatgagttttgttttattattctcaaagccagtgtggcttttctttacagcatgtcatcatcaccttgaaggcctctgcattgaaggggcatgacttagctggagagcccatcctctgtgatggtcaggagcagttgagagagcgaggggttattacttcatgttttaagtggagaaaaggaacactgcagaagtatgtttcctgtatggtattactggatagggctgaagttatgctgaattgaacacataaattcttttccacctcagggccattgggcgcccattgctcttctgcctagaatattctttccttttctaactttggtggattaaattcctgtcatccccctcctcttggtgttatatataaagttttggtgccgcaaaagaagtagcactcgaatataaaattttccttttaattctcagcaaggcaagttacttctatatagaagggtgcacccttacagatggaacaatggcaagcgcacatttggacaagggaggggaaagggttcttatccctgacacacgtggtccctgctgctgtgttcttcccctactgactagggttagactgcacaggctaaactaattccaattggctaatttaaagagaatgatggggtgagtgctttggcaggagtcagggaagagcaggtagcaggtaactggaatgagggtggagcaggtaatggaaaaacattgctttacgaggaagttaagtttaaaagtagaaggcaaagaattgaacatactggcgtattaattctttgaaatttagaactcacatctaacattggcttaaatgttaaatcctcaaagataacattcctgtttctcctaacacgattaagtccttcttggtatcttttctcatagcaacttgtcctttctcacttgtcacaatttgcaaatatatatttatttacattgtttatttaatgcctaatttccttctttattgcaaggcctgtgagggtactgagtctccagggtgaggtgtataataaatggccaaacgaattgttaattgaaaggatgaacaactaattcaagccagcactctctagactcctggggggctatcatgtgggttccctggtgctgctgatgtcagcccttggcctccaagaaaaatgcttgattcaaatgtcatctagttccatctctacgactctcatggggtccaaagaagagttttaattgagttttagaatttgaagttgtgaagtgtctgaaaaactacatggtgttctgaaagccaaacttttagccttttgggagagcatctaagacagcaggtgaagggcaggggttagaactagagggattgaagaatattatccatataggttagggttaggtttggcaacgtattatagaacaaacattggcaagctacagccacaggccagatctgtctgctacctttccacaaaggtgtaataacaaagttattcacaaatttgtgaataaactttcattggaaagtgaccacgctccttggtttatacattgtctgtggctgctttcacactacagtagcacagttgagtgtttgcactggagaccatatgacccatagagcttaaaatattcagtctggctttttacagagatgtttctgactttgttaatagaaaatcaaaacaactggtttaaataatgcacatactttctctctcatagagtagtgcagaggtaggcagtccagattagtacggtggcttcacgttcatcaaggactcaatctccttctttcttctttagcttctaacctctagcttacttcagggtccaggctggagccctagccttcattctgacagtaggaaggagtaggggagaaaagaacataggacatgtcagcagaattctctccttagaagttccatacacaacacatctccctagaagtcattgcccttacttgttctcatagccatcctaaatataagggagtcagaagtaaagtctttttggctgggaatattggcacctggaataaaaatgtttttctgtgaatgagaaacaaggggaagatggatatgtgacattatcttaagacaactccagttgcaattactctgcagatgagaggcactaattataagccatattacctttcttctgacaaccacttgtcagcccacgtggtttctgtggcagaatctggttctataacaagttcctaataagctgtagccaaaaaaatttgatgaggtattataattatttcaatataaagcacccactagatggagccagtgtctgcttcacatgttaagtccttctttccatatgttagacattttctttgaagcaattttagagtgtagctgtttttctcaggttaaaaattcttagctagattggtgagttggggaaaagtgacttataagatacgaattgaattaagaaaaagaaaattctgtgttggaggtggtaatgtggttggtgatctccattaacactgacctagggcttttgtgtttgttttattgtagaatctataccccattcacagaagataccgagactgtgggccagagagccctgcactcaattctgaatgctgccatcatgatcagtgtcattgttgtcatgactatcctcctggtggttctgtataaatacaggtgctataaggtgagcatgagacacagatctttgctttccaccctgttcttcttatggttgggtattcttgtcacagtaacttaactgatctaggaaagaaaaaatgttttgtcttctagagataagttaatttttagttttcttcctcctcactgtggaacattcaaaaaatacaaaaaggaagccaggtgcatgtgtaatgccaggctcagaggctgaggcaggaggatcacttgggcccaggagttcacaagcagcttgggcaacgtagcaagaccctgcctctattaaagaaaacaaaaaacaaatattggaagtattttatatgcatggaatctatatgtcatgaaaaaattagtgtaaaatatatatattatgattagttatcaagatttagtgataatttatgttattttggatttcaatgcctttttaggccattgtctcaaaaaataaaagcagaaaacaaaaaaagttgtaactgaaaaataaacatttccatataatagcacaatctaagtgggtttttgtttgtttgtttgtttgttgaagcagggccttgccctgtcacccaggctggagtgaagtgcagtggcacgattttggctcactgcagactcaacccaccagtttcaagcgattctcctgcctctgcctcccaaatagctgggattacaggtgtgtgccaccacactcggctaatttttgtatttttagtagagacagggtttcaccatgttgaccacactggtctcgaactcctggcctcaagtgatctgcccaccttggtctcccaaagtgctgggattacaggcatgagccactgcgcccggccctaagtggttttaatattttgattgacagtatactgaagaaatatactctaagacctttatgaatctcctcattcacaaataacactgtaggatataatggtccctataaaatacggtataactaaaatcagatttttatattggagtacagaacaataaagccatcttcagatgctggtattaaactcactggtgactggtcacaccttgcctaaactggtagccaccatgcatcctctcaccatctccactgtactacttccttccttgggaagtcgggcgctgggaggttgtacaggaaagatacagacccacccttctcagcctctcctcccctagctcgctcttttgccaaagtgacctactgctgagtttcaaagtgacctactgctgagtttcagccaactagcacgtttcagattcataccttagaaaaaattacacattatcacaagtcatgcaccttttaaggtcattttcaaataatagaaattataagtgttcggccaggcatggtggctcatgcctgtaatcccagcactttgggaggccaaggcaggaggattgcttgaggtcaggagttttttttgtttttttgtttttttccccgagacgaagtctcgctcttgtcccgcaggctggagtgtgacagcgcgatcttggctcactgcaagctgtgcctcctgggttcaagcgattcttctgcctcagccccccgagtagctgggattacaggcgcctgccaccacacccggctaatttttgtatttttagtagagactgggttttaccgtgttggccaggctggtctagaactcctgacctcaggtgatccacccacctcggcctcgcaagggctgggattacaggcgtgagccaccatacctggccgaggtcaggggtttgagaccagcctgagcaacatagtaagacctatctctaccaaaaaaaaaaaaaattaactttccaaatgtaggagtctactctgtttccttctagtatttatttctgtatacttttctaacatggttaaaatgtgtaatcaatatgtgtccttttactttggtgtgaacattttttctattataaattcttagaaaatatttctatggctatgagatatttgattcaagtgccttgtaatttacttctcaaatgtccctgatgttggacatttgtttctagtgtttcactattttaaaaaacagtaatatctgtctttatgcttagagctttttcagtttttcaaattatttccttagggtaaaatcctagaagtagaatttttggggcaaattatctacatatttataactgtcttggtattcaaaatctcgttttcaaaaagcttatatcaatttgtacttaacaccagtagtgaatgagagtatctgtcgtaccccaccagtgctgaatttcttttttaaaactgtgctggtttttataggtaaagaaaatgtcttaatttgcatttagttggttactagtaatatcacataccttttcaatgcttgtgaactttaagcttatacagagtttaaccttgcatgttgaacatttgagtgagtggaagtgttaagtgatggccatctgtataatctattagtaatgtatggagaccattaaagatgacaggtatgtgtgatgatgacaggttgttaccaacactcagaaggccaaaaagcaagtgatataaacccatgctgggaagcattcacctcccccactttaaaaatgctagtttcttaattccttttctttatccctttttttgtctgcacgtgtttacttgcctttagtttccctgctttagtaggctgaccttgtgacttttaccaggatcccattatacttttgttcttctgtttatttctcagattttattggagggtggaattctactttttctttcttataatctagaatttacattcagatttcctgcctttcccttacaaaatacctgtgtagttggataggtggagctctggactcagagttctttcttctagtaatcttaggaaattatttaatttttctgtgttttcatattttcacacataaaagagaaaacaccatttctaaactacctcttcttttctctgcttttaagcatgtaaaggttttcccaatcttgggcagtgacatgtacaggacagtatagctttacatctgccttgttttaattaaacactagttctttgaggtaacccctactattatcccagttttatggatgaggcactgaggcaggggtcacacagctagtgtgggtcagaacctaatgggtcagaatggacatttgagtccagagtttggcctggattgacacacatagctattacgtaagattcctctcaaattcagtcctcagctccctgaagtgtgggttctcttttcatgcctccatggaaactgcgtatcatgtggttaccagtttttcctttggtcgtatctgctgacctttttgaacctaattttttctggaccttattgccatttgacttatttattgcctcccacttgacactgattctggcttttgcttttcttcctactttggtcctttttgcagttttctaaagctaaccagccatgactctcagatgatggactttttcgtctctcccattacttcttgggaaattatattttaatctcatggtttaaattttcatccttaaatataacttttaatgtagtatttttagcccagaagggcccatggttggtttgttttctcctttgcatatctcttctactcagatacctggtagcatataaatcaaatgaattatccttcataccatttcattatcatcagtaggactgctttgctggggtttttttgtgtgtgtgtttttgtttttgtttttgtttttgttttgagataaagtcttgctttgtcacctaggcaagagtgctaggattacaggcgtgagccgctatgccaggacagccgttttcttctagtattatttgccctctgtctgaacatcttcctttagtaatgcttttagagcaaggcagctggcctcaatttgttttaatttttcttccccttaggatgttttaattttacctttattactgaaggatattgttactgggcagaaaattgtcttgatattccccttttcagcatttaaaaaatgctcttctgctttctttcagcctccatggtttctcataaaaatcagtcattcgaatcactgttcttctaaaagtaatacattgttttgttctggtcactttcaaaattttctttttcttttcagcagtttaattatgggactgtgtgaggatttctttgttcattctgtttggagttcactgagctttttgaatctctaggtttatgtcttttaccaaatttggaaaatttttcaaccattatttcttcaaaatttttctgtaccacattctttactctttttttttttgaaacagagtggcgcactgcaacctctgccttcccggttcaagtgattctcctgcctcagcctcccaaagtgctgggattacgggtgcctgccaccatgcctggctgattttgttaatttttagtagagacggggttttaccacattgaccaggctggtcttgaactcctggccttaagtattccgcctgcctgggcctcccaaagtgctgggttacaggtgtgagccaccacacccggcccttttttttttttttttttgagaccgagtctcgctttgtcacccaggctggagtgcagtgatgtgattttggctcactgcagcctcagcctcccaagtacctgggattacagagatgtgccaccatgcccagctaatttttgtatttttattagagatggggtttcaccatgttggccaggctggtcttaaacccctggcctcaagtgatccgtctgcctcagcctcccaaagtgctgggattacagacgtgagccaccatgcctggctctttaccctcttctgggagtgacaacacaaataactttttattccacaggtttctgaggctctgtttattttccaatttttttcactattgttctggttagataatttctattgatctgtcttcaagtttcctgaaatttgcattttgttggtaaacctattcagtaaaatgtttttggttattttatttttagttctaaaattcctatatagcccgtctttacatttttttattctgaaacttaaaactttcctttcattttaagagtgtttgcccttacttcttggagcatttttatgctccaaggattttgatatttttgttttattggccaattgatctgattgggctaggtccagccagccttgtcaaagcctttgcagtgttgctcagatctgccccatgtatatgccacccagtcaccagtctgggactggtatagtggtgttctatttgtaattcggttgtcagggtcggtgtgtactgttgaggatcatatccatactcactcaccttgggaatggacccacaagtttataaacagctttaagagattgctttcatgagtttctttctttctgtgatctccatgtggtttcttgggcttcccttttccattcctgcagccaaaagtggactttatcttcctaaagtcagggccaaaatgtgggaggagagagagaaataaagcaagggctatttgccccactctctcgggactgacattcttccagtcagagtaaggattccctccctctgaattttaggcttctgccacccacattaccatcaccacaggattgtgtgaggactgggcatacgagaatggagaaaagcggaaaagaatgccgggtgtggtggctcacgcctgtaatcctaacactttgggaggccaaggcgggcagattgcctgagctcatgagtttatgaccagcctgggcaacacagtgaaaacctgtctctactaaaatacaaaaaattagccaggcatggtggtgggcacctgtagttccagttactcaggaggctgaggcaggagtattgcttgaacccgggaggcagaggttgcagtgagccaagatcgtgccactgcactccagcctgagctacagtgcgagactctgtctccaaaaaaaaggaagaaaaactggatttttacactgtctgggtgttaggagacctctttcctgatcctcaagccagaactagaggtcttctggagctcccattgtcttgctaatgcccactcatgttgtaatgagcacaggtggaggaaaaaaagtggtcagctcactgctagtacttctaattccccagcccacctacctctcattacttttcatcttttgcaaccagctgctgcctgctttctgcccaggttttgtaactgtattcagtgggatagagagagtggaaggtacttactccatcttatctggaacctttcttaatatattttttgtcgcatttgtacatcttttatccatccttcattttattttatttttttttttgagacggagtctcagtctctcgcccaggctggagtgtagtggcatgatcttggctcactgcaacctccgcctcctgggttcaagtgattctcctgcctcagcctcccaagtagttgggattactgggacacgccaccatgcctgggtaatttttgcatttttagtagagatgagggttccccatgttgcccaggctggtctcgaacttctgacctcaggtgatccactggtttcggcctcccaaagtgctgggactacaggcctgagccaccacgcccagccttatccttcattttagacagtttaagaggtttgtattcagccagatctccacatttacttgttcatttgtgttgtgatgttttttaatgttcaagtcttagcacacacaaacaattatatagaaacaagttgtttactttgacacccagtataactaaaaggatcttttgagtcagagattgagtaacttgccagagcctgtttggaaataaaccctgaggatttttcatatcagtggttggttatgcaatgtctgtggcaagccctagaaactaaaagaccaaaccttaaaatgttaaaaacaggaaaggcagttaattattatacataatttgttataaaaggaactataacttattaaagtcagatgatttctggccttgatagtttagggtttagagaagatactgttgtgtactataaaacagcagggctgttttctttcataccctttagcacaggaaagctgaactagggatttttgcaagatgagaaaggcctgttgaaatgtgtgtgtataacatagtaataaaagaaatgcatatgaaaataacaaattaacatatttgacatattgactttgtcaagattagtcttttttgtcaagtaactaagccagtgtgtattaattaaatcagtaattagaaaaagtttgtacactttgatttagtaattttgcttttatgatatattctaaagaaggaattagaaatgcagaaaaatatttgtgaagtaggatgttcattttaatgtaaattaaaattggggaaagaaagggaaaacaatacagattccatgcataaggcaaaggttcaattgtgggtttatccgtatgagtagactattattttgtcatttaaaaatcatagtttcagctgggcgtggtggctcacgcatgtaatcccagcactttaggaggctgaggtgggcggatcacctgaggtcagaagatcgagaccagcctgaccaacatggagaaatcctgtctctactaaaaatacaaaaaaattagctgggcgtggtggcgagtgcctgtaatcccagctactcaggaggctgaggcaggagaatcgcttgaatctggggagtggaggttgcggtgagattgcgccattgccctccagcctgggcaacaagagcaaaactccatctcaaaatcaatcaatcaatcagtcaatcaatcatagtttcacgccaggtgcagtggcacggacctgtagacccagttacttgggaccctgagacgagatgattgcttgagcccaggttttccagtctagcctgggaaacatagtgagaccccagtctcttaaaaaaaaatcatattttcaaataatatttggtggcatgagaatatgtttgtaataaaagattacatttgtgaaagcagaatgtaaacagtacactagttgattctcactgttaaggtctttacacacgcctatacgtgcagatagaaaacatgtctgaaagggaaacggttttattttgtttcgtatttttttttgagacaatgtctcactttgtcagtcaggctggaatgtagtggcactgtctcggctcactgcaccctatacctcctgggttcaagcaatcctcccacctcaacctccatggtagctgggactacaggcacctgccaccacgcctagctaatgttcgtatttttagtagagacggggttttggcatgttggtcaggctggtcttgaactcctgacctcaggcaatccacctgtctcagcctcccaaactgctgggataacaggcgtgagccactgtgcctggcctgaaagggaaatgttggtattaattttggttgtcactggcctttagaatagttttcttcttttagtgtttctgtgtttcttaagtgttacaagcatatgttacttttgattcagaaaaatgctatttttaaaataagcaagactgggcacggtgactctcaccagtatggctgagaccagaggatcacttgaagccaggagttcaaaaccagcttgggcaacagagtgagacccccacctctacaaaaagaaaaaaaaaaaattaaaaaattagccaggcatggtggtgtacccacgcctatagtcctaggtactagggaggctgaggtgggagtatggcttgagcccagtggttcgagattgcagtgagctacgatcatgccactgtaccccagcctgggcaacacagtgaggccctatctcaaaaaataattaaaaaaaaaatatttgggggctcctagaaggtacagttaaaaaaattaaaattaggccgggcatggtggctcacgcctataatcccagcactgtgggaggctaaggagggtggatcacttgagatcaggagttcaagaccagcttggccaacatggtgaaacttcatctctaatacaaaaatcacctgggcgttggtggtgggtgcctgtaatcccagctactcgggaggctaaggcaggagaattgcttgaatctgggaggtggaggttgcagtgagccaagaccatgctactgcactccagcctgggcgacaaagtgaggcttcatctcccaaaaataaataaataaaattaaaaaaagaaataaataagaacatctccttcttcctttgccaaaaaaccgaggtgaaaagcatctctcaagaatgatgagaatttcaattatttaatatttactctggtccttaatttaaagcttaatatggaatcccagtgtacatctcccactggtattgtttgtcttggccaagacagacaagttttaaagagtgagataaaatttaggctaaagttgaagtatttggagggaaatgtacagatgttctcagcttaccttttttgtttttttgagatggagtctcgctctgttgctcaggctggagtgcaatggtgcgatctcagctctccacaacctccgcctctcaggttgaagtgattctcctgcctcagcctcccaaatagctgggactgcaggtgtgtgccactatgtctggctaatttttgtattttttttttttaatttattttttattgataattcttgggtgtttctcacagagggggatttggcagggtcataggacaatagtggagggaaggtcagtagataaacaagtgaacaaaggtctctggttttcctaggcagaggaccctgcggccttccgcagtgtttgtgtccctgggtacttgagattagggagtggtgatgactcttaacgagcatgctgccttcaagcatctgtttaacaaaacacatcttgcaccgcccttaatccattcaaccctgagtggacacagcacatgtttcagagagcacagggttgggggtaaggtcacagatcaacaggatcccaaggcagaagaagttttcttagtacagaacaaaatgaaaagtctcccatgtctacttctttctacacagacacggcaaccatccgatttctcaatcttttccccacctttcccgcctttctattccacaaagccgccattgtcatcctggcccgttctcaatgagctgttgggcacacctcccagacggggtggtggccgggcagaggggctcctcacttcccagtaggggcggccgggcagaggtgcccctcacctcccgggcggggcggctggccgggcggggggctgacccccccacctccctcccggacggggcggctggccgggcagaggggctcctcacttcccagtaggagcggccgggcagaggcgcccctcacctcccggacggggcggctggccaggcggggggctgatccccccacctccctcccagacggggcggctggccgggcggggggctgacccccccccacctccctcccggacagggcggctggccggccggggggctgacccccccacctccctcccggacggggcggctggccgggcggggggctgacccccccacctccctcccggacggggcggctggccgggcggggggctgacccccccacctccctcccggacggggcggctggccgggcggggggctgacccccccacctccctcccggacggggcggctggccgggcagaggcgcccctcacctcccggacggggcggctggccgggcggggggctgacccccccacctccctctccgacggggcggctggcctggcagaggggctcctcacttcccagtaggggcggccgggcagaggcgcccctcacctcccggacggggcggctggccgggcggggggctgacccccccacctccctctcggacagggcggctggcctggcagaggggctcctcacttcccagtaggggcggccgggcagaggcgcccctcacctcccggacggggcggctggccgggcggggggctgacccccccacctccctcccggacggagcggctggcggggcggggggctgacccccccacctccctcccggatggggcggctggcctggcggggggctgaccccccccacctccctcccggacggggtggctgccgggcggagacgctcctcacttcccagacggggcggctgccgggcggaggggctcctcacttcccagacggggcggctgccgggcggaggggctcctcacttctcagacggggcggccgggcagagatgctcctcacctcccagacggggtcgcggccgggcagaggtgctcctcacatcccagacggggcggcggggcagaggcgctccccacatctcagacgatgggcggccgggcagagacgctcctcacttcctagatgtgatggcagccgggcagaggtgctcctcacttcctaggtgggatggcggccgggcggagacgctcctcactttccagactgggcagccaggcagaggggctcctcacatcccagatgatgggcggccaggcagagacgctcctcacttcccagacggggtggcggccgggcagaggctacaatctcggcactttgggaggccaaggcaggcggctgggaggtggaggttgtagcgagccgagatcacgccactgcactccagcctgggcaccattgagcactgagtgaacgagactccgtctgcaatcccggcacctcgggaggccgaggctggtggatcacttgcggttaggggctggagaccggcctggccaacacagcgaaaccccgtctccaccaaaaccagtcaggcgtggcggcgtgagtctgcaatcgcaggcactcggcaggctgagtcaggagaatcaggcagggaggttgcagtgagccgagatggcagcagtacagtccagcttcggctcagcatgagagggagaccgtggaaagagagggagagggagaccgtggggagagagagggagagggagagggagagcgcttaaaacaatttttaagatgtatttcttttctcatagttccagaggccagaagtcccaagtcaagggttggaagcaatttttgtatttttagtagagatggggttcaccatattggccaggctggtcttgaactcctggcctcatgatccgcctgccgtggcctcccaaagtgctgggattacaggcatgagtcactgcgcccgatctctcagtttactttgatatgtattaataataacaaagactaatggatgaggagctagacagaaattttataaaccaagtactgcaaaatatgaatggtagactctaggtgatatatgggtgttcactgtaaaattaattaaattttgctgtgtgttcgaacatttttgtaacaaaatgttggaaaatttttgtggaagaacaccagaaacaactttgttgtatctggatataatttagaatattcaaatgttggctaggtgcggtggcaacctgtaatcctagcactttgggaggccaaggcaggtggatcacctcaggtcgggagttcgagaccagcctgaccaacatggagaaactgtgtctctactaaaaatacagaattagccaggtgtggtggcacatgtctgtaatcccagctacttggggggctgaggcaggagaattgcttgaaccctggaggcggaggttgcggtgagccgagattgcgccattgcactccattctgggcaacaagagcgaaactccgtctcagaaaaaaaaaaagaatattcaaatgtccaaggagtaccaatatctaggtaaagccattctgttggcctttgccaaattgtactattttataaagttgttttaaagagagatgtgggccgggcatagtggtgcacatctgtaatctcagcactttgggagtctgaggcgggcggatcacttgaggtcaggaatttgagaccagcctgggcaacatggcgaaaccctgtctctactaaaaatacaaaaattagcctagcgtggtggcgcgcacgcgtggttccacctactcaggaggcttaagcacgagaattgcttgaacccaggaggcagaggttgtggtgagctgagatcgtgccactgcactccagtctgggcgacaaagtgagaccctgtctcaaaaaagaaaaaaaaaatctgtactttttaagggttgtgggacctgttaattatattgaaatgctttcttttctaggtcatccatgcctggcttattatatcatctctattgttgctgttctttttttcattcatttacttggggtaagttgtgaaatttttggtctgtctttcagaattaactacctttgtgctgtgtagctatcatttaaagccatgtactttgttgatgaattactctgaagttttaattgtttccacatataggtcatacttggtatataaaagactagtcagtattactaattgagacattcttctgttgctccttgcttataataagtagaactgaaagaacttaagactacagttaattctaagcctttttgaagattatatagtcttctagtagaagtctgtgcatcagaatgttttaagaaagggttttaagaatgtataaaaaccaaaataattgattttcatacttctatattgttttttatcagtgactcttttttctttcaaatgaaatcttatatgaaattttcatatataatatagaaaaaagtggatctagtctgtcaaagagaatagtgaagctcagagatgtgccagcctggcctttttctcagctcaagtggcagaatacagtttgtaaacaattgcactagctcttaaattcgaagaggcagtcaaactaataaataaattggagagttatttctttggtagaggattaagggaaataaccacagacagaagaagcaaatatgagaatctatgtgaaatggatgatattctagaaaaaaaattatcaaaactgacccctaaagagagaatatctaaacagagtaaagaagaggtacagaaagttactgaagaagtttccaccccacctgcacaaataacaatagtaccaggccccagtggattaatggggaaattctgttaaacctttaaggaatggtaactctaatactaagtgttccgaacatataaaaagaaaaaaagcttccagattaattttatgaagccagcataacattaataactaaagccctgcaagttatcaagtaaaagaaaactattggtcggttatatttattgatttcaaaagcataacagaatattaagagaattcagcaatagatgaaaagaataatactttttttttttgagtctcacgctgttgcccaggctggagtgcagtggcatgatctcggctcactgcaacccccacctcctggattcaagcgattctcctgcctcagccccctgagtaaccgggactacaggtgcgcaccaccatgcccagctaatttttgcatttttagtagagacagagtttcaccatgttggccaggatggtctcgatctcctgacctcgtgatccgcccgccttggcctcccaaagtgctggaattaacaggcctgagccaccgcaccctgccataataatacatttgaccaagtggagtttgtttgcagaatcgttcattataagttgccatattactagatcatcatctctgtatgtgctaaaaggcatttgataagattcctgttcttgatcagattccttaataaatagacggggtcgggtgtggtggctcatgtttataatctcaatactctgggaggctaaggtaggaggatagcttgaggttgaaagttggataccaacctgcgcaacataacaagactttgcctctacaaaaaataaattagccagttgtggtgtgtgcatgtagttctagctgcatgggagactaaggcgggaggatggcttcagcccaggaattcaaggctgcagtgagctatgattgcaccactgcaccccaggctgggtgactcagtctctaaaaataaataaataactaaatctctaacattataaaatgtatgcatctcattctaaaggccaatgtcatcctcatagggaagctagaagcttgcctattaaggtcaggaatgagatggaggttttcttttctttcttttgtttgtttgttttttgttttgttttttctgagatagagtctcactctgtcatccaggctggagtgcaatggtgtgatctcggctcacaggaacttctgcctcctgggttcaagcgattctcctgcatcaaggcctcccaagtagctgggattacaggcacctgccactatgcccggctaatttttgcatttttagtagagcaggggtttcaccatgttggccaggctgttctcaaactcttgacctcaggtgatccacctgcctccgcctcccaaaatgctgggattacaggcgtgagccactgtgcctggctgagatgaaggttttctttatcaccaattatctagcattgctctggagggactagcaaacacaattaaacaggagaaagaaatacgaactatataatttggaaaagaaggttaaattaccaatatttggagataaaatgattgtttactttgttttagaactaactgaaaaccaattcaaattactaagtaagtttggtaaggcaattaattgattacaaaattaaacaaaagtcccctgtctgggtgccgtggctcatgcctgtaatcccagcactttgggaggccgaggcgggtggttcacctgaggttaggagtttgagaccagcctggccaacgtggtgaaaacccacctctactaaaaatacaaaaaattagccgggcgtggtggtgggtgcctgtaattccagctactctggaggctgaggcaggagagtggcgtgaacctgggagatggaggttgctgtgagccgagatcgcaccattgcactcccacctgggcaacaagagtgaaactccatttcaaaaaaataaagtgaaaacacaaatcaataaccttcacataaacaactagttagaaaacataataaaaggataagtcccatttatgatagcagcaaaaaagattaaatatctacgagtaaacaagaattgtgcaagccctggacactggtgaagcagagatgccagctgaggtcctgcccccagctccccttaagctgagcagtgtggagaacatcttgcacaggctgctgactgccttccaagaagcccttgacctttaccatgtgttggtctcccttgaccgggtgggcactgagcagtagcaggtgtagactgagctggcctctaacttcctttggatccacagccagttgtaggccaacaacggggtggaggggtctgatgtggctccaggccctctccagctcaggttacccctccttatgtacattgtactcagagctgctagtgcaggctgtgcagaggaaggcaggggacactgaggtccagcagtccctgctcctgcttctgaagaaatagatattttaagtgaataaactgacagcttagaggggtaaaaaagataatatgcaagatctattgagaattttaaggctgggtgtggtggctcacacttgtaatctcacctatttgggaggccgaggtgggaggatcctttgagcccaggggttctagaccatcctgggcaacatggttgaaactccatctctacaaaaaatacaaaacttagccaggcgtggtggtgcatgcctgtagccccagctgcttgggaggctgagtcaggaggatcacttgagccaaggactttggggctgcagtgaactgtggttgtgccctctatccagggtgacagtcagaccttgtctctatttaaaaaaaaaaaaaaaaaaaattaaaatatgctatcatttgtgtcaagtagaaaagtatatatatgacatgtatagactttctggaaggatgtacatgaaattaatagtagtgctttccaatcaggcacggtggctcacacctgtaatctcaacatttttggaggtggagacaggaggactgcttgagcctaggagttcatagccagcctgggcaacatagcaagaccccatctcaagaaaaagtagtgctttcctctaaagaggggaaccatggggcacagtggggagaaaacctacttttcacagtatctgttgtgaattttatatcttattcatgtgttacctggccaaagattaataaatagattgtttttgtttttgttttttagtttgaggatactggaaatgcttaatataaatatctacatcgtccagaaatttcaatgtttactctattttggaatttcaaagtgggagaggaatcatctttttggatggtacctgaaactgaaagtttatgcctaaaggcgtgcttgctttctcctcagttacctcaggcatcttctacagttgcaatctctttgttgttagatggtggattttgcctccccagaattaaaatagcattttcttcattataaaaatacttaacattcattgtttttttaaaaaagacattatataagattataaagaagaaaaatgaccagattcccaccacctaaagataagtcctgtcatcctttcaggaattaatatatcaatttctcatctactcttctctcacactactttgcataaatgggatcataaatgggatcctatattttttcaagcaacagtgtgttatgcctatactccatgtttatatgtgtgtattaaaaaatgtatttgtatatatgtgtatgtataagtgtgtgtgtgtgtatgatgattcttctcccgctttgaaggtgaaagaaagcacacctttatttaagcataaactttgggtttcagatactgtctggaaaaatgatttatctcccactttgaaattccaaaatacgtacatatattttttttttcttttcttttttagttttagggtcttgctgtgttgcccaggctggagtgcagtagtgtgatcatagctcacacagcctctaactcccaggctcaagctatcttcctgccccagcctcctgagtagctgggactgcaggcatgtgccatcaactttagctaattttaaaatttttttgtagtgatagagtctcactgtgttgcccaggctcgtctggaattcctggcctcaagtgatcctctcacctcagcctcccaaattgctgggattagagtgtgagccactgtgcctagcctgcatatatctatttttaatgactgctaaatctcattgtatgaaaatttatgtcctagctataaaatttgttagcacatgtttaattttttctaatttcagatgttttaaactaatatttcccaaagtatagtatggcattttaggtatgatatgatcttttttcctcttcgtactcatttttatagttatggcctgtgcaactggtttcccatttatatgaatgatacagagcttcctattaagaaaaagttcagcttgggaaaaaaaaagtgaattgttcaacttgagggaaaaaagtgaattaattggccaggcaccgtggctcatgcttgtaatcccagcactttgggaggctgagacgggtggattgcttgaacccaggagttttagaccaacctgggcaacatgttgaaaccctatctgtacaaaaaaaattagaaaaattagctgggcatagtggcacacacctgttgtcccagctacttaggaggctgagctgggaagaccacctgatctccggaggtaaagactgcagtgagccgtgattgcaccactttactccagcctgggcaacaaaatgagaccctggctcaaaaacaaaaacaaaaacaaaaaaagagtaaattaatttaaagggaagtattaaataaataatagcacagttgatataggttatggtaaaattataaaggtgggatattaatatctaatgtttgggagccatcacattattctaaataatgttttggtgaaaattattgtacatcttttaaaatctgtgtaattttttttcagggaagtgtttaaaacctataacgttgctgtggactacattactgttgcactcctgatctggaattttggtgtggtgggaatgatttccattcactggaaaggtccacttcgactccagcaggcatatctcattatgattagtgccctcatggccctggtgtttatcaagtacctccctgaatggactgcgtggctcatcttggctgtgatttcagtatatggtaaaacccaagactgataatttgtttgtcacaggaatgccccactggagtgttttctttcctcatctctttatcttgatttagagaaaatggtaacgtgtacatcccataactcttcagtaaatcattaattagctatagtaactttttcatttgaagatttcggctgggcatggtagctcatgcctgtaatcttagcactttgggaggctgaggcgggcagatcacctaagcccagagttcaagaccagcctgggcaacatggcaaaacctcgtatctacagaaaatacaaaaattagccgggcatggtggtgcacacctgtagttccagctacttaggaggctgaggtgggaggatcgattgagcccaggaggtcaaggctgcagtgagccatgattgcatcactgtattccagcctgggtgatagaacaagaccttgtctcaaaaaaaatttggtttttcaagctttttgaggttttgacaagctggccaatatggtgaaaccccgtctctactaaaaatacaaaaattagctgggtgtggtggcgtacccttgtattcccagctacttgagaggctgaggcaggagaattatttgaacccaggaagtgaagtggaggttgcagtgagccgagatggtgccactgcactctagcctgggtgacagagcgagactctgtctcaaaaaaaaaaaaaaagcaaaaaaaaaaaagcacaagcagagtggtagacacacaaaatgctcaattcattttttaaacgatttttttcctttatatcttactgcagaagcttttttcttttttttgagacaaagtcttgctgtgtcacccaggctggggtgcagtggcacagtcatagctcactgcaaccttgaactccctggctcatgcgatcctcccacttcagcctctcaagtagctagaactacaggtgtgcaccaccatgcctgactaacttgtttattttttgtagagagaacgtcttgctatattgcctaggctggtcttgaactcttgggctcaagcaatcctcctaccttggcctctcaaggtattgggattataggtgtgagccactgcatctggcctcaattcacttttaaaatcaaaattaggttacctactttttataaggtaatgtatagaattattcttttaaaaataaaaccgatttggacagtgtgagattcacattctgtaaccaccagtgtgacatgggtcctgaacagttagaacatactccagccattaacccaggcagctttcaggtacgtactctgtggctgttgccttgtatgaaagccaaaaagagatccattttcagagattaatatgtgaccccttctatattataaggccatggccatactcttttttttttctttttgtttttttcttccaaagacaggatctctctctgtcatccacgctagagtacagtggcatgaacgtggcttactgcagcctcaaacccttgtcctgggctcaaacaatcctcccacctcagccttcaaagtagatagaactacaggcatgcactaccatgcctaattttttaaaaaaaaattttttttcagagatgagatctcactgtgtttcccaggcttgtccggaactcctggcctcaagcgatcctcccaccttggcctgccaaagtgttgggattacaggcatgagccaccatgcctggccatacactttttttttttttttttttcaagacggagtctggctctgtcgcccagactggagtgcagtggcgtgatcttggctcactgcaagcttcgcctcccaggttcatgccgttctcctgcctcagcctcccaagtagctgggactacaggcatctgccaccacgcccggctatttttttgtatttgtagtagagacggggtttcaccatgttagccaggatgatctcgatctcctgacctcatgattcacctgcctcggcctcccaaagtgttgggattacaggcatgagccaccgtgcccggcctggccatacacttttgtcattatttacatacttactaaaatgtttggtggcctgtaataggaaacatcatcctcatttgattgacgaagaagtctgtggaaataggattgaactggttctgttcttgtatttgagtaatcagttgtggaactatagaagtcatatactctctctgactttcataattaccttatgttgtatagtacttgatggtttgcaaagtaaccatctattcttgcttagctgtgagtaagaatgccaggtctggagacagaatgtctgggttcaaattctactcatcactttttatttttattttttttgagatagagtctcgctttgttgcccaggctggagtgcagtggcgtgatctcagctcactacaacctctccctcccgggatcaagcgattctcctgcctcagccttccgagtagctgggactacaagtgcgcaccaccacgcccagctaatttttgtatttttagtagagacgaggttttgccatgttggccaggctggtctcaaactcctgacctcaagtgatctgcctgcctcagcctcccagagtgctgggattacaggcttgaaccactgcgcccagcctactcatcacttactagctatttgaccacacaagttactcaactcctatgtcagttatgaagattaaattaaatgatccatttaatacaataatacacttagaacaatgtctatcagtaaatttttttctgttttaagaaacaggatctcactctgtctcccaggctggagtgaagtggcacgattatagctcactgtagcttcaaaagcctgggctcaagcagtcctcctgtctcagcctcccgagtagataagactacaggcacaggttggtgttgacctcctagcttcaagcagcctcccaaagtgctgagattacaggtgtgagccactatacccagcccagtgttatatttttgtataatcctatgaagtatcaaggcagttattatccctgttttactgctaagaaacttgaagtttacagaggtaaattatttgcctaagcctaaactctgatctcgaatctgaatcccaagtccaatattcttttcaccgtattacaatatttttaccatcaaccctccattctgtctgcacatcatacaaatgagtatctctacagagctttgagttgcttttaaacaaaagagatttttgtacccaatgtttagagtagtgattctcggctccatttttacaagatttcaagatttaatttgtcaaaaaagttctgaaattttcaaagcaaaagcaattttaatttaattgctctaaaaaataagcagatttatcatttagcaattctttaagggagagtgtatcataaaactgaaatagtactgaatgtggcagaatcaaacaagttgaaaatctcatcacttcagagcagggcagacttctcattcaaacaaattgaggtagaagtggtgagagtagagatttctttgtgtatgtgtgttttattactgtactatattatattatagttctatatatactatattatattgtacatatatattattatatgaagagacatgaccactttgaggcatgaaatttttttttttttttttttttttttgaggcacggtcttactttgtcacctaggcagtggcgccatcttggctcactgcagcctccacctccagggctcaagcaatcctcccacctcagcttcctgagtagctgggactataggcacctgccaccatgagctgctaattttttgtatttttggtagagacggggttttgccatcttggccaggctggtctcaaactcctgagcacaagtgatctgctgcctcagcctccccaaagtgctggaattacaagcataagccactgtgcctggcaagacatgaaatttttaaatgtaaatgcatttaagtgacaataatgtgaatacaagttatcaattcttcctttacaagtttagctatacctgttttatatttttcagtgtttaaaattatttttatatttttatattctgaattttctttctttctttcttttttttttttttttttgagacggagtctcgctgtattgcccaggctggagtgcagtggcgcaatctcggcgcactgcaagctccgcttcccgggttcacgccgttctcctgcctcagcctcccgagtagctgggactacaggcacgcgccaccacacccagctaattttttgtattttttagtagagacagggtttcaccgtgttagccaggatggtcttgatctcctgaccttgtgatccgcccacctcggcctcccaaagtgctgggattgcaggcgtgagccactgcgcccggcctatatgctgaattttcatgacagagaatgaaagaaaaagtgcagttgatcgaaagaaatggtggtataaacaggaataacaggcatgttgtttcctctctgatttattatttttgtaaaataagctacttttcagcaccacatacatatgttctgagacctgaatatttgtgaccaaagagtaaagaagtaataaactttatctcgcaaagagttattattgtgttttatttaaatttactgccctcttacttcaagtacttctcagtagtacgtaatactgcttttaaaaaggagaagggatgaatttcttctactctgctcttcatattttgaaaagttcagtcaaatcccctttattaaattcatctcagagtaatctttttaatttgtagttcatatccgtgattagtttagaagtgacttctccctgtttctgctcactgtaggttgacaactgcttaaaatagtctatctcatcattatctctgcagctttcctttaaactaggaagacttgttcctataccccagtaacgatacactgtacactaagcaaatagcagtcaaacccaaatgaaatttttacagatgttctgtgtcattttattttgtttatgttgtctcccccacccccaccagttcacctgccatttatttcatattcattcaacgtctttttgtgtaaaaagagacaaaaaacattaaacttttttccttcgttaattcctccctaccacccatttacaagtttagcccatacattttattagatgtcttttatgtttttctttttctagatttagtggctgttttgtgtccgaaaggtccacttcgtatgctggttgaaacagctcaggagagaaatgaaacgctttttccagctctcatttactcctgtaagtatttgagaaggatattgaattagtaatcagtgtagaatttatcggaactgaagcacatgtaactatggtcattttcatggtacttgttctcatcttaaatgcacagcattcctggaactcctgcagatctctttgtttccttgcaagcaattgtcttctacctgatgttgattcaagagagttttcaatatgaatagaaagaaagaaaatgtttagatattggggaaccagcattcccattttaaaacctgttaggagttgttgattagggcaagctcaaggattcctttgagtgactggtttagatgtctttctgctattcggtgaccactggggaactgagattgttgagcagaagggtaatgtgagcagagccgtgcctttgtaagctggcagcactgtgtgagatgaattggtgggttggatactgagatcatgagaggcatactaagcataattaagatgatattgccatgatctaggtggaaagtaatgggggtttgaattatggtagtggcagtagcaatcaagggaaagagttgatcagaggattcagaggtagaatcaatagttctagcaactgaggagagaagttgtaagcttgaaggaaaggtgatgaagaaaaaatgctttcctgtgttttcttgttgttgttgttgagatagggtctcactcccatccaggatggagtacagtagtgtgatcatggctcactgcagcctcgacctcccaggctcaggtgatccacccacctcagcctcccgagtagctgtgactacaggcacgcactaccaggcctggctaatttttttgtgttgtgtgtagagactgggttttgccatgtgcccaggctggtcttgaactcctcggcttaagcgatcctcctgccttgacttcacaaagtgcttgagttacaggtgtgagctaccacgcctggccatgttttcttgtgtgaaggatctgtttagttttatatctttctgtggctcatatctaatttagttgacagtacctgtgggtcactaggtagacattgctagcagacgtttagaaatgaaatactagagcttgggaaaaagttgatatttgagatagagacttgaagaacattagcagagagttggtagttaaggtctgtgagctggtgagcaattcaaataaaagcagaagagaagaggaagacaagggtcaaactttgtcaactactgtgtttagagaatgagacaagagaggatactacaggaagtagaggaaaatagtggaaaattgggcaagccagtatttttcacttaagaatatcattactgttttttgatgtcagcacatgaaatggctgcatagtgttctcttacgtagatattcagtggtgggtatcctcattgatagacatttagatcatttccatttattttctatcacagacagcacttacagagtgcatccatgaacttatgaatattattataaaatgtattcttacagtagaattgctaagtcaaaggatgtatttaaattttgatagtttgccatattgcctcctaaaaaagctgtgcctgtttacattcccttcagtaatatgaaagtatcaatttccttacccctttggtgttttggtttgttttgttttggagactgagtctcgctctgtcatgcaggctggagtgcagtggtgcgatctcggctcactgcaacctccgcctcctgggttcaagcagttctcctgcctcagcctccggagtggctgggattacaggcgtgtgccaccacacccagctaattttttgtatttttagtggagacacggtttcaccatgttgaccaggctggtctcgaactcctgacttcaggtgatccgcctgcctaggcctcccaaaatgccaggattatagctgtgagccaccatgcccggccactgctttgttaatgcttgcctgtgtctgtgcatacatgcatgtgtgtgtgtctgagagagaaagagatctaataggcaaaaaaataacatcttgttttattttttattgtttgtctaatgctttgggtgattatttgaactttttttcatgtgtttcttagttacagatctgaatttattttgtaactggcttggtataatctttttcatatttgtgaaattaatcttttttgtgtgtgtgtgagacagtctctctctgtcacccaagctggagtacagtggcgcaatctcaactcactgcaacctccatctcccaggttcaagcaattctcctctctcagcctcccaagtagctggaattacaggcgcatgccaccacgcctggctgatttttgtatttttagtagagacgggatttcaccacgttggccaggctggtctcaagtgatccaactgcctcagactcccaaagcattagtattacaggtgtgagccactgctcccagccctgtaaaattaatcttaattatacaagtaattcattatccttgaaaaaggataaacattacagataaaaataaatttcacggtaactatcatctctaatcttaatgccttatcaagtacttacccctgttgtcagtttgttgtatatccttgtagattttttttgccaatttttctgttgagttactggaaaagcagtttcaagaaggagagaggctgggcgtggtggctaacacctgtaatcccagcactttgggaggcctaggtgggcggatcacttgaggtcaggagtttgaaaccagcctggccaacatggtgaaactctgtctttactaaaaatataaaaatcagctgggtgtggtggtgcacacttgtaatcccagttacttgggaggctgaggtgggaggatcacttgaacccaggaggcggaggttacagtgagccatgatcgtgccactgcactccagcctgagtgacagcaaggcttcatccccaccctcccaaaaaaagagaatatctttttgtttgtttgtttgtttgtttgtttgtttgtggcagagtcttgctgtgtcgcccaggctggagttcagtggggcgatctcggctcactgcaagctccgcctcctgggttcagccattctcctgcctcagcctccccagcagctgggactacaggcacacgccgccacgcccggctaatttttgtatttttagtagcaacggggtttcaccatgttagccaggatggtctcgatctcctgaccttgtgatccgcccgcctcggcctcccaaagtgctgggattacaggcgtgagccaccgcgcctggccgagaatatcattttttataaagaagtcaaaggtaatgaggactaagtaaaaccatacagtatttgctgtctaagatgtcattagtgacattgaagagagcagtttcagtagagtgatagaaccagaagcagtactccaaagggaaggtgcgtatgtgtgcatgcatgtctctgtgttttgccagtgctggcagtggaagtgatggtgtaggcagagaatgggtggtgaagaaggagaggtatagtaaatgtcatgtactacatcaaagattcctgtctcacaggcagagcaggtggtgacctgacaggagaacaggtttcaggaaaggtgtttcaaggagagggaaggttccattttattttatttatttattttttttgaaacagagtcttgctctgttgctcgggctagagtgcagtggtgtgatcttggctcactgcaacccccgcctcccaagttcaagcaatggtcctgtctcagcctccggagtagctgggattataggcacccaccaccacatccggctaatgtttgtatttttagtagagttggggtttcgccacattggccaggctggccttgaactccccacctcaagtgatccacctgcctcggcctcccaaagtgctgggattacagacgtgagccactgcacccgacctgttttattttatttttgaggtaagtcttgctctgttgcccaggctggagtgcagtggcgcaatctcagctcactgcaacctccatctcctgggttcaggcaattctcctgcctcagcctcccgagtagttgagattacaagcatgcgccactatacctggctaattttttttttccatatttttagttgagccacaggttgggagaagggaaaatacattctactcaaagtgagtccgtggcaaaagtgtgagtacagagatgggtgaggaattaggaccagactttcagtctgcagcaacattaaacatgtatgttaatttaatactcagaaagaagcatttactctgttttaaaatatctatcacatactatatatatatatatatatatatatatatatatatatatatatattttttttttttttttttttttttttttttgagacagtcttgctctgtcacccaggctggagtgcagtagcgtgatctcgactcactgcaagctccacctcccgggttcacgccattctcctgcctcagcctcccgagtagctgggactctaggcgcccgccaccatgcctggctaattttttgtatttttagtagagacggggtttcaccgtgttagccaggattgtctcgatctcttgacctcgtaatctgccctcctcggcctcccaaagtgctgggattacaggcgtgagccaccgtgcccagcctatcatatataatatttttaaaactcaacgtctgtgctcgctttagcagcacataatagtaaaattggaatgatacagatgatttgcatgtatttttttaaaagttctcaagtctatttaataaccacagaatatgagacattctgagatgttttagaaacagttcaacatatgtgggaaaataggagtataaacccttacctcctgtgtagatcaggtaggttcaagattgcatctgttcttttgtaatactaaatgtctggtgaagatttgaggattttatataaatcattgagtttgagaggtttttttgtttttgtttttgagatggagtttcactcttgttgcccaggctgaagtgcaatggcacaatctcggctcactgcaacctccgcctcccaggttcaagcgattctcctgcctcggcctcctgagtagctgggattacagacgcctgccaccacgcccagctaattttttgtatttttgtatttttagtagagagagggtttcaccatgttggccaggctggtctcaaacttgtgacctcaggtgatctacccgcctcaccctcccaaagtgctgggattacaggcatgagccaccgcacctggccttcgttttgttttttcaacagaatgtaagaattttttcttacatttttcttacatttttaacagaatgtaagaaaaccacaacgcaatgccgatgagtactttttccctgaagtggatataagcatgaatataaaaagttttaaatcagtcatcctggctatttgttctctaaaaatcaataaataattctttcatgcattttaatactgtctcccagttaagggtattcagtttgcaaaatgctcttactgacaggaaatgtatgagcatttttgttttttacttctgtcgtttgacagaaaaaatatacacctactctttgagctaatttattcttacctagtggtcattagtagaagtggttcactctgggagcttaactagaagggaaactaacaattccttgaggtagatcattttatctaaagctttttgatttcatatcagttgggggcgggtatattatgttaatttttaaatctgcatattttccagccaggcatgactataatcccaggactttgggaggtagaagcaggaggattgcttgagcccaggaattcaagaccaccctagactacattaaaaaacatatttttttgtatttattttttattttatttttttgagacagagtttcgctctcattgcccaggctggagtgcaatggcacgatctcggctcaccacagcctccgcctcctggattcaagcaattctcctgcctcagcctcccgagtcgccgggattatagacatgcaccaccacaccgggctaattttgtatttttagtagagacagggtttctccatgttggtcaggctggtcttgaactcctgacctcaggtgatccacccacctccgactcccaaagtgctgggattacaggtgtgagccaccatgcctggcctttttttttttttttaatttaaacgaaatctgcttattttcctgttgatgtaaggtgtttgtgttaaggtgaaatgaaaagtgatttttaaaaaaatattattttaggactatttaacaaatatactatttatgataattaacatggggttagcaaactactgcttgaagccaaatatggcccatggcttgtttttgtacagcttataagctaaaaatgctttttacatttaaaaaaaaaaaaaaagaacaaggaagaatatgtgacacacaaaacctgaaatgtttactccctggccatttacagaaaaagttagctggacattgattttcatgttactattaactgctaaaacaaaggagcttgtagctatattttttcatacttgcataaagaaagaaaacctaataaatcgctggtggcttcatttccaaaaggctatggaaatccataaacaggctgggtgcagtggctcatgcctgtaatcctagcactttgggaggctgaggcgggaggattgcttgagcccaggagtttgagtctggcctgggcaacgtagtgagaccctgtttttagaaaaaatgaagataaaaaactaatccataaacctcatacttggtggttgcccttcagtttttcttctttagatctggatttagttaaacagtgtattgcctgcctggtttctgttaacttttgatcatttggttgggttatcctataatgaaacttggttgacctcagaaataacaaggtggtcgttcagcttctttgattgtgtgtttctttcataagttcttcaagaagcctgagtattagaaacatggataaaattattgtgataaaaagccagagagacataaatgtcaagtatcttgtttaaaattactgtgaccaggccgggcgtggtggctcacgcctgtaatcccagcactttgggaggctgaggcgggcggatcacgaggtcaggagatcgagaccatcctggctaacacagtgaaaccccacctctactaaaaaaaatacaaaaaattagccaggcatggtggcgggcgcctgtagtcccagctactcgggaggctgaggcaggagaatggcgtgaacccaggagacggagcttgcagtgagccgagatcatgccactgtactccagcctgggtgacagagcaagactctgtctcaaaaaaaaaaaaaaaaaaaaaaattactgtgaccagattggactcagcttgctgctggcatttggttcccaccataacctcatatgtcatgtgtttgcttatatgtacttttgtgttattgttggtgtatcttcaggataagttccaaaatgtaatattgctgggttaaaggattaatgcacatgtagttttattagatgttaccaaatttccctccagtggggattataccatttttcattcctgcctgaaatatatgagagaagcaccattttaaagttttcacaatgtctctgaactaaaatgtggtagagatgcacatgtgtatatctagatctagattgatatattgatatacatgtatttttgtagaaggggcacagaggaggcctcttgactatccctattatgtttattgcttttaacgttttttctcacgccgggtttaaaacatggtttagcattattgaacattctaaaaatgagacataatatgaaggaaatttactctgtgcatcttttgaattataatcaccatctgaggcttttgtgagctccagtttgtcctggaatttagaacattcaactagtccagctattgtttcagtggaatcttgctggcctgaacagttttccttctggttccttttcagggactaaaaatgatgaagagttttgtgatagcaggtgcagtttgagtactacagtaaacattcagtttcagaacttcttctcttacctgctaaaaccaaagagaaccttttttttatttttacttctgattgttgaacagtcttaaggcagcattaggaagactggcgatttgtgtggagaaatgatggcttgttgttgtctatgcatactttgtgtgtccagtgcttacctggaattttgtctttcccaacagcaacaatggtgtggttggtgaatatggcagaaggagacccggaagctcaaaggagagtatccaaaaattccaagtataatgcagaaagtaggtaacttttattagataatatcttgatttttcagggtcactgttataagctaacagtatagcaatgtttttatcgtctttctttggtcatagactcctttgagaatctcttgagaactatgataatgcccagtaaatacacagataagtatttaaggagttcagatactcaaaacccaacaatacagtcaaagcatcctaggttaagacacctcccattaaatacagaataccagcatggaaaggttcaggctgaggttatgattttgtttttgttttttgtttgttttttataagtcatgattttaaaaagaaaaaataaactctctccaaacatgtaaaagtaagaatctcctaaaagaaacaaaaaagaaacagacaataaaggaaaaataagtaaacaaaaaaagcaaaatataaacaacataaaaatgagaacctcttgtctaacatggccagaataactgaaatatgatttgagatgtgctgatgtgtatactgagaagatcaaatattctaggtggatatgactttttagaagaggataagaatgacttaggatgagctgggtgcagtgatgtgtgcctgtagtcccagctacatggccaaggcaagaggatcacttgagctaaggagttccggattaccctgggcaacttataccttacctcaaaaataataataataatgaataataataatgacttaggataagagagtgaaaggccctctaaggatactacagaacatattaaggagaacacaagttagaagttgttattagatggagttgagggggagctttcattcagttttctggaatggaggctaccttcccacacacactaaaaaaaaaaagaaagggttgaggaataacagcacaatataaatagtctaaaaaaagggctaacttttatgaggaatctgaaaaacaacaggcacagtaaatattggtgaggaaaaaaaggccttaattgagttgctgtttgtcaggaaagggagagtttatgttttataaagccaggaaatctacagagttagcatttaggcaactgcaaggaagatactttcaaccaggaattcctatttggaactcagagatgtgagtctttattatacagtaagcaaggcagcagaacaaggtcatgttagactctcacgggatccttagggtgtgactttgctagccagaaacctctgtggctggtggcaccttttcctgagatttgctcaggcccactgggctcattccacctactcagcctagctggctatgcttggctttctctaccagctggaccccatgcctgccaaaggcaagccaggcatggagcagcgaggagtgcatgagcaagtgagtgcagggtccagccactgcacacagccaggcatgctggctgcagcagggcaggcagcctcaggtactagctccctgctgcagctagaccaggcattacctaagcagctttgactacaggccactaccactagtaaacctgatagaaaagtaagaaatatactggaaagaattgccacaagcctggctcttgtgttaaccttgtgttaacctggggaacacaggggcacccagaagcttggagatgccaggaactgcagaaccccaaagaggggggtcatagccctggcttagggaactcctgagtctggactccccgaagggccacatctcttcactcctctcttctctccttctcgccacctgcaacgtggcaagtggggggcacgtttcagccctgtttgtcttacggttctttcaatcctgccattcaatgggtcccaagttcttgtcctgcatccaggaagaatgaagtacgtggacagctggagggagagcaagatgaaaaggtgctttattgagcaacagtacagctctcaggagaccctatctgcaggcaggtcgtcccattgtctctgcagctctcagtggagaggagacctggagtgggtagctcctgtctgcaggcaggtcatcctgatgtctgtaatcctcagtggagaggagacccggaatgggtatctcctatccacaagcaggtcatcccatcatctctgcagccctcagtggagaggagacccggagtgggtagcttctttctgcaggcaggttgtcccttcatctgcccaagtctgactgagtctggggtttttatgggcttcagaggggaggaagtacatgctgatgggtccatgggtggccatgagcaggcccagaaaatgcaccataagttctcactgtggtctgtggaactgggagcttggcctccaggcttcaggctttccctgacttgaggtggtgcttcaccagggaacttcccctttccgcctaggagcctgtctgcctcctgctgccatcaacctgctgtctatagctcccatggcacccaggctgttcatgccaaagggtgcctgcaggcccacggtaagctgccttcagcccctcctcagtctccctcccatgcttgtcagcacccaaagtccagagggggccaaggtggcagggggctggcatgtcagtgctgccccaagcgcccgcacacccggccaggtcatgacagcacccagcctcagccacaactttgctctgaaatcggagcctgcagacgcaaggggcttcctggacccctgagagcacagggatgcccaggtctacagccacagctgggaagctgcagctgtgggagtgcgggacttctgccccaccaactcagaagggggcaggactcccgcctgttcctggctcctgccagctcacagagcatgctgccccagctgcacctcccctgctgcagctgccatctttgcagcagccactccagatgggccgctgctgccatcaagaccactagtaaacctgatagaaaagtaagaaatatactggaaagaattgccacaagcctggctcttgtgttaacctgtgttaagctaaagaaaatcaaatgattgtctgtgagcatgtaggtatatatgtatgtgagtgagtgatacaacagaatttcattcattttacagatgttgactgagcacctgactatgtgctaggccctggggatatagcactgaacaagatttcccctgcccttgtggagcttatagtctatttggagagatagatggtcaacaaattattacataaataattcatacagttgtgataggtactacaaagaagacgtataagttgctatgaaagtttataataggggaattttacgtatcctggaaagtcaaggggtgcttccctgaggaagtggtaataggggacggcccgctgaaggatggaggaagagctttccaagagagggacaacatgagcaagggctttgaaatgagaaggctggatgaactgcaggcttcctcagtgagaatgctgctggtattttggggggcacagttctttgtgggactttccctcatattgcaagatatttaacatccctggcccctcacccactaaatgccaataatggctttaaggctttgcaataatcaaaaactcctccatcctagttatttccaaacactccccggaagggaggtgctatccctagttgaaaaatcactgtgttaacggaactagaagttacattggaacaaaagggcatagggctccaagagggatatctgtgtaaggaaaaaacaaacaaaagaactgagagattacctgatgtggttgagctctgtcagagcatttcaggataaattagtcatagataataatataaaattcatcagtggaaaaaaatgaggcagttttccaaagaaaacaaaaacttgctcaaaaaagcaaatgtaattatagtatattctggctatagcaaagtagtttagttgtgaatattatttgcatagtgagaatataaagctgaatttaatataaggttatggcactgggaagacaggaagagttacatttgcgtgcactaaaggatgagacctaatgctttatcttctctataggaggtgaataagtacctcaaattaaaacatcaagttatggcacaatgagcatgctacttataattaattatggaggtaaataccaaaagggatggctaaaagagtttaaggtaggaatgagtatcagaagtgaggagggagggggtagaaaagggactgctgttttcatttataaatcttattcttatattatttcataaactccaaaccagagaagattcaggtttttggagatctggataataaaaagaatacaaaactatcaatacaaaattgtgagggctctcccagaggaagccatgcaaggaagggccctgaagcttacaagctttacttattcatggcaaatctacttctgctctgaacatgtattacttttataaaaaatgaaggaagaataaaagtactttgaacttcacttatatattttaattatttttaatgtatggaagttttttaagactatcatgctcaccattttcaatgagattgatagtcattataatgaaatgactggcccataaagacattcactccccgctcctttcccaatccaccctccagaatgaagccacttttataattttgtcaccaaatccagggatgagtgccaacagttaggaagctttcagttgcaaaagataaaaagcccaactcagttgccttaaacaaagaagaaatttattctttcacgtgacaggaaggcctgaggtgtaggcatttgaaatttgtagggttggttaatttggtggctcagggatgttttcaagtagcccaacttcctactctaccatcactagtttataggcttggtcttcagcccactgctcttcgtggtcatgacagctgtagttctaggcatcatgtctagataaggcaacattcaggggtagaaggggactgtttattttttcctttagtctctcttaaagagtgagaaaaattttcccaggaatcccggtggactttgcttcaccactcataggttcataccaagttacaaccccacaaccttagagcttttgttaggaagaggcttggtgggattaccgtgcttggcttggcttggtcaggattcaccaccagagtcatgtgggagggggtgggaacccaaacaattcaggattctgccctcaggaaataaaggagaaaatagctgttggataaactaccagcaggcactgctacagcccatgctttgtggtttaagggccagctagttacaatgacagctagttactgtttccatgtaattttcttaaaggtattaaatttttctaaatattagagctgtaacttccactttctcttgaaggcacagaaagggagtcacaagacactgttgcagagaatgatgatggcgggttcagtgaggaatgggaagcccagagggacagtcatctagggcctcatcgctctacacctgagtcacgagctgctgtccaggaactttccagcagtatcctcgctggtgaagacccagaggaaagtatgtgcatttctctatgttgcaaagtcatggattcctttaggtagctacattatcaacctttttgagaataaaatgaattgagagtgttacagtctaattctatatcacatgtaacttttatttggatatatcagtaatagtgctttttttttttttttttttttttttttttttttttttttttgagacagagtctcgctctgtcgccaggttggagtgcaatggtgcgatcttggctcactgcaagctccacctcccgggttcaagtgattctcctgcctcagcctcccaagtagctgggactacaggcgtgcgccaccacgcctggataatttttgtatttttagtagagatggggtttcaccatcttgggcaggctggtcttgaactcctgacatcatgatctgcctgccttagcctcccaaagtgctgggattacaggcgtgagccactgtacctggcctcccttcagactttttaagttggcattttacagcctgaccttttggcatttattttataaagtaaaagatttgtttttttaattgttccagtaagccttcatggccgtaatacatttgtctacaaaaattttattaatatgtctcactctgctgtagagagatctgtggatttgcatgatacaaccttgtacattattattccttttgttgacaagtgctatattttattttaaagaaaatcaaagggatttaggatattggcagaaatgcaagtatttcttcagtgtctaagatgtgttgccacttgatggatttaagttaacacttagggcttcttaggaacattatcagccactaaagccctttggttagggctcagtcatctcttcagttagtcttagagatgtggttcattgaataagactttagcatattttccaaccaagttatttttggttgtcttgtttttgcaagagtgaaacttgattaaaacattacaacaagaatattaagtagttttaaggaaacaaacacctaggttccttagcatctttaatcattagtcactaattattatgaccttgacatatccatcagtttgaggagaacactttttacaccttgtcctcagttttttaactgagtcagaactttcactgggcatgttcatgactttactgcttggctgagttttccagatatcaaagcccagctgcagcctgtgactttcacactcctggaaaagtagacgtatctgcctgctcttacagcaggctttagcttgcctttgctgggactttgttctgccctcagttaccacagtaattaggttgcctcttctactttcctcttttctcacaggcaccaggagccagaggaaataacataatagttgttgaccagagcagcagcataattctttcatgactgccttttctaatttgacgattccctctcctgagagggctctttgtgtcctcctcctcttcgtctccaacttttaaaaaaaaaaaagtgaaactatcaagtattgctcctgctaacttcagatcagtattttctttctctgaagccaatgcaaagtaataacggacgtgcttcatcatcttagcattcagcacacgtgtcaccatctctgatggtgtgagcatgttaaaccagacttgtgggtacttaccaaaaggttcagttgacactataggtcagttgctaaaaggcacaaatgtcttctaaagcaatctgttaaaagtcaacatttaacatttaattagaaaactgatcaaaggatctgaatgtttagttctcccaagaaaatgtaaaaatgatctgtaaacacataaaaagatactcagcatcattagccatcaaggaaatgcaaatcaaaaccacttcatactcactagattggctataataaaaaagatagacaataacaggtgttggtgaggatgcgaagaaactggaatcctcatacactgctggtgggaatgtaaaatagtatagtgattttggaaaacagttcggtagttctttgaaagattaaatatgacccggtaattctactcctaggtatatactcaagagaattttaaaacatatgtcaacacaaagacacatatacaatggtcatagtaatattgttcataacaggtaaaaacagaaacaacccacatgtctattaactgataagtggataataaatgtggtatattcatacaatggaatattacttggttataaaaagaaacaatctatcattagtacacttaggatgagcttgttactggcatgttggctgtgggaagtatatcttgaaattcactaaaagaccaactattgctgggcgcagtggctcaagcacctgtaatcccagcactttggaaggccaaggcaggcggaccacctgagatcaggagttcgagaccagcccaaccaacatggagaaaccccacctctactaaaaatacaaaattagcccattgtggtggcacatgcctgtagtcccagctactcaggaggctgaggcaggagaatcacttgaacctgggaggtggaggttgcagtgagctgagatcataccattgcactccagcctgggcaacaagagcgaaactccatctcaaaaaaaaaaaaaaaaagaccaactaccttcacaataaataaaaatgtcttacatttctaattaaaatttttgttcagttttattattcagctttaaaaaggaagggaattctgacatgttacaacatgaataaatcttgagtactttgtgctaagtgaaataagctagttacaaaaagaaaaatactgtatgattccacttacatcagagtagtcagaaagtagactggtggttgccaggggttaaggggaggggaaatgaagggtcgtttaatgggtgtagagtttcagttttacaagatgaaaagagttctgtggatggacgatggtaatggtagcacaatgatacgattatacctagtgtctttgaacggtgaacttaaaaagggttaagatgttaaacttgatgggtatcttaccacagttaaatttttattatttttttattttttgagacaatttcgctcgttgcctagggtggagtgcagtgctgggatctcagctcactgcaactctgcctcccaggttcaagcgatactcctgcctcagcctcccgagtagctgggactacaggcacacatcaccatacccggctaatttttatatttttagtagagacaaggtttcaccatgttggccaggctggtcttgaactcctgacctcaagtgatctgcccacctcagcctcccagagtgctgggattacaggtgtgagccactgtgcccggccaaaaaaattttttttaaataccgttaagaagtggaaaataaggccaggtgtggtggctcacacctgtaatcccagcactttgggagaccaaggttggtggatcacctgaggtttggagtttgagaccagcctggccaacatggtaaaacctcatatctactaaaaatacaaaattagccgggcgtggtggcgcatgtctgtaatcccagctattcgagaggctgcggcaggataattgcttgaaatcgggaggtggaggtttcagtgagccgagatcacttaaaaaaaaaaaggaaaataagctaccagctgagagaaaatatatgcaaatcatattgaagtcctgttaaaggacttgtatttaggatatataaaggatgcttacaacttaatacgaagacgatagcccaaatttaagatagggaaatgctttgactagacattctaccaaaagagatatataatggctaaaaagcacatgaaaagatgctcaacatcattaatcagagtggctagaatgaaaaaggctaacaataccaagagctggtgaggatgtgaaaaaactggaactctcaattgttgctggtggaaattcagactggtacagccagtgtggaatgtgatttggcagtttattaaaaagctaaaaacctaaacttacatagcccagcaattgcacccccaggagtctacccaatggaaatgaaaacagtccgtccccacagagacatggacataaatgttcatagcagcattattcagaatagccccaaattgaaaacaatccagatgtccatcaactggtaaatggataagcaaaccatataatggaaaaccattcagcttccaataacttccaagaaactgtagacacatgcagtatcatggttaaacctcaaaaacattatattaagtaaaataggcgaggcatgtattgtatgagtcatatgaaatgtctagaaaaggcaaatttattgagatagaaagcagatcactggttgcttaaggcctagggtaggagtggggattaactgtaaacgggtacaaggtacctgactggggcaatggacatgtggattgtgatgatagttaaattgtacagctctctctatatatagttgtacagctctattaattttccacaatcattgaatcatgtcttccagttttatgaggtaaatcatagtccaatgaagcttttttaaaaataagatgataggccatgtgtggtggctcacgtctgtaatcccagcactttgggaggccaaggtgggtggatcatgaggtcaggagttcgagaccagcctgaccaacatggtgaaaccctgtctccatcaaaaataaaaaaattagccaggcatggtggcatgcgcctgtaatcccacctactcaggaggctgagacaggaaagtcgcttgaacctgggcggcagagtctgcagtgagccgagatcatgctgctgtactccagcctgggccacagagcaaaactccatctcaaaaaaaaaaaaaatattaattaatatgataaaatgatgcctatctcagaattcttgtaaggatttcttagtacaagtgctgggtataaactatatattcaatagatgacgattattacttattattgttattgataaataacagcagcatctacagttaagactccagagtcagtcacatagaatctggaactcctattgtagaaaaccaaaaaagaaagaaaacacagctgaagcctaattttgtatatcatttactgacttctctcattcattgtggggttgagtagggcagtgatatttttgaattgtgaaatcatagcaaagagtgaccaactttttaatatttgtaacctttcctttttagggggagtaaaacttggattgggagatttcattttctacagtgttctggttggtaaagcctcagcaacagccagtggagactggaacacaaccatagcctgtttcgtagccatattaattgtaagtatacactaataagaatgtgtcagagctcttaatgtcaaaactttgattacacagtccctttaaggcagttctgttttaaccccaggtgggttaaatattccagctatctgaggagctttttgataattggacctcaccttagtagttctctaccctggccacacattagaatcacttgggagcttttaaaactgtaagctctgccctgagatattcttactcaatttaattgtgtagtttttaaaattccccaggaaattctggtatttctgtttaggaaccgctgcctcaagcctagcagcacagatatgtaggaaattagctctgtaaggttggtcttacagggataaacagatccttccttagtccctggacttaatcactgagagtttggtggtggttttgcatttaatgacacaacctgtagcatgcagtgttacttaagacagcaagcatctagtgagaggagctggtgccatgcatgaccccacatagatcttgctgatagtgctacagcatgaaccctgaagctttcaaaactatgattttttttttttttttttttgagacggagtctctgtcacccaggctggagtggtgcaatctcggctcattgcaacctctgcctcccagatttaagtgattctctgcctcagcctcccgagtagctgggattacaggtgcctgccaccacgcccggctaatttttgtatttttagtagaaacagggtttcaccatgttggccaggctcctcttgaactcctgacctcaagtgatgtgcctgcctcggcctcccaaagtgctgggattacaggcgtgagccaccgcacctggcttttttttttttttttttttttggagacagagtcttgctctgtcgcccaaactagagtgcagtgacattagctcactgcaacttctgcctcctaggttcaagcgatcctcctgtctcagcctcccaagtagctggaattacatgtgtgcaccaccatgcctggctaatttttgtatttttagtggagatgaggttttgccacattgcccaggctggtctcaaacttctgacctcaactgatctgcctgcctcagccgcataaagtgctgggattacaggcatgagccactgtgcccaacctgaaaactatgatttaagtaaacaacccataaaatatttcttgctatttttactaaagatgtgttatcttggccgggtgaagactttctagtgtttccgtaactagggtaaaaaatgaactctattatatggcttgtacatgtgtttacaagaaagcagtgtactcctcataaataaacttttagtttattttattttttaaacactgcagcctcatcatgcttcacggaggagcctgtgcgggaagaatgctcccacacagcataaagaatgctcccgcacagcatagagaatgcccccgcacagcatagagaagcccccgcacagcatagagaatgcccccgcacagcatagagaagcccccgcacagcatagagaatgctcttcacctctgggtttttaaccagccaaactaaaatcacagaggccaacacatcatttaagatagaaatttctgtatcttttaatttttttcaaagtagttttacttattttcagattctatttctttactagaattaagggataaaataacaatgtgtgcataatgaaccctatgaaacaaacaaaagctaggtttttttcatagctcttcttccagattgaatgaacgtctgttctaaaatttaaccccaaaaggaaaatattcagttaactatgttaaaaaccaagacttgtgattgagttttgcctgaaaatgctttcataattatgtgtgaatgtgtgtctttcccatcttctccacagggtttgtgccttacattattactccttgccattttcaagaaagcattgccagctcttccaatctccatcacctttgggcttgttttctactttgccacagattatcttgtacagccttttatggaccaattagcattccatcaattttatatctagcatatttgcggttagaatcccatggatgtttcttctttgactataacaaaatctggggaggacaaaggtgattttcctgtgtccacatctaacaaagtcaagattcccggctggacttttgcagcttccttccaagtcttcctgaccaccttgcactattggactttggaaggaggtgcctatagaaaacgattttgaacatacttcatcgcagtggactgtgtccctcggtgcagaaactaccagatttgagggacgaggtcaaggagatatgataggcccggaagttgctgtgccccatcagcagcttgacgcgtggtcacaggacgatttcactgacactgcgaactctcaggactaccgttaccaagaggttaggtgaagtggtttaaaccaaacggaactcttcatcttaaactacacgttgaaaatcaacccaataattctgtattaactgaattctgaacttttcaggaggtactgtgaggaagagcaggcaccagcagcagaatggggaatggagaggtgggcaggggttccagcttccctttgattttttgctgcagactcatcctttttaaatgagacttgttttcccctctctttgagtcaagtcaaatatgtagattgcctttggcaattcttcttctcaagcactgacactcattaccgtctgtgattgccatttcttcccaaggccagtctgaacctgaggttgctttatcctaaaagttttaacctcaggttccaaattcagtaaattttggaaacagtacagctatttctcatcaattctctatcatgttgaagtcaaatttggattttccaccaaattctgaatttgtagacatacttgtacgctcacttgccccagatgcctcctctgtcctcattcttctctcccacacaagcagtctttttctacagccagtaaggcagctctgtcgtggtagcagatggtcccattattctagggtcttactctttgtatgatgaaaagaatgtgttatgaatcggtgctgtcagccctgctgtcagaccttcttccacagcaaatgagatgtatgcccaaagacggtagaattaaagaagagtaaaatggctgttgaagcactttctgtcctggtattttgtttttgcttttgccacacagtagctcagaatttgaacaaatagccaaaagctggtggttgatgaattatgaactagttgtatcaacacaaagcaagagttggggaaagccatatttaacttggtgagctgtgggagaacctggtggcagaaggagaaccaactgccaaggggaaagagaaggggcctccagcagcgaaggggatacagtgagctaatgatgtcaaggaggagtttcaggttattctcgtcagctccacaaatgggtgctttgtggtctctgcccgcgttacctttcctctcaatgtacctttgtgtgaactgggcagtggaggtgcctgctgcagttaccatggagttcaggctctgggcagctcagtcaggcaaaacacacaaacagccatcagcctgtgtgggctcagggcacctctggacaaaggcttgtggggcataaccttctttaccacagagagcccttagctatgctgatcagaccgtaagcgtttatgagaaacttagtttcctcctgtggctgaggaggggccagctttttcttcttttgcctgctgttttctctcccaatctatgatatgatatgacctggtttggggctgtctttggtgtttagaatatttgttttctgtcccaggatatttcttataagaacctaacttcaagagtagtgtgcgagtactgatctgaatttaaattaaaattggcttatattaggcagtcacagacaggaaaaataagagctatgcaaagaaagggggatttaaagtagtaggttctatcatctcaattcatttttttccatgaaatcccttcttccaagattcattccctctctcagacatgtgctagcatgggtattatcattgagaaagcacagctacagcaaagccacctgaatagcaatttgtgattggaagcattcttgagggatccctaatctagagtaatttatttgtgtaaggatcccaaatgtgttgcacctttcatgatacatttcttctctgaagagggtacgtggggtgtgtgtatttaaatccatcctatgtattactgattgtcctgtgtagaaagatggcaattattctgtctctttctccaagtttgagccacatctcagccacattgttagacagtgtacagagaacctatctttcctttttttttttttaaaggacaggattttgctgtgttgcccaggctagacttgaactcctgggctcaagtaatccacctcagcctgagtagctgagactacagcccatcttatttctttaaatcattcatctcaggcagagaacttttccctcaaacattctttttagaattagttcagtcattcctaaaacatccaaatgctagtcttccaccatgaaaaatagattgtcactggaaagaacagtagcaatttccataaggatgtgccttcactcacacgggacaggcggtggttatagagtcgggcaaaaccagcagtagagtatgaccagccaagccaatctgcttaataaaaagatggaagacagtaaggaaggaaagtagccactaagagtctgagtctgactgggctacagaataaagggtatttatggacagaatgtcattacatgcctatgggaataccaatcatatttggaagatttgcagattttttttcagagaggaaagactcaccttcctgtttttggttctcagtaggttcgtgtgtgttcctagaatcacagctctgactccaaatgactcaatttctcaattagaaaaagtagaagctttctaagcaacttggaagaaaacagtcataagtaagcaatttgttgattttactacagaagcaacaactgaagaggcagtgtttttactttcagactccgggattcccattctgtagtctctctgcttttaaaaaccctccttttgcaatagatgcccaaacagatgatgtttattacttgttatttacgtggcctcagacagtgtatgtattctcgatataacttgtagagtgtgaaatataagtttaactaccaaataaggtctcccagggttagatgactgcgggaagcctttgatcccaacccccaaggctttgtatatttgatcatttgtgatctaaccctggaagaaaaagagctcagaaaccactatgaaaaaatttgttcagtgttttctgtgttcccgtaggttctggagtctgaggatgcaaagatgaataagataaattctcagaatgtagttataatctcttgttttctggtatatgccatctttctttaacttctctaaaatattgggtatttgtcaaataaccacttttaacagttaccattactgagggcttatacattggtgttataaaagtgacttgattcagaaatcaatccattcagtaaagtactccttctctaaatttgctgttatgtctataaggaacagtttgacctgcccttctcctcacctcctcacctgccttccaacattgaatttggaaggagacgtgaaaattggacatttggttttgcccttgggctggaaactatcatataatcataagtttgagcctagaagtgatccttgtgatcttctcacctctttaaattcccacaacacaagagattaaaaacagaggtttcagctcttcatagtgcgttgtgaaatggctggccagagtgtaccaacaaagctgtcatcgggctcacagctcagagacatctgcatgtgatcatctgcatagtcctctcctctaacgggaaacacctcagatttgcatataaaaaagcaccctggtgctgaaatgaacccctttcttgaacatcaaagctgtctcccacagccttgggcagcagggtgcctcttagtggatgtgctgggtccaccctgagccctgacatgtggtggcagcattgccagttggtctgtgtgtctgtgtagcagggacgatttcccagaaagcaattttccttttgaaatacgtaattgttgagactaggcagtttcaaagtcagctgcatatagtagcaagtacaggactgtcttgtttttggtgtccttggaggtgctggggtgagggtttcagtgggatcatttactctcacatgttgtctgccttctgcttctgtggacactgctttgtacttaattcagacagactgtgaatacaccttttttataaatacctttcaaattcttggtaagatataattttgatagctgattgcagattttctgtatttgtcagattaataaagactgcatgaatcca

SEQ ID NO: 2706 - DNA, 87257 bp, Homo sapiens; identical to SEQ ID NO: 2705
  source 1..87257: mol_type = genomic DNA

SEQ ID NO: 2707 - DNA, 1410 bp, Homo sapiens
  source 1..1410: mol_type = genomic DNA
ctcgcccaaagaagactacaatctccagggaaacctggggcgtctcgcgcaaacgtccataactgaaagtagctaaggcaccccagccggaggaagtgagctctcctggtgagttgggggtcgtttcgcccaccctagtaaatataaagagctctttaatccagccagcttactagtgggggtggggatgccctgctttcagcaaaccgacctttacatttatctctgatttgttctaataggggcgtggttgttcgtgatccttgcatctgttacttagggtcaaggcttgggtcttgccccgcagacccttgggacgacccggccccagcgcagctatgaacctggagcgagtgtccaatgaggagaaattgaacctgtgccggaagtactacctgggtaaggcagatcgctagggtcccaggagaagagaggggactggactagagcacccgagggaagagggcctcggggcctggattcttaagtctaagagatgaaggacctgcgaacgccgactcctggatttgagtggggagggcctgggtcctgaggaatgaggaagctggggcctcaatttctggatcccaagagaggagggggattgagggcctggactcttgggtcctgtgaaagagatggttgaggaatcagattcctggatcccaaagaggagccagattcctgagtccctgacaacagaaatctccatttgaacttgggtgtgggagagtttcttccaaatagatctcggtgggagttggagaagatcttcattgccttatgaggttttggggtttgtttgtttgtttttctttctccctaggggggtttgctttcctgccttttctctggttggtcaacatcttctggttcttccgagaggccttccttgtcccagcctacacagaacagagccaaatcaaaggctgtgagtctagagcacagaggagggaggccagtggcaggggagagggggaagcggggaatcttggtgggaagggacaatggaggatccaaaatgttggggctctgggtgagaagggaaggctggtctagggaagtctggagagcagccggaggccaacccttccagcttctgtttcccatgacagatgtctggcgctcagctgtgggcttcctcttctgggtgatagtgctcacctcctggatcaccatcttccagatctaccggccccgctggggtgcccttggggactacctctccttcaccatacccctgggcaccccctgacaacttctgcacatactggggccctgcttattctcccaggacaggctccttaaagcagaggagcctgtcctgggagccccttctcaaactcctaagacttgttttcatgtcccacgttctctgctgacatcccccaataaaggaccctaactttc

SEQ ID NO: 2708 - DNA, 6732 bp, Homo sapiens
  source 1..6732: mol_type = genomic DNA
aacaggttaaaaatacggaagtttattgtaggacactcagtgtgaataaatggaatggaaaggcctacacatcgagactcatccatgattgatatgaatttaaaaattacaagcaaagacattttattcatcatgatgctttcttttgtttcttcttttcgttttcttctttttctttttcaatttcagcaacatacttctcaatttcttcaggatttaaaatctatagaaaaaaacttcatggttacctaagccacacaaggtgccaaggaaccagcgccctcttctggggagggcggccaggctttggcactgctgctcatacagcctctttggagaggaacctcaagaaaaacaagaggatgctggcctgacctagacaagtattaagcagcagtagcagcagcagcagatctgactggcagccgctcagcatgcccagagaacacgcgtggaccatctaatcagaggaagatgggaatcttctctttgacgtatggggagcctcagaaagacattttcctaatgttaaaaccacagaatggccctatgatgtttccttcggaactggtactgctcagccctgatcatgggagaaaactgacaggtaaagaaagcagacaaacttggtgattaccttgagggattgatctcgcctcatgacagcaagttcaatgtttttgccacctgactgaaccaccttgaagggacagaagacaggagcattaaccacctttccctattcaagacaaaagcagctctcaggagtaccttaaataggtgtgtacccaaacccagcaccgtcccaggaacagaggtcccagcccccaaaacctgtgtctttgtcctaaactcatggccatttgtgaagtctgtttgggatgcctgcacacccctccgcctcccagcactgggactcctctctcctgcacagtagcgctgctccaggccctcctcttgacacagtggttacaaccaggaatcctgatgcctacgctcccgcctggccttccagctagtccctctctggttttacctgctagcacttcaaggtcttgacaaagcccaaccatatctccagttctctaatcccctgactttagcaacagttcaagcctctggaaggcctagtgatggctcgagaacagattccacagctggacagctgggttcacatcctgcctctggttctcatgctgtgtgtccctgcacaaccctcagctgccccggctggataaagacactaatgatcacatcttgcatggctatttcaaggaacacagcagttaggatacaccatagaccagagcagtgcctggaacacagcagtcattaagcattactgctggatccttgccaccttccttcctgctcatctacctaccactcaccaccaaaacgtggtatcttcaccaccttgcctggattccaaatgcaaacttacttccaggagtgccttgatcaccagcttaatggtcagatcatctgtttcaatggcttcgtcagtatagttcttctccaggaactcgcgcactgacttggcaccccgacctatggcattggcctaaaacagacacgtatgttctcacgtggcatagggcatgacaacccagggccagccctggaacacagctgccctacatgggccgcccagccagtggcagtggcaggaggcaagctggagtgctggacagcagctgtggacacaggccctgcctcgtggcttccttttgcaaagagctctttagagttgatgctgattcttaccgagaatggggttatacgattgtatgttttactgcgctatcaagaggcaatgggagatttttttttttttttttttttgaggtagagttttgctcttgttgcccagcctggagtgcagtggtgtgatctcggctcactgcaacctatgcctctcgggttcaagcgattttcctgcctcagcctcctgagtagctgggattacaggcatgtgccaccatgcccagcaaattttttttgtatttttagtggagacagggttctgccatgttggccaggctggtctcgaacacctgacctcaggtgatccaactgcctcggcctcccaaagtgctgggattacaggcgtgagtcaccacgcccacccaagaattttaatttatgtggactacgcttacaccttgctgccctttgattttcttccaaacagcaatgtttaatcattttcttgctctcataggactaggttaacttaaactgactcattcactgatacagggcctacagcaggaagcccaggacctcccacccctcaaagcctttttctggcaagactgtccaaagcccctttgtcacgaactcaccttccaggcatggtatgtgcccgaggggtcagtctgatagagcctaggagtgccatcaaagtcgaaacccacgatgagggcagagatgccaaacggcctgcgcccattgctctgcgtataacgctagcaagaaaagaaacaggtcagtgccatccaattaagaaactgcatgtgaggaaagaaccgtacttagtgaagatacgaacattttaaaccatgcctgagccccttctcaggttatcagcagttcaaatgatacattagccaatagctttcaacatccttttctgcattttcactcctagaaaaactcacctaggaccagaattgtgaactcaggttactggaaattactttgacaggtagacacacattctgcttacatactaatggcgtgtcctcatagggtggcttccagcccccttcaactgctttgtgactggtcactcaggatggcaagacaaaagctatcatttccctccagacacaggaatttggaatatcccatgccaggaactgagaacagaacaatgttactgaaattggtgagctaggtcaagttacacttgtgcaagtcaagattaggatcacgccccagaataaatcagttttctgattcacctgaagtgacatggcaggaccctccatggcggagccgtgactgccctgctgccagaggtgagcatgcaagcgggcaggcacccacctgcttcagactggcgatgtagcgggtgatgtactccacagtgaccgggtcctccacagtcagccggtggctctggcactccacccgggccctgttgatgactatccttgcatcggcggtgaggcctgcaaggaaagcagagaggcttctgctagagagacagcacaaactacagggtggggacagacacgatgacccagcatttaaccttccacagaccccccaaaccggcagcaaggctattctaactgactggcagcggaacctatcagcccctgggaacttccaggaaattgggtacagatgcttcttgatgtgcagtggggtggtatcccgctaaactcatcgtaagtcaaaaatacctggctgaaaatgcatttactaccccataaacccattgtaaataaaaaattgtaggctgccgtgcagaatctggatttttaaaaacacagatcaacagggactgtctgcatatgaagaattgtgtacttcagaccatacttaaatacagtacctgagtcctcttgggaatcttagaaattgagttaatccctaatttcattacatgaattgagatcttcctagattgcatctgctgagaggagaaatgagcaagaccaaaacagcgctgagaacatggcgaggcatggcctgcatccaccagtgtggtcctttttactgctggggatggcaggacgtggttctgtcctctccatgccacagatgcagttagctctagaaagtccagcctttctctagattgtaactgattgatacagaaaaataacagtggaggtcaaattgcgcagcagccagaagtgttttcatccatttagccatttgtttcacctgctatggcagagagaggccaccaaagaaactagccaacttaaaagtccaaatccaattcttttaaatgattttcatttactcagtttatatggctcacaatagcccacacacccaagttaatctccaaagccctattcttcgctgagactctagagagtaagacagcgctccccaccgactcatacctgcaaaggccatgcagacgttgtcatccaaagcacagatcttccgcactgttctttcatcctgcagtttggccactgacttcttctccacaccaagaacaacaatgtctcttcctcgaacaccaacctttaattaagatccacaaaccacgtaagaaagtgatatgagtgctgggtgcagtggctcatgcctgttaattccagcactttgggaggctgaggtgggtggatgacttaaattcaagagttcaagaccagccggacaacatgggaaaaccctgtctctacaaaaagtacaaaaattagccaggtgtggtggctgaagcctgtagtcccagctactgtgggggctggtgggaggatcgctagagcctggaaggtggaggctgcagtgagccatgacggctgggagacagagacagcaagaccctgtcccctcaccccaccctatcctcccaaaaaagtgatacatggttctactgccaggcagcgagcagtaggagcagatctgaacctgggtcctggggggtacgtactccgggtagcagctcccactggaaggtgcgttcacccacacccctttctcctctacttgtctgtcactgtggctggcaccacatcctgcaaacccaggggtattcatctactgctggtagagctagcccaggcgtgctcacctaggtgcccaacctgggcctttcaaatactgagatgtagttttagttacaacatagctagtaagtaaccattatataatcggcatgtgtttcctttcaacccaatgaatcagtcccatgcaaagcctggaagcctgagactttcactcaagtctggtgttctgaaggcagtgtttctgtagttgtgaaattatattgagccacaatgcactgtttcctgcactgtgacatactcatgtgacagccatgagaaggggcctgatttgccgtcagtggacaaggtgtcaagtgttatcccaaactgtttatggctgatgctggagaaggatatggctgttattaaaagcatgaacaatcactgacagtcaacccgagtcaagccagaaacaaagggaaccatcattgggataaacagcgcctcctggtttagagcagggcttctccagctcagcactgtgagcacctgggcagggggatctccctgtgcctgccgccctgagcacgggtgggatattgagcagcgtccctggcctctaccctccaaatgccaagagcacctctgcaaggtcttaccactggaaaagtctccacacactgccagtggctccgtgtgggcccaaaaccatccctggctgagaagtattgatctgaagtgtttgggttttctgggagctttctcaggtactgactcacttgaccttcgactgactcgaggcccagagaagctatatgggttcgttaaagccagcggcggccagctggcgggggtggcagtattggggtgggtacaggggtcagccgactcctagtcctctttaagctgagttagatcacctgatgaatactgggccttcatttcaaaacaaagattcagaaaatgaaaacaaatcaaaatttacagaaccgtgtgtgctgctttctctgcctgctcaaacctctgaataccagatgataaaagaataacgatctcacagactgaccaattaaactgacacgtcttgatggtacgaatttaagtttcaaacaatgtcactaaggtcaatgtacacgagccctcgtcaaaacgaaacggccgcgtccaaaccagtcctgacccgggcggctgcagcccggccccgggaaggctcctcccggcagagtgcggagacctgggaggcgcccgccaccggccaggccagcgagccgctttgttctcgaagcccacctgggcctagagaataagtgttgccccggagcgggtgggggtccccataaggggggtttgagtagttcgctccccagccacccggctgcgtgaacagccccccagcgagcgcacggcctaccccccgcgctccgcggcccagagcggccctcgcccggcctctgctcgccggggcggcggcgcgacccacgcgcccggccggggccaggggtgctcaagatggcgtcgtcacggcccccgtgcccggggccccacgcgaggccgggccccaagcgaggcgctgagtggggagaacgagcgctcgcggctcacgccaaacgccgcctctgcaggcactcgtggagaccggcagcggggcccgcgctcagctacagccctgaccgcccgcgccgctgccccgcgcacgcccgcgggcgcccacagcgccgcgcccggccccggccctctctgggctccccagccccacttccgcccgcgtccccggccccgcgcaggccccgccgcctcaccgcggtcgagcccttcttgacggcctcctgcgcgtactccacttggaagaggtggccgtcgggcgagaagacggtgatggcgcggtcgtagctcatgccggcgggcggcggccgggctccttccgccgcgactctcaaaagcgcacactcacggcccgcgcgcacccgcgactcccggcgccactacgcccgcgccccaccctcggcgccgtgtcctgcgctgccggcgacgggcggcgtcaggcggcgac

SEQ ID NO: 2709 - DNA, 38096 bp, Homo sapiens
  source 1..38096: mol_type = genomic DNA
aagtgacgaagtggcgcagttcgctgcgtgcagcgacgtggcggcggggccggcaccgggcagcggaagtggctccggcggtgggacttgagtgtttgtgttttggttcgtgaaggagccggcggctggccttaggggaggaggcagagggaggaggaggaggaagaattagtcggaactccagcgccggcggcggcggcggcggcggaggaggagaaaggaaagaggaagggggagcggcgagaggcggagacggagcccgacaggggcggcaccacggcacgagccccgcacagtccagtgtgaggggagcggcgctaagagcaggcgacgccgccgccgccaccaccaccgccatagatacactctcatcctacgggccacgcctgggccttgctgccaggaagcttcggccccgcagctcggcttgctgcggtctcaggtaaccgaaccgcccctcctcctgcgcagcgggggcctggaccccaggttatccgcggtccccagcctgtccgcggccctgccggtactgagaccccccaccccttctccctcacgcgcagcagtgccctggaccagagaactatcgaacccggcgtcttgttctgccagccctggtgactcatcctccaggggctctggagaccgggatttggggactgactgagggagcgacgggtgtcaccctttcccttctcaagatggcgccgtggaaagtgtactggaggccgcggttccgcctggtctccgtcctggcagtcctgggggtctcggtcaaagcaaggcaggttcgggggaggaggttggaaaggccaagggacctggcgagtgctgcttatccaggcgatctgtagttggctattagctactcaggtgctctccaagcaggaacctgggcctactgcaggtgtcaatgtggggagctccgcctatcttcaacttccaaagatgagtagtgtcggtgggtgggaggctcgtcaaaataggctgtctagagacttgttttctgtttggaaggtagtgaactacagcgttaaataaattcaagataacaggaccgctgaactccttcactgggtagagaccatggaacttgctctggcgttatcttccctggaagctgcttacctctgagactttcaaacttgttaagttctgaacgtcatagttcacatacttggtttttgtcttgcttaaatggaatcaaagcgttcaatcagttgcctttcacataataagaaaaaaacacttgtacacctctgggaatactcaagactgctcataaactttattcctaaagtaaaatggaagtgataactcagcatttgtataaacaaagtaaatggaacagtgcctggcacaaaataagtgcccagtcaattttttgatcaaagaacccttagaaggattttaactatagaatgaataacagttattttcaaaagattacaaatgtatattatgcaaaattcttgttttgcaaaacagaagtttcagtaagcagtgaatacaaatgaatgcacgtaatttttaaccttagtgttatgctaagtgtatatttaccattaactttagttatttcctgtttgagatccttagggggagtagccacaattaagtagctttaaaccttaaaagtcaaagtgaaatcagaatcttgtttgatttttttttttaatgggagtctgatattttccctaaaattttggaagtgccgtagaaatttggagcatattgtccttgataagtaatttcttgttttcttaaataaaaagacaaatggaaaatgttttgattgtgtgtaatatctgaagatgtattggtgcattttcagtatatatgatgttctattgatattttatcattttcttatcaaaggagcacattattggcaatttcaatccctactatgtatattagagattgtttacatgtattgttttatttaattgtcacatcagctatgcaagttagatattatgggaatagaaacttggaaattaaagagtttgcccagacggaaattggtatagccaggattacacccctaaatctggtatgtttgtggaggagggggcatttttatttataccttgttatttggaagcaactcagatattacgtcaataaatctgtaaatatttcagtatgtaatggtaaaagataaggactctaaaaagctggtgtttagttaaggcaaggaggtagtttcattgccttaagaactaagatctcgtggacatgttagggaattcattatgaagagcgtattataagctcattttatgggaaaggcatatttctttcttttgtttttaatatagagacagggtctcactgtgttgcccaggctggtctcagagtcctcctgcctcacccccaaagtgttgggatttaccggtataagccactctgtccagtgtgaaagacgtatttcttatatgaggtagctaaatgaaatatagcagggtttttagagagggaatcatcaggtttaatatattagcatgtattcggattttgattaaagatagaaggaaactgttaagattggtttgtgagtggattgaaaaaggttcttcaaatattcactaattccttagagattaaaaattagcatagaagtcgccattcaggctagatttctttaatgtgttgtttaaataaaaaataatggcctgcaggctgggcgtggtggctcacacctgtaatcccagcactttgcgaggctgaggcaggaggattgcttgagcccgagagttcaggatcatcctgggcaacatagcagttaagtgtctctaccaaaaaattagcctggcatggttctgagcgcctgtagtctcagctactcaggaggttgaggcaggaggattgcttgagcccaggaggtctaggttgcagtgagctgtgaccacgccactgcactccagcctgggtgagagagcaaaaccctttctccaaaaaaatttttttaaaaatggcatgtatattgttcgtctaaagactacaaaaaagttacaattattgtaagtaaataagtcagtaataatcaccacatggagaacaactgttagcatttctgtgtatggtgtgcttgagcagatgaggaaacagttttaagtctgccgttaggcacacaaacctgggagactgaaaatatttgttgtccaaaattaccattaattaaatgaaaaatgcatcgtttaacagaaaacttcaaataatactaaattttaggatctgttctaaaagtttcccatttattaataacataatttttctcaaaacaatgttaatccaagtagcctggctacagaacttgaactcgagtcatctctcaggttgcctgggtttgaaactcggctctgtcacttctgtgacaataactgtgtgacctcaattaagcttcttaacatctctgtgcttgtttcctcatttataaggattgtaataatatctcattttataggattgttgagaagttaagtacttaaagcactgcctggcacaaacttgaagctttgaggttagcctttaaaaaaaaaagtaattttggactcacatcctatacctttgaatttcctttaaaagatagtgacataatctaaagggcattgaaggtctagtagagtttaagataatcatgctataggcaatatttaaagtgattaatagtaaatttgctttactgatttgtatatttaattcataattgtttctttacaggtttctttacctccagaaagaagaatattggccccttgaattctggaagttcattgaagagtctgaaattagggacttatttcaaatttggacatggctagtcgaggcgcaacaagacccaacgggccaaatacgggaaataaaatatgccagttcaaactagtacttctgggagagtccgctgttggcaaatcaagcctagtgcttcgttttgtgaaaggccaatttcatgaatttcaagagagtaccattgggggtgagattttcttttttccctgcttcatttaatcgaatcatacattgacagaaaatattttgatgttccaattgtgtgattatgaatagctaaataagtcatagagtgaagaaaagagctgttcagcttaccttagctttaaaacttgcctttatctttgttaaaatgatgtgtttttatatttgattgtttggttaatcccttgtggttatattgtagctaaaatacagataaaaaacatgagtagaatcagtgtctcaagtaataacatttgacctgatacctatttctagctaacaactagaagcttcttcaaattaatacagtacatgtttgtgctcaattatattggtttaaaatgaatagtaaaaaaggtaaccttaaattctgatctatataactgaagtatttgcaaataattatacttacttgtaaaattaaatgtaattaaatactgctagatgtacttttttttggtatttaagagatgggatcttgctgtcgcctaggctggagtgcagtgtccggatcatagctcactgcagactgcagcctgaaactctaggctcaaatgatcttcttgccttagcctcccaccaagtagttggacctaagggtgcatgccaccatgccaggcaagttttttttttttttttttaagagtcagagtctcgctgtgtttccaggttggtcttgaactcctggcctcaagtgagcctccagcctcaacctcccaggtagctgtgattacaggtgctccctgctgagatgcatatgtaagaatgctcctaagctgagggaagagaaaaagtgattaatggaaagggacataacaggaaaatggaacctgaagaaaaagatgaaagaagaagggaaagagtaggcactgacaagggtggttatggtgggacagagatgaggggaaggtaagatgcagggtgaaaaggagacaacaaacagtacagtattgtcaagagaggacgtgaaatgggaaaattgaattttagctggacatggtggtgcattcctgtagtcccaggtatttggaggctgaggcaggattattttagcttgggagttcaagtctagcctgggcaacataatgagaacccatctcttaaaaaaaattgactttaatcaaagaaacctataattatatagcagtgggacaagatagcctcttttgggcctctgtttcatctgtgaaatgatgcttttcaattagatgatgtgtggcaagagccacacggtttgagattcacaatattttgcaagtgatatataattaagcaatgctgttttctaaggtattcatgtatatattttaaccccatcctgtaaaattaaagtcaaactttggaaataagacaggtagataccaactggcatgtggcaacttcttggaatctgtctttcagaagcaaaactttatactgtgcatttagtgaatgctcttctgcaaatatacttgagaatgttattcataatcttagacccattctagtaagataagttacagaagtctactacctcctggcctttgtatatcttgttaaaatgttatattagaatgttttatgttttttctaatggctgagcatcagaaagcatcatggagcttttattttgagtcagaagtcttggcattttaaaaaatgttaatacacaatatattagacatctttgtgattttttttttccctgaaagtacatccacgtgtgattttgttgttgttgttgttattgttaatacattatatccagtttaataatgaaatactacttctcaagaaggctttgcttcctccagaagtgatttggtcaaagctaactgtcccatctagtaggaaaagtttaaagactgctagatcatgtccacccacttatttcactgttaatggaagcatttcccaaagtatatgtgcattctgggttaaataacctgggccacgtaggtttgggacttactatatgctactcttctcctctctctttattattttattaaaacaataaaaactctgaagtactgtagtataggacttaattcctggggagctttgcaagagcttaagattagaatttttatcttgttttggataatgcacttctaagtttattttttcctaatgatagctcaagaaggatgtttaaaagaaaaatgtaaccccatatcctgtgtatcataaatatatctctgatatgtgtgtatctctatataatctccatgtaacaccagttagattgtctagatttcattaatgaatttttcataaagattttcatttctatgtgtagagcttcctgtttaaaaacaaaaaggaatttgcatccaaatttctgttaatcctttttttttttttttttggagacaaggtctctgtcgcccaggctggagtgcagtggtgtagccctggctcactgcaacctccgcttcccaggatcaagcaattctcatgcctcagccccccaagtagctgggactacaggcgcaagccaccactcctggccaatttttgtatttttagtagagatggggtttcaccatgtcggtcgggttggtcttgaactcctggcctcaagtgatctgcctacctcgggctctccaagtgctgggattacaggcatgagccactgcccctggcccaactttctgttaatctttattggatactttttcactgtgctgaccccatgtgaatactattcaggaggtatgacagtaccattatggttatagctgtggacactattcttttatgctctgtactcatagctcttcacctttaggaactagagtagatgtaaagcatttaagaattttaaggtttgagctatttcatgatcaacctgaaagggccataacttgtaggtaatacgtatttttgttttgactgtcatgtggtagaagttacctgaaaaatgaagccaaccaactcttttgcatttcaactgttggtttattttttttgagacggaatttcactacgtggcccaggttggagtgcagtggtgtgatctaggttgactgcaacctctacttcccaggttcaggcagttctcctgcctcagcctcctgagtagctgggattacaggcccacaccaccaatcccagtgaacttttgtatttttagtagagacagggttttgccatcttggccaggctggtctcagactcctgacctcaagtgatccacctgcctcggcctcccaaagtgctggaattataggcgtgaacctccacgcctggcctcaactgtttaatttttcactttactgtttatatctcctaacatgagttattgttctgaagcactcaaaattttaatctctatttgattgtgttcgaaggtggatatcatatgttacactcttgatttgtggattctggattcattaagaatatcaagatttcttctgtaatttgtgtggttcttcctaaatacaataacttgatttacgaattcctgttgcgctgtgtgcggtggcttgcatctgtaatcccagcactttgggaagctgaggtgggcagatcgcttgagtccaggagtttgagaccagcctggccaacatagcaaaaccccgtctttacaaaaaatacgaaaattaaccgggcatggtggcacacacctgtagtcccagctactgagaaggctgaaatgggagaattgcttgaactgaagaggcggaggttacagtgagccgagactgcaccaccacactccagcctgggtgacagtgagaaccctgtctcaaaaacaaaacaaaacaaagaatccctgttgcctcaccatacttcatgcatcctacccctatagcacttctgatgaaattgcgtgccgtagatttagcaatttagagaattctagcttgtttgtatgggtttaaagtttgcatgacatttatgtttctattgttggtctaaagttagcccagagattagcagggagcagtaggctcagagagttgtcttccttctttacttggtactgcatctctaggcttggtagctcttcagtaaatactctcaaaaaatacttatttttaagaagacatttatgtgatatttataaacaaattaatcctcagtggttagaatatgcagtgaaatagcaagcagacaatcctttttttctcttctgagaaaagtgcttcataccacagttacaattttgtatgcactaatcaaaaaatgtgttataaactctaaagtttagatgatggaactgtacatgaaaataacattcctcttgctggttctgtgatttttgtacattagcttagaacagtggtcctcaaagagcgttcccacttccagaagtagctgcattaactaggaacttgttaaaatgtagaatcccgtgttgaatcaaaacatttgggtgggaccaacaatctaggttttaataagttttccagatgattctaatggcatgttacgtttgagtagttgattttacattggtactaacattgattcacccatacatggaataattggggggtttttttgaggtgtggtgtttgtcagatttttaaaaacattgttgactgggcgcggtagctcatacctgtaatcccaacactttgggaggctgaggcgggcggatcacgaggtcaggagttcgagaccagcttgccaatgtgatgaaaccctgtctctgctaaaaatacaaaaattagccaggcatggtggcgtgcgcctgtagtcccagctacttgggaggctgaggcaggagattcgcttgaacccaggaggcggaggaggttgttgcaatgagccgagatcatgccattgcactccagcctgggtgtctcagcgagactccgtcttaaaaaaaaaattgttcatgcaactaacctagtttgagaattacatgtattatgtactgctcacattacatgttatctgtatctctttataggagaatgccttcctgttagccacctgccagacatctttaggaaagtatgatccctctgtccaatcaagagtattctgctttttctctacttagggagtacccatagttttcagtcatctgtaccactgctgctctcctttcttgtcacaaatgatcaaggcctgataatacacaaaattaattaagaaatttagtgtaggccgggcgcagtggctcatgcctgtaatcccagcactttgggagggtgccagcacactggcagatcacgaggtcaggagttcgagaccagcctggccaacatggtaaaaataccagaattagctaggcgtggtggtgggtgcctataaccccagctactcaggatgctgaggcaggagaaacatttgaacccaggaagcggaggttgcagtgagccgagatcgcgccattgcactccagcctgggcgacagggcgagactccgtctcaaaaaaaaggaaatttagtgcaattattaactcttaagtgaagtgctgtttctacttacatatttaacatccatctaaattggttagcatggccaactagttgtttttagtctaaaacaacctgtaacaggaataaaagttactgttaaaatgaagaaaaacaaggcttatttcaaagttattattaacatactattttacctaacaatttatggccaagtcattctaaagaataaactattgtggttaagagagactgtatccagattgaagtttttaccacaatgcctggcacagtaaaaggtttattaaattatagctattacagttaccatcaccactgttaacttttggctgaatcgttttgtcattgttgatatttttgttgtttggtcatgacatactattatcttgagatggtagctgttacacctagtgcatagcgtttgatttagaaaatttgaagatttgaaaaattttgtgttttttttcctttttttttttttttttaaacagcctgctctgttgcccaggctggtgtacagtggtggcatcaaagctcactgcagccttgacgtggcctcaagtggtcctcccaggtagctgggactgactataggcatgcaccccacacttggctaattttttatttttttgtagggacagatctcactgttggtgcctaagctggtctcaaactcctgggctacagcagtcctcccacctcagcctcccaaggtgctgggatgaaaggtgtaagccactgtgcccagcccaactgtgttatttgtggaagtttctcagagggagaaattacagggctaaagtactacacgtgtgcatatattaaagttttttccagtaactacttaataatgtgtacttgaaaactgctaaattcttaaatgtcctcaccattaaaaaatagtaagtgccgggtgcatggctcatgcctgtaatcccaacactttgggaggccaaagtggtcagatcgcttgagaccagcctggccaacatggccaaaccccatccttactaaaaaaaaaaaaaaaagcaaacattagctgggcgtggtcgcgcatgcctgtaattccagctactcgggaggctgaggcatgagtattgcttgaacctgggaggcagaggttgcagtgagcccagatagcgccactgcattccagcctgagcaacagagtgagactctgtcgcggaggttgcagtgagctgagatagcaccactgcactccagcctgagcaacagagtgagactctgtctcaaaaaaaaaaaaaaaggtaagtaggcgaggtgatcaatattgaattaccttgatttagtcacctcacaatgtgtacatgtatcaaaacatcatgttaatatacatatgtatatattgtaaatacataacgatttttatttttcaacaataccttaataaagctggggggaataaagttacttcctaaacagaaaagctagccagaaaatttaaatccaaataactcatgtttttccagtagtagaaagctttctacaattgcccttcacttgttagccttcagaatgacttctttgtataattataatctgtgcatttatttaatgtgcttttacctttttgcatgtgcacattgttaaaagtgcttttgagaaaggatagaagacctagagaccaaaccaccagcatgtggtttttgattcgtgagaaaaattgtgtgtttgaagtattcattctactttctgatacattgatagttaaaatttgtggaagttaatcatttggtttcaagcaaaataataatatctttgttcatcatattttctcctaaaaagtacatattcagaatttgagaggttgttacccagagaagttggtagagatttgatatttcaaatttatatcacaacctaaaaaaatctttcggtagtcttaattattccccaatttcttaggttaaaatattatcatatgtggctacttaaacattcccgtgagctgggagtcagtatgcatggttctaatcctcacatgctttcataagcatttatgtgaactctgtttacacatttgtaacacgagagtattgaactctaggtaaggattcttgtaggccaggtgtggtggctcacgcctgtaatcccaacactttggaaggccgaggcaggcatatcacctgaggtcaggagttcgaaaccagcctgaccaacatggcaaaacactgtctctactaaaaatacaaaaactagtggggcgtggtgtcatgtgcctgtaatcccagctattgaggcattagaattgcttcaacctgggaggcagaggttgcagtgagctgagatcacaccactgcacttcaacctgggtgacagggcgctgaggtaggggagactgagacatgagaattgcttcaacctgggaggcggaggttgcagtgagctgagatcgcaccactgcacttcaacctgggtgacagagcgagactctgtctcaaaaaaagaaaaaaggattcttgtagagcagatgttcttataaactgtgtactcttctcattaaacaatacagtcaatacaatttaacttttgttttcttaaaatgtatttcaagatttggaatcattatgagcatcagtttttgccttgccgtgcttaatgtgttgatgtcctctggtgctttggaagtattcaagctgtttggtagaatgattttgccaaatagctcttagtgaactgctactgattcactaatttactgcttttatttgttatatatgggaaatattaggttgtctaaagcaaatcaaaataaaaccagaaatcatctctgatgattctaaaactagaaatcagggacaacttcttggtatagtttgagagacagattgagtgaacattgtaatctggtgctatatattaaaggtttttaaaagtgatattatatgccactttttaaaaattaagcctaaatctccaactgatcttcttgttatgtactaatttatatatatatatatgtatgtatatataaatcaatctccaaaagaagatatacatagaaagtggtctcagttacattccgaggaaatctgtaaatttgcataacctttagtgcatggactttgtgagatttattctggctgcatttactcttcttttgctagctttctggttgtgttctgattttttttttttttttttttgaggcagggtcttgctctgttgcccagggtgaagtgcaatgatgtgatcatggctctctgcagcctcagcctcttgggtcaagcagtcgtctcacctcagcctcccaagtagctgggactacaggtgtgcaccaccatgcctggctaattttgaaatttttgtagaggcgacgtcttgctgtgttgcccaagcaggtcttaaaactcctgacctcaagtgatctcctggcttggcctcccaaagtgctgagatatagccatgagccaccgcgctaggctgtgttctgaatatataaggtttccagataattgatctttttggagacacactcagaggcacatgaaagacacttggttttgaataataattggtggaggctgtgggatgggaagtgttttaaaattttgcttttagaatagaataagaattcttacttgatagaaacatgggaaattttggcaaactgtttctcccttttttaggtcatataccataataacctgacattgcatatacataatcttgtttatgaagtatgctgagtaaatttatgataggatagtatcatttggagttacatcaaaagccttttcagcaaacctctttgtgaaggagaataaagatgtgtgagagtaagaaaagcaataagagtacttctaaaggtttttgtttttgagatggggtctcgctctgtgctagactggagtgcagtggcatgatcatggctcactgcagcctcaacttctgggctccagccatcttcccacctcagcctcctgagtagctgagaccacaggcatgtgtgcccctgcccccggctaattttgtatttttggtagagatggctattctccatgtttcccaggctggtcgcgaactcctgagctcaagcaatcaacctgccttagcctcccaaagtgctgggaatacaggcgtaagccactttttcaggcatcattttttgtcttttaattcattggctaccttgatgtatatgtaaactttagttacctagttgctaaattcctcaagatgaaagttaagtgttactgaagtcatatgttggactttgaaaataagaatgctctacaaatcagaatatctgaagtaagtgttgctaaacagcattcatcctccgtttgaggaaaggtagaagcaggatgaagaaccggttagttattcatggttttttaagccttaagtgttcgcagtagtagttgttggatattctttgggccccaaagaagaagtgggtaatcttgatacatgactagtcactgcataattatcagacaccttcagcttttctcagtcaaaaaactgttctttatctttgcataaaactagagccagaatatattccacctagttactatcgtttttatttgaggtataacatgaatagaattttctcctctattgcattcataagtaatttgtaaattttagaaaaatgtgacttctaggaaataaaggataatttaaagataggacacttataataattacttgttatgtgatacattcctagaacttaaacaggattttcagaagtttcatctgtaccttaccatggctatatgggaaggtactaattttatagacaaggaaactgaagcaataaaggttaagtatatgcttgaagttttgcaactaggtgacagctgggattaaagacatctttctgaaatgccattcatgttctggaatgtactgtgtatgtgtgtatttctccttgcaagaacctatcagactagaaaatttggctcatagttagagtacacatgacaagtgttctgttaaataatatgtagtatttgacaggtaggggccttcttgctatgtatcacttaaggaaaataatgtgaaagtattttgagaacaaaagaatataagacgattatttaaattgtccatattcctaaattatcaccaccattttcatttttatgccatcatcatgtgtcacacgctatattttaactgcctttaatcaaatgcattaatttgttcatgtgagtcaaaattcaagaagtttataaggtttacagtgaaaaatctccccctcatcttctatctagcccactcagttctttttcccaaagatgatgttactttgttatatatccttgcaaagttactactatactcaaatctatatattcttgtctccctttttacaaaatttgaaatatgtcagatgtactgtaatacactttttatttttcactttaatgctgttctagttatctattgctgagacacaaatgactcctccaaaatgtagagacttaaaattattttgtcatctccatggttctggtgagtgggcttagtaggtggttctcactctgatcttttccttgctcttgcagttcattacggggcaagaatcatctcaacacatccggcagttggtgctggctattggttgggacctcagatggggctgttagctagaacacacctacatgtagtagccttttatgactttgctccagaagtcacatagatagatagcatctgttctattctagtcacaggcctgtacagattcaagggaagagtgtcaacatcacactgtaagaagaatgtggtgtagaatgtcttgttgcagctgccttagaaaatacaatctacaggctgggcgtggtggctcacacctgtaatcccagcactttgggagactgaggtgggcagatcacgaggacaggagttcgagaccagcctgactaacatagtgaaaccccttctctactaaaaatacaaaaattaaccgggcatggtggcgcgtgcctgtagtcccagttactcgggaaggctgaggcaagagaatggcttgaacctgggaggtggaggttgtggtaagctgagattgcaccactgcatttcagcctgggcaacagagcgagagtccatctcaaaaaaaaaaagtactgtctgccgtaagacctatctatatcaaaagaacgtccgcatttttcttggctgtaacagtattcccttgcatgggtcatattagtaatatcagttctctagttttagatatgcacattgttgtatctttggctataatagtactgtactaaataacagcagtaatttctcacatattctgagtatatctgcagtatatatttttagagcccagtgtgtttggtttctcttttcttttttgatttttttttgaatcggggtgtcacttgcccaggctggtgtgcagtgacgctgtcatagctcactgcagccttgaactcctgggctcaaatgatatttccacttcagcctcccaaatagctgggactacaggtatgcaccaacacacttggctgatttttaaatttttgtagagaagggttctcatgttgcccagggtagtctcaaactcctggcctcaagccatcctcctaccttgacctcccaaagtgttgggattaaaggcatgagccaccatgcccagcctgtgtttagtttttctgtgaactattcataacctcatgttacttctatgtagatttctttataatagtcacactactgtgttccatttgatttattaatggtaatatttctcagtacatctatattgtcatattttagtatctggcaatcttctctttttattattttttaactgttccattgttgggcatttaatgtttgcttttttgtttgctgttttaggtaatcacctaataggggatatcttagaatttcaccccccccccccccgacttattttcgtaagatcaatttctagaggtgattactgaacccaaaggaattttatcctaataaaattgttttgtaggatcaaaagaattctaatcttcatcctttttcatcccttagagatacatccagtttctttgggggttggcatagataattatatcctaggattacaggtttcctctaactgttaataggagtttaaagttttccctctctgtttagtcttcttttctattatgttgtaaaattctcagatatcagaacttttgtttttgttttgagagacaaggtcttcctctgtcacccaggctgaagagcagtggcatgattatggctcactgcagcctccaccccctgggctcaaatgatcctcccacctcaccctcccaagtagatggtactacgtgtgcatgtgccaccatgcctggctaatttatttttaagatggagtcttgctatgttgcccaggctggttttgagctcctggcctcaagcaatcttcctgagacaggaatcccaaagtgctgggattacaggtgtgagccactgtgcccagccaaatattagaacttttaaattcatttagtatgtaagcttactgccaagcatgaaagaatcactttgaaggccagtaatgttttaaaggtctggaagattctcttgagggctaggaagcattatgtgctaggttcttgaaccaggagaaaaggggtatcactaagaagaagggaaggaatcctggtatgcaaaatagcttgggcgctatccttgcacatttgacaagtttagtgaagtactattgaactgttcagtaaagtatctgttgcctatagataaaatgtcttttgtagatacttatatatctacctacctatagatatctatatatctgtatctatatatcccttaaagctaagctaatttccttaaccttttctctgttgatatttgtttggtagcctttatctgattctagttaataactcgtaccctgtcatttttttaaaaataccctttgtttttgtaatgtgttctttcattcttcttcccaattcagttttggtacgttcctgttacgtaaatctaatctggtgagcagagactttcttaggattatgccacttggtgaggcaatcacagggtcttagccctgaaggcgcccatactgactttatcagtttattctagggagatcaggtttggggcactaacttaatactaacaaactcctaagattaatttaattttatttatttgtttgagacggagtcacccagggtggagtgcagtggcgtgatcttggctcactgcaacctctgcctccctggttcaaacgattcttgtgcctcagcctcctgaggctgggactacaggcgcatgtcaccacgtctggcttatttttgtagttttagtagagacaaggtttcaccatgttggccgggctggtcttgaactacctcaggtcccaccttggcctcctaaaatgctagaattacacagacgggagctaccatgcctagccaaaactcctaagatttacttacttacttactttatttatttatttgagacggagtctcgctctgtcccctaggctggaatgcagtggtgtaatctcagctcactgcaacatctgcctcctgggttcacctgtctctgcctctcagatagctgggattgcaggtgcatgccaccatgcccgactaatttttgtatttttagtagagatggggtttcaccatgttggccaggctggtctcgcactcctgacctcaagtgatccacccgcctcggccccccagaatgctgggattacaggtgtgagccactgtgcccggccctaagattaattttcaaacaatgtgcatcagtatgttagaaatacctagtgttagccgggtgtggttgtgtgtgcctatagtcccaactactctggaggctgacttgggaggattgcttgaggccaggagttcaagggcgcagtgaactatgattacaccactgccccaacctgggtgacagtgggagaccctgtcttaaaaaaaaaaaaaaaaacttagggcgacgatgttcagctggtgacatgtggctgactgtcttatgtactggttagtgaattcccttagagttgggtgtcccgtaagggttgctgtcaagctgtgatagtaaaaagcattgacttctcaatatcctttatcctagacagtgttggagaaatgctaatttttattctttacctcactcttgacttcatgcaggatcttccctgtgtatcattaatattcttcaggattttaaattgtttcacaactattacctttagatgttgctcatagatttttatatttgtttccttccttcctttattttttggggcaggggttgggatggggacgggatgacagggtctcactgccacccaggctcaggtgatcctcctgcctgagccacaaacctctcccaccaaccccccgcccagtagctgggactacaggtgcacgccaccacacctgttttgtatttttgttagtagaaacgatttctccatgttgcccgggctggtctcgaactcccgggctcaagcagcatacccgcctgggcctcccaaagtgctgggactgcaggtgtgaaccactgcgccttacccagatttctttttaaaattgcggtaaaatatccgtaacacaaaatttaccattttaaccatttttgaatatacagttgagtggtattaggtacttttaacattgttgtgtaactatccaaaactttatcttccctagctgaaactctgcacccactaaacaataactaccccttcttcccgtgtctggcaactaccattcacctttttctctctgactctgactactctagctacctcacataaatagaattgtacagtatttgtacttttgtggtttccttatttcatttagcataatgtcctcaacgttccatccatgttgtaaagcaagtgccagaattttccttcctaaaactttttaggctggataatattccattgtatgtatatacttcatcttgcttgtccatcattggacacttaggttgctttcatctttagctgttatgaataatgttgctgtgaacattggtgtacaaagagtgttttaagttcctgctttcactacttttggatgtatgcccgtaagaggaattgctggatcatatggtgattctatctttaatatatttgagaaatctctatacagttttccataccagctgcaaagcagttccagtttctccacatgatcacccacactttacctttttctcttggtttgatcatagccattctagtggcagtgaagtggtaatttgtggttttgatttgcatatccctaatgattggtgatattgaacatctttccatgtgcttattggatttatttatttatttgtttcggtttttttgaaatagggtctcactctgtcacccagactggagtgcagtagcatgatcacagcacactgcagcctgacctcctgagctcaagtgattcttctgcctgtacctcccaagtagtccagcgcatacccccatgcctggctatgtaaattttttatagagacagagtctcactatattgctcatgcagatcttgaacgcctgcttaagcagttctattgccttggccttccaaagtcctgggattacagttgtgaaccactgtgcccagctcttattggtcatttgtgtatatccgttggatcaatgtttattcaagtcctttgtccatttttttttttttttgagatggagtttcagtctgccgcccaggctggagtgccatggcaccatcttggcttgctgcaacctccatctcctgggtacaagcaattcttctgcctcagcctccagagtagctgggattacaggcaaccgccaccacgtccagctgatttttgtgtttttaatagagacagggtttcgtcattttggccaggctgatcttgaactcctgacctcgggtgatccacccacttcagtctcccaaagtgctgggattataggcatgagccattgcgctcggccctttgtccattttctaatcaggttttttgttgttgctgagttgtaggagttccttacattaatatgttctagctttcagtcccttatcagatgctcattgatttttaagagtgaattgtagataaactagtatagatcacctcttaagatggattaatttggggaagattgctgtctttctgtatgctatctacataataattttttattttcttgttaggcttttggaatattctctttttgggtttactcacagtgtgtatgctttactgtgccttattttttcttttttccctcctgggtgctgagtaatacttagccctattctacttttatttcttactcttcctcacattaattgcaatgtaactcttccctaactacactcacgactgtcgcttctgcagtccattcactgggtgcttcctgtatacacacactttcataggaaataaaaatggcctcagtttttatttttcctgttttcggctatgtatgattcttctctgtgtgtaattttatcatctgaagttagtgcttatctgtctgagaaaatctgttatgtcggattactgctgttagtactcattttcccagtgaaccaatttctgtcttcactgataactttagtacctgattctaacaatctctaacttgaatttttttttatcacaaagcctcattctatttctgaaattttgaacaagaccctttctcccctctctagtcactgcatgcatcctttccttttagttttaatttaattgctacttaatacttagttactagtattttttttcacttacacattgggattgtttttttaaaggtactcaaatatgacagtctatattattgtttctctatacacatttatttactaccgaaaattgaaaaaaatagcacatcgaaatttccttttactgcaattcaaatttttgaaaaccagaaaatctgatttattatactctagccaaactacccagtgttttctttacattctttccccacaagttactttacttctgattctttcttttgagacagtctgtcacccagactggaatgcagtggcataatctcagctcactgcaacctccgcctccaggatttaaggtattcttatgcctcagcctcctgagtaggtggtactacaggcacgtgccaccatgcccagctaatttttgtatttttaatagagagccagggtttcaccattttggccaggctggtctcaaactctgggcctcaagtgatcctcctgcctcagcctcccacagtgtgctgggattacaggcatgagccactgtgcccggccttacttccaattcttgatgatggatttcatttcactaacaaggttgtttttaattattaaatagttttaaattctttgagcataaaagtttgttctacctactctcctgccctcacactatcttttggaattttagtgagattattaggttaaaaagtattagcattttcttgcctttgctacatgttgccaaaatcctttccaacggagttgtacgaaatcaccagctgtgcttgggttttttgcaaattggtgttttttggttttggttttttttttttggttttttttttttttttgagatggagtctcactcttgttgcccagactggggtgcaaaggcacgatcttggctcactgcaacctccgcctcctgggttcaagcggttttcctgcctcagcctcccaagtagctgggattacaggcgcccacatccacgtccggctaatttttgtattttttaatagagacagggtttcaccatgttcctggctggtcttgaactcctgaactcaagtgatccacctgcctcggcctcctaaagtgctgggattacaggcgtgagccaccatgcctgctgtatttttattttttcattatgctaatttaggagataaaaattgttttgactatgtggatgatttcattgactactggtctccttttctgttcttttgtgaattgtctttacacatttatccctgaggttctaaagtttttctaaacatttataatagctttctacacattgaaaatactaatcacttagcatccattgtagaaatttttctcattaggtttgcccctttgttatggatgttatgacacaagttttgcaaacctgaagtttcatatttttgtgtaatcaaatctgtagtcttatatagaattttggtcaattttaataaagcaattctttcctgtcaattttgataaataataagtttgggcttgaagttgtatggtttctcagtttttgtatttttcccctttctgtttaattcatgtagaatcattttagttatggggtggcggttactttgtttttcttttttttcttgagacggagtctcactctgtcacccaggctggagtgcagtggcacaatctcggctctgcaacctctgcctcccgggttcaagtgattcttctgcctcagtctcctgagtagctgggattacaggctcatgccaccatgcccggctaatttgtatttttagtagagacgggttttcaccatgttggtcaggctggccttgaattccagaccttgtgatccacccacctcggccaccatgcccggctaatttgtatttttagtagagacgggttttcaccatgttggtcaggctggccttgaattccagaccttgtgatccacccacctcggcctcccaaagtgctgggattacaggcgtgagccactatgcccagccactttgttttttaattattaatctttggtttaatgccatcaatttgaatatcctttcccttgcccagtgtgttacagtgtcttcccctggcttactgtttaagtcttgcatattataataggcctttggtatttgcagatttgacatttaaagcttcagctattctcacctgattccagggtctgtggtaaagtaatttgtagttttgctgaggctgaaatgttacttgcttgctgccaggcttgcaaataggagctgatcacgtagctcagagggagcctatcagacaggccagcacccacatctcaacgcagctttgtttttctctacttgtcatcgcgtacacagtaactctcgaagtgataaaagctgtttctttgtgaaatatgggcccgaaaagaaaaccaactgctagtgctggtgatggaagtgaagagaaaatgaagcggtctaagagtgatggttcttagccagaaaatagacgttttggataaattaaagtggttttacagattcaggtaagtttgtggttggttaatgttgctacagtattgatgtagtagttttatcttttcagtggcagaatttgtttacgtaactttataaattactagtaatgtatttttaggagcactgaggatttgaagatgtcacctaaatgtcagttacacttcaccgagttttataggggaaattaaacactgtagtggaatttggccaggtgtggtggctcatgcctgtaatcccagcactttgggaggccaaggcggatggatcaccagaggtcaggggttcaagaccagtctggccaacatggtgaaaccccatctctactaaaaatacaaaaattagccagacgtggtggtggccacctgtaatcccagctactcgggaggctgaggcaggagaatcactcgaacccaggaagcggaggtttcagtgagccgagatcgcgccattgcactccagcctgggcaacaagagctaaactccatctcaaaaaaaaaaaaaaaaaacactatagtagtattttaaaactttaggactttgagaaatcatgaacgtcttagggtgtattatgtatatcaagagtttattatagtgggctacactattccagtaatatttctgttcatttagtactgtagcacttttcattttttaaagtatattataaaactgattttccctggcctctaatgttggtcttttctcccccaaaattatgctttatcataccacatgaacagtagtacggtggtggtggtggtggtggtggttgttgttttgagacagagttacactcttgttgcccaggctggagagcaatggcacaatctcagctcactgcaacctctgcctcccgagttcaagtgattctcctgcctcagccttccgagtagctggggttacaggcatgcaccaccatgcctggctaattgtttttgtatttttagtagagacgaggtttcgccataccggtcaggctggtctcaaactcctgacctcaggtgatccacctgcctcggcctcccaaagtgctgggattacaggtggaagccaccgcacctggcccagtacagtgttatcaggtgaaaaatatcttgatgttgtttttgaggttgtgttacaacttgagtagataccttgtgaaatatctattttttcacatttgggagctgcctctctctacattcaaatgttatctgaagtagcctctaaatggttccatgtatctttttgaacttccttcttttagtagacatttttgaacatctgtatgaacaaggatttatattaaatgttggtacagagaggagctactacaagttgagcatccctaatctgaagtctgaaatgctcccaaattcttcgagcatcaatatgatgtcacaagtgaacaatttccacacttaacacctttgctttctgatgagtcagtgtacataaacttggtttaatgcacaaaattattttagcttcaggctatgtgtacaagctttatgtgaaacaaacgaatttcatgttttgacttggatcccttcccaaaaatatctcattatgcaaatattacaaaatctttaaaaatccaaaacattcctggttccaagcatttcagataagggatacttaacctgtggtcattgctcaagtaactcccaatcaaggagaagaaaaagatataaaccaatgattataaaaggtgtgaaacgttattacacagagaactctgggagcacagatgtaggagatattaactagggtggaatgaaggaaggtttctaagcagagttgaggaatgaattgattatcttctttgttaatctgaatgggatccattcctgttcagcatgatttcccttggttttgttcctagatttaggaatgatgccctgttttgccataaggaagaatctcgtgtgtttattaggaatggatattgactcaaatgcctttttgtaatttgtttaaataaaatggatttttcttcattagcctgttaatgtaatagttttgtatttctgaaagaatgtacttggtaatgggcatttgtttgtcttaatgtatttgttgcaatttctttgtatttggcatttttgtacatgtatggtgtacatgtatggtggcctcttgtgtctttaactggcttgagaattggatcatattttctttaaggcaacatctctaatacagttggccctctgaatctgtgagttccacatttataaatgcaaccaactgcaagttgaaaatattaagggggaaaaaattaacttagctccaaaaagcaaaaattaaatttgccacacacttaatactatgttgaatctatgtggatgacgtgaggtgcaggcattgtattagatattataagtaatctagagatgctttaaagtatacaggaggatgtgcttaggttatatacacatactttgcaattttatatcggggacttgagcatcctcagattttgttatccattggggattctagaaccagtccttcatgatatatggggaggtcctggaaacagtcctccacagatactgagggatgactatagttatttccctgagcctgaagtttacttatggacgtataagtgaatgtttttagtactagtagactttgtgatcatagtatgtctgaaaaatgaaacagtctgtgcacattttaattcctttttttttttttgcaagtctgcatcaaactatacttgaaaaaaggcttatgtattgtgacttattttcctcttttcctttttggtaagagtactgtcttagggacttaattttagtttaaaattttagtttaaaaacattttttgatcctacaggagaacctctcgtgaccttcaaaaagtgacatagtgctgtctggatatcctttaccataaatacaatattttagaaaatggacaattctgctaattgttggttaaaaaaaagtttgaactggattagaatatatttacaatgtgattaatgagaattcataaaactattaattagaatctaggtccaaatgaagatgtttacagtattgtttgcaaaattcagaagattttagttgttgatactaaagccagcaaccagttaacctaaaagagcgtgaaaaataaatgttgtgtctaacgtaaaagagatatatctcattagactttgtttctttagcacatttgatactggttagtacatctctatcaacgtcactagataaacggctgtaatttagagaaatatatcataattcttttgcataatatgacagttttagaaaatggtaattcaagtgcataccaatttggaaatagggcttgaatatcacaccttgagctaaatgtagaaggaagggaggagcataccaatttacagtgaatgatagagcagcagcagagggcggtctaatggctgtgtgtaggtcttttaattttaacaatattgtatcattttataatgctactttttttttttttttgagacagagtctctgttgccaggatggagtgcagtggtgcgatctcagctcactgcaacctctgcctcatgggttcaaacgactctcctgcctcagcctcccgagtaaccggaaccacaggcaagcgccaccatgtcgagctaatttttgtatttttagtagagacagggtttcaccatgttggccaggatggtcttgatctcctgacctcgtgatttgccttcctcagcctcccagagtgctgggattacaggcatgagccaccacgcctggcctataatgctactttcctagtgttaaaattagaatcagggaaagtacagatccaaaaaattcttatggcagggaatgaaaggtaggagcaaatattgaatcaactgaacaaattaaatctaggttaaggtaataatgactaccacaattaaagtgtcacaatgttttaaaaaataatatagcaagaggcctggtacggtggctcacgcctataatctcagcacttttgggaggcactccagcctgggagatagagcaagactgtgtctcagaaaaagaaaaaaaaagataatataacaagaaatactaatttggtggtaactgactgggactaaattgccagtgtgcgccaataaaaactagtaaaatggaacaggacatggtgtcagcagtatagatggtacttttaggcacactgggtttcccccaacttcattttttaagactatcagtgcatttctttaattgtagagcaattttgaaatgcagtcttcgctgggcttggtggcttacgcctgtcatcccagcactttgggaggccaaggtgggcggatcacctgagatcaggagttcgagaccagcctggccaacatggtgaaaccccatctctactaaaactacaaaaattagccacgtgtggtggtgcatgcctgtagtcccagctactcaggaggctgaggcaggagaattgcttgaacccgggaggcggaggttgcagtgagctgagatcacgcccctgcactctagtctgagactcttgtatcaaaaaaaaaaaaaaaaagaagaaggaaaagaaatgtagtcttaagtttatttagtattataacaagcttttttaagatgcagaagtttttcaatctgtgatttcactacaaaggccctatatgtaagcatatatgtaaatagcttagaagcacaggtttgccagtatttaaagctattatcagctgtgggtatgcaatctgtcaagtttctaggtgttttctttttttttcccccctcatttattacttttaactgacacataatagttgtacatacttacggggtacagtgtgacattttgatagatgtatacaagcaggtgttttctatattatgaaaacatttggagaaaaatgattgacttattgtagtccttttctttcagctgcttttctaacccaaactgtatgtcttgatgacactacagtaaagtttgaaatatgggatacagctggtcaagaacgataccatagcctagcaccaatgtactacagaggagcacaagcagccatagttgtatatgatatcacaaatgaggtaagtatggatgcattccacagtaaaactaatttgagtacccacttttggtgttcagaattttgattaaatgttttggaaaatctttttctgatagtcatgacctttctgctgaagcttttgtgaattagaaaatctggttttaaaaaaaaacgaaaatgtctcataatacaatagtcctaataatttctttcccacagtcacttgggacagtcttttaaagccttgtatcacaaagatgcttggtaaccattttttgagcctgtgctcaatggctgtttctttgtttaacaggagtcctttgcaagagcaaaaaattgggttaaagaacttcagaggcaagcaagtcctaacattgtaatagctttatcgggaaacaaggccgacctagcaaataaaagagcagtagatttccaggtatgttaaatttaactctcatttgaaaggcacttttttcctgtatgtttttctttcatgtcaacacttgaattagttataatgtcaaaaccatgcaagtaatagaaaatactgatttttaaaacaaatataaagtactacatataataaaatgtttctgataaacctaaatttttaaatagattattgtaatatataaactgacccaaagattttgtagacttaaacaataaaggccgggttcagtggctcacgcctgtaatcccagcactttgggaggccgaggtgggtggatcacctgaggttgggagttcaagaccaacctaaccaacttggagaaaccctgtctctactaaaaatacaaaattagctggagatggtagtgcatgcctgtaatcccagctacttgggaggctgaggcaggagaatctcttgaacccaggaggcggaggttgtggtgagccaagatcacactattgcactccagcctgggcaacaagagcaaaactccgtctcaaaataaaaaagaaaaacagtaaaagtagtcattgttcacagtgcagaaagtgattgtatcctgccctaattcctccatcccacacatactttatgtcctaaccctcttctactcatgtgcaaatatgtatcagcacatgtgtgtaccccacatatgtacatacgcaaacacttatgtggttgttcttaaaggggcattcaaacataaaggttctgccaatctgtatccagagttggaaaataataagctaaaaactaataattaaaaaaaatttttttaaggctgagaaaatccagttttgtattacgattgctaattcagaatgtttgctgctgcaaaataggcaagtgcaatcacttaaaaacaaagcaagtcctctatttagacttttttttttttttttaagatggagtcttgctcagttgcccaggctggagtgcagtggcgcaatctcaagctcactgcaagctccacctcctgggcttacgccattctgctgcctcagcctcccaagtagctgggactacaggcgcccaccaccactcctggctaattttttgtgtgttttcagtagagacagggtttcactgtgttagccagggtggtctcgatctcctgaccttgtgatccacccgcctccgcctccaaaagtgctaggattacaggcgtgagccaccacgcccggcatacttagaccttttaaaactgtgcctgttctcttgctctttggcttctctactagaagggcggttgtggctgttctgtatatatcagtgatgaaatagttttcttttttgatgacgtagatggaatccatgtattcttgcatcattaggtattaagttgggcatgttacatttgtaattttatttaattcttaggacaacgatgtgagatgtagtatccattactctttccaaaattgttgccttcccagcacaagagtggcagagaaaacacttaaattacagtcagaagtggccctgtcacataacagttcagaggaacctcagttgtttctttgtccaatgggaaagatcattggttacccctcacaacagctatgaggatcaaaagtaataatatatgtaaactgtaaaagcatgacaaaaatgtagggcagtgatgtaattttcaaaggaatgatttatgatatattcaagattataatattgctgtagaagtcattgaaaattaaatatgaggttgtcatttagtgtttgaagccagtgttagatatttggtttccctttgtcttcattgcagacagtaagtgcaaataaaaattgccgttgagatcaaagagagttttatttagaataagataattctcccccatctctggaactcagtatttgaaagcagatttaatgtaagaaaagattaatcaaggtgggataatgcaagaatttcagacaaaaaaggaaatagtccattataaaattatcttgcacagtgctcttacctctgttgtagcttattatatagttgttgattatagatgattataggaatcaggttgtagtaataagaaagtctccttttctataacaagtttaaagcaggtgtagtgtatttccaagagatatatctcatatatctcattttttgttctgtaaacaggaagcacagtcctatgcagatgacaatagtttattattcatggagacatccgctaaaacatcaatgaatgtaaatgaaatattcatggcaataggtaagattaatatctctttttaaatgatcaatataagcaaaacaagtgtgaagcatatttggtttgactgtctcttttttaaaaaatttttgggggtgggtttgtgtgtatgtttatgtgtgtgtgtgagagagagagagagattataccacttttctaagtcccttccacaaaacaatattttgttggtaatattgttaaatttgaaagatgattacctattaggttgtaatactgtcagtttaggcagcttcttccaggtgagttaagccttaacctcttaacctgatagttcagacagacagattttgcaaaggtttcgctgggaaatttggataaatattttttttattagattatactttttaaaaatcaaattattggtaaatataactcagaagaacatgacacataagtatacagattgacaaattattttaatgtaaacattataaggaagatgatttcaaagcatagaggcgtaaggagaaaaaaggaaaacaaaacaacatccatactttatattacctcagatggtcatttgatcttacacaatgttcttgctgttgctttaaggtactttttttttttttgagacagtctcgctctgtcgcccaggctggagtgcaatggtacgatctcagctcactgcaacctccacttcccggattcaagcggttctcctgcttctgcctcctgaattgctgggattacaggtgcacaccaccacgcccagctaatttttgtatttatagtagagacagggtttcaccatgttggtcaggctggtctcgaactcctgatctcgtgatctgcccacctcggcctcccaaagtgctgggattacaggcgtgagccactacacccagcctaaggtactttctttttttttttttttgaaatggagtcctgctctgtcacccaggttggagtgcagtgggacgatctcggctcactgcaagctccgcctcctggattcacgccattctcctgcctcagcctctcctgtagctgggactacaggcacccaccaccatgcccgactaattttttttgtatttttagtagagacggggtttcaccatgttagccaggatggtctcaatctcctgaccttgtgatccgcccacgtcagcctcccaaagtgctgggattacaggcgcgagccactgcccctggccctaaggtacttttaactgatggtaattgctgtttcagttataagtaatgaagttggagtagtaataagcctccttttttctataacaaaaataaaggttggttttgttttttggttttggattttttttttaaccctttcctctttccagtggttttaatgtatagattctacctgaagggtctgttttggtggttctcaaagtttgccgtctgtggttttcatgtgcccagcactcttctcatcccataacaccttttattttacagcactgattcttaactggggtgttcacagtcctaaccccaagtaagaaatattcttaaattgaactcataaatagttaatagctgaatcagagaataatgaaaacccagtaaaagttgcaagtatttttattatttttcactaggtgacagagtttaatggtacttcattcgaaatgggaaagaacttgccttttctcatgtaaactgttttcctgaaaaactcaagtttgcagtttgctagggaagtgctggcacagttgcgaaggattgtgtgataatatactcattttacaaatgtgacagatgacacccagaatcacatctgaaaagttagaggaaacaatgagttaataggcctctcaaatcagcctgcactgtaaacctttctcacaatatttaaactctaccagatgggctttagtttgtacctttttattcaaacatgctaataaagtcatttttcgagttagaaagcagcctacatattttagttttttgtttttttctgaaatcagaatgttgcacttcttaaaagaaaatctatgttgtaaatggaattgtggcctttccatttccttcactaggttagtaaatttttttttctttttttttttgttatgaaggaacactttgatagattagtaacttaaatcacacagtgcactcataacaactctaatcaatgcaaggactaaaaagttactcgttctagtttacctccttcatcctcttaatctcactcacctctgatttaaacacttagggaacatgctaaagggatacatgattgattactcaatctggaacctaagttgttattatatacaatatatagtgctattttgtgtcccaggtaccagtgttcaacatttctggggctttgcttgtaaatacatttgactggagatttaccattataatgctatttatgctaccagcccagagccagtcccagagaagtggcccaattgaaggctttctttccaaacttcagtgctcctggctcccaaatccattgcccaacccagcatctaggattctaaaaatgattgatgctgatgtagaatggaatgtgtagaacaaataaaggataaaaggttcacaatgcaactaggcaatccgatctcaaagcagagtgtattcaatttctgagtaacctgagtcaaagctatggtaaagttagagtcttaccatagtggtctgtccccaagattgatagagatcagtgtgtgcagccactcttaaaatcagtactcttagtcatctttaatattctgcctcccctcaaaaaatgaatttagcacatcaaggatcttatgtattaaaacaaactacagcaatctccaactttacagtggtttgacttacgattttataactcgatggggtgaaagtgatatgcatttagtacattcttaacttactacgggattacatacagaaacccatcataaattaaaaatatcataaatcaggctgggcgcagtggctcactacctgtaatcccagcactttgggaggccaaggcgggctatcacctgaggtcaggagttggtcaggaaacaagccgggccaacatgtcgaaaccccgtctctactaaaaatagaaaaattagctgggtgtggtggtatgtgcctgtagtcccagctacttgggaggctgaggcaggggaattgcttgaacccaggaggcagaggttgtagcgagctgagatcgtgccactgcactccagcctgggtgacagagcgagactccgcctcaaaaaaaaaaaaatcataaatcaaaaacatacaacttaggatggatatatcaggatgtagccccattgtaagtcaaggagcatctgtatatccagcaggtaagtttttttaatcagtgggaagcacactccagagaacagccactagctgtatagagcttggcagaggtaaagccgtaactgctggttgagagtgttgtctgaatttgacaagccacactcatcggactcaaataaaattaagaaatagtttttggagatgaggtcttcaggataattctatctggattaggtacagctactggtcagtcagattaggattcatcagcccataaaaggagaaaatgaggttggttgaggtggctcactcctataatcccaatactttgagaggccacggtgggatgatcttcaaggccaggagttctagaccagcctgggcaacagagcaagaccctatctctaccaaaaaaaaaaagccaggcatggtggtgcacaccctgtagtctcagctacttggaaagctgaggtgggaggatcttttgagcccaggagttcaaggctgcagtgagctatgattgatgcaccacactctaacttgggctacagagggagaccttgtctccaaaatgaaaagaagtatggctgcaggctacattcaaactaagatcacaacgaagtgttgagtatgtataaatgtatgtggatatgtttgtgtctaagtgtatttccactagcatgctaaggtatgtttgtgtgtgagtatgtttcctccagtatgctaagttttgacacatgcaggcatctaacttgggtgttatctgtccttcctttgcccaaagcatagattataattgttcattctcaaaaatgcaactcttatctatttcccctttatttgaaggcagctgatggttactctgcaaggtgtaagtttctcttttaaaaactaagcggtcgagcatggtggctcatgcttgcagtcccagcacgtgggagtctgaggcggaagagttgcttgagcccaagagttcaagaccagcctaggcaacaaagtgagaccccatctcactttggaactcaggactgcagtaagccatgatcataccactgcacttaatcctgggtgacagagtgagaccttgtctcttaaaaaaaaaaaaaaagagagcatgtatatagatgttttaaggccaaaggctgtggaagccaggaaggaaatagtagatatgatctatcacaattcggggtgataattagttgcacagtagaggacaagttttgttggggtgatgattgcaaaggtatttgtatcctgacttgttctaaaaaatgtttgtggcagtctagagaacgctgatatgagctgagcttctttataaacttactggctggccatcatctttattgacttagattttatttaatagaagtaataatgaggccaggtgccatggctcacgcctataatcccaacactttgggaggctgaagcaggtggatcacctgaggtcaggagttcaagatcagcctgggcaacatggtgaaaccccgtctctactaaaaaacaaaaattagctgggtgtggtggggcatgcctgtaattccagctactcgagaggccaaggcacgagaatcacttgaacccaggaggtggaggttgcagtgaactgagatcacgccattgcactccagcctaggtgagcctgggtgacagagtgagactacatctcaaaaaaaaaaaaaaaaaagaagtaataatgagtataaaataaaatagaacttttctggtattattgagtgaatcggtatagagaattacataaagcactagttaggcttaagttttaattgtatctacaaccagtccccatctaccgttcccccaacacaattaccccagaaatcaaactccctaagacagcaaccaatattttggcattcaatactcagtaaacatttgaaaagaatgaacatatggttatatgatactttgggggtaacctaactggaaagaaaaattatagataagcaggtgaaactgatattaatatgagtattcaaatattctatttatttgatcattttctttcagctaaaaaattgccaaagaatgaaccacaaaatccaggagcaaattctgccagaggaagaggagtagaccttaccgaacccacacaaccaaccaggaatcagtgttgtagtaactaaacctctagtttgaactagctggaatagtcttctgcttcctaaatgttaataacaatggaattggagcatttaaccagcccagtatgacttccaaaagaagagacttatgatagagtcaagtttctaatacagaattattttaagtgttttgaacttaatttttaataacatgcatgggtccctctcactaatgtttcaacaatagggaaaaatgagaactatgtggacacttgtttcattggaaggttagggggaataatttctcatcactaggaatatagacaaatgactgtctgggcccacacagttaaccagcccatttctccacactggtacagtagtcacctgtgaaaaaaaaattggaacttactaatttgggcttttcaaaaacattctttgtttagaaggagattctaaagttatttatgatgcttagccatagtattcaggcaaatgttcatttctcctggtacctgtatttaaaatgtacattccacattttaataaattaaccacaagaaaataatcccacatatacaaggtcaggggtggggaagagtattaatggtatcttaattatacccagtctggttttttttttttaaatggggtaaaaatcaaatgcaaccccatcttgttttaggaattttgagaactaataaatgcaccttaatggtcagtgttcctttcaaacatgtgagttctttaacaaaaatgaaataaaccaggtgtctgtgatttctaattaatcaccgctggccattacacaggttttgttgtttggggtggggagggggcttttgttcccttttgacataatatagtcaatgcactaacaattatgtatattcaaacttgattattttaaattcgatcttcagctgtactgtaaatagggtactgcattgtagtctccatatctgtattacttttctgtaatatttaagagttgcttaaaagcatacaaaatgtactgttactaaaacagctaattatttctctctccccctttgacaggaaggggcttcagttgttcctccatggctagaaccataataaacaatgtacccgtaatttgtaacataaagtattgcaatatgttagtaacaatcttgcagccttcctttccaaagttcattttattttgatcagttcagtatattgcactaattattttaggtattttcattatatgaaagctaccatgtgtcagagatgatttaatctatttaagtgttggactgctaggagaacttgtacatttatgataatgcagaattaggaaaacggttcaccagtgtttagttttatattgaggtgctcaggttggaataaagtggtataaaaagcaa

SEQ ID NO: 2710 - DNA, 22771 bp, Homo sapiens
  source 1..22771: mol_type = genomic DNA
gctcgtacttgttggtgacagcgcccaaagagactcgcctttctccagaggattggtggatgagtgcacatatagcccaccctcgaaggtaggcgggtaatcgagctattggctggagccccgccccagggcgaggaggagaaggaggggcaggagggtttggttgagctgcagctgtttgtctgttcgacacaggcttggggccgacgggggagacggagccccaggtaccgagctgatggagcccaaagggcaggggcggaagcgcccgggagatgagagcagcctggcctgagagcggaggcgggtctggtcctaagcgaggggttagagtggcccaccggagaggggagaagggggccgggccccggcaggcctaatgggggtcgctgaggaggggactgggcggcctgggaccccgaagttggtgagtcgggaaggcggctgggctgtggcggcggccaggccgagggccgggggctggaggcctggagcttgagtgagggcaggggcaggcctcattaagcagcgctgaagagggaggagctggggaaaggaacagggcagcgggtgaggtaagcccatttgccgggaggtgaggagggtcagacctgtcgcccgagccccgggggtgactggggctgggtccctgcagagaggttcattggaagggcctgagaagggttcttagttgggtaagaagcgttcttttcagggaaagtgcctattgtaaaaagaactgagggtgctatggtgttgagctgagagagatttgggttcagtgagggagaactggggaaaatgaagaaggctgtattaatctagaagactaaggtagttgaagtaatggaagcagggcctggtatcagttatgggaacttctgggaatgctgaagggtgggctgggggctctgggtcttgggagtacacactcttttgttccctttagtgtttagatgtggtaatttgaagctttttaaaactcccagggtagggatgaagatcaaagtaatttttttttttccatgactgttggctgctccaaactcagcccctacactttctgttggcctcatagctggtctatactgcagtctgtttcttaacttactgtttcatgtcctatgaaagagctaagaagttggattgggggcatgttttgtccacttctttcccacttaataatgtggtctatagcaaataccatgtctcctagaactgagaatctatttcatatctatttcattatctacatgggaaaggggcttagagatcctcagccatcaggagatcttctgatcatagttggtgaaacttttgtgggacttagacttgacttgggtatttcccaggcaggtaatggagttaacaggtccgaaactatgcggtgatatcactgaggaagagatttggggaagagtgagaaattccatttcaaaagcttggcatcaccccttgttctttgtctacttcaaaagcccagatttctgtgctgttagaaagttgggtcaaactatgaagtatctggggaagatggtgagtagagaaaaagatacagaggtgcagtagcccacgcctgtaatcccagcactttgggaggctgagacaggaggatcacttgagcccgggagttcgagggtgcagtgagccatgatcttcccactgcactccagcctgggcaacagaatgagaccctgtctccaaaaaaaaaaaagacaaagattgccaaagcagaggagtggagtaccctcctccccacatatttttaatggtctgctagccttcttagtccctcatagattggagcctattggattttcccttactgtacttcctccttttctgcgtctctaccaatatattttatcactacatttcttttttttttttttttttttttgagacggagtctcactgcaacctccacctcccaggttcaagagattctcctgcctcagcctcccaagtagctgggactacaggcgtgcgccaccacgcccagctaatttttgtatttttagtagagacagggttttaccatgttggccaggatggtctcaatctcttgacctcatgatccgcccacctcggcctcccaaagtgctgggattacaggcgtgagccaccacacccggccatcactacatttcttaattacaaaagttaatatgtacatattttaaaatatggaaggtgtacagcagtttaagaagtataaatcctcccacacataccttattcatatttcatttaggaaggtcaaggatcagagacagcaaatcagactaatcttgctttgctttgggggatgtgtcacaaaaggcaattgtgttttcatgttctcatcaaactctagtcttattctttctacagttttcccttctgggatgatactctgttatttattgtgttcctttcacagttcattttgtcttctaccaagtccgacaagcagagggctgtactgtgtgttattcaccttgagtacacacaaacacacacaccccaagttgtgtgctgggtgtcctaggaagtgcccaaagagatggaacaaaactttatggggagaaaggatcattttggttgggataattgttggcatctctgctaaagaaaggaatttcagacccttatctcaaattcatggtctctggatgttcatggtctctgcatgttcacattacttgactatccctttcttatccatgatgatgatggttctcctaagaggcccctgtatttgtctttcttttcttttcttctatttttagagacagggtcttgctttgtcacttaggctggagtacagtgtgtgtctttctgtagggatctgagaagctccaagcttatctggatttgaaatcggttttcctctaaatctcagagtcagagtacagctggggcatttcatactaccaccttattaattgaatttgtccttactagctttaaaagccctctgttgtacccagcctttgtacagcgcccattggaaacctcggttttttcccccaaggaacttttctcacctgcaagccagtcctagagacagttgtgtaggagtatgtgtgtgtgtttttagacggagtttcacttttgtcacccaggctggagtgcagtggcatgatctcggctcactgcaacgtctgcctcctaggttcacgcgattctcctgcctcagcctccagagtagctgggattacaggcgtgcaccaccacgaccagctaatttttgtattattagtagagacgggatttgaccatgttggccaggctggactctaactcctgacctcaggtgatccacgtgcctcagcctcccaaagcactgggattacaggagtgagccaccgcgcctggccgtgtgtgcgtgtgtgtgtgtgtgttttaatcctatctaatttttccaacagttttttgcatcctaagagagtttaggagtagaattatcaataaggaatttcatacatagacctggagttgcaaaaatatatttggagaagagagctttcccattgcccttcaagtcatacctcatatcttttaaaatttttttcctggacaatccctactgcataacatacctcatatcttctaactcttactttacctgggagcaaatattgcttattggtatgaattttacttctgagaaggaggcatagggtagaagaagcaagcgtatagtttgctccctaatcctaaagcatttcagattggaaggtaaccaaagtgtgagacaatgaacttataataaggaaatgcagcagccctcttggaggaaggataccataaaaccctacatggtatactcccacttccgttttgggaaagatttagccattgactcaacagtaactgaactgaataaggagctacccaggtgaacaaagtatgtgtacatttctgggcaaggttgtagcttctgttcagggacagtgggtaccttttcagagtgtctcctggttctgtggtgttatggctcctttttttaaacttgtgtttctcaagtcaggaattaatagatagtggcccaaagcttttgaccgttcaacatcaactgaaaattcagcgaactttgtttttagctatagttgcctcagtgtttgggtgggagggccacatattgggtgtgattaggccatctgaggcatagtaacgggtgacaggaaaagcagttagcccatgcgagttgcaatagtaccttgtgggcaagatcccaagggggccctccatccaagggagatcacagaggagccagggagagaattgattctgaggcctattaaaaatattcccaaatggggccgtgtgcggtggcatgcgcctgtaatcccagcactttgggaggctgaggcgggtggatcacgaggtcaggagattgagaccatcctggctaacacggtgaaaccccgtctctactaaacaaaatacaaaaaattagctgggcgtggtggtgggcgcctgtagtcccccagcttctcgggaggctgaagcaggagaatggcgtgaacctgggaggcagagcttgcagtgagccgagatcgcgtcactgcactccagcctgggcgactgagcaagactccgtctcaggaaaaaaaaaaaagaacccaaatggaattgagtaagatctgtccagatggtacagaaagggaggagttgattgggggagagaagtagaattacttagccttaatttagggagcatttaatgagcacctactagggatcaggcagcatgctgtgctctgaagattttaagataaactcccacttttaaagaagttcatagtttagcagagcagacagacacaatttatatactgtgataatgtgatacatactattatagaaatacagtcttttttttttttttttgagacggattcttgctttgctgtccaggctggagtacagtggtgcaatctgtgctcactgcaacctccgcctcccgggctcaagcaattctcatgtctcagcctcctgggtaactgggattacaagcctgtgccaacatgcccagctaatttttgtatttttagtagagacggggtttcaccatattggccaggctggtctcgaactcctaacctccagtgatccatctgccttggcctctcaaagtgctgggattacaggtgtgcgccaccacacctggccagaaatacagtcttaatactgtgggaccctacgggcctctagagaatgattaattctgtgggggagagggtgattatgtaatttcactgaagtaacatttgagcttggtcttatgagatatatagaattttgctaggcagacaagtagggacgggcattccaatcttacctaggtcaataatagggagtttgtactaccatactgataagaggtaagtatgctttttgcctcttggagaaatataagggaaagggtgcgagatgtggaaggaatctcatttaatccaatgactcattaggtaacactggatcaacaaaatgaagagctgagccaagtggtagaactctcatttcaagattttggtgacttgggtttaaacagagttggagagggagatgaaggtatttactggtttctgctctatcttccctacttagtaaaactctcacattaatcgcagggcccaccaaattctgcaaaagttaccgcttgttttcctattgcctctcattgaattgcttctatttcaactgtcctggcagggtttggtcatagaccttctagaaaagagtagtgatgaattaattcttctgtcagaaagatatgggactgcatcccagttgccaaggaaggcctgggtcttcttaatttgtttttagtcccaaagcaagtacttacctaaactgaatagaggcaggaactctatccagtctaagctctcgatcctgtcctggtgttctctttagagttcagcatttcctgcttccttaagaagtatagtggtataagaggcaggagtacctgactaggagtcctacatttactgcttagcagttggctgtatggtaacacttgacaagttgactaattttattttattttttatttatttatttattttttgtgcaaatggtggcctttaataccaagaaagaccatgacaagtgacagaacaggagcaaattccctagtgtagtgccgagctagccctttgcaggaccctaaaacctgatctagtaacagaataaatcagtgtatttacatttatgtttgccctgaaaacccaggtaaggtctgaagcctgaggcatctctccttcctttcctcctccctctcttcctacctccttgccttcgttcacttcctcaattcattcctctcccttctcccttcctctcttttccttcttttcctttctgcttttcccttttctcctttttctcctcattctctttaccatctacctatgtgtccctccaagcccctctgctatttctcccctgctcactccctctgctgttgtctccctcaggttcagcttccggggtggggaggcaagaaagggtcctcagctcagggagcacttgttggtgttctttatgtcacaagttttcaggtcagtactgggaggcttgttgccgtttcctgatctccggcctcctgacttgagcaagatgtcccgggccagggaactaaaagcctcatccacattcatactggatttagcactagtttcgaaaaatcggattccatgctctcgagccaacttatcggcctgctccttctgcaccttcctcttggcctccatgtcacatttgttccctagcaagaggtgctccaccccagctgaggcattctccatgatgcttttcatccagttctgaatattctcgaaagatttctcatccgtgatgtcgtatgctaggataatgcccatggctccacggtagtaggcagtagttattgtcttgaaccgctcttggccagctgtgtcccagacttgtagtttgatcttcttcccctctatatccacagtgcggatcttgaaatcaattccgatggtggagatgtaagtgttgttgaagttgtcctctgcaaagcgaatgatcagacaagtcttgcccacccccgagtccccgatcagcagcaacttgaagaggtggtcgtaggctttggccatggcggacaccgggggagccggggaagggatggggctatttatttatttttgagacggaatcgctctgttgtccaggctggagtgcagtcgtgtgatctcggctcactgctacctctgcctcccaggttcaagcaattctcgtgcctcagcctcctgagtagctgggattacaggcacgcaccaccacacccagctaatttttgtatttttagtagagacaggttttcaccacgttggccaggctggtctcaaactcctgacctcaggtgatctgcccatctcgccctcccaaagtgctaggattacaggtgtaagccaccacgcctagcccaaattgactaattgtatgtgtctcggtttcctcacctataaaatatagagactggactaaatgacctctagactggctctgatctgcctgactgaccttaaggctgacaactggtactgggttggactccagtggctatatataccgagaactctgtctctgttgataggtgatagacttctggagacttcatatgtatttggtttagggactcaaagctaacaagtggaagggggcttgaggaatggagtcttactctagctgggactgctaagacacttttactgttatgcctactttgctgcactgcttgggagagttgcccacattaaagaacatcctccatgggtctcctgcatctagtgggctaacccatggtcaggcctcaatcctccctagttaatgggtcattttataagtcattcttgtagagccgtacttctttttttttttttttgatggagtcttgctctgtcacccaggctggagtgcagtggcaaagtctcgacccactgcagcctctgcctcccaggttcaagcaattctcctgcttcagcctcccaagtagctgagattacaggtgtcagccaccacacctggctaatttttgtgtttttaatagagacggggtttcaccatgttcgccagactggtgttgaattcctgaccttaggtgatccgcccacctcagcctcccaaagtgctgggatttcaggcatgagtcactgcacccggcagagctgcacttctaagggaagttaaatctgatttcttctcttctgagctaaaaaggttgaaaggaagagaaacctgccccatctcccttttttttgtctcgggtttgaaggtaataatcatcataccacttgactggtttaccaaaaaaaaaaaaaaaaattagtatttttgtgggaaaaaatgagaatagaaaataaataattgaatcttatatgtattatttcatttctgtaccacagaatttttgagagtctagctattatattttttaaatgatacccttataaacatgataagattaaagatcaaagcttagaggtggctcaacaattgctgtgaacagggaggaaggcaggacatattctttctttttcagaggtgggatctcactatgttgcccaggctggtctcaaactcctgggctcaagtgatcctcctgccttggcctcccaaaatgctggtattacaggcgtgaaccatgatgtgcagccagaacatactcttaaggctacatattagggtacgaggtagtcttttctaagtcagtagttactgatctctgagaatccaaggttgcttagtagcaagaaagcttgctgaccacatctgggctctggcttgacttcccatctctgagagttagtgacagagactttgcaactcaagcgtgtctgcaattgtttcctgtctttacactcccccagagctcaagtgatatgtttagccatgagaattcagtccattctaactcccacattttcctttattgtagagtagtaacattgaggcttaatattctaccccttggatcacatgctttgaaatacataaaaatgtaagggagtaagttgaaaaaaccagtaactttttctattgtttcttgagagtatagcatatatatgtcacctgaaggaaacttgatcagcttatcatctgtccttttttttttattatggtgtcacctgtcttctcttttatttattttttattttgagagacggagtcttgctctgttgcccaggctggagtacagtggcataatctcagctcactgcaacctccgccctctgggttcaagcgattctcctgcctcagcttcccaagtagctgggactacaggcatgtggcgctacacccagctaatttttgtattttttagtagagacggggtttcactatatgttggccaggctggtctcaaactcctgacctctcaaacaccagagtgagactctctctaaaaatggaaaataaattttaaaatgttataattaaagatactcatttaaattgaataaatttagctttatgaaaaatttgctgtatcatctttattttgatcctttcgtcataggccattgaaaacttaatcataaaatggtacatgtatatctgaatttttaagactgactgaccaaggggactacagaatacccagtagaatcaaagtaattgtcatgttcctctgtattaatctagtctactttgggaccttgagttctcacctctcattcttttgctaacttcctctttaccctttagttatgtctccttttttttttttttttttttccagagatagcgtcttgttctgtcgcccaggctggagtgcagtggtgtaatcagctcactacaaccttcaactcctgggctccagtgattctcccaccacagcctctggagtagctgggattacaggcacataccaccatgcccagctaatttttttaaatgttttctagagactcagtctcgctatgttgcctaggctggtctcaaactcctcacctcaagcaaggcttccccttttatctcccaaacccctgggattacaggcatgggccgctctgccaggcctgttttttctctttttctttctctgtaccactttcatattgtggcttcttccctgcccccgatctcccccctacccaccccaggtggagtcttgctctgttacccaggctggagtgtggtggcacgatctcggctcactgcaacctccgcctcccgggtttaagcagttctgcctcagcctcccgagtaggattacaaatgccggccaccaaccacacccggctaattttttttttttttttttagactgagtctcgctgttgctctgtcgccaggctggagtacagtggtgcaatctcagctcactgcaacctccacctcacaagttcaagcagttcacctgcctcaacctcccaagtagctgggactacaggcacgcgccaccacgcccagctaatttttgtatttttagtagagacggggtttcaccatgtttgccaggcttgtctcaaactcctgacctcctgatctgcctgcctttgcctcccaaagtgctgggattacaggcgtgagccactgtgcccgccttttattttttgagacggagtctcgctctgtcacccaggctggagcacagtggcgcatcagctcagtgcaccctctaccttctgggtttaagcgattctcctgcctcagcctctggagtagctgggattacaggtatgcaccaccacacccagctaattttttttgtatttttagtggagacggggtttcaccatgttggccaggcagggctcgaacttctgacctcaggtgatccacctcagcctcccaaagtgctgggattataggtatgagctactgcacccaggctgtggctgctttttaggaatatattgataacaactaatattgagatatattttaatagctattagcactatgctaaacacatctttcacttattatttgtagctatgaggatggtattttttccattttacaaaggtagaaggtaaggcttagagaggtagagaaattctctttatatcatattagtaatgattagtagcttaatatttatttagcacttagtatctatcaaatacttaaaatactttagttatttatatgcattatctcatttaatccttacaacacccttatgaagtaggtgcttataaggctattatctcattttacagatgaggaaatgaatgcacacatatatttagtgacttgctcaaggttcatagctagtaagtagagctgaaaaacaaacgtggagaattggactccagagcctttattcctctgaattgcctcctgtatgattttctgtctttacgatctagtaagtggggttactgaaaatttttaaccccagtttaactccagtcccactaattgtggtgacaaaataatgatgtttccccacatatgccatagagtatgatgtctgtgaagtcactaggatctgctttggaaaagcgaaagagtaatttgaacaagcaaagtacaactctcaagcaatgcttaggtttgggagagaggtttttgcatgctctgcctatgctaacttccctttgaatttcatagttcctttccgctcagagtcaggatgatgaaatgtattcagatttagacgattagaatctcaaagtcccaactcttctctctgttccctgccccaccagcagctttcttagccctcttagaagatagaggagctgattcagtgtattctttcatcaaatactgattgcttgcagacttaacgccctataccatcctctggagacttctgcatgtctttagaaggtatacctttctctgcctctaatttggagggctacagctgttaggcccctttggtgtggagggtaatctaatccctaggcaccagcaagacagctgcaagttgagagtaggtcaagcttactgattcttgatagactttcagatttggaaagatggcagaaacaaagtgaaaaaagagttgttaatgaaacaaagagttgataatgaatgtgatctgttggttgtatttctctctttaccttcaaccaaaaatgagaaaggatagattttgtggcaatgggaccctggttagatctttagaaatgtcttatcagggagaccggtcatatataaaggatacagcagcaactacccttctgcccttaggagtggtgactcttatcccacacccctagagtgaatctctcattttgacaaagagctaaggaaaaatgaaaagaaggccaggcacggtggctcatgcctgtaatatcagcactttggaaggccaaggcgggcagatcacctgaggtcaggacttcttagactagtctgaccaacatggagaaactccgtctctactaaaaatacaaaattagccaggcgtggtggtgcatgcctgtaatcccagctactcgggagactgaggtgggagaattgcttgaacccgggaggcagaggttgtggtgagccaagattgtgccattgcactccagcctgggcaacaagagtgacgtctcaaaaaaaaagaagaaaaggaaaagaagagcacagcaccaggatgccaaggagatactggggatctagggtaccggtgggtggatctggatattcttcaggccagctaaaggttgatcactttgtgtgactcaaacaaaaaactttgaagacctggtggggaattactggggaattaaaaactctcagttttcagtctctctatttcggctcccttggcagttagagattatgtggtagggcagactccagaagcagttcttattttgctcttcccaactcttaccactgaggatcagctgcctgggaccttctcagagctaagtcctcatagaagcaaggagatgaagaggttctatccttctctgaaaagcgattgcagcttcaatggacgtatgtttaattttattcacttttttttcttgcaggagtgttgaagcctggaaatcccctccccttccccctcccccctttacagtatccccctccctccaccctttcccattctgataatctggccatgactagcagaagcacagctaggcccaatgggcaaccccaggccagcaaaatttgccagttcaaattggtcctgctgggagaatctgcagtgggaaagtcaagcctggtattacgttttgtcaaagggcagttccatgagtaccaggagagcaccattggaggtgagtgccttggggtaataggagattgaatgtttggtaagggtttttttttttttagatggagtcttgctctgttacccaggctggagtgcagtggcgcaatcttggcttactgcaacctctgtctcccaggttcgagcgattctcatgcctcagcctcccgagtaactgggattacaggtgcacaccgtggcacctgtctaatttttgtatttttagtggagagggggtttcaccatcatgttggccaggttggtctcaaactcctgacctcaggtgatctgcctgcctcggcctcccaaagtgctgggattacaggcgtgagtcaccacgccgggccggtaaggcttttgaaaagagatataagacctgattatggagctggccctcttagtcccattcttttccccagaaatggaaaccctttataaaaacagaggccggtcccagtggcccaccactttgggaggccaagatgggcggatcacctgaggtcaggagttcgagaccagcctgcccaacatggcgaaatcctgtctctactaaaaatacaaaaaattagccaggcgtggtggcaggcgcctgtaatcccagctactcgggaggctaaggcaggagaatcacttgaacccagggggcagaggttgtagtgagccgagattgcgccactgcactccaccctgggcgacaagagcaaaactccatctccaaaaaaaaaaaaaaatcaaaatctggtaaaataggctgggcatggtgggtcacacctgtaatcccagcatttgggaggccaaggcaggcggatcacttgaggccaggagttcaagaccagcctggccaacaaggtgaaatccccgtctctactaaaaatacaaaaaattagctgggcgtggtggcacatgcctataattccagctactcaggaggctgaggtaggagaactacttgaacccaggagatggaggttgcagtgagccaagattgcgccattgcactccagcctgggtgactagagtgaaaatccgtctcaaaaaaacaaaacaacaacaacaacaacaaagattagccgggcatggtggcacatgcctgtaatcccagctacttgggaagctgaggcaggagactcgcttgaactcatgaggcggaggttgcagtgagccaaaatcacgccagtgcattttatcctaggcgaaggagcgagactgtttcaaaaacaaaaaaaaatctggtaaaatagaggctggaactaatgcaaaatacaaagggtgtctgtctttctcatctttgctaccttttccccactactaccccaaaatagggtgctaattcaataaaggatcttttatgagaacttccaaattattccttccccttgttatttttatttatttatttatttatttttgagacggagtctctgtcgcccagactggagtgcagtggtgcaatcttggctcattgcaacttctgcctcccaggttcaagtgattctcgtgcctcagcctcctgagcagcggagattacaggcacataccaccatgcccggctaatttttgtatttgtatagagacagggtttcaccgtgttggccaggctggtctcaaactcctgacttcaagtgatccacccgcctcggcctcccaaagtgctgggattacaagcatgagccaccgtgcctggcctctttcccctttttattagtcatcttggaaatgtattcctggacctgcagcagattatatgaaaaagtaacagccaaataatattgataatgatgggacttgccatcaagctttaaaatcttctaattaattctttttttttttttttttttttttggatactgagtctcaccctgttgcccaggctggagtgcagtggtgcagtggttgcccattgcaacttccgcttccccagttcaagcacttctgctgcctcagcctcccaagtagctggaattacaggcgtccatcaccatgcctggttaacttttgtgtttttagtagaggcggggtttcactatgttggccaggctggtctcgaactcctgacctcaagccatccacctgccttggcctcccaaagtgctgggattacaggcatgagccactgcgcccagccaatcctctaattaattcttttgtttgtttgcgtttgtttgtttgttttttgagacggagttccgctcttgttgcccaggctgaagtgcagtggcgccatcttggctcactgcaacctccacctcccaagttcaagggattctccagcctcagcctcccgagtagctgtgattacaggtgtccaccaccacgcctggctaatttttgtatttttagtagagacgggttttgccgtgttggccagactggtctcgaactcctgacctcaggtgatccacctgcctcagcccccacctcccaaagtgctgggattacaggcgtgagctaccgtgcccagcccaatcttctaattaattcttgatgtgacttttatctgaagctattttctctgtcatttgttattctcctattttggttagaagaaggatgactcgtataagtgccagttcttctgtccctcttagtttatgatgtacccccattccttagctagtgacatttctggcaggaaggacttagccaagggcagtcttaatcctggtttcaagacttacatgtaaggagaactcaaaaccttttcctgtagctgactatcctgggtggtgactggtcttagtgtagggcagttacattttgaagggggggagggatgttcccattcatcctcccacttacagcatcttcccctccattctctcatccatagcggccttcctcacccagtccgtttgtctagatgacacaacagtgaagtttgagatctgggacacagctgggcaggagcgatatcacagcttagcccccatgtactacaggggtgcccaagctgcaatcgtggtttacgacattactaatcaggtaagtgagctaagaagactgtccttgttggctggacatggtggcttacgcctataatcccaacactttaggatgccaaggcgggaggatcatgaggtcaagagattgagaccatcctggccaacatggtgaaaccccgtctctactaaaattacaaaaattagttgggcgtggtggtgcgcgcctgtagtcccagctactcgggaggctgaggcaggagaatcgcttgaacccaggaggcggaggttgcagtgagccgagatcgagccactgcactctagcctcggcgacagagcaaaactccgcctcaaaaaaaaaagaaaaaagactgtccttgcttatatttagaggagttagtttggggcagggggtaagggggcagaaaacgggttcttgaaatagcaaataagagtacaaattatgcttccaagtgctaagaagacagataatgaattatcagagacctgtggtttcactgagggaagaccacctagaagaggtgaattttgagactcattttaaaaggtgatggatatggattggcagtcattccagcctactcattctcttcatgttttcctaggaaacctttgcccgagcaaagacatgggtgaaggaactacagcgacaggccagtcctagcatcgttattgccctggcagggaacaaagctgacctggccaacaaacgtatggtggagtatgaagtaaggtggcccgtggagttcctctctaacacttcctctgttcctgggacctctttttttccaaaccagccctctctgaaaacgtcaacagaggacattcattgtctcattccccagttctacaccaagttaaatacagcaacactgtgaccctaatgacagccaggagattttcaaaggagtcaggagaaaactccagagcagagggttagggaggtaccagctgtgggggtaccagtgtgaaaacaggaaggagggagcaattaaatttgtggtaagggactattcaagtgtcacaacccaaaagcccccaactaacttaccctctcccctataattaagctttctgacatttgtgtgttggactgagtggacatggggtcatcttgagggagttgtcattaaattatgcatctaggctagctggctcaaaggggtattaattaaggggagggaacctaggattttgcctagctgttgtgctgcatgggagtggaaaggcaatactcgttcccaccctacattctgagcactaatacatcccactccttgcaggaggcccaggcatatgcagatgacaacagcttattgttcatggagacttcagccaagacagctatgaacgtgaatgatctcttcctggcaataggtaaggtcagaacatcctgaggtcctcctttttccctcgtttataggcaaaattatagctaacccaaatcaaggataggtgcgagtatctccttttgcaaaaactttaggtatggaaataccttaactttctgttatgacctccatccttggctgcagctttagctcccttgtcttcaatgtgtaagtttgccggccaggtgtggtggctaacacctgtaatcccagcattttgggaggccgaggcgggcggatcacgaggtcaagagatcaagaccatcctggccaatgtggtgaaaccccgtctctactaaaaatacaaaaattagctgggcgtggtggcgcacacctgtagtcccagctacttgggaggctgagccaggataatcacttgaacccgggaggtggaggttgcagtgagccgagattgtgccactgcactccatcctggcaacagagcgagactccatctcaaaaaaaaaaaaaaagtttgcaaatagtgaaccctcccatcttcagaacattcttttaatctctcaaattctcccttttccccaattcagtagccgtttttggcgggtggaggcagaggggtagggaagtaaagtctaccatactttgttctcttctctttttatctctagctaagaagttgccaaagagtgaaccccagaatctgggaggtgcagcaggccgaagccggggtgtggatctccatgaacagtcccagcagaacaagagccagtgttgtagcaactgagggggtggctagcagcaaacaagtatggagctagcacaagagctaagaaataacctccatccctacccctcagcacacaacccctacggtaacagcacactgagccctggctcccaagggctgcctcctgacagctccgtcatggcactttttaacgcttcagcaacaaacaccaggcagctgttgccactggcctcctaccccctactctggggcttgggggtcaactccccccaggacttaccttccaaaacaaactttcttcactttgtattataggtacaagacagcgacttacgtatcttttctcctcctccctagtgttcctccccattttttcagaaaacacttctgactcctgtcccttccccttctgcttttggtcagtccctgttcttgagcctcttttctcctctccccaggatgcagaaagtggtgaacccaggaactgaggaaggaggtttccagttcatttacattaagggccctgggggagaataaagctcagagcaggagggagtaaggaaacatttcctttttgtttttatttggttggagtttctcatatttgaaaacattgcggtatccatgatttggccttgtggagggtgttcctaggtagaggtgagaatggggaggcaagatctcaggcaccaggcaggaggtgccttgtaagctaactgggcggaggtggaggtgcagtgtcaactgtggctctgtaactcttcaaaggcccagtttcccctcacgcagcctcttaggtagcgtttcccctaatcgtgggggttggaccccagagtcttccaaagaattttcactggttgcctgcatctttggctctgctgtgatctgattggaggagggacagtttctggtacccatcctctgatttatacatatgcattttttcccctctggcctttagatggcctcagccccagccaccatatacccctgcagtttgcactttaattgatggtagttcagttggggtacttgttttatggaagttttgattgatttacttgccctcccaccttctttttaattcaatgaaatctgaggttaatgcgaggttcgaggagaggttatagataaaactaccagtggcagctactcaagtcctatctccactgttagcttcctccaactctaattattaacctatattcttgccaagctaactattgactataggtttgcctttcctggagaattaattgagcaattgaggagtgtctcaggatagcacaggccaaggtaggggagtaaaaaggaggtcaggcaaaagggaggagttttctgtcctttcccaggtttcacactcaatttgatatccattaccatgtcttttctacttccttgtaaataggtatgatctttattcccactgtacagtctgttctatcctctgcctcccatcaggccctgtttctttgttcctttgttaatatcttgaatttagtccctccatccttaatccccccatccctccccatcatgcaaccagtggtttaatccatgtaccaataggggctagtaccacagaggcctcctgtggtgccctcgtatcataccacctgttcctgtggagagggaatgaccggcactgaaggtaccttacaactggctcatattatcagaggaccttggtcctttctaaatctctagtctctcttcatatccttcatcaggtgttttaagatgtctctgagaagccatcaaggcaaaagagaactttaagttccttgttccagcccggagttttgggaaagaaagaaaggaaaggtcacagtgacctaggattggaaccttcctgcccttttggcttgcagactgccttctatcccagaacagctgagaaatctatgaagctgagattctgaaggacccagcttaggttcttccacttaggcctcaattcccttccttttccaggggcagccttagttcccatggccctgaaacacacacatttcccccttcctttcccagaagccactggccccccatagcacccagtgcatcctttttacaagtggaagaactaggatggctttccaaagtcttctagaaatgaagttctttctctgtgcagctttcccccttggagcaggagtgaagatgtttcattatcttgggcctgggaaaccacttccccaggcttctccctccccccacccccataggaacaggatttggccttagcttctgggcctatcggctgccttccctctacttcctaccacctcttctgccttcctttgagctctgttgggcttggggatcttagttttcttttgtttatttcccagctcatttttttcttctggtcagtttttttaagggggggtgttgtggttttttgtttttgttttgcttctgagaaagcatttgcctttcttcctctcccaacataacaatcgtggtaacagaatgcgactgctgatttaccgatgtatttaatgtaagtaaaaaaaggaaaaaaagaaaagggcattggagtgttgcttttttttattttattgttattattattattatttttgctatttgtcaggtactaggaatttggaagaaaggatacccagtaatgttctactgaatcagaaacacacctttccctgcatcttgatacatctttattccctttaatcttttcttaaacatctagtttagaaaatagcccttctattgctatttaatcacccctcttctaaggccactagattgttcatcaaatcaaaccctattatatctttttaggccctcttaacagaatgtatatgtgtagggtatggtctgtggatctttgggcccactgatcagattagagagaggggtgctatttgaagtagtatacaaaaatgtatgtgcatatttctttttttttttttaattgagacggagtctctgtcgctagcctggagtacagtggcacgatcttggctcacagcaatctccgcctcctgagttcaagtgattctcctgcctcagcctcctgagtagctaggattacaggcacgcaccaacacacccagctaatttttgtatttttagtagagacggggtttcaccatgttggtcaggctggtcttgaactcctgacctcgtgatccacccaccttggcctcccaaagtgctgggattacgggcgtgagccactgcgcccggccgtatgtgcatatttctaggatccatttctatatgtttctcaaaggggtccatgacccaaaggttgaaaaacatcactgagttagttttcttgtagcttccacctcaacgggaaaatttcctctggatctgctcttgactcctagtgtacttcaaacccttcagtccaccacagtctaaaggtcgagggaagggaaatgaaataggattatgtgtggttgcagtaggctttaaattccaaagaatctgaaggtggataggaaagaggactggtgccagacaaatctgacattctaggcctgtctctgtcaacttaaccagctgtggccttgatcaagttagttagtgccttccgcctcgtttcttcatctgtaaagtaaaagctgaagattaaggtcaattatgtaaagtatgtgtgtcacacaaaagtagatgacactattaggaaggaggcttttagatagtccctaactgacttctctgtatcttcctttggctgagacttttttttttttaggttgaagctcgctttctctctctctccctctttctccctctctctctctctctcactctctctctctccatatatatatacatatatatatatatatatattttttttttaacaactggtaggataggttgggcattagccttcttcagtgatttgattgtatacagattgaaatcctttccatttccaaacacttaagagccaaagccaacttgccaacttttcactgtcggttcccttaccttatatctcttggtaataccccccacccccgttccctgattcctggtaaaagctctagttggagagccgaaaggaaaggaaatgatctttcaaaattaaaggtgaacaccttcacttaaactgattaaaattgcagctccaccgtccggcctctagagggcagtgtatggatacatttgtccagattgggggactaggtttgataaattttgtcctgcatcaaatgacaaaagggtaataggaaatgtattatatttatgccccttactttgagataagagactacaaccttcatacttcggggtgttaagctgccattgctcttgttaaggggcagtttgttttttaagagatggggtcttgctctgttgtccaggctggagtgcagtgccgcgatcttggctcagtgcaacctcgaactcctgggcttaagcgatcctcccgcctcagcctcccgagtactgggactacaggcgtgtgccaccaaggggcgattattattttttttttctacgcaaaataaaagacggctattca

SEQ ID NO: 2711 - DNA, 22673 bp, Homo sapiens
  source 1..22673: mol_type = genomic DNA
aatcgagctattggctggagccccgccccagggcgaggaggagaaggaggggcaggagggtttggttgagctgcagctgtttgtctgttcgacacaggcttggggccgacgggggagacggagccccaggtaccgagctgatggagcccaaagggcaggggcggaagcgcccgggagatgagagcagcctggcctgagagcggaggcgggtctggtcctaagcgaggggttagagtggcccaccggagaggggagaagggggccgggccccggcaggcctaatgggggtcgctgaggaggggactgggcggcctgggaccccgaagttggtgagtcgggaaggcggctgggctgtggcggcggccaggccgagggccgggggctggaggcctggagcttgagtgagggcaggggcaggcctcattaagcagcgctgaagagggaggagctggggaaaggaacagggcagcgggtgaggtaagcccatttgccgggaggtgaggagggtcagacctgtcgcccgagccccgggggtgactggggctgggtccctgcagagaggttcattggaagggcctgagaagggttcttagttgggtaagaagcgttcttttcagggaaagtgcctattgtaaaaagaactgagggtgctatggtgttgagctgagagagatttgggttcagtgagggagaactggggaaaatgaagaaggctgtattaatctagaagactaaggtagttgaagtaatggaagcagggcctggtatcagttatgggaacttctgggaatgctgaagggtgggctgggggctctgggtcttgggagtacacactcttttgttccctttagtgtttagatgtggtaatttgaagctttttaaaactcccagggtagggatgaagatcaaagtaatttttttttttccatgactgttggctgctccaaactcagcccctacactttctgttggcctcatagctggtctatactgcagtctgtttcttaacttactgtttcatgtcctatgaaagagctaagaagttggattgggggcatgttttgtccacttctttcccacttaataatgtggtctatagcaaataccatgtctcctagaactgagaatctatttcatatctatttcattatctacatgggaaaggggcttagagatcctcagccatcaggagatcttctgatcatagttggtgaaacttttgtgggacttagacttgacttgggtatttcccaggcaggtaatggagttaacaggtccgaaactatgcggtgatatcactgaggaagagatttggggaagagtgagaaattccatttcaaaagcttggcatcaccccttgttctttgtctacttcaaaagcccagatttctgtgctgttagaaagttgggtcaaactatgaagtatctggggaagatggtgagtagagaaaaagatacagaggtgcagtagcccacgcctgtaatcccagcactttgggaggctgagacaggaggatcacttgagcccgggagttcgagggtgcagtgagccatgatcttcccactgcactccagcctgggcaacagaatgagaccctgtctccaaaaaaaaaaaagacaaagattgccaaagcagaggagtggagtaccctcctccccacatatttttaatggtctgctagccttcttagtccctcatagattggagcctattggattttcccttactgtacttcctccttttctgcgtctctaccaatatattttatcactacatttcttttttttttttttttttttttgagacggagtctcactgcaacctccacctcccaggttcaagagattctcctgcctcagcctcccaagtagctgggactacaggcgtgcgccaccacgcccagctaatttttgtatttttagtagagacagggttttaccatgttggccaggatggtctcaatctcttgacctcatgatccgcccacctcggcctcccaaagtgctgggattacaggcgtgagccaccacacccggccatcactacatttcttaattacaaaagttaatatgtacatattttaaaatatggaaggtgtacagcagtttaagaagtataaatcctcccacacataccttattcatatttcatttaggaaggtcaaggatcagagacagcaaatcagactaatcttgctttgctttgggggatgtgtcacaaaaggcaattgtgttttcatgttctcatcaaactctagtcttattctttctacagttttcccttctgggatgatactctgttatttattgtgttcctttcacagttcattttgtcttctaccaagtccgacaagcagagggctgtactgtgtgttattcaccttgagtacacacaaacacacacaccccaagttgtgtgctgggtgtcctaggaagtgcccaaagagatggaacaaaactttatggggagaaaggatcattttggttgggataattgttggcatctctgctaaagaaaggaatttcagacccttatctcaaattcatggtctctggatgttcatggtctctgcatgttcacattacttgactatccctttcttatccatgatgatgatggttctcctaagaggcccctgtatttgtctttcttttcttttcttctatttttagagacagggtcttgctttgtcacttaggctggagtacagtgtgtgtctttctgtagggatctgagaagctccaagcttatctggatttgaaatcggttttcctctaaatctcagagtcagagtacagctggggcatttcatactaccaccttattaattgaatttgtccttactagctttaaaagccctctgttgtacccagcctttgtacagcgcccattggaaacctcggttttttcccccaaggaacttttctcacctgcaagccagtcctagagacagttgtgtaggagtatgtgtgtgtgtttttagacggagtttcacttttgtcacccaggctggagtgcagtggcatgatctcggctcactgcaacgtctgcctcctaggttcacgcgattctcctgcctcagcctccagagtagctgggattacaggcgtgcaccaccacgaccagctaatttttgtattattagtagagacgggatttgaccatgttggccaggctggactctaactcctgacctcaggtgatccacgtgcctcagcctcccaaagcactgggattacaggagtgagccaccgcgcctggccgtgtgtgcgtgtgtgtgtgtgtgttttaatcctatctaatttttccaacagttttttgcatcctaagagagtttaggagtagaattatcaataaggaatttcatacatagacctggagttgcaaaaatatatttggagaagagagctttcccattgcccttcaagtcatacctcatatcttttaaaatttttttcctggacaatccctactgcataacatacctcatatcttctaactcttactttacctgggagcaaatattgcttattggtatgaattttacttctgagaaggaggcatagggtagaagaagcaagcgtatagtttgctccctaatcctaaagcatttcagattggaaggtaaccaaagtgtgagacaatgaacttataataaggaaatgcagcagccctcttggaggaaggataccataaaaccctacatggtatactcccacttccgttttgggaaagatttagccattgactcaacagtaactgaactgaataaggagctacccaggtgaacaaagtatgtgtacatttctgggcaaggttgtagcttctgttcagggacagtgggtaccttttcagagtgtctcctggttctgtggtgttatggctcctttttttaaacttgtgtttctcaagtcaggaattaatagatagtggcccaaagcttttgaccgttcaacatcaactgaaaattcagcgaactttgtttttagctatagttgcctcagtgtttgggtgggagggccacatattgggtgtgattaggccatctgaggcatagtaacgggtgacaggaaaagcagttagcccatgcgagttgcaatagtaccttgtgggcaagatcccaagggggccctccatccaagggagatcacagaggagccagggagagaattgattctgaggcctattaaaaatattcccaaatggggccgtgtgcggtggcatgcgcctgtaatcccagcactttgggaggctgaggcgggtggatcacgaggtcaggagattgagaccatcctggctaacacggtgaaaccccgtctctactaaacaaaatacaaaaaattagctgggcgtggtggtgggcgcctgtagtcccccagcttctcgggaggctgaagcaggagaatggcgtgaacctgggaggcagagcttgcagtgagccgagatcgcgtcactgcactccagcctgggcgactgagcaagactccgtctcaggaaaaaaaaaaaagaacccaaatggaattgagtaagatctgtccagatggtacagaaagggaggagttgattgggggagagaagtagaattacttagccttaatttagggagcatttaatgagcacctactagggatcaggcagcatgctgtgctctgaagattttaagataaactcccacttttaaagaagttcatagtttagcagagcagacagacacaatttatatactgtgataatgtgatacatactattatagaaatacagtcttttttttttttttttgagacggattcttgctttgctgtccaggctggagtacagtggtgcaatctgtgctcactgcaacctccgcctcccgggctcaagcaattctcatgtctcagcctcctgggtaactgggattacaagcctgtgccaacatgcccagctaatttttgtatttttagtagagacggggtttcaccatattggccaggctggtctcgaactcctaacctccagtgatccatctgccttggcctctcaaagtgctgggattacaggtgtgcgccaccacacctggccagaaatacagtcttaatactgtgggaccctacgggcctctagagaatgattaattctgtgggggagagggtgattatgtaatttcactgaagtaacatttgagcttggtcttatgagatatatagaattttgctaggcagacaagtagggacgggcattccaatcttacctaggtcaataatagggagtttgtactaccatactgataagaggtaagtatgctttttgcctcttggagaaatataagggaaagggtgcgagatgtggaaggaatctcatttaatccaatgactcattaggtaacactggatcaacaaaatgaagagctgagccaagtggtagaactctcatttcaagattttggtgacttgggtttaaacagagttggagagggagatgaaggtatttactggtttctgctctatcttccctacttagtaaaactctcacattaatcgcagggcccaccaaattctgcaaaagttaccgcttgttttcctattgcctctcattgaattgcttctatttcaactgtcctggcagggtttggtcatagaccttctagaaaagagtagtgatgaattaattcttctgtcagaaagatatgggactgcatcccagttgccaaggaaggcctgggtcttcttaatttgtttttagtcccaaagcaagtacttacctaaactgaatagaggcaggaactctatccagtctaagctctcgatcctgtcctggtgttctctttagagttcagcatttcctgcttccttaagaagtatagtggtataagaggcaggagtacctgactaggagtcctacatttactgcttagcagttggctgtatggtaacacttgacaagttgactaattttattttattttttatttatttatttattttttgtgcaaatggtggcctttaataccaagaaagaccatgacaagtgacagaacaggagcaaattccctagtgtagtgccgagctagccctttgcaggaccctaaaacctgatctagtaacagaataaatcagtgtatttacatttatgtttgccctgaaaacccaggtaaggtctgaagcctgaggcatctctccttcctttcctcctccctctcttcctacctccttgccttcgttcacttcctcaattcattcctctcccttctcccttcctctcttttccttcttttcctttctgcttttcccttttctcctttttctcctcattctctttaccatctacctatgtgtccctccaagcccctctgctatttctcccctgctcactccctctgctgttgtctccctcaggttcagcttccggggtggggaggcaagaaagggtcctcagctcagggagcacttgttggtgttctttatgtcacaagttttcaggtcagtactgggaggcttgttgccgtttcctgatctccggcctcctgacttgagcaagatgtcccgggccagggaactaaaagcctcatccacattcatactggatttagcactagtttcgaaaaatcggattccatgctctcgagccaacttatcggcctgctccttctgcaccttcctcttggcctccatgtcacatttgttccctagcaagaggtgctccaccccagctgaggcattctccatgatgcttttcatccagttctgaatattctcgaaagatttctcatccgtgatgtcgtatgctaggataatgcccatggctccacggtagtaggcagtagttattgtcttgaaccgctcttggccagctgtgtcccagacttgtagtttgatcttcttcccctctatatccacagtgcggatcttgaaatcaattccgatggtggagatgtaagtgttgttgaagttgtcctctgcaaagcgaatgatcagacaagtcttgcccacccccgagtccccgatcagcagcaacttgaagaggtggtcgtaggctttggccatggcggacaccgggggagccggggaagggatggggctatttatttatttttgagacggaatcgctctgttgtccaggctggagtgcagtcgtgtgatctcggctcactgctacctctgcctcccaggttcaagcaattctcgtgcctcagcctcctgagtagctgggattacaggcacgcaccaccacacccagctaatttttgtatttttagtagagacaggttttcaccacgttggccaggctggtctcaaactcctgacctcaggtgatctgcccatctcgccctcccaaagtgctaggattacaggtgtaagccaccacgcctagcccaaattgactaattgtatgtgtctcggtttcctcacctataaaatatagagactggactaaatgacctctagactggctctgatctgcctgactgaccttaaggctgacaactggtactgggttggactccagtggctatatataccgagaactctgtctctgttgataggtgatagacttctggagacttcatatgtatttggtttagggactcaaagctaacaagtggaagggggcttgaggaatggagtcttactctagctgggactgctaagacacttttactgttatgcctactttgctgcactgcttgggagagttgcccacattaaagaacatcctccatgggtctcctgcatctagtgggctaacccatggtcaggcctcaatcctccctagttaatgggtcattttataagtcattcttgtagagccgtacttctttttttttttttttgatggagtcttgctctgtcacccaggctggagtgcagtggcaaagtctcgacccactgcagcctctgcctcccaggttcaagcaattctcctgcttcagcctcccaagtagctgagattacaggtgtcagccaccacacctggctaatttttgtgtttttaatagagacggggtttcaccatgttcgccagactggtgttgaattcctgaccttaggtgatccgcccacctcagcctcccaaagtgctgggatttcaggcatgagtcactgcacccggcagagctgcacttctaagggaagttaaatctgatttcttctcttctgagctaaaaaggttgaaaggaagagaaacctgccccatctcccttttttttgtctcgggtttgaaggtaataatcatcataccacttgactggtttaccaaaaaaaaaaaaaaaaattagtatttttgtgggaaaaaatgagaatagaaaataaataattgaatcttatatgtattatttcatttctgtaccacagaatttttgagagtctagctattatattttttaaatgatacccttataaacatgataagattaaagatcaaagcttagaggtggctcaacaattgctgtgaacagggaggaaggcaggacatattctttctttttcagaggtgggatctcactatgttgcccaggctggtctcaaactcctgggctcaagtgatcctcctgccttggcctcccaaaatgctggtattacaggcgtgaaccatgatgtgcagccagaacatactcttaaggctacatattagggtacgaggtagtcttttctaagtcagtagttactgatctctgagaatccaaggttgcttagtagcaagaaagcttgctgaccacatctgggctctggcttgacttcccatctctgagagttagtgacagagactttgcaactcaagcgtgtctgcaattgtttcctgtctttacactcccccagagctcaagtgatatgtttagccatgagaattcagtccattctaactcccacattttcctttattgtagagtagtaacattgaggcttaatattctaccccttggatcacatgctttgaaatacataaaaatgtaagggagtaagttgaaaaaaccagtaactttttctattgtttcttgagagtatagcatatatatgtcacctgaaggaaacttgatcagcttatcatctgtccttttttttttattatggtgtcacctgtcttctcttttatttattttttattttgagagacggagtcttgctctgttgcccaggctggagtacagtggcataatctcagctcactgcaacctccgccctctgggttcaagcgattctcctgcctcagcttcccaagtagctgggactacaggcatgtggcgctacacccagctaatttttgtattttttagtagagacggggtttcactatatgttggccaggctggtctcaaactcctgacctctcaaacaccagagtgagactctctctaaaaatggaaaataaattttaaaatgttataattaaagatactcatttaaattgaataaatttagctttatgaaaaatttgctgtatcatctttattttgatcctttcgtcataggccattgaaaacttaatcataaaatggtacatgtatatctgaatttttaagactgactgaccaaggggactacagaatacccagtagaatcaaagtaattgtcatgttcctctgtattaatctagtctactttgggaccttgagttctcacctctcattcttttgctaacttcctctttaccctttagttatgtctccttttttttttttttttttttccagagatagcgtcttgttctgtcgcccaggctggagtgcagtggtgtaatcagctcactacaaccttcaactcctgggctccagtgattctcccaccacagcctctggagtagctgggattacaggcacataccaccatgcccagctaatttttttaaatgttttctagagactcagtctcgctatgttgcctaggctggtctcaaactcctcacctcaagcaaggcttccccttttatctcccaaacccctgggattacaggcatgggccgctctgccaggcctgttttttctctttttctttctctgtaccactttcatattgtggcttcttccctgcccccgatctcccccctacccaccccaggtggagtcttgctctgttacccaggctggagtgtggtggcacgatctcggctcactgcaacctccgcctcccgggtttaagcagttctgcctcagcctcccgagtaggattacaaatgccggccaccaaccacacccggctaattttttttttttttttttagactgagtctcgctgttgctctgtcgccaggctggagtacagtggtgcaatctcagctcactgcaacctccacctcacaagttcaagcagttcacctgcctcaacctcccaagtagctgggactacaggcacgcgccaccacgcccagctaatttttgtatttttagtagagacggggtttcaccatgtttgccaggcttgtctcaaactcctgacctcctgatctgcctgcctttgcctcccaaagtgctgggattacaggcgtgagccactgtgcccgccttttattttttgagacggagtctcgctctgtcacccaggctggagcacagtggcgcatcagctcagtgcaccctctaccttctgggtttaagcgattctcctgcctcagcctctggagtagctgggattacaggtatgcaccaccacacccagctaattttttttgtatttttagtggagacggggtttcaccatgttggccaggcagggctcgaacttctgacctcaggtgatccacctcagcctcccaaagtgctgggattataggtatgagctactgcacccaggctgtggctgctttttaggaatatattgataacaactaatattgagatatattttaatagctattagcactatgctaaacacatctttcacttattatttgtagctatgaggatggtattttttccattttacaaaggtagaaggtaaggcttagagaggtagagaaattctctttatatcatattagtaatgattagtagcttaatatttatttagcacttagtatctatcaaatacttaaaatactttagttatttatatgcattatctcatttaatccttacaacacccttatgaagtaggtgcttataaggctattatctcattttacagatgaggaaatgaatgcacacatatatttagtgacttgctcaaggttcatagctagtaagtagagctgaaaaacaaacgtggagaattggactccagagcctttattcctctgaattgcctcctgtatgattttctgtctttacgatctagtaagtggggttactgaaaatttttaaccccagtttaactccagtcccactaattgtggtgacaaaataatgatgtttccccacatatgccatagagtatgatgtctgtgaagtcactaggatctgctttggaaaagcgaaagagtaatttgaacaagcaaagtacaactctcaagcaatgcttaggtttgggagagaggtttttgcatgctctgcctatgctaacttccctttgaatttcatagttcctttccgctcagagtcaggatgatgaaatgtattcagatttagacgattagaatctcaaagtcccaactcttctctctgttccctgccccaccagcagctttcttagccctcttagaagatagaggagctgattcagtgtattctttcatcaaatactgattgcttgcagacttaacgccctataccatcctctggagacttctgcatgtctttagaaggtatacctttctctgcctctaatttggagggctacagctgttaggcccctttggtgtggagggtaatctaatccctaggcaccagcaagacagctgcaagttgagagtaggtcaagcttactgattcttgatagactttcagatttggaaagatggcagaaacaaagtgaaaaaagagttgttaatgaaacaaagagttgataatgaatgtgatctgttggttgtatttctctctttaccttcaaccaaaaatgagaaaggatagattttgtggcaatgggaccctggttagatctttagaaatgtcttatcagggagaccggtcatatataaaggatacagcagcaactacccttctgcccttaggagtggtgactcttatcccacacccctagagtgaatctctcattttgacaaagagctaaggaaaaatgaaaagaaggccaggcacggtggctcatgcctgtaatatcagcactttggaaggccaaggcgggcagatcacctgaggtcaggacttcttagactagtctgaccaacatggagaaactccgtctctactaaaaatacaaaattagccaggcgtggtggtgcatgcctgtaatcccagctactcgggagactgaggtgggagaattgcttgaacccgggaggcagaggttgtggtgagccaagattgtgccattgcactccagcctgggcaacaagagtgacgtctcaaaaaaaaagaagaaaaggaaaagaagagcacagcaccaggatgccaaggagatactggggatctagggtaccggtgggtggatctggatattcttcaggccagctaaaggttgatcactttgtgtgactcaaacaaaaaactttgaagacctggtggggaattactggggaattaaaaactctcagttttcagtctctctatttcggctcccttggcagttagagattatgtggtagggcagactccagaagcagttcttattttgctcttcccaactcttaccactgaggatcagctgcctgggaccttctcagagctaagtcctcatagaagcaaggagatgaagaggttctatccttctctgaaaagcgattgcagcttcaatggacgtatgtttaattttattcacttttttttcttgcaggagtgttgaagcctggaaatcccctccccttccccctcccccctttacagtatccccctccctccaccctttcccattctgataatctggccatgactagcagaagcacagctaggcccaatgggcaaccccaggccagcaaaatttgccagttcaaattggtcctgctgggagaatctgcagtgggaaagtcaagcctggtattacgttttgtcaaagggcagttccatgagtaccaggagagcaccattggaggtgagtgccttggggtaataggagattgaatgtttggtaagggtttttttttttttagatggagtcttgctctgttacccaggctggagtgcagtggcgcaatcttggcttactgcaacctctgtctcccaggttcgagcgattctcatgcctcagcctcccgagtaactgggattacaggtgcacaccgtggcacctgtctaatttttgtatttttagtggagagggggtttcaccatcatgttggccaggttggtctcaaactcctgacctcaggtgatctgcctgcctcggcctcccaaagtgctgggattacaggcgtgagtcaccacgccgggccggtaaggcttttgaaaagagatataagacctgattatggagctggccctcttagtcccattcttttccccagaaatggaaaccctttataaaaacagaggccggtcccagtggcccaccactttgggaggccaagatgggcggatcacctgaggtcaggagttcgagaccagcctgcccaacatggcgaaatcctgtctctactaaaaatacaaaaaattagccaggcgtggtggcaggcgcctgtaatcccagctactcgggaggctaaggcaggagaatcacttgaacccagggggcagaggttgtagtgagccgagattgcgccactgcactccaccctgggcgacaagagcaaaactccatctccaaaaaaaaaaaaaaatcaaaatctggtaaaataggctgggcatggtgggtcacacctgtaatcccagcatttgggaggccaaggcaggcggatcacttgaggccaggagttcaagaccagcctggccaacaaggtgaaatccccgtctctactaaaaatacaaaaaattagctgggcgtggtggcacatgcctataattccagctactcaggaggctgaggtaggagaactacttgaacccaggagatggaggttgcagtgagccaagattgcgccattgcactccagcctgggtgactagagtgaaaatccgtctcaaaaaaacaaaacaacaacaacaacaacaaagattagccgggcatggtggcacatgcctgtaatcccagctacttgggaagctgaggcaggagactcgcttgaactcatgaggcggaggttgcagtgagccaaaatcacgccagtgcattttatcctaggcgaaggagcgagactgtttcaaaaacaaaaaaaaatctggtaaaatagaggctggaactaatgcaaaatacaaagggtgtctgtctttctcatctttgctaccttttccccactactaccccaaaatagggtgctaattcaataaaggatcttttatgagaacttccaaattattccttccccttgttatttttatttatttatttatttatttttgagacggagtctctgtcgcccagactggagtgcagtggtgcaatcttggctcattgcaacttctgcctcccaggttcaagtgattctcgtgcctcagcctcctgagcagcggagattacaggcacataccaccatgcccggctaatttttgtatttgtatagagacagggtttcaccgtgttggccaggctggtctcaaactcctgacttcaagtgatccacccgcctcggcctcccaaagtgctgggattacaagcatgagccaccgtgcctggcctctttcccctttttattagtcatcttggaaatgtattcctggacctgcagcagattatatgaaaaagtaacagccaaataatattgataatgatgggacttgccatcaagctttaaaatcttctaattaattctttttttttttttttttttttttggatactgagtctcaccctgttgcccaggctggagtgcagtggtgcagtggttgcccattgcaacttccgcttccccagttcaagcacttctgctgcctcagcctcccaagtagctggaattacaggcgtccatcaccatgcctggttaacttttgtgtttttagtagaggcggggtttcactatgttggccaggctggtctcgaactcctgacctcaagccatccacctgccttggcctcccaaagtgctgggattacaggcatgagccactgcgcccagccaatcctctaattaattcttttgtttgtttgcgtttgtttgtttgttttttgagacggagttccgctcttgttgcccaggctgaagtgcagtggcgccatcttggctcactgcaacctccacctcccaagttcaagggattctccagcctcagcctcccgagtagctgtgattacaggtgtccaccaccacgcctggctaatttttgtatttttagtagagacgggttttgccgtgttggccagactggtctcgaactcctgacctcaggtgatccacctgcctcagcccccacctcccaaagtgctgggattacaggcgtgagctaccgtgcccagcccaatcttctaattaattcttgatgtgacttttatctgaagctattttctctgtcatttgttattctcctattttggttagaagaaggatgactcgtataagtgccagttcttctgtccctcttagtttatgatgtacccccattccttagctagtgacatttctggcaggaaggacttagccaagggcagtcttaatcctggtttcaagacttacatgtaaggagaactcaaaaccttttcctgtagctgactatcctgggtggtgactggtcttagtgtagggcagttacattttgaagggggggagggatgttcccattcatcctcccacttacagcatcttcccctccattctctcatccatagcggccttcctcacccagtccgtttgtctagatgacacaacagtgaagtttgagatctgggacacagctgggcaggagcgatatcacagcttagcccccatgtactacaggggtgcccaagctgcaatcgtggtttacgacattactaatcaggtaagtgagctaagaagactgtccttgttggctggacatggtggcttacgcctataatcccaacactttaggatgccaaggcgggaggatcatgaggtcaagagattgagaccatcctggccaacatggtgaaaccccgtctctactaaaattacaaaaattagttgggcgtggtggtgcgcgcctgtagtcccagctactcgggaggctgaggcaggagaatcgcttgaacccaggaggcggaggttgcagtgagccgagatcgagccactgcactctagcctcggcgacagagcaaaactccgcctcaaaaaaaaaagaaaaaagactgtccttgcttatatttagaggagttagtttggggcagggggtaagggggcagaaaacgggttcttgaaatagcaaataagagtacaaattatgcttccaagtgctaagaagacagataatgaattatcagagacctgtggtttcactgagggaagaccacctagaagaggtgaattttgagactcattttaaaaggtgatggatatggattggcagtcattccagcctactcattctcttcatgttttcctaggaaacctttgcccgagcaaagacatgggtgaaggaactacagcgacaggccagtcctagcatcgttattgccctggcagggaacaaagctgacctggccaacaaacgtatggtggagtatgaagtaaggtggcccgtggagttcctctctaacacttcctctgttcctgggacctctttttttccaaaccagccctctctgaaaacgtcaacagaggacattcattgtctcattccccagttctacaccaagttaaatacagcaacactgtgaccctaatgacagccaggagattttcaaaggagtcaggagaaaactccagagcagagggttagggaggtaccagctgtgggggtaccagtgtgaaaacaggaaggagggagcaattaaatttgtggtaagggactattcaagtgtcacaacccaaaagcccccaactaacttaccctctcccctataattaagctttctgacatttgtgtgttggactgagtggacatggggtcatcttgagggagttgtcattaaattatgcatctaggctagctggctcaaaggggtattaattaaggggagggaacctaggattttgcctagctgttgtgctgcatgggagtggaaaggcaatactcgttcccaccctacattctgagcactaatacatcccactccttgcaggaggcccaggcatatgcagatgacaacagcttattgttcatggagacttcagccaagacagctatgaacgtgaatgatctcttcctggcaataggtaaggtcagaacatcctgaggtcctcctttttccctcgtttataggcaaaattatagctaacccaaatcaaggataggtgcgagtatctccttttgcaaaaactttaggtatggaaataccttaactttctgttatgacctccatccttggctgcagctttagctcccttgtcttcaatgtgtaagtttgccggccaggtgtggtggctaacacctgtaatcccagcattttgggaggccgaggcgggcggatcacgaggtcaagagatcaagaccatcctggccaatgtggtgaaaccccgtctctactaaaaatacaaaaattagctgggcgtggtggcgcacacctgtagtcccagctacttgggaggctgagccaggataatcacttgaacccgggaggtggaggttgcagtgagccgagattgtgccactgcactccatcctggcaacagagcgagactccatctcaaaaaaaaaaaaaaagtttgcaaatagtgaaccctcccatcttcagaacattcttttaatctctcaaattctcccttttccccaattcagtagccgtttttggcgggtggaggcagaggggtagggaagtaaagtctaccatactttgttctcttctctttttatctctagctaagaagttgccaaagagtgaaccccagaatctgggaggtgcagcaggccgaagccggggtgtggatctccatgaacagtcccagcagaacaagagccagtgttgtagcaactgagggggtggctagcagcaaacaagtatggagctagcacaagagctaagaaataacctccatccctacccctcagcacacaacccctacggtaacagcacactgagccctggctcccaagggctgcctcctgacagctccgtcatggcactttttaacgcttcagcaacaaacaccaggcagctgttgccactggcctcctaccccctactctggggcttgggggtcaactccccccaggacttaccttccaaaacaaactttcttcactttgtattataggtacaagacagcgacttacgtatcttttctcctcctccctagtgttcctccccattttttcagaaaacacttctgactcctgtcccttccccttctgcttttggtcagtccctgttcttgagcctcttttctcctctccccaggatgcagaaagtggtgaacccaggaactgaggaaggaggtttccagttcatttacattaagggccctgggggagaataaagctcagagcaggagggagtaaggaaacatttcctttttgtttttatttggttggagtttctcatatttgaaaacattgcggtatccatgatttggccttgtggagggtgttcctaggtagaggtgagaatggggaggcaagatctcaggcaccaggcaggaggtgccttgtaagctaactgggcggaggtggaggtgcagtgtcaactgtggctctgtaactcttcaaaggcccagtttcccctcacgcagcctcttaggtagcgtttcccctaatcgtgggggttggaccccagagtcttccaaagaattttcactggttgcctgcatctttggctctgctgtgatctgattggaggagggacagtttctggtacccatcctctgatttatacatatgcattttttcccctctggcctttagatggcctcagccccagccaccatatacccctgcagtttgcactttaattgatggtagttcagttggggtacttgttttatggaagttttgattgatttacttgccctcccaccttctttttaattcaatgaaatctgaggttaatgcgaggttcgaggagaggttatagataaaactaccagtggcagctactcaagtcctatctccactgttagcttcctccaactctaattattaacctatattcttgccaagctaactattgactataggtttgcctttcctggagaattaattgagcaattgaggagtgtctcaggatagcacaggccaaggtaggggagtaaaaaggaggtcaggcaaaagggaggagttttctgtcctttcccaggtttcacactcaatttgatatccattaccatgtcttttctacttccttgtaaataggtatgatctttattcccactgtacagtctgttctatcctctgcctcccatcaggccctgtttctttgttcctttgttaatatcttgaatttagtccctccatccttaatccccccatccctccccatcatgcaaccagtggtttaatccatgtaccaataggggctagtaccacagaggcctcctgtggtgccctcgtatcataccacctgttcctgtggagagggaatgaccggcactgaaggtaccttacaactggctcatattatcagaggaccttggtcctttctaaatctctagtctctcttcatatccttcatcaggtgttttaagatgtctctgagaagccatcaaggcaaaagagaactttaagttccttgttccagcccggagttttgggaaagaaagaaaggaaaggtcacagtgacctaggattggaaccttcctgcccttttggcttgcagactgccttctatcccagaacagctgagaaatctatgaagctgagattctgaaggacccagcttaggttcttccacttaggcctcaattcccttccttttccaggggcagccttagttcccatggccctgaaacacacacatttcccccttcctttcccagaagccactggccccccatagcacccagtgcatcctttttacaagtggaagaactaggatggctttccaaagtcttctagaaatgaagttctttctctgtgcagctttcccccttggagcaggagtgaagatgtttcattatcttgggcctgggaaaccacttccccaggcttctccctccccccacccccataggaacaggatttggccttagcttctgggcctatcggctgccttccctctacttcctaccacctcttctgccttcctttgagctctgttgggcttggggatcttagttttcttttgtttatttcccagctcatttttttcttctggtcagtttttttaagggggggtgttgtggttttttgtttttgttttgcttctgagaaagcatttgcctttcttcctctcccaacataacaatcgtggtaacagaatgcgactgctgatttaccgatgtatttaatgtaagtaaaaaaaggaaaaaaagaaaagggcattggagtgttgcttttttttattttattgttattattattattatttttgctatttgtcaggtactaggaatttggaagaaaggatacccagtaatgttctactgaatcagaaacacacctttccctgcatcttgatacatctttattccctttaatcttttcttaaacatctagtttagaaaatagcccttctattgctatttaatcacccctcttctaaggccactagattgttcatcaaatcaaaccctattatatctttttaggccctcttaacagaatgtatatgtgtagggtatggtctgtggatctttgggcccactgatcagattagagagaggggtgctatttgaagtagtatacaaaaatgtatgtgcatatttctttttttttttttaattgagacggagtctctgtcgctagcctggagtacagtggcacgatcttggctcacagcaatctccgcctcctgagttcaagtgattctcctgcctcagcctcctgagtagctaggattacaggcacgcaccaacacacccagctaatttttgtatttttagtagagacggggtttcaccatgttggtcaggctggtcttgaactcctgacctcgtgatccacccaccttggcctcccaaagtgctgggattacgggcgtgagccactgcgcccggccgtatgtgcatatttctaggatccatttctatatgtttctcaaaggggtccatgacccaaaggttgaaaaacatcactgagttagttttcttgtagcttccacctcaacgggaaaatttcctctggatctgctcttgactcctagtgtacttcaaacccttcagtccaccacagtctaaaggtcgagggaagggaaatgaaataggattatgtgtggttgcagtaggctttaaattccaaagaatctgaaggtggataggaaagaggactggtgccagacaaatctgacattctaggcctgtctctgtcaacttaaccagctgtggccttgatcaagttagttagtgccttccgcctcgtttcttcatctgtaaagtaaaagctgaagattaaggtcaattatgtaaagtatgtgtgtcacacaaaagtagatgacactattaggaaggaggcttttagatagtccctaactgacttctctgtatcttcctttggctgagacttttttttttttaggttgaagctcgctttctctctctctccctctttctccctctctctctctctctcactctctctctctccatatatatatacatatatatatatatatatattttttttttaacaactggtaggataggttgggcattagccttcttcagtgatttgattgtatacagattgaaatcctttccatttccaaacacttaagagccaaagccaacttgccaacttttcactgtcggttcccttaccttatatctcttggtaataccccccacccccgttccctgattcctggtaaaagctctagttggagagccgaaaggaaaggaaatgatctttcaaaattaaaggtgaacaccttcacttaaactgattaaaattgcagctccaccgtccggcctctagagggcagtgtatggatacatttgtccagattgggggactaggtttgataaattttgtcctgcatcaaatgacaaaagggtaataggaaatgtattatatttatgccccttactttgagataagagactacaaccttcatacttcggggtgttaagctgccattgctcttgttaaggggcagtttgttttttaagagatggggtcttgctctgttgtccaggctggagtgcagtgccgcgatcttggctcagtgcaacctcgaactcctgggcttaagcgatcctcccgcctcagcctcccgagtactgggactacaggcgtgtgccaccaaggggcgattattattttttttttctacgcaaaataaaagacggctattca

SEQ ID NO: 2712 - DNA, 22673 bp, Homo sapiens; identical to SEQ ID NO: 2711
  source 1..22673: mol_type = genomic DNA

SEQ ID NO: 2713 - DNA, 30069 bp, Homo sapiens
  source 1..30069: mol_type = genomic DNA
ttgtgaggtcgatcgatcggctgactatattgacaagatactgattggttacatgttgaagaaaacatacaatacaaaatacagaaaaagttggttccgtcccctcccactcccccccttacccacccacccccaaatactcatcatcatgatttggtcagaacagggctcagagccagaggttggggtgaccgagggtggaggggttgtgggcaatgggttcgtggctgtcacaataatgctgtgataatgctgtggtttcccagcagggaggtgggagcggggagggggctgcagcctgatgagagccagctgaaggaagagctgcctctcccttcctaagccccttcccaaggtctgccccaccgcccaaaccaaagaccactccgaacaaagtgaggatgtggatgctcttgctgggtccgctgttccgcaggagggaaagaaagggtagctgcactgaccccactgtccccatatacaagggttggggggcaagagcatgtggctactcccagcaagggaaaatgggagagcagtagaaaggggaggaagtgggaagagcagaagatcatatatattaaaaaagtgacttaagacttaaaattgaattagtatttgtacagaaaggtgcaggtggaatgactcactccggcctatgatcaaaattatatggagaaatcatggtggacccctccccctgcccccccagtggtggcccgagtcgttaagtgcgattggttagagtggattccagtcgggtcattcaggcggaggaggcgggggcagcgggcaggcaaggggggctcagttgctgcagcactggctccggctggctgggttgttctcctggaggtccacacctcggtttcggcctggagcaccagttgcattctggggctcgttcttgggaagcttcttagctgtttgggagggggaaaagtgcatttgttgggggtaccccaataactctcccagttccactggagcagattctggcctttatacccaatcagtggtaactcacatattgagggcttctgtgtgtcaggtgcattctgattgttttcaggaaactgcggcaaagtaaggttaaataacttgcccaagactacagagctaatgagtggtagagccaggatctgcaacccaggaaggaagattccagagccaaatgagctaaaaactcctaggcagtgggtaggggtagtgatggcaggctctgaaatgggtggcaggctacaggctcagagagtgaaatgttgagactctggcccaggcttcaggaacttctcgggtgaacaaccaacatctacatctgggagtcaggtgatgatgaaaacaattttatcagaaggttaaaagtggtgaagggggctgggcgcagtggcttacgctcgtaatcccagcactttgggaggccgaggcgggtggatcacgaggtcaggagatcgagaccatcctggctaacaccgtgaaaccccgtctctaccaaaaatacaaaaaattagctgggagtggtggtgggcaccagtagtcccagctgctcgagaggctgaggcaggagaatggcgtgaacctggggggcggagcttgcagtgagtcgagatcgtgccactgaactccagcctgggtgatagagcgagactccatctcaaaaaaaaaaaaaaaaaaaaaaaaaaagagtggtgaagggaccccgcaggcccactctagaccagcagacaggtgatatgcccttgctgtggtggagagaggaggggaggagaagcaactgacctattgccatgaagatttcgttcacgttcattgcagtctttgctgatgtctccatgaacagcaaactgttgtcgtctgcataggcttgtgcttcctggtttggatggaggtgagaggaggtgagagggaaatgttggcaggggccagggcccagggcccaggatacaaaccttccttattcgagcaccttatcataatagagatcagctggacacacacaggagttttcaggcctaaggctgccctgatctgggtttccccgctcatgtatatcacctctcagctcacaatcactagcagatgtcttacccgggtttccccaggtccaccctgccttcttgctcttcaaaatcactaggctaggaaatacttctagaaagttaacctacaaatacacttacatgtttgcacaaaagcacaaaagtatgtggatgtctactgcagcactgttttcagtcttttgctattattagggattggtaaaaaattatcatatacagtatgtatagcacactgccatcaatgtaaagaaagggattaaaaaacacgtgcatatttctggaaggacaagaaactggggaaattagaagaagagaagttgagtttctagggttagcagagacttaagtatttctttctcaataagtttaattaaaaagtcaacttacaagaaaagagaagtagaaggctagtgatccatatatacacatacccctaccaccaaagaaagagaaccagggagagacaggtgacgggcaattccttttaggcccatgctttttttattcttttcttttttttttttttgagacaggatctcactgtgttgcccaggctggagtgcagtggcacgatcactgctcactgcagcctcaatctcctggcctctaatgatcctccccacctcggcctcctgagtagcacaccaccatgcccagctaacttttgtatttttttagacatggggtttcgccacattgcccatgctggtctcgaactcctaagctcaagtgatctcccgcctcagcctgcagagtattgggattacaggtgtgtgccaccacacctggctgttttttttttttttttaaagagatggggcctcactcttgctcaggctggagtgcagtgttgcaatcactgcaatcttaaactcctgggctcaaacaatcctcgtgcctcagcctcctgagcagctgagactacaggtgcgtgccaccaagcccagctaatttttaaatcttttgcagagacagagtcttactgtgtcgcctaggctggtctcgaactcctggcctcaagtgatcctcccactccagcctcccaaggcactgggattacagacaggagccatgttaggcccatgcctgaggcacgagaggacagcagatggaagcttccctgttgcctcctagcatggcccttcccaaagcccctgagcatcccaggcgaggccggggggagctgcttactccactccttcccccaagtctgtcatctccccacctggaattccacggctctcttgctggccaggtctgccttgttacccgcgagtgcaatgacgatgttggggctggcctgcctctgtagctccttcacccagttcttggcccgtgcaaatgtatcctgaggagacagggacagaatgtcgaagggacagagaaggcattctgcccagggccacccattagagactctcaagctggcacagccaaattatctaagacattgccacctaaagattctgatgcaatgtccccaaacaggaaatctgcccaccccccacccaggaacagagggttaagcggcctgaaatcagggctctgataacccaatccctgggactttgagaagatgaagggcaaaggaagaagcaaggggaaatctttactgtgttggtgatgtcatagaccacgatggcagcctgggccccccgatagtacatgggggccaggctgtgataccgctcctgtccagctgtgtcccagatctcaaacttgactgttgtgtcatccaggcagacagtctgtgtgaggaaggccgctgtaagagagaaggagcgtccatgggcaagagcgagttggaatccaccccacacaatcccactgttgcttctaggctctggcactcagaagcccaccactgagatgggcacagagaaccctcaagccaggagccaaagcaggcctgagtggggggtggagtttggatttttatgtatgtgtctgggggacggggtctgcacaggctttgcagacccagcccaggcaacggcaggagaagggactcctgcatgcactgagccatctcaggaccactctctgaagagcaacacagcaggggcaagagagggaaagcctaggggaagcctactccaagcacagaagggtgagcgccctcagacctcctcctccgccactcagagaacagaccagcagctagggaccgctccacccctcagtttgctccagcccaggggtgtcactgaccttgggtttcctaaggacattctcacacacttagctatgctggggaagtacacactgttccaccaccaggctgaggctgggtggccggcttcccaaccacccctaccacctccaggcactccagctagccaccgcccctagctctgacccagacctgttcctgtatggccaccctgtgacctgaccttcagtcactaagaggtgactccttaggggaatgcagggtgcctgtacacatgcttcaaaggaggagtccagagctgggacagacagcaaaaggcccctttgcccctggacccagcagagaacccaggacagccatgtgtagaaggctgctttcctggtctgccctcccccagctcactgagggacatggggcactgcctcacttcccctctccagctcctgacccaaatgctgaggaggcagcagggagactgctgacatggcccattttgtttccagctgcctagaaacctcctaccaagagagtagagaaaggatgactcaaggccaaggccagcgttggcccctgcctcttgatgtgtgtgttagccacggaggcaagaggccgaggccagaccctcactcacatcctaaatgctgaccactggaaaatcaacaacaggctgtgagctccagaaagggtaaagtcagcttcagaaacacccacctatcacccagctccgactcaccaggctgttccttcttctggaagtgggaaaggccagggcacatggaccacccattatagtaagaaggggcctcaaagatccagagtcagctctccctccatgaggccagggcagtgaaagggcctcagccaaggccacacagatcaagaaggggcagaaacaggatgggaagctagctttccactcccagcaaatgcttactagcgatgcttgaggggactctggcatggagaccagttgctgggctcaattccagggcccaggtgaggaagtggggctgccaccacagacgcatttagtccctaatgcaggcaggcagcttcccatctcctcaaggtcaaagcatttctttggcaaccttcaggcccctccccgactccctcatgcccactcacctccaattgtgctctcctggtactcgtgaaactgtcccttgacaaagcggaggacgaggctggatttgcctaccgcagactcccccagcagaaccagcttaaattgacagatcttgttcccagcagctggtccattgggtcgtgctgcgcctccccgacccgccattgcccgtccagctgtagtggtccagagagcgtgcgggtggggactggtgctatgcaaagaggcacttagtggggagggggacctccaactgtaagggagaaatgagaagtactgagttagttcagaggccgtcacccgctgtgtccttcttaaattacagatctttccctctggcctcactgaagacctagctgactgcttcccctcacctcacctccctgccctccccactagaggtcaggaggccccactgggctatactagatgtctaccggctctaccaccatctgagctgtaaagaggagaatggtctcccaacttcaggctcatggttctgagcaaacacattgacttctggatcccaaatatgtacattcacctacaaataaacacacacaggcgatgaatgaatgtgtgacagcctggtgacagttaagtcaacaggcttttggggcaaaattaaaacaaaacaaaacaaaacaaaagctcaggaagacactaggatttagatcaataatgaagttccagtctggtagccaggaccacagtggtgaggcagacaggggcccaagaggtcctggtagaaagctcctcagagaaggtgcttggccaacctcatggccattcagggaccagggcctggccagcacaagttgttattaacatagccatttttctcctgccaccttcagaaggactgaccgactttcagtctagggctggactgtgtgcctctgtgcaccagaatcaaagcaatgtttcactctctcatcctgatccttcttccctagttctctcatttttgatgggccaaagtctcgcacccattaaaaaacaaaacacacacagaaacaaacacatagtaaaacacacaccgatacacacacacaaacacacacagaaacacacacaccggaacaaatacacactgaaacacacacacacacacacaaaaacacatgccaacacacacacagaaatacacaccaaaacagacaccaaaacaaaacacacaccgaaacaaacacacacagaaacacacaccaaagtcatagctctgccacagtcagcacagctaccaactttccctttttcaatagagacctcagttccattctctactggcagagatggggcgatggagagaaagaagaggcaggaggtgtgggagggcagagaccaagtcctgcatccccaacagctggtgttccagtcccgacatctgaatcacttggttagtgacagcttcagaggctcaactttttgtttttgttaagttttggaattgcagacacatgaggagcctatctctagaagcctctagaagacataagtggatgtctcatcagacatatacatctgatgtcaacagacatcagaatatatacagaatgttttacaaacaggtcctgtgagtaggtattaagtactgaacactgttcagcatttgaacctgggttggaaagaaaaggtttttattaggctgccctttgcataatggagtctaagatcccagggagagccccgatctgcccctgagcaagggaagtacattccctcatggttaagggacagcaatgtggatgaacaggaggtatctgtgggaagcaaatggtccacattcatgcaagaagctgacagcaaagggcttgttttgttcaacctcaaatcgttttccacatccaagttctcccagcaactcatttaaaaagtgagcttcaggaagaatgattcactagccagaaacaacagtttcctttctggagagaaccaaaggaaaagaggtttgaaatggggcccacctcttccccaaaagtacaaggaaggaagtacggggtggtgggtctcaattagcaaccagaaataccatgtaaatatttcaaagttatgtcatttcaatttttcatagtttaagacgctttctcatttcacctcagtcaatgaagagacaaggtctgtgctttctgcttcttagagatgccttcctcacagtgcctatgtgcatactaggaactcaaagagtgctgatggaaggaaataatttttttttttaaagaaacaaggtctcactgtgttgcccaggctagagtgcagcggtgtgatcacagctcactgcagcttccaagatcctactgcctcagcctccagcaggtatacaccaccacacccagctaattaaaattttctttctttctttctttcttttttttttgcagagatggagtctcactgtgttgcccaggctggtctccaactcctggcctcaagcaaccctcccgcctcagcttcccaattgcacaactattatctccttcaagctttacgacaacctccatttttcagatagataatttaacattcatatattaaatgtcctgctcatggtcacccagcctacaggtgacagaaccccccagacccaccatagacatgatgccatcctccctgctgtggaagaacaatggaggcagtgcctgccctatgtttggtttagggctgctaggtgaatgaaactctctttttttgtggcagcaactttgctggtccaggaaggtctagctctagctggctctagcaacagtcacagtaatcttgcagtttctgagtgccctcaacagtgggaggagccgcccagagccaggcagggcgacagcaacagagggaaaaccacagtggaattacaagttggttattaccatgaatccacgtgacacagagtcttggctgagcaatggtctgtggctggggcactggaggaggaggtatgaatggactgggagatggtaatagaaaaccaagtctctgattccaaaaaaaccaaagcagctggtgcttagggtaccgagctgggaagtaaccagcacctacaggtcgagaaaaatacaggtaacagatctaagtcttgtcactaccaaaccacagggttagaggaacagaatgtgatttttaaaaacaagccagaaggggagacaaataactctcctgcagtggttctcaacggtgtctgtacattgaagtcatctgtgcagccagcccctcgagattctcatgaaggtttggcacagagcccagcatctgcaggtgaagcacacccactgaagcacagccagggctagagcatctggcagagagagagtgagcacaggcactggctttcggcaccacagatgtgactgtctcctgccacttctgaatcactttgtagaagccacctgagctgagcctcagtgttctcatcactaatatggggcacaccagggttaatggcagtgtttgccagctgtctcacacacatcatgttgagtaaacagtagctaagagtactgacagggttatttgtaacactttctccaagactgttggtgaacagactctggccatcccaatgaactgagacaggctctccctggcatgaactagctggtgacatgttctgcctggtcactgatcctgccttccagagatacctgagcaggcacacccagcactttttacggtctgttgcctagtggtttgcctggccctgcttggtgatcaaatgagcagtggtgtccaacctttgcagtcaataaagcccaaggaagccaattttgctaggaagggcgcacggagatatgagggtgtctaagccaggggaaggccagaccgagagccccaggaagcattataccctctcctcccaagcctgggaaactgaagacatggcaggtagtaaaggtgaatgcattcactgagctgtcctgcctcccagggatgtgtgtcttactggcaatctttctttttgaacccctggcaaaaattatccacttgtgcagtcaggtgatggaattatagccaaaactgacatagttttcaaagtcttctttgagacaaaaatcaaattctccataagagctaaagttacagtcaaagttgatttttttaaattagccaacgtggtggtacacgcctgtaatcccagctacttgggaggctgaggcacaagaattgcctgaacccaggaagcagagattgcagtgagctgagatcgcgccattgcactccagcttggggcaaaagagtaagactctgtctcaaaaaaaagttgactttttttcacaagtacaatggccgtgctggagcttcagatctagggagaaagattctccttgccatggacccaccatccaaatcagaaccctggcttgttcagaggccactaagaacaagcaccagtcccaacctcatgtcttccacaggaaaggggagagaatgtataaggacttggagtcacactattttcctattaatacaatgcacatgaaagcgcagaagggatctaagctcctaaacaccctggccctgtgcacaggcacttctgggccaaggatggaagagaaagagaaagaaaaatgggacactgttcttccctgctccggggttccctctgctctggacactacaggtcagtgggtctcaaattctttttttttcttaagttttttttttttttttttgagacagaatctcgctctctcacccaggctggagtgcagtggcacgatctctgcttactgcaacctctgccacccaggctcaagcgattctaatgcctcagcttctaggagtagctggaactataggtatacgtcattacacccggctaaatttttgtgtattttttgtagcggcggggttttaccacgctggccaggctggtatcaaactcctgcctcaacctccaaaagtgctgggattacaggtgtgagccacctgtaattttttttttttttttttggagatagagtctcactgttgcccaggctagagcagtgatgcaatcacgattcactgcagccttgacctcccaggctcaagtgatccttctatttcagcctccagtcaaactcttcttcaccagaatcacccagggcctttagaaaataccctgaccaactgaattagaatctctagaggtggagtccagaaatcagtattttaaaaataagttcccagtgattttaagcagttgatcgaagcacaagagctacagttgatatacgaaggagggagaaatccaagagacagaaaggcacccccgatcagtgctgtgcacaactcgtaagtgtgcatgtgtaagtccatgaatgtgggaggggtcttcagcttcactcagcaactggagccttctccaagacactagatgctgctgcaattcctccccctaacctccctttgaaagtttcacctttcctctaatccacgaagtcacccacttcatatgttttgtccttcctggtaaaagggtgagcaattccagctgatgagtgtctcgtgtacttcctgtttgctttagagacttcctctagctgagagtcctggcacagcctggagagcaagctgattagggaaaccaatcagactgttgaccagggcaggcggggcgtagagactagctcactcaaggttagccaggtggcctgagaaccaagtgaccccgcccagggtcccctgcaggtgcttctgaccagtgactcttcagctacattttaccccggaaaagggcattcctgaatatttaaacaagagtccagcaaaacaaaacaaaatcaaaccaaaaaaacaacagcagaaaggagttgttaaagaaaatggagcaagagacacaggaggaagtaactcggttcaaaggctaaagtggaagacatttgatttaaaagccaactggagtcaaggttttgcaaatgcttcccaggctccgattagttggggagatgatttacccataggctcaagaacacagctcttcctcaaaagggaaaaccactgccagcacacagaaacagaggacagactcacagcaggactatccaggcttctagctggttgcagacccagaggaaagaagaatctgaagcaacgccagccacgatccacacgaggtacccacaaccttccccagcgtggctagcaggttaggacttgggaggctgagccgggtttggttcaagctccactccaccgtttattagccgtgtgaccttggccaagtcacacaagtgatcattatcagcttcagttccttatctaaaaattggtattctttaatactaattgcatggggtagttcagatcaagtgaaacaatgcaccacagtatcaggctgaaggtgagctttcaacaagtggcaggtttattaccccagaggctagaattggtagtcagagcccaaaagggccttaaagaccccatcctactgttgacaattaaagaaaaaaaatgaaggtgaggagaagtgacctgcctagggtcacacagccagctagctggtggcagagcccaagcctgcccaagactcataactcaagcaaggctctcctattagagatagaaagaaaaaccccagaatattaacaatctcattaccataacccctgttactaaaaataacagggactgcgaccttctatgcatgtttttaaaaaatgtagcttttagctaggaaaaaatgagtttctatcaaactgaaaaaagcacattgccgccgggtgaggtggctcatgcctgtaatcccagcactttgggaggctgaggtgggtggatcacctgaggtcaggagttggagaccagcctgtccaacctggtgaaaccccgactgtactaaaaatacaaaaattagctgggtgtggtggctggcacctgtaatcccagctacttgggaggctgaggcaggagaatcacttgaacccaggagacagaggttgtggtgagcgaagatcgcaccattgcactccagcctggacaacagagcgagacactgtctcaaaaaaaagaaaaaaaaaaaaaagcacactgctggatggaggagttataacttgatttgagaggtaaatacatgagtgtataataatataaaaacccatcgagctgtatttacaatttgtaaactattatacataagtcacatgtcaataaaaaggttaaaaaatgctgctggtatagaattttgcatataatcatgaaaagttaaagcttggaaacgatatgaatgcaatctagctcctctgtatataaaatattttctgcctctttagtatgaagaaaataatattaaagacaatcaagggccgggcacggtggctcacgcctataatcccagcgctttgggaggctgaggcgggtggatcatgaggtcaagagatcgacaccatcccggccaacatggtgaaaccccgtctctactaaaaatacaaaaattagctgggcgtggtggcgcatacctgtagtcccagctactcgggaggctgaggcaggagaatcgcttgaacccgggaggcagaggttgcactgagctgagatagtgccactgcactccggcctggcgagagagcgagactctgtctcaaaaaaaaaaaagacaatcaaaaagatgatacctgaattggaaaagaccaacggagaacaaagatacccaaatgttaaacacaaataaggtgcaagacaatgggattcctcataaaaaataagattcccacatatatattaaggatatatttactgtttgggcttaactgtgggctaaaggattttcaagtggtttaaagcttcacaataataaagagaaactgatatttatgtcttttcgatggggagaaagaggttataacagtatgatattctccactccccaaccagtctagagtatatctgcagaggaaaggggggtttaggggttgggggatggaatcaaagagaagggtgtcctctgtgtgaccaggcctatggaactgcttcacacagggcctgtgtcttacctaagagtctaacaggggaagcttggccctggccctggaagccagaagcttaagagcccagggtgagatctagccgaatcccaatggggggtgttgcaacagggtgggctccacctcccaccttcaggaggtccagctcttaaacctagacttgggggaggcagcagtagggaggaaggtgctgcctttccacagccacaggaagatgaccctttttccagcggaaagggaagtaaattatcccagaggggcactgaaggtgagctgggtccccttccacagggaaagcacccccaccttccttaactgagattggtttcatttcattcttttttcaataagatttctgaggcttagtgcctagacttccacaccacaatcaggccctgatggggtccaccagagccccaagtgcagacaccaactccaccaatacctgcaaaaggggccagtgtgcagaggcatcaagaggcttaaagcctggatacacattaccaagtgatctttaataaacactatgcagactgagcctggaactttgctgaagtcagccaggacagagcacagctggctcctgcagccctttcccttgtgtgggaagtcttgtatcacttaggacagatgccaagctcactcgggtggaagacacccctgagggacagacccttagctttccaggactctaccccagcagaacaccatgaaatccttccctgatccctgagcttcttcccagctctcaatgacagatgggttctctggagaggctcagagaggagcagtcagggctggatggaaacctccagcatccactccctctttctgcacccacagggaggaagactattggggtgggaggacatctccatggatctgctagcacagcttggccagtgtggtcggccagtgctgtccacagaagggccccaggcttcatgggcagctcaacaactctcagtcattggccctgctggccaacagaggagacaggtagcacggaaggcccacagacagggcactgcctgcagctgcaccaggcaaggctctccgccagcctaccgattccaaaaggcaccaggggggccaggccctaacgctgacattcctgagactgttctccctaagagggcccagtgtctaacagcacacctcagtcagcaaggttgtggcagattctttttttttgagacggaatcttgctctgtcacccaggttggagtgcagtggcgtgatctcggctcactgcaacctccagctcccaggttcaagcaattctgcctcagcctcctgagtagctaggactacatacgcgtgccaccacatccagctaattttttgtattttttagtagagatggggtttcaccatgttagtcaggatggtctcgatttcctgaccttgtgatccaggctgtgccagattctctactcctgtctagggctgctctctcaagcctcaagcaaaagctcaacttggaatctttctgcagcccagaaccacacacacgtcccagccacagggcttgttagggatgacaacatggctgtatggtggctcacacgccaccagtcagttcttcacctgccaatgccaggcaggatgctaggaagagtgccatccaaggcaaaggttcttctggccccagcctaccccaactatcctgtatttcatttgttcaggcagttactatttagctaggacatttctcaccggaatctcatcaatgtagggcccgtcttccccccgtctcaaaaggggctctgcaggggtcagaagcaccagccaggacagctgccacttctgctgcttccctaggcccagaaagactccagaaacctctgctgaaagtcaggatcagaagcagcacctgttcatccagccactcacaccagcggacacctctccaaaacccttcccgcccttacaaataacagaaaacaaaagaaagccagtttaaatcactgcccctttgttttgccttcagctcctaaacagagagcagaggtcaagtttgagaggaaagtgggagaaaagagaaatagcaatccaaatgcctcctgttcagacaccacacacaccgtggtcagcggctatgcaaccaacaagaaaaaagtcaaagttctcagtgggagacctgagggacgatggctattctcagaagcctgggcaccaaagaacaatattttagaatatatatatatatatatatatatatatatattttttttttttttttttttttttttgagatggagtctcgctctgtcgcccaggctggagtgcagtggcacaatctgggctcactaccacctccacctcctgggttcaagcgattctcgtgcttcagcctcctgagtagctgggattccaggtgtgcaccaccatacccagcttgtatttttgtatttttagtagagatgaggtttcgccatgttggccaggctggtctcgaactcctaacctcaggtgatccgcctgcctcagcctcccaaagtgttgggattacaggcatgagccaccacacccagctcttttttctatatacatttttgagacagggtcttgctctgctgcccaggttggattgcagtgacgcaatcatagcttaccgctaccttgacttcctgggctcaagcaatcctcctacctcagcctcccaagtagctgggactacgggcgcatgccaccatgcccagctaatttttctattttttgtagagatggggtttcaccatgttgcccaggctgatctcagactcctgggctcaagtgatccacctgcttcagcctcccaaagtgctgcgattacaggcatgagccactgtgtctgccatctttcttaatttttgctgaacaaactgtagagtggtgcccagtgaagaaatcaagcaatgaataggtctaaacaagattcaatgagcgaatcacacttctgcttccatggccccaaatgttcataagactagtgtaggtggcaaggggctggagaacttgggggactgagggttgtgagagagaaagcaagagaaattaaaggcactgttgcagatgaaaacaaccacattacaaaattctcaaaggctggacaatgggtttcctttgtgttaacagcacataacagcaagcctgacccatagtaggtgagcacagatacggtgaactgtgcatgtgagaggtaccgcccgcttacacttggcaagtgaacgggggaagttgagggcttaaatctgcattcatctgccagacggctcgggtcccctaacagagccacagagcagctgaggagctgcctcacttccccagggaggacttcctccatccctactgcacagagcttaagagcacaagtgctggagtcagacaacttgaacttcagttcaagttctggaggcaccacttactagggtggcctggtgttgtcactgaacccatttcctcacacgtaaaatggagagaccagtaccacccgtctccaggactgccaggaagatgatgcatgtgagactctcagcaaagggcctggcatcgggaagcattcagtacatgttctgtagcaggggagcccctgcgccttcacttccctgtgaaggagccggactcctcacttcatctgtcagacaacattcacacattcctcttacctccagtttcccgggactccattcttcagcacctctcatttggagagaatgctgaagaggacgtctttcctcagtttcctagaagatactcagtgtcctgtcaacaaccccaatcttgtatcctccagagactagctcccaaaaccacaaaaatggaggggagaaaccattaccatccaataaatctgcatggggtgaaggccccaaccatgcaaaccataacctcttaaaaaaaaaaaaaaagccccattaacacaaagcatcttgggtttttttttggtagagatggggtttcatcatgttgcccaggctgatctcaaactcctgcgctcaagcaatccccccgccttggcctcccaaagtactgagattacaggcatgagccaccgcgcccagcccacaaagcatcttaaagcccaaatgcccttccttccatctcaaagcctctttcaggaaagggaagaagcagttcagttgttgagagggctaggggacaggaatagagcagctgacaaagaaagcagagttccttttaaaaaccaggctgcaaatgctagaggtttggaaactggcgtcattcatcaccacgctgtctgagcagctcagagagcaatctgatgtctaggagagcagccagggttagagaggccacccacgccctcctccatgcctgggatgcctctgacagccacctgaaggggacatacatggagctatgaatagaaggcaaaaggcttgtaaaccaactcctgttaagatcccaagttagtgtttccagcagggctcaagttacacattttcagagagatgacagtacaatggaaggatttcagctattcaatgattcaggatcacggcacaaagtgacagcctaccctgagcccgccaacagccacaaaccgtcccatgggggcagtccattttggaagggcagcaaaagacactgactggcccggaccatgtggaatctcttacaagacccagagtccaggaaggtttagctggagaacttagcacctgaaatagagaacgattatatacacatgcctcatcttcccacacctccataggtaaattccaaaggaaagaccaaatcagaccattttttggatcagtcatagcatcaggcaggggtaagagcagtatgaatgggtgagtagaacaacagccagctactgggattaactcccaggactgcagttgattctcagggggtagatttcccaggtccacctctacctttcccaactccagagtctctagtaactatgactaaccatcaagagaagaaataactcaaggcatccacatcactctatgtcaacatacctgagagaaaacatttgctaaaaaggcagtggccttggagagccagctgaatctacaactctggcacgaaatacacaaagtaagcctggggccgggagtggtggctcatgcctgtaaccctagcactttggaaggctgaggcaagtggatcacttgaggtcaggagttcaaaaccagcctggccaacatggtgaaacctcgttgctactaaaaatacaaaaattagccaggcatggtagcgtgcacctgtaatcccagctactcaggaggttgaggcacaagaattgcatgaatctgggaggcagaggctgcagtgagctgagatcgtgcagctgcactccagcctgggggacagagtgagtctgtctccaaaaatctggcagtgccaaaatgtaaagaagtaaccaaaaaccaaaaacaaaaatcctcacaatgactaggcaggtcaaaggaggctaaaagagcaaccaatgggcaaagctgaaacattttgggcaataaaacaaagtaacattggattatttatttatttatttttgagacaaagtctcactctgttgcccaggctggggtgcagtggcaggatctctgctcactgcaaccaccacctccctgcttcaaaccattctcctgcctcagccaccagagtagctaggattacaagcgtgcaccatcatacccagctaacttttgtatttttagtagagatagggtttcaccatgttggctaggctggtctcaaactcttggcctcaggtgatccgcccatcttggcttccccaagtgctgggaatacaaacgcgagccactgtgcccggccttatcgctggattataaaccaaagtgtaaaataaatatcctggagtccatactgatataaataattgaacaaataaatgggggagaataggccaggcgcagtggctcacgcctgtaatcccagcactttgggaggccgaggcaggtggatcacctgaggcctggagcttgagaccaacctggccaacatggtgaaaccccgtagctactaataatacaaaaattagccgggcatggtggcatgtgcctgtaatcccagctactcgggaggctcaggcaggagaatcgcttgaaccccggaggtggaggttgcagtgagccaagatcgcaccactgcactccagcctgggcaacaagagcaaaactcatctccaaaaaataaataaataaataaaaataaatgggggaaaatagacaagtctctcatatagaagaatttaataattcagctgggcgcggtggctcacgcctgtaaccccagcaccttgggaggccgaaacgggtggatcacgaggtcaggaacttgagaccatcctggctaacatggtgaaaccccatctcagggtgggcgtggtggctcacgcctgtaatcccagcactttgggaggctgaggcgggcggatcacgaggtcaggagatcgagaccatcctgcctaacaaggtgaaaccctgtctctactaaaaatacaaaaattagctgggcgtggtggcgggcgcctgtagtcccagctacgcaggaggctgaggcaggagaatggcgtgaacctgggaggcggagcttgcagtgagccgagattgccccactgcatccagcctgggcgacagagccagactccgtctcaaaaaaaaaaaaaaaaaaaaaaaaaaaaaaaaaaaaaaaaaaaaaaaaaaaaaaagaaaccccatctctactaaaaaaaatacaaaaaaattagccgggtgtggtggcgcgcgcctataggcctgtagtcccagctactcgggagactgaggcaggagaaaggcgtgaacccgggaggcggagcttgcagtgagccgagattgcgccactgcactccagcctgggcgatggagtgagactccatctcaaaaaaaacagaaaaagaaaaaataatttagtaactcatgtagctactccgccctcaacaaggggaacatgaacataagtccctgttccttaggtgtgggctacacagtgactttcttccaaagggtgcatgcagcatggaaaggggaaggggagaacaactttacagagaagcctcacacacatcacctcagccaagtgatcatggttgacatcagtcatggaaaggcttgtggattgtatgtacccttgacatgatgtgatgaaaatagcactttacctctctggtcctccttcccaaaacttggcacagtctacttatgaaaaaaacactggacacagccaggcgtgttagctcacgcatgtaatcccaccactttgggaagctgaggtgagcagatcgcttgagctcaggagtttgagaccagcctggacatcatggtgaaaccttgtctctacaaaaattagccaggcgtggtggtgcatttctgtagtcccagctacttgggaggctgaggagaatggcttgagccgagattgcaccactgcactccagcctggctgacagagcaagactctgttaaaaagagaaaaatactggacaaatcccagttgagaagagattctctttattttttattattttttttgagacggagtctcattctgtctccagcccaggctggagcacagtgacacgatgttggctcactgcaacctctgcctcctggttcaagcgattcttgtgcctcagcctcctgagtagctgagattacaggtgcgtaccaccatgcctggctaatttttgtatttttaatagagatgaggcttcaccatgttagccaggctggtctcgaactcctgacttcaagtgatccacccacctcggcctcccaaagtgctgggattacaggcgtgagtcaccgcgcctggccgagatcctctttagatgcttgcccagcactcctcaaaactgtcaaggtcatcaaaaacaataaaagtctgagaaactggcacagcaagaggagcctaaagagacaatgaatataggtaacatgggatcctggaacagcaaaaggacatcaggtaaaaatctaaggaaatctgaataaaggatggactttaatgtaaaatacgtactaacataagatgttaataacagggaaaactatgtgtgagggattgtgagaaaactctgtactatctgcgtaacttttctaaaagtattctgaaagaataagtttattaagcctcggcaacatagggagaccccgtctctacaaaaaaatcaaaaattgcccaggcacagtggctcacacctgtaatcccagcactttcagaggccaaggcaggcagaccacaaagtcaagagatcaagaccatcctggccaacatggcgaaaccccgtctctactaaaaatataaaaattagctgggcatggtggcgtacgcctgtagtcccagctactcgggaggctgaggcaggagaatcacttgaacccaggagacggaggttgcagtgagccaagatggcatcactgcactccagcctgggaaacagagcaagactccatttcaaaagaaaaaaaaaaaaggaggccaaggtaggcggatcacgaggtcaggagatggagaccatcctggttaacatggtgaaactctgcctctactaaaagtacaaaaaattagccaagcgtggtggcaggagcctgtagtcccagctactcgagaggctgaggcaggagaatggcatgaacccgggagcttgcagtgagccgagatcgtaccactgcactccagcctgggcgacaaggcaagacttcgtcaagaaagaaagaaagaaagacagaaagaaagacagaaagacagaaagaaagacagaaaaagaaagaaagaaagaaaaagaaagaaagaaagaaagaaagaaggaaagacagaaagaaagaaagaaacagaaagaaagaaagaaagaaagagagagagagagagagagagagagaaagaaagaaagaccagcctcaaggtgagcagaggatatccaagtactgcaggcacaggaccagggaatgttaaagaccccatctgtggaatacacatgtgagggctgctcataccactggtctgaacagctgctgccaccacttttttaagccaccttcactcaggaacgagccttgtgcagacatacagaacagtatccacaggcagagtcaaatttgcttccactgatccttgctaagtactggtctggggtcggtgctgcctcaccacacacaactgcagaagcacggtcgttctgtcctgccatcagatacacacacggcagaagccagtcagccggactgtggctagtcagggccgcgccctcattgtcccattaaacccttcaccagaaatggagatttggagagtcttaacttctggaaactgagtttgtgacttgcttcccatcatccgtactgtaacattgatcctattgacctgtttgctctcccatttgtctgtgagcaactttctgggggatggaccaaagatatggctcaagctgtgggatcagatggatttaagtttgaatcataggttcacgacatccaaagtgtgtgaagaaaggaagggaagtgtgtgttaaaagaagtgggcgagggccaggcatggtggcttacacctgtaatcccagcactttgggaggccgaggcgggtggatcacctgaggttgggagttcgagaccagcctgaccaacatggagaaaccccatctctaataaaaatacaaaaaattagccggccgtggtggcacatgcctgtaatccctgctacttgggaagctgaggcaggagaatctctttaactcgggaggcggaggttgtggtgagctgagattgtgccattgcactctagcctgggcaacaagagcaaaactctgtctcaaaaacaaacaaaaaaaaagaagtgggcaaggctgggcacagtggctcatgcctgtagtcccagcactgggaggctgaggcaggcagatcatgaggtcaggagtttgagatcagcctggccaacatggtgaaatccgtctctactaaaaatacaaaactagatgggcgtggtggtacacacctgtaatcccaggtactagggaggctgaagcaggagaatcacttgaacccaggaggcggaggttacagtgagcaagatcgtaccattgcactccagcctgggtgagaggtcaagactccatctcaaaaaaaaaaaaaaaaaaaaaaagaagtgggcaggtgtttggtgtttgctttaagggcaggtttgaatgtctgccctctcctttaacaacttcagtagggagcctactatgctgagtgccatgccaggtcctaaacacacaaagatcaaacaggacccgatctgtgcccctaaagggctcacccaccagagaatgaggcaaataaggaacaatgagatagcagttgagaagacagcccatgtaggagacaagccctcagcccatttggggcaagggaaggcttcacagaggaagtggcattcaaactgagctttgagagaaaagtagggagatacagtttccaggcacgtgaggtgcagaagagccttctaggcaaagtgaacagtaggcatttagcccagagatgggtcaaggagaggctgtattgaatagcgataagagcacaccccatctctgccattactacatagtcccccactctaacatggggattaaacacagaacctacctcctggggttgtcggaggattaaaggagtcaacacatagggctcacaagagtgcctggcacatggcaaaaatagaagtttagcttttatttgtattactgttcttatacatagaggatggggctatttaattggaaaagtaatctcttacaataccaagctattaatgcagaggatgccaaaaatattccgattctcctctgccaaggtttttgcaagcatgattacctggattttggcacatcctagtttataaattctacctaaagcagtgcttctcaaacagccccaacatatgtacccttcactcaagtcaggggagaggaaactcccagaaatctgggagttgaacccaaagcagctggctacaagcaaaatactgtctttggccaggtgcagcggctcatgcctgtaatcccagcacttcgggaggccaaagtaggaggatcacttgagcccaggagttctgagaccagcctgggcaacatggcaaaaccctgtctctactaaaaatacaaaaactagccgggcatggtggtacatgcctacagtcccagctactcaggaggctgaggtgggaggatcacttgggtccacaagatcaaggcggaagtaagccatgatcgtcccactgcactccagcctgggtgagagaggccctgtctcaaaaataaataaattaattaattaattaaagtttcctgtgttagcttcaattcatgcaaactttgcattctaatctataatagttacaggactgttttaatattaaaacgcttacaactaagtaaaactgaagtggcacagcgttctcttctgtaaaatgggaatacaacccacatcaattctgttcaatgtctacaaaatgagacaatttgtgaaaccatcaagcaatgtacaaggcatcccagcagacattttgtttttgttttagacatggggtctcattatgttgcccaggctggttttttttttttttttttttgagatagactcttggtctgttgcccaggctggagtgcagtggtgcaatctcggctcactgcaacgtccacctcccaggttgaactgcctcccaggttcctgcctaagcctcccaagtagctgggattacaggcatgtgccaccacgcctgactaattttggtatttttagtagagatggggtttcaccatgttggccaggctggtctcgaactcctgacttcaggtgatctcccagcctcagccttccaaagtgctaggattataggcgtgatccaccacacctggcccccaagctggtcttgaactcctgggatcaagcgatcctcccaaagtgctaggattataggcatgagccactgtgcccagccccagcatacatttggtacacatgttgaatcagaatcagtgttgaggctgggcacaattacctgaggtcaggagatcgagaccagcctggccaacatagaggaaccctgtctctactaaaagtacaaaaattagctgggcatggtggcacacgcctataatcccagctactcaggaggctgaggcaggagaatagcttgagcccgggagacagaggttgcagtgagccaagatcacgccattgcactccagcctgggagacaagagtgaaactccatctcaaaaaaaaaaaaaaaaaaaaaaaaaaaaatcagccagacacggtggctcatgcttgtaatcccagcactctgggaggccgatgaggcgggcagatcacctcacctgaggtcaggagtttgagaccagcctggccaacatggtcaaaccccatctctacaaaaataccaaaaaaaaaaattagccgggcatgatggcaggtgcctgtaatcccagctactcaggaggctgaggcaggagaatcgcttgaacacaggaggcggaggttgcagtgagcctgggcaacagaatgagaatgagactgcctcaaaaaaaaaaagaaccttcaaacccctacctacccatcagaggcaactgctattttgtgggcatccagtctgccagcactggactagctcctttctttgtttctaattctgcaaggtatttagcatccccattttaccagaagaaacacaggctcagtgaggtcaagtaacaagcccagggtcacacaactggtaagtgggggaatcaggatgagaactcaggtccaactgcctctgaagttctagtgccttccacccgaccacactgcctgtttactgggcaagggttagaagtagaaggtctggccaggcgcagtggctcacgcctgtaatcccagcactttgggaggccagggtgggcggatcacgaggtcaggagatcgagaccatcctggctaacacggcggaaccccatctctactaaaaatacaaaacaattagccggacgtggtggtgggcacctgtagtcccaactactctggaggctgaggtaggagaatggcatgaacccgggaggcggagcttgcagtgagccaagatcgcaccactgcactccagcctaggcgacagagcgagactccgactcaaaaaaaaaaaaagaagtagaaggtctaagaagtacttgcttggtggggctgaatttaaatgtatgatcttgctctgtttccatgtaaattctagtgacaggagctcctggtggcaagccacattcttcccacttgcaagcagcaggcagcaccacaggagaaacagaggactaaccagaggcccgctctgttgcttcccccttaaccctgcccagtgggacccctgagtttactcactttaactttcattttctagccattaggactttcaggttcccagaaaaattaatgacatgtagatgtcagcaaactctcaggccctgaagagtactgacttgggactcctaactgttttggtcctcagaggcagaggtgaaaggggtcaagagagaagacaggaggtcgggtagacgctggggaagacaaaaaaacagaggagcgctagtgatgaggagggctaaagagttaagagtctgcccttgtgccgtggcgcactcagtctgcatgttcattcatttaacgaacaaaccaggccgaagaagggcccactgttagatcaggtcacatctgaccccaaatccaagccccagctctactactttctaaatgtatgatcgatcttaggcaaactacttaagttccttctgcatcccttctaaagcagggacacttgccttatcttactcaaaaaaaaaaaagtaataataaaaattaaaaacaaagtggggaaacaagccccactatttcccaaggcacctatgaggaatatgtatgaaaataattttgcaaccttaaaatgatttttaaaaattagtgttactgtccctctacagtttaacagccctctaattgtgagaggcaagagggcaggggaggaacagcatcagaaaggaggggttctgtcgcacacggagccatcgctctctctgccaggcagagtcagacctctgcttggactctataatttctaggtgccagaagtggctgcataacgacccaaagcactggggcctgcctcgtctctctaaatggcagagcttccccttcaaagtcgtttcaggttgggtgcagtggctcatgcctgtaatcctagcactttgggaggctgaggtgggtggatcatctgaggtcaggagttcgagaccagcctggccaacatggtgagaccccatctctactaaaaatacaaaaattagctgggcgtggtggtgcatggctgtaatctcagctactcaggaggctgaggcaggagaatcccttgatctcgggaggcagaggctgcagtgagccaagattgtgccactgcactccagcctgggtgacaaaacaaggctctgtctccaaaaaaaaaaaaaaagtcgtttcagagtcagagctgggagagcatgtccagacaaagaaaagaaggtctcctcagaaggctggtcggcctcatcccagcactcctgaagagtgacaaactgcggtctactcctgaagacctaagtctggtcagagaccaatggccagtgagcagtcaggcctctctggccctgcccctcagatgcccaggctgaccagatcagagaaactaggttggttgaagaagtctccaatgaaccccaaaggaacccacacagatacagagcctgtgatccagctgttgaccctaataaggaaggcttcttctgttgtccgataaaaagtgaaataagtaggccgggcacggtggttcacacctgtaatctcagcactttgggaggctgaggcgggtggatcacctgaagtcaggagttcgagaccagcccggccaacatggcgaaaccccatctctactaaaaatacaaaaattagccgggtgtggtggcaggcgcctgttaatcccagctactcaggaggctgaggcaagagaactgcttgaacccaggaggcagaggttgcagtgagccaagatcacgccactgcactccagcctgggcgacagagcaagactccatctcaaaaacaaacaaacaaaaaagtgaagaaagtacatcctagctctactcaaaagactgtaggaatcagatactagccactgtccagaagccctcaaacacacctcaaggccaaaaaacacagcacttttaagtggcaagcgagggtggtaaaggtagcccagaacactgaagagctacagaagttcccacaaactgcacggctttccgtcccttcctccactgtagatagcaagggtcagtcatggcctcagagccaggctactcctcgttaaggtacagtctccggcctgtactttggccacataacaaagcttggtctgagacagcagctatttcacacacctaagccccaagcaacagacaaggatcagtcaatatggttgagggaacctgcactttctggcatgtatcggaattcctcaggctacaattaaaaatccagaactgccattgtgatcttgacttagtcctcagtaataagtccaagccctgaagggattgcagacagaccctggcgtggtgtggacctgttgctcagggaggtgtatgtgtgtgtgtttgggagtgggaaagagatggcccttcaattccagactcctcattttgggtcttattctcctccctatagacacacggacagcagtcccaagaaaagcagtccctttgaggcggctgggaaaccactcacgtgctctgggaggacagagctgagcctggagcaaggggggaggggaaagaagataatgaatgggcacatccaccctgatctgtgatctgtagctaggattgagcaaacctcagctaaattcttcagaggcagaaagagagagacactcaaagaacaacataactagaggacagggctgggagacagaaggggcaaaacaggaaaacagctcatttctagtaagtgactttaaactcagctgaggtcctggttggttctctggcttgaggaaagagaggaagtaaggagttgcgggagcgcacacacacttctgtgcgtgtggaacggtctcacccagacgacccccctcccccaaaggaaatcgagatattcctctagggctagaggggacaactggttttgtgggacaggaggaaggaaaacggcgacagacagcactccctgtcacttctaaaagagaagagggacaggttccttcacacctagcaaagatcctccgattctggaagcagggggagcggaacttagggtacctctctcccacaactagaatggacaggccagaggacagtcatagcggtttccttaaggctcaccaaaggcaggtaagctaaggaaagaagctccccacctcctatggcccgacgcctggggagcccctcaagagggggctacgggtcgggggaggggtcagtatccccctaaactggggctgggcgggaggaagggctgccctggagatgcttcaacgcaggcgagacaccaggtcctgggacaagcatactcacggcggctccggggcggcggcgttacttggggccggggctcggacgggatccgcttctctccccgccggcggtgtcccaggctccggcctccacttccgcctttcagccgctccggatccggatctccacctccgccccgcccctcaatactc

SEQ ID NO: 2714 - DNA, 30069 bp, Homo sapiens; identical to SEQ ID NO: 2713
  source 1..30069: mol_type = genomic DNA

SEQ ID NO: 2715 - DNA, 30069 bp, Homo sapiens; identical to SEQ ID NO: 2713
  source 1..30069: mol_type = genomic DNA

SEQ ID NO: 2716 - DNA, 87698 bp, Homo sapiens
  source 1..87698: mol_type = genomic DNA
tttcccggcgtgccccaggagagcggcgtggacgcgtgcgggcctagaggcccacgtgatccgcagggcggccgaggcaggaagctgtgagtgcgcggttgcggggtcgcattgtggctacggctttgcgtccccggcgggcagccccaggctggtccccgcctccgctctccccaccggcggggaaagcagctggtgtgggaggaaaggctccatcccccgccccctctctcccgctgttggctggcaggatcttttggcagtcctgtggcctcgctccccgcccggatcctcctgaccctgagattcgcgggtctcacgtcccgtgcacgccttgcttcggcctcagttaagcctttgtgggctccaggtccctggtgagattagaaacgtttgcaaacatgtcccggatcgaaaagatgagcattctgggcgtgcggagttttggaatagaggacaaagataagcaaattatcactttcttcagcccccttacaattttggttggacccaatggggcgggaaagacggtaagtcttcagtagccgccttcagtttacaggtcgctacatctttcggagaataaaatgggaagttgagaactctccttaggagcagaagcgtccctagggctccacaggtgtaggcccttaaagtgccttagggtgtggcctgcaggctacagcgaccttaggagtttgcctgaagcagtctcggaaggatgtccggacctggcctggggacaaggtttacttaagaatcccacgataccgggagctgtcgccgctcactcagagttcagttcccactggatgccctttggtctgtattgatgtttttaacgctgtctccttgctttcaaagcatagcattcacttcccagtagttgtcccatacaagaattcctttaaaagttataaaatgatacatacatgactaaagagtttccaagtatgccaactgtccagacataatacatggaaaataaataaattcaaaatgtaactgatgtagtggggcttaacttggaaaacttctcttcttaaaactcagtcaaaaatttaacgttggtgcacgactgacttttttttttttttaaagccgtgggaatatttataaatttgaatggaaagaataaccaagaggcattctggtcaggaatagtggcttaagaaaaagcaagacgatgtcagtatagcagggagaagagtctaaaggaaggatttgtgaagagtgtagaaagagagaaggttgagaattgaatgccaaacttgtttacttttgtttttgtaaaaatgttatttgttgaatgcttgttatgtacttaggattgtactaaatactagcagaagggagagtagtactgtatagtgtttatgaggactggctgcctcaatacagctttttcgcttcatttattagttgtctgattgtttgcgagtgacctcactgctctgtgccttagttttctcatttataaaatggagattaaaaatagtttctacagctgggcacggtggctcacgcctgtaatcccagcactttgggaggccgaggcgggtggatcacctgaggtcaggagttcgagaccagcctggccaacgtggcgaaaccccatctctaataaaaatacaaaaattagccaggcgtggtggcgcatgcctgtaatcctagctactggggaggccgaggcgggagaatcgcttgaaccggggaggtggaggttgcagtgagccgagatcacgccattgcactacaccagcctgggtgacagagggagactctctccccccacaaaaaaaaaaaaaaaaaaaaaaaagtttctacaggctgggcatggtggctgacgactgtaatccgagccgtttgggaggctgaggctgggggattgcttgagcccaggaggtcgagaggtcgaggctgcagtaagccatgatcatgcagctgcactgcagcctgggcagcagaatgagaccctgtctcttaaacaaaaagttcctacagcctggagttaatgtgagaattaaataaatgtatgtaagagtgcttagtacaatacagtacttaactgttagccattcttattattaacttaaattagtttaaagggtttcagttgaaaataattatttttttcccaagtaacaattcttcatattaggataacttcttagttatatagcatttctgtgaacttacagcattaacacttaatcatatttttattacaggttttataatgtcagattttatcttttatagtttccatgataaataatatttttgtaatgaattcatattttatggtaaacttctgtggttctcttataacgaaataatgtaattttctatttctttagaccatcattgaatgtctaaaatatatttgtactggagatttccctcctggaaccaaaggaaatacatttgtacacgatcccaaggtaatggtgctagtacaattttgtatttttataattataaaaatgataatagcttattatagaaaacttggcactggaaaactataaagagaaatgaaagtcagccccacacagttttagcacccagtagtaaccgttgttgacattttcatgtgttttcctcctcctttaaatactgttttatatagctgatgtcatactcttaattttgtattctgggtttttttccccacttaacattatcatgaagtcctatgtcattaaaaaactatcatctgggtgtttggtatgtaagtgtttcttttaatctttatactgctttgtatgtctgagatattttctacttaaagtgcatgaacactttagtagttatgtaattttcttacattagattgctttcagtttttcattaaaatgtaccatgataagccaggcttgggggtgtgtgccaatactcccagatagctctagaggctgagatgggaggattgcttcagcccaggagttcaaggctagcctggacaatatagtgagacccactgtctagaaaaaaaagtatcatgataaaaatctttgtgtatgaatcattgtttgaattatggtgtttatactattcgtatgtgtaaaggacatagaatttggtctataggtttgtttttgcacatatagaagtgaaacaacaatacacacacacacacacacacacacacatatatatatagtttattcgtttttagtggggtcatgtgcctctctagccgctccctgaccccagttccactatgttttcgttacgtattcttccaagcttttttctgcttataaaaccatgtctacgtgagcacataaatgcattcacacatacatattttagcacattaatataattttatacttctattttattgtttttaattagtaaattgtattccattgagtttatatcctgtagtttattaaatgaccccctgttgattattatttgtttctaccttagtgtgattaaagataactctgtaattatgaaaatatttatgaattttcctcttagaaatgtaatagtatttagtacatttactgagtcctctccataatgactgtttcccaccttctctctccttaaatctacaatctactttccttaattgatgatcttgctttgtactttattgagaaataggaagaatcaaatgagaattcccttattttccaatcatcacatctacgaaactactgtacatacgtgcccatactgttttttcttggataaattatttgttgttttatctaaacatgaaccagctccttggaggctagatctcattgatccctcttatccacccaaggattttgcccttcagtttttccatctctctcctggatcagcagtttctcttgatggatcattcacatcagcatataaacatgctctggtatctctagtcttcaaacaaaaaactctccctttactccaatttaccctctagccattaccttttctctgttccaatatatttcaaaattcataagatttgtatgtcctcattgtctttacttcattgactcccatttttccctcaatctactccattcaggttttctttttttcctccactaaaagtgcctttgtaaggtcaccaataatctcaatgtgccagatagagtggtcagtttctaattctcattaacatcttgtcagatttgacacagttggctatttcttttttaaaatatatttccttcttggcttttgtgacactataatctcatagtttccttctttctcactggctatactttagtctttgttgggtctacctttgcttgatttctttttttttatgagacggagtcttgcactgttgcccaggctggagtgcagtgtggcatgatcttggcttactgcaacctctgtctctcaggttcaagctattcttgtgccttagcctcttgagtagctgggattacgggtgtgccaccacacccagctaatttttgtatttttagcagagacggggtttcatcatgttggccaggctggtctcaacctcctcacctcaggtgatccacctgcctcagtctcccaaagtgctgggattacagatgtgagccactgcacccaacctgcttgatttctaaaagccagtgtgacacaagagttggccatctttgcattaaccctcttccctatctctcttggatgagcttattcagtctaacggctttaagtactggttatgtgctggtaactaccacatttatatatttgaccctgacttctttccttaactctagacatatatgtctagctgtttgtttggatatttaatgggcatctcaaatttaacatgttcaaaacagaactcttgattccttgtacccacttcctgcctacattctcagctctgttactacctcagtaccccacccccgccagttttgtaaatgatgtcatcatccctacataagcaattcttacctacccttctaaaatatgtcagaatttgtctacttcattccatcggccactgtgttcctgttccaagccaccatcatattccctttcaactattagaatcgtctcctaacttattttcctgccctcattcttgaagctctctctttctcacagagtaatcagagttgtcttttaaatattcattcaagagggaatgagttgttcaaaatctgggaagaaaacatttcattcagtctagttgcagagtccctgagcatggttggtgtgttcaaggaatgacaaggaagaacaagggaaaatggtagaaaataaagttagaaagataggagagactagatcctgtaggtccttggattctagtcttatttaaataggaatctgtctattgggagattttgagcagggaaaggacatggtctgatttatcttttaaagtgctcagtctggttgctgagagaagactgtccgtaggtagcaaagatagggcagagacaaattaagaagattttgtgatgatccaggtgagaaatataggtggcttcattaaggtagtggtagaatggtgagaaatgtttggatttaggatgtattttgaagatagaaccaacaaattagctaatggtttggataatggtgtatgaaagaagtaaaagcatcaagcataactccaaagtttttggcttgaacaactggataaaatagttttgtcatttattataataggggcactatggaaaaaatatttgggtggatctggtttaaacatgcaaattagggatatgtgttaaatatccaaaggagatgtccagttggcaagcagaagtctgttcaggaaagagattaggactggagaaagaaaattaggaatcattagtgtatacaggtagttccacatagttaatttttaaagcctgatgagatcaaatagagagtgaatatggaaaagatattcaagaccttaacctagagcactagagccgatgatgcctttagaaattgggaagaggaggagaagctagtaaaagagcaattcgttaagtaaggaaaactgagagagtggtgtcttggaagacaagagaataaagtgttataaggaggaaatcatcaactgtgtcaaatatgttgatagctcaagaaagaagaggagtgtttggatatgtggagtccgttgttgctcttgacaaaaccagttccagtaatcagagaaaagataaagaagtgaaacagaattattttatgaattttgttgtaagtggacacagacataggacagtagctgaagaggttaacaggataaaggaaagttttgttgttgttgttttattgtgtttttaaaagtgggatatactagagcatttgtagactgttgggaatgactctggacagaaacattgatgcaggagaggggataattacagagcacaattcttgagtaggcaaaaagagataagatccattgcccaactggaggggataccaggaacatccactgttatccattgtaacagggatttaggcagattatatgattggaaactttagtggtgaaagaatgagtaagttctcttttgattgcttttatattctcaaatgaaaaaagaaatgaagttactggttgagagtggcagaaggggttgattgagcctagaaaacatagaatagtttttaacctcagtaagtaaattgattaagggaggtgttctgggattacatgacagtgtcaggggttttgtgaaaatttaaagagagaccagccatcatggttatgtatgttttttcagtcttgttcagcccaagcactgaataaattggaaagttgcatttatccatggttggggatttggtaaatactatgaaggtaatgagaagcaaggaattgagtaccgatatggtttgaatttgtatctgcccaaatctcatgtcaaattgtaacccccattgttggaggaggggcctggtgggaggtgattgaatcatggaggtggatttcccccttgcagttcttgtgatagtaagttctcatgagatctgattgtttaaaagtgtgtagcacctcccccttcactctcttcctcctgttctggccgtgtaagatgtgccagcctcctcttcaccttctgccatgattgtaagtttcctgaggcctccgcagtcatgcttcctgtacagcctgcagaaccgtgagccaattaaacctcttttctttaaccagtttcaggtatttctttgtagcagtgagaaaacagactaatgcagaaagttggtaccgagagtagggtattgctataaagatagctgaaaatgtggaagtgactttggaactgggtaatgggtagaggttggaacagtttggagggctcaaaagaagacaggaagatgaggaaaagtttggaacttcctagagacttgttaaattattttgaccaaaatgctgacagtgatatgaataatgaagtctaggctgaggaggtctcagatggagataaggagcttactgagaactggagtaaaggtcactcttgcgatgctttagcaaagagactggcagcattgtgcccctgctctaggaatctgtggaactttgaacttgaaagagatgatttagagtatttggtggaagaaatttccaggcagcaaaactttcaacatgtggcctggctgcttctagcagtatatgctcatatgtgcaagcaaagagatctgaaactggaacttatatttaaaagggaagcagagcataaaagtttggaaaatttgcaccctgatcatgtggtagaaaagaaaaacccattttctggggaggaattcaagccggctgcagaaatttgcataagtaaagaggagcagaatgtttaatagccaagacactggggaaaatggctagaaggcatttcagagatcttcacagcagcccctcccattacaggacactactccctgtgtttcagccactccagctccagccatggctaaaagggccccagatatatcttaagctgctgctccagaggctgcaagctgtaagccttggcagcttccacatggtgttaagcctggggttgcgcagagaacaagagttgaggcttgggagcctccacctagatttcaggggatgtatggaaacgtctggatgtccaggcagaagtctgcaggacttgttgcaggagggacctggttggggtgattggatcatgggggtagatttcccccttgctgttctcatgatagtgagtaaattctcatgagatctggttgtttaaaaatctgtcacaattccccctttactctttttcttctgctccagccatgtaagatgtgccagcatcccctttgccttctgccatgattgtaagtttcctgaggtctccccagtcttgcttcctgtatagcatgtggaactgtgagccaattaaacctcctttcattataagttacccagtttcaggttttttttttatagcagtgcaagaatgtacttatacaaccataatcttaatatattgacttaatcaatcctcctgtatgtaatcaatgtctcatcgttgcatcagggccctagcacctcatatgggctgactccatccctgtatgccagtcttccttatcctgcgtaggctcttgactcttcattctgactccctcatgggatgcttttccattctgtatacactttgacttctggtgctagatcatgtcctcattccccgcccttctctgataccaggtggcctcttgcagggatgcccactgtactctgacctgaatctccccagatctgtgtcactgagagggtcactcttctcagtctgatactttataccaggtggcttcttgcaagaatgccgtctctactctatgatctgacttccccctagccgacttaaccctcaggtgggcccccttctcatcattatcaggctctgaatccccacactattccctggcgtggacactctgcttctgagctggatcccccctatttgtggattcctctttcatcctgctggaactctgataccattggactcttgaaactctgtctatgccaagctgtttccccatgagggtacccttctcagcctactcaagctcatttattccactctaggctgagttataggtgccttaaccttcagctggcatgaacacgcaccttcttctgccccacctaatggttttacaactagattgtttggagaaagaagggtttttcttattttttattttattctttttgatagaaattgttctgaagtataatacacatttctttgttttaataattcaatctaaattacacttcacttttgaagtgactcttcttcaataagagtgtcaacaacaatgtagtgatagaaatgctacaagatagcccttgcttgaattctatttactaatttgatgtttgccgggtagctaggtcctcgaaaagtagatgccatggagaaagagtatgtgtatttggcttgctactcaggaacactgtaaacaaattaattttttgctgcataaatacatagctccttagttcaactactgtggattaaaccttcagcagaatgctctccttatgatgaaatgacagagtcaagtctgggctttcaaagctttatactgacctctggccacctcctcattgaaatgtctgtatcctaagaggctgtttctgagtagccagttcagcgacttcttcctctttacctccatcctcaacccttgtccaggctgccttcctatctctcctcgattattccctgcttcatgtcttgtctcagttcactctgttcaccctaaagacaaaataattcttctaaaatgcatatctacttcatgcaattcccctggttcaaaccatttagtgccatcaccttaaatccaaaagccttaccaagtttagaaggctgttaatttctgaaacattttaggttgatactcttcttttccctactttctatgccaaacattctgaaatttctgtagtcacgtagtgactcagatcttctcatctggttaacttctacccagattggtagaagtttcatttaaacattcacttcctttagactaccttccctgagctgtcctagataggttagatgctcctgctttgtactcccagattatcctgtgcttatgatggtgtttagcacaccttgtctacatttaacctatcttgcatgcttcaaaggaaaaaaagtctgtcagtttgaaccaaaacaacacatgaaacctacaaagtgcctgtaaatatttgttgaatgattaattgaattagtatcaaagttaaattcatgccaagaagtcattaaaaagtcagcaaaggatctttaatgattttttttttttaaagcagaatccagtacttgtgatttgggttgcaacaaaataatgagtatcacacttatactcgcaagatgaataactgtaacactggaaaagtatgtgaaacaactattttcaggcattggaccacagataatgcagggctatattctttgagaaaggagaaacataaaaggtgattctgcattcattccagctttctacctgggaacactttgtaaactttggcacatggaattggaatccagtagagagctgggcagaattgggcatcactaggcagatgaaacaaagataggattttggatttgctaaagtgactggaaattgtagagcagagtactgaagtagggttgttgtgcagagatggtgtaccagaaatctgcataaggatcttttgagtctttggccaaatactaagctatccatgtataggatgagatttaatgagggctagtagagaacaactaccaaggtggcaagtggggctgtgagtgttgtattctaaaggtcacacaatgctgtgagacatttgagtcctgatgtgccagaatggagtgaccttgtggaactctccagtgttcacttgagacctcagaaaggcccacctaacaaatactgaaaccaggttttgatagaatcaagctgagttgccagtaaattaactggctgctagaacaaaactcaagactttttaaaggaagcctactcagtcgaagctctcaatgtggcatctacaatgtgcagaatataattttaaaaattaatgggaatatgcaaaagaaaatgtggtctatacctgagaagggaaaagtgagtagaagcagatccagagatgacagattttggaattagcagacaaggatttttttttaaattttttttaaatttttttttttgagatggagtctcactctgtttcccaggctggagtgcagtggcacaatctcggctcactgcaacctgtgcctcccaggttcaggcaattttcctgcctcagcctcccgagtagctggaactacaggtgcccacgaccatgcccggctgattttttatttttttattttttatttttagtagagacggggtttcaccatattagccaacctggtctcgaactcatgaccttgtgatccgcctgcctcggcctcccaaagtgctgggattgcaggcatgagccacgacgcccgaccggatttttttaaagctatgatagataagctcaaggacttaaaggaaaagatggacataatgtgtgggaagacatctaaacagagtaataaaaactataaaaaaagacccaagaagctgaatgcatcacaagcagcataaacataactatgttgtacattacattcaaattgttcaaaactaaatataaaatcttaaaaacaggtggaggaaaaagtaacacatcatgcagagggaaagaataatgagtatgattacttcttaggaaaagcaatctaaacctgaaaacagtgggacagcacctttaaggtgctagggaataaaagttaaactcctatatccagcaaaaatattctttgaaaattggaggtgaaatggaggacattttcagatttaaaacaaaatggtagaggtaatttgttacagacaggcttgcactatagtaattgttaaagaaagtttttgaggctgaaggaaaatgtcgaaaatgattgtaaattagtcctagagtaaaagctgctctaggtccccctttacagaccttaacaacaaaggttcaaaagaatccaactgtttgttgctcaaaaaacttaactgcatgccagaacaaagttcagtactcattaaaggaataaaacaaaatctttcacccaacaatacaaaattcacaatcaaaagttaacaggcatccaaagaagcagggaaataggacccataatcagagaaaaatcaatcatatgaacagatccaaaatgaaagaaataatagaattagtagataagaaccctaaaaccttattataactcttataaatatgctcatagatataaaggaaaacataagcataatgagaaaaatggaaaataattttaaaaacccaaataaacggaataatggtgttttgtatataatggtacaaataggttaaaagcaaaaggattgaaaaaatatactgtgccagctaatgaaaagaaagctgaagtgaccatattaataccagacagaagacatcagaactagggaaaatgaaacattttatgatgagaagaggtcaatttaatgcaaggacacaaaaattctaaatgtaaaacttccaaatatatgaggcagaaacctatggaacagaatggagaaatacacaaatctgcaaggtcaattggagatctcaatacccctctcagtagagaaaagaagcagatgaaatatcagtaagtatatggaaaattttaacaacactgttaaccaaatcaacctgattgacatttataggacattccattgaacgatagcagaatacactttattttcaagtgcatgtggaacattctgtaagatagaccaacattctggactgtaaaacaagtgtcaataaatttataaggagtaaagtcatagataatgtattctgtgactacaccagaatcagtagcagaaaagtatccggaaaatccccaaataattgaaaaattaagcagcatacttctaaatattacatggatcaaaaaaggaatcacaagggaaattagaaaaaatactttaaatgaatcaaaaatatagcatgtaaaaatatgtggggtgcagctagataatgcttagagagatacggtagaaaagaaaccaatcagtataatttgccacattaacagaataaaaaagaaatatcatatgaacaccaatagatacagaaaacgcatttcaatttaatagtctttcgtggtaaaaaccctcagcataactgatggaggaatattaattcctgaataattcagtccaaaatccgttaggtgtggctgagtgaggaaggcatccacaaaaacaagctgtgacagcctggtgggggattggagcccaagtaaggaatctatgagtttatactgatacaagaaaatggggggggaaatggagaaagagcaaagccccttatactagaaccttaactaatataaaaggaataatggaactagaaaattactataggcataccttagatattgcaggttaagttctaatggatggcggtcttgtctacattgaaaatctgttgtttagtgtagctaccttcatcaattacctgagctagatcttctggataacttgctgcagctcctgcatcagcacttgctgcttcacctcgcacttttatgttgtggagacagcttctttctttaagcctcatgaaccaaccattgctagcttccaacttttctttgcagcttctttacttctctcagccttcatagaattgcagagagttggggctttgctctggattaggttttggcctgagggaatgttgtggctggtttaatctatcccaactactaaaactttctccatatcagcagtaaggctgtttcactttcttatcatttgtgtgttcactaaagtagcacttttaattttattcaagaacttttcctttgccctcacaactcagctaactgatgaaagaggcctaactttcaacctgttttggattttgacatgcttttctcaactaagcttaatcatttctagtttttgatttaaaacgagatgtttgactcttctttcgcttaaacacttaggggctgttgtagggttactaattggcctaatttccatattattgtgtctcaggcaatcaggttccaaggagagggagagagacgggaatggcaggtcagtaaagcagtcaggacacacacgttaatggattaagttcacctcttatatgtggatggtttgtggcacacaaacaattacagtagtaacatcaaagatcacttatcacagatcactataacagatacaataataatgaaaaagtttgaaatattgtgagaattaccaaaatgtgacacagagacacaaagtgagcacatgctgttggaaaaatggcaccgatagacttgttagatgcagggttgccacaaacctctgaagagcacaataagatggggtatgcctgtatttgatagctgtcataataataattcattcaggtaagaaacagtagatgctaaaactaatggaagaaagtttgatgaagtatgagatagttgtatggtctctgcatctctccctcaaattattaattaattgtaaagaaaaattttttggtgaagctaggagatacacctttatcaagagattgaagttagtctaggcaacatggtgaaaccacatctctacaaaaactacaaaaattggcggggtgtggtggcatgcacctatagtcccagctacttggggggctgaggtaggaggattgcttatgactcagaggtcgtggatgcagtgagctgtgttcatgccactgcactccagcctggatgacaaagtgagaccctgtctcaaaaaaataaataaagggattgaagttaataccctccgtaatgagataaatggaaatgatgtcctgtctgatgagatgcagtaaaaggaactcatcatcgcttgtataatattcttgccaaagatacataacctgattctagtcgtgaggaaatattacccaaattttgggaggtattctgcaaaataatggtctgtacttttcaaaattatcagtcatgaaagtcaaggaaaatctgagcaactatttcaggctgaaagaaagtaaagagacataaccaccaaatacaaagtgtaattctgaactgaatccttttgctctaaaggacgtactgggacaagtgaattaggctgtagaaaaagaaaaaaacaatcagtataatttgccacagtaatagaataaagaagaaaaatcatatgagcatcaatagatacagaaaaagcttttcaatttaatactcattcatgataaaaactctcagcataactaatggatgaatagttattcattcctgattaattcagtccaaaagccattaggtaggactgagtgaggaaggcatccacagaagtaccctagggatgaatagatgatagaattagtagataagaaccttaaaatcttattataaatcttataactatgttcatagatataaataaaaacataaaaataaaaacatgagaaaaatggaggacaataaccaaaaaaccctaaataaagtaaaaggaataacagtgtttttatatataatagtacagatgggtttaaaacaaaaggatggaaaaaatataccgtgccagctaatgaaaagaatgctgaagtgaccatattaatataagacagaagacatcagaaaaaataggtgattatatgatatttgaatgtctgttcattgttggtcttttaggtcttataagatgatggtcattttctactactttaagggagcatattaaatttttttcaacagactttaaactttattttgtagatcagcttcgggtttatagcaaaattgagcagaaagtacagtttctgtatattccctgcctgtacacacacaacctcctctactatcagcatctaactttttgtagatactttgcctcattcaaataatccagggtaatctttctattttaaagtcaagtgattgacaccccagttccatctgtaatgttaattctcttttgctgtgtaatgtaacattcacaaattcaagggattagaatgtggacatctttggagaaccattattttatatgccacagctgagttaatggtaacttatcacattttggaacaactggcaaaacttgaatgggatttgtggaccatgtggtaataatatatcagtatcagtttcctgatttttgttgttgaaaatgtccttgttttgtaggaaatactggtgttgggacatcagatcagcaacttactctcatgtggtttggggggcaggaaagctatgtatactgtagttctgtgtattactccattttcacactgctgttaaagacatacccaagactgggcaatttacaaaagaaagaggtttaatggacttacagttccacgtggctggggaggcctcacaatcatggtggaaggtgaaagtcatgtctcacatggtggcaaatgagagcttgtgcaggaaaattcccccttataatgaccatcagatctcgtgagacttactatcatgagaacagcacaggaaagacctgcccccgtgattcaattatctcccacctggtttctcccacaacacatggggattcaagatgagatttgagtggagacacagccaaaccatatgattccacccctggcccctcccaaatctcatgtcctcacatttcaaaaccaatcatgccttcccaacagtcccccaaagtcttattttagcattaattcagaagtccacagtccagagtcttacccaagataaggcaagtcccttctgcctatgcgcctgtaaactcaaaagcaagttagttacttcttagatacaatggggatacaggcattgggcaaatacagccattccaaatgggagaaattggccaaaacaaaggggctacaggccccgtgcaagtccgaaattcagtggggcaggtgtatcttaaagctccagaatgatctcctttgactccatgtctcacatccaggtcactctgatgcaagaggtgggcttccatggccttgggcagctccacttctggctttgcagggtatagcctccttcctggctgttttcacaggctggtgttgagtgcctgcagtttttccaggtgcacagtgcaagctgtcagtggatctattattctgggggatctaccagtctggaggacagtggctgtcttctcacagctccactaggcagtcccctccataggaactctgtggggtttcaaccccacatttcccttccatattgccctagcagaggttttccataagggccccacccctgcagcaaacatctgcctgggcatccaggtgtttccatacaccctctgaaatctaggcagaggttcccaaacctcatttcttgacttctgtgcacctgcaggctcaacaccacgtggaagctgccaaggcttcgggcttccaccctttgaagcaacaggccaagctgtaccttggcttcttttagttgtggctgggacacagggcaccaagtccctagaccgcacacagcagagggaccctgggcctggcccacgaaactattttttcttcctaaacctctgggcttgtgatgggaggggctgtcacaaaggtctctgacatgcccctggagacattttccttattgtcttggtaattaacatttggttccttgttacttatgcaaatttctgcagctggcttgaattcctcctcagaaaatgggattttattttctatcacattgtcaagctgcaaattttccaaacttttatgctgtttcccttttaatactgcatccctttaacagcacccaagtcaccgcttgaatgctttactgcttagaaatttctttcaccagataccctaaatcatctctctcaagttcaaaggtccacacattcctagggcaggggcaaaatgctgccagtttctttgctaaaatataacaaaagtcacctttgccccagttcccaacaagttccttatctccatctgagaccacctcaacctggatttcattgtccatatcctcatcagcattttggtcaatgccattcaacaaatctctagggagttccaaactttcccatattttcctctcttctgagccttctaaactgttccatcctctgcctgttacccagttccaaagtcgctttcacattttcggataacttttcagcagcactccactcctggtaccaatttactgtatgagtccgttttcacactgctaataaagatatacctgagactggacaatttacaaaagaaagggtttaatggactacagttccacctggcttgggaggcctcacaatcatggtggaaggtaaggaggcgcaagtcacatcttacatggacagcaacaggcaaagagagcttgtgcggggaaactccttcttataaaaccatcaggtctcgtgagacttactcactgtcacaagaacagcatgggaaagacctgtccccatgattcaattaccttcaactgggtacctcctgcaacatgtggaaattcaagatgagatttgggtggagacaaagacaaaccaaatcattctacctttctataaacttgcaatttttaaggataaaaaacatttttgatgcttacagagataaaattcatttatttgaaaaatctgcatacctgatctcctaatgatgctgaataaaggaggtagatagtatatcatttttgtaaattaattaaacagtattcttctatattttggatagcatgtaaaaatatcactcattttggatgtttttctttttgttccctcattttgggtaagattgcttatgcctttttctcagaaccaacactggtgcttattaaagtaacataagttttttctgtgttttccttcaaaggttgctcaagaaacagatgtgagagcccagattcgtctgcaatttcgtgatgtcaatggagaacttatagctgtgcaaagatctatggtgtgtactcagaaaagcaaaaagacagaatttaaaactctggaaggagtcattactagaacaaagtaggtgtttatatgatatttgaatttctgttcattttcagtcttttaggtctgtaagttgatggttgttttctactataagtttaggggagcatattaaatttttttcaatagactttagactttatttttttagagcagttttgggtttatagcaaaattgggcagaaagtactgagcttccattttctccctacccccacgcacacacagcctcctccactatgaacatttgattttttgtggatactatttgtcagttaaatagaatgatcccatgaaagacttagggttatgttccattctcttgagtaatttctgaacagttgctgaattgaaagcacataatcactcaaatacaggttgaatgagtaaaaaattctagtgtcatgtttaagaatgggtgagatgagaagcagacaagtaggaaagaatgataaattgttcctttcaaccattatcattctgttagaggcaggtatcattttctaatggatatggatttggggattagactaccttagattcaagtctctgtctttgttgagcaaattacttgactattcagcttcttctcctcccttttatttaactagctaagtaattcctttatttaaccaataatgcacatctactatgtgctggaggcactatactggcttctcaagcaggttttcatcattgccattttaacacactcaagtatctctcataccctgggatttcattccactccagttactacctgtctccttcttctcctttatagccagtctctcaaaagagttgttgatactgtctccatttcttcacctcctcttcactccaattgcagtcccattcgtcctttgaaacacctctgactaaagttactaataactctgtttttaattagggtaatgctgctgctatacaaagtagacctaagagtgagcctctgtttatttcatttgtaaagtaggcattcattttcactgtgtgtatcttagatgttgtcaaggttgagctaatgcatataaaatgcttaacatgtagtaagagttcatgtattagtcttctatgactgctataagaaaccacaaacttagtgctataaacaatacaaatttattatcttacacttatgtagtttagaagtctgaattgggtctcactgggctaaaatcaagatgttagtagggttacgttcctttctggaggctctaagggagaatatgtttccttgttctttccgtcttttagaggccacccatattttttagatcatgccctcttactctgtcttcaaagcaagcaatagtgggcagagttcttctcatatcaaatcactgtgacctcttcttctctcttcttctgccttcctctctcacattaaaggacccatgtgattacatttgccccatccaaataatccaggatagtctattttaaggtcaaatgattaacaccctaattccatctgtaatcttaattctcttttgctgtgcaatgtaacattcacaaattcaagggattaaaatgtggacatcttggaggaccattgttccatgtaccatagctaagtaaatgctagtttattactttttatttgaaaatttctttttctagacctccatgatacaatactgttctctctttctatcacagctacatactacttcattcaccccatcaataaaggttggaagtctcattaggctcagtcctgtatcttctccttttttttgctctgtattttcttcctaggtaatcacattcttatccattgctcaaactactctgtgttcatagatgactcacagatttatgtcatatctccaaaccagacctctgtttccagacccatttacccagacctatttacccatttctgattttttttttttttttttttttttttgagatggagtcttgctctgtctgtcacccaggctggagtgcagtggtgaaatctcagctcactgcaacctccgcctcccgggtttaagcgattctcctgcctcagcctcctgagtagctgggactacaggcgtgcaccaccatgcctggctaatttttgtacttttagtagagatggggtttcaccatgttagccagaatggtcttgatctcttgacctcgtgatccgcccacctcagcctcccaaagtgctgggattacaggcgtgagccaccgcgcccagccccatctctgattttttttaccagttgtttcaaagacaacttaggttcaacgtttccaaaaccaaactcagtcctttctctttgacctccccccttaaaaaacctccaacaacttggtcttatggtatacctcaccttggtgaatgataccactatccgtccagtgacaaaagccaagaacctaagtcttgatatgtctttgccttccatatccagtctattactgagacctatgaatttaatctaaatgtctctggaatctgtttccatctctacaaccaccattctagtcctagtccaagctaccattgtctttccatgacctcatgtgataacctattgatttatctgtgtctattctagccctctgcaaagcattcttaatatattcagtataatattttttttctttcttttttttttttttttttttttttgagacagagtttcgctcttgtttcccaggctggagtgcaatgatgcaatctcagctcactgcaacctcaccgagttcaagtgattctcttgcctcagcctcccaaggagctgggattacaggtgcccaccaccacacctggctaatttttttgtatttttaatagagacagggtttcaccatgttagtctggctggtctcgaactcctgacctcaggtgatccattcacctcggcctcccaaattgctgggattacagacatgagccaccgtgcctggcccagtgtaatattttcaaaatacaaattgaaatgtataaaaaacagtaaagacagatattgcctctgctcaccagagcagtctgttactgaagaaagaaccccattctaagatgtttttaacttacctttgcctgtctgctattgatcatcatgttttgttttattctttgtctcttatttttaagacagttaatgctctatatagtatctctaagtattctaaattattatatttaaaagtccaaatatgtaaaaaataaattctggcttcctttcctgaactactttgttttacatatcttttcatctgtgaaccgttaaatagtttaagagttacactttttagcatgatgaagccatttctaacgggataggtgaagggcctttttttttattcttttaaagaagtacagtatgaattgattaagcaatagaatagatacactgaaggttattttacatatattcttgattttcattttctgtaggcatggtgaaaaggtcagtctgagctctaagtgtgcagaaattgaccgagaaatgatcagttctcttggggtttccaaggctgtgctaaataatgtcattttctgtcatcaagaagattctaattggcctttaagtgaaggaaaggctttgaagcaaaagtttgatgagattttttcagcaacaaggtttgtaacccttaaatagactttgtagtccattaagttattgaactgtgtttgcaatttggatgcttctttttaacagaaaaaatttaaaaagcagaaaggtcatcagttactacctctcatccagcagcaaccattgggcatattttctttcacttgtctttctgtgcgtatatttatttacctgattgacagtataaatgtaatttttttcacttaccattatgtcataggcattttacaagttattaaaaactcattgtaactgtaatcttagtgacagcataatatcccactgtatgaatatataccataatttactttgccagaaatttgatttttgtttcatatcttcaaagatacattaaagccttagaaacacttcggcaggtacgtcagacacaaggtcagaaagtaaaagaatatcaaatggaactaaaatatctgaagcaatataaggaaaaagcttgtgagattcgtgatcagattacaagtaaggaagcccagttaacatcttcaaaggaaattgtcaaatcctatgagaatgaacttgatccattgaaggtaacttgattttatttttaattgacaaaaattgtatatctttatggtatacagcatgatgttttgatataagtatacatcgtggactggctaaatcaagctatttaacgttcattacttcaatttttttatggtgagaacacttaaaatctactctcttagcaattatatattgttattaactaaagtcacagtgatgtacagtagttaatttcttgtatactaaataggtagtcctttttttgctatagtagcattctccccttatttgtatatgaaactgaatggcttgtatatttcttgaattatcagggagctaatgttttaggtctatgttagtctttaaattgctgaaagagcttggatttgaaagaaaacaaatttgtagcatcacactaaattagtagtatagatcactaggtgttaaatagcaatatcattacccaaccttacagttctgtattaatatttttaaaaattgacatctttctagagaatttttaaaatttgcagaaagtttttgaagcattcaaaaattgcacagaatttggaattgatccataacatgttcatatatttgcaaatgagtataccttcctcaacccggtgatttataagaaaggcctacaggaaattccattcattcatttaataagcatttattgggtgtcttctttgtaccagggtatactgtgcttgggtacaaagaggactacaactgcacccctgtccttaaggtattcctagtctaaataagagcattcttaaaaatggctatttgctatgttttagatagtagattttttaaagtcattaaaaaatttattgatttggtttttaaaaaactcacctgtaaataccagtatagatctttgaatcatgaagtagaaaatatatatatatttttaatgatggccatgcatagaaatatattgcaagggcttctgggaggaggtagggctgaggtgggccttgaagaatgggaagaaatcaagtcagcaaactagaagacattttatacatgtttgtatttatttatttatttatttttgagatggagtttcacttttgttgcccaggctggagtgcagtggcacgatctcggctcactgcaacctctgcctcccgggttcaagcaattctcccacttagcctccagggtagctgggattacaggcatgagccaccacgcccggctaaataaaaaaaaaaaatagaattttttgtatttttagtagagacggggtttctccatgttggtcaggctggtcgcgaactcccgacctcaagtgatctgcccgcctcggcctcccaaagtgcagggattacaggcgtgagccaccgcacctggaaatgtttgtatttattttgacttttcttttaaaagtaatatgtgcccctagtaaaaaagttataaaaggatattaggtgaaaagtaaaagatagtcttccatttctcatctctaaccttccagagtatattttacctgcaactttttttaactgcatatatacaatacatatgtatatacaaacattcacttgtatgtatgtgcatatttacctttacaagcttaatcagaacaggattatgagaggaagagtctgggttaagtaaatcaatataaaaggagtaaatgaccaatatgaatcggggtcagattatagaaagctaatggatttcagacttagttcaatagacagaagagtggaagactatgttatattttaggatgagttgtcctgataactctgtgtgggtcccgtggtaattaccaagatattagaacagatttcctttttttttcttctttcccccttgccccactccacgttttattttcttgaggagcatcttggttggagagatgacaagcacatgtaatggtaaggcagagaaaaaaacaagacctgtaggagctctgaggataaagaaagagaatttctatctgaggtagccagagaggatttcataggactgaatttggccatgacttttttgatcataaatgagtaagtcattggagacatagagacagtaaaatccaagctgtctttgaacactgtcaaggaaatccatattgttgaaatgaagcatttatattggaaatgatgtcaaggtagggctaaatgataatacctaggatttagtgagtggtgccaagattctaaccaaggctgtagcagaggttgaggtatttatttacttgtttgtgtttaattgtgagtaattctccaagggtttaatattcttctctgtatcctcagagcctagcctagtgcctggcacatagcaggtggttcaataaatgtttattaagtagatgacttccaaagtccttttttttagctctgacatgtgaagattcttcccttcatagaacccaattaaagtttgggtcaaatcaccttcccagaaaagactacgtcctttcaaccatgcactagaatgcatcctttcccatttttactgattccctttatcttcgggaactctcactctctcataaactactttattaccatcccaccatatcctgtcctctttttttggcctacttagatctgttttcctttcttgccttaaatgggaattgctagaggaatatgtttctaactttttttttctgcacacaagttcatggtccttctatacttgatagcccagctgctctattttttttatctcatttcacactggcacctaagctttaaacccttggctgtttttgttattgttgtctgcctgcttgtcctagctccttttactaggtgtgtactctggggatagaacctatgttttgtgctctgagattagaaccaaaacacagatgtcaaagaaggaattcaggggatctggtgactggctggatttaaggaatgaagcaggtagagatgtcatgaaagatccaagcccagatgattatcataatgtttgtgctaccaagaggcagtgaaaacactgatggaaagaaactgagcactttgtagagtatcatagtagagctgttagtattcattgctcttaagtatccatccagttatatttgttagactctactcaaaaggtattttctgagtacagaatttttttcacaagtggtgcaaatggtctcattaattgaatgtttactgcctaacactaacccgagtgctttaaaatgtataatgtaaactccatagtaactgtgaggttgtataggcaggaaaactgaggtacaggtattcacagtggaaataagggttaaaggtaggatttgagtcctctgattcctaagtttatacctttttttctttttaagtcaagtttattaaggtataatatatatatggtaaaatccaccctttttagagtataaattctatgagttaggacatatgcatacagtagcataaccatcactaaaatgaagatgtagaatatttcagtcactccaaaaagttctctcaaagtccttgcagtcagtcctctcccctgctcccatccatagtaaccactaatttgttttctgtcattatagttttgccttttccagagagtggcacatatatagaatcatacagtatgcagacttttgtgtctgggatttatctatgttgctgcatgtgtgagtaattcattccttttttttttttttttttttgagacggagtttcactcttattgcccaggctggagtgcaatggcatgatctcggctcactgcaacctccgtctcccaggttcaagcaattctcctacctcagcctcccaagtagctgggattacaggcatgtgccaccatacccagctaattttttttgtatttttagtagagacggggtttctccatgttggtcaggctggtctcgaactcccaacctcagatgatctgcccacctcggcctcccaaagtgctgggattacaggtgtgagccactgtgcccggcaattcattcctttttattgtggaggagcattccttccattgtatgcatgtattataatttttttcctcatccattctgtggctgatggacattaagttgtttttggttgaactagtttacagtccctccaacagtgtaaaagtgttcctctttctccacatcctctccagcacctgttgtttcctgatttttattgatcgccattctaactggtgtgagatgatatctcattgtggttttgatttgcatttctctgatggccagtgatgatgagcattttttcatgtgtctgttgtctgcataaatctcttcttttgagaagtgtctgttcatatccttcacccactttttgatggggttgtttgtttttttcttgtaaatttgtttgagttctttgtagattctggatattagccctttgtcagatgagttgattgcaaaaatgttctcccattctgtaggttgcttgttcactctgatggtagtttcttttgctgtgcagaagctctttagtttaattagaacccatttgtcagtgtggcgattcctcaaggatctagaaatagaaataccatttgacccagccatcccattactgggtatatacccaaaggattataaatcatgctgctataaagacacatgcacatgtatgtttattgcagcactactcacaatagcaaagacttagaaccaacccaaatgtccaatgatgatagactggattaagaaaatatggcacatatacaccatggaatactatgcagccataaaaaatgatgagttcatgtcctttgtagggacatggatgaagctggaaaccatcattctcagcaaactaccgcaagaacaaaaaaccaaacaccgcatgttctcactcataggtgggaattgaacaatgagaacacttggacagacacaggaaggggaacatcacacactgggtcctgttgtggggtggggggagggaggagggatagcattaggagatacacctaatgtaaatgacgagttaatgggtgcagcacaccaacatggcacatgtatacatatgtaacaaacctgcatgttgtgcacatgtaccctcgaacttaaagtataataaaaagaaataagttgttttcggctttgggttgttacagataaaactgctataaacttctgtatacaggtctttggataactttaggactcgggttgctaggtcgtgtggtaaatatatgtttaaccttataagttaccagatggctgtaccatctggtaccacttcatagtcctaccaacaatataccaacaatttatgggaatgtaattgctctgcattctcatccccacttagtactgtcagtctttttcattttagccataacagtaggggtgtggtagtgtctcattgtgacattgtgaggttgtatttctttatatttttaatttgtgttttcctagttgatcagtcaattgattattgattttgagcatcttttcatgtatttatttgccacctgaatatcttcgttagtaaaatataaaagtcttttgcctatttttcaatgttatttatttattggtcattttattattgagctgtgagagttcttttttttttttttttttttcttgttttttgagacagggtctcgctgtcttacccaggccagagtgcagtggtgtgatcttggctcactgcaacctctgactcccaggctcaagtgatccttccacctcagtctcccacgtagctgggactacaggcacacactcaccacaccggtgagacttgtagaggcaaggtctcaccaggttacccaggctggtctcaaacttctgggctcaagcaatcagcctgcctcagtctcccaaagtgctgggattacaggtgtgagctacagtgccaggcagagagttctaaatatgttctggatacaagccctttatcagatattggttttgcagatatttcttaactgcttttcagaggacaggagttttaaattttgatcaggtacagtttataaacttttttctcttatggtttatactttttgtttattatttaggaagtctttgacccagtgtcacaaaaatattcttcagtgttttcctctaaaagttttatagtttgagttcttacaattaagtatatgcttcatttcagaatcttaatatgatatgaggtaaaagttgaggtttactttcttacatacaaatgtccacttcttctagcacccagagcctagtcattatgataccctgccttctaatcttattgttatcttgtctcccaatcttaactatacaattttgtacaagtcagttaagtcctttgaatttcctgcttagtatatacttttgtgaggattagagagaatttatagcagcacctagtacagtgtctggaacatagcagacattcaatcagtgatacctgtgactgttgctcttggtaaaattatttttttcaaatctctctttcgtttagctaacattgaacacctattgcatgttctggggatacattagggaacaaagtaaacaaagtttctgtttttaggttcatttgtatatgaacgtttacgttcatatacaaatcacaagctatactattagtataattttaataaattatgttaaagtcgaggatgcattttggtgcaattatgaaagcttgcaattgctgtctaagcattccaataacttcatatgttagtttaaaattaggttctgctgggcatggtggtacatacttatagtctcagctacttggaggctgaggtgggaggaacacttgagcccaggagttcaagttgtattgcactgttattgcacctgtgaatagccactccagccagggcaacatagcaagaccttgtctctgcatttgaaataataataataaaagtaggttgtaaaaatgtcttagaagaagagttggtcagttttggaatcatagaggcaaacactagaagaatatccccagcatcatccaataagagaatgccccgaaccagatcccagtattcctgggagatgaggcaaccagctgtctctggaagcgagcctcagagcaggccactgagctcccttgttgtactttacttgctcagagtcctctgtggttgagcaagctttggattaaagtatactcttcatgtaaatttgcctataggctcagaatgcattggtaactcaccatgaatttctagccttctcagtagtcctgacttaaaaaaatacattaaatagttacctttttaaggattaagtaactctaaatgcccaatgaatgaataatgacttttgtggcaggtgttgaggacaggacatggtgtttggagttagaagtggaatttaattcctgcttctctctactagctgtgaggacttgggccaagttacttaatgtctctgaacttcagtttctctaggcctgctctacagtgttattgttagccttaaatgagatcacttttactaaatgcctggacctggagtatcttacttgtcttcatctatcagccatgtaagctatagtgagttttatttatgtaatgtttctttattttcagaatcgtctaaaagaaattgaacataatctctctaaaataatgaaacttgacaatgaaattaaagccttggatagccgaaagaagcaaatggagaaagataatagtgaactggaagagaaaatggaaaaggtttgtggtggtagaattttgttctgcttcaaaattttgggattattgtaatgaactttatttgaatccattttgccatccacattggaaaaaaacaaatacagatcttgttacttctatgtatatgttaaaatgaaggatattgaataaggtttggtttatatttgatacctcaaagtgatcatattttcttatgtttgtacattaaagctttttattttggtgttacacaggtttttcaagggactgatgagcaactaaatgacttatatcacaatcaccagagaacagtaagggagaaagaaaggaaattggtagactgtcatcgtgaactggaaaaactaaataaagaatctaggcttctcaatcaggaaaaatcagaactgcttgttgaacagggtaggacaaaatgtttatttggtcgtttttcctactatgatgttatacattttctgtatgaatgaagaatctccaaggacttatgctgagtgaaaagccaatcttaaaaggctatacacagtatgtttccatttatataacatttttataatgtcaaaattttagaaatagtggagaaattagtggttgccagggatactgggtaagagaaaggacaggagggagctaggtatggttatgattagaacaaaaagagagtccttgtagtattggaactgttcagtatcttgactgccatagtggatatatgaaccgacacaggtgataaaattatatagaacttaatatacacacatccacatgctcaggggtacaaataaaattggggaaatttgaataagattgatgaattatatcaatatcagtattctggttgtgatattttactgcagttttgcaaaatgttatcattgggagaaactgggcaaaatgtacaagagacacactgcattattttttataactcgtgaatctgcagctatctcaactttttaagcaccagttgaaaaaaaaattatgagattttttttttaaaaggtcgtctacagctgcaagcagatcgccatcaagaacatatccgagctagagattcattaattcagtctttggcaacacagctagaattggatggctttgagcgtggaccattcagtgaaagacagattaaaaattttcacaaacttgtgagagagagacaagaaggggaagcaaaaactgccaaccaactgatggcaagtattttgaaatacagtatttgttattttgtttgcatcatattctctacttgaattgttttaatttttggttggactccattttggcatatttttctattagtgttaggataaaatctgctacaaggcagaaaaacctttattgaagcaaatgttcttaagtgtataaagataaaaatatgaagaaaatgtaaacctacattttttatttggttttaagtaaaaatttttaaaaactaattgcagagaaaacatttgctcacagttaatgattatctctgggtaatggttttgattgtttttaaaatacagtcttgaaccacatgttttggtcagtgatagaccacatatttgacattggtcccataaaattataatactgtattttactgtatgttttctgtgtttagatatgtttagatacataaatacttatcatcatgttacagttgccaaagtattcagtacagtaatatgctgtataggtttgtagcccataaacaataggctataccatatagtctatgtgtgtattaaactataccatgtaggcttatgtaaatacattctgatgttcacacaatgataaaattgcctaatgatgcatttcttggaatatatccctgctgagcaacacacgactgtacttttttgtattttcttcagtgtacatatattccttttgcaattaaaaaacttaaattgtttagtaaattattaatgctcattctttacatatgcatttagaatgactttgcagaaaaagagactctgaaacaaaaacagatagatgagataagagataagaaaactggactgggaagaataattgagttaaaatcagaaatcctaagtaagaagcagaatgagctgaaaaatgtgaagtatgaattacagcagttggaaggatcttcagacaggattcttgaactggaccaggagctcataaaagctgtaagatattgtttgaataatctaataattttaagatataatacttttagaagtattttgtctatttttgatcctaagattatagcattttaataaaaacatcaactttgtcttattctcatgtaaaatgaattcatctgaatatcttgatcttctgactctttggttctacaacccgatagcctgaaaattagaatcacatagggagctttttaaagatactgtactcagaccttaaagcttcagaccttccaaatcaaaatctctgagaatggggcatagaaatgtacattcaaaacacaacaaaactggctaattcttatgagcaccttgattaagaacacttaccaggccgggtgcggtgtctcacacctgtaatcccagcactttgggaagccaaggcaggcagataacgtgaggtcaggagttcaagacctgtccagccaacatggtgaaaccccgtctctactaaaaatacaaaaattagctgggcgtggtggcgtgtgcctgtaatcccagctacttgggaggccagggcaggagaatcgcttgaacctgggaggcagaggttgcagtgagccaagattgcgccactgctctccagcctgggtgacagagtgggactccatctcaaaaaaaagaaaaagaacacttgccaaagttttaaaaaagcaagtatttttcctctaggtcacacacgttgtaattctagatgatttttgctgtattattactttttctgtgttaaaaactttcttagccaatcttttcaggtatttccatattttctttcttgcttctagtctgtcctccttcttcacatctccattaccaaagtaagcattctaaagcatggcaaacttcttaaagcccatcttgataatttatgtaaacatttatttttgctccataactcaccattgtagcatacatttttgtcagtttagcacttcatcagtgttgtcttgttggggtggggagatacttggtcagggaccacatcacactatttttatagtttctacataccaggcaatatagtgaattacatggggacataataaatatttaattgttgactgaggactcactaatctgtgtacttagacacatgtctcctaattttacagtaattctcacatttctttcctgtttgacccttctaggtttatttactaattctctaccattataacatagtaaggtcactttaataagatataccttagagcatatatagtgccttatgtttttttctcttgttggatgcaaacagtaatatttggaacattctgaggagtagttaatttctaatacactttgtcattattttaattcttgcacaaaatatataacacctttgcatttgtatgaattattgactaggaacgtgagttaagcaaggctgagaaaaacagcaatgtagaaaccttaaaaatggaagtaataagtctccaaaatgaaaaagcagacttagacaggaccctgcgtaaacttgaccaggagatggagcagttaaaccatcatacaacaacacgtacccaaatggagatgctgaccaaagacaaagtatgatttttctttttgttctaattatactgtctggtacttaaaatagcctaccttgcactcataagtcatagactataaggtattaagttggtattgactatattttagaggctaagtgagcttagtactctatataatagactttcaagcttaaaagttattgtttaattacaaaaagttaatacagaaatgtatatatatgtatatacacacatgcacattactgttaacttttaacatacacaaattttaaaattttatattgttcgacttggtactccactcttaaggcttagaaagaccatccccacttgaagactttaagaactttaagaaattttatattttattttcatatttttatagttttaagcttagaactttagtcagtctagaatttatttttgttcttgatataatgtggagatatagactttatttttaaaagattttttttttacctataggctgacaaagatgaacaaatcagaaaaataaaatctaggcacagtgatgaattaacctcactgttgggatattttcccaacaaaaaacagcttgaagactggctacatagtaaatcaaaagaaattaatcagaccagggacagacttgccaaattgaagtaagttgcaacatttggagatgtaatagaaatctcttatttcatgcttacctgtttaattgttttaaaataatttattgtcatgaaatggtatgttatattgataaactttagttcttacatacaaggagacttcagaaagttcatggaaaaatggaattaaaagataaaaattttaaataaactgtatttctcaacataagctccatcaagttcaagactcttctgagcagtgataccagcaatttagttcagtcctaaagaactgagggtcctgggaatttaaccatgtcagtgtagtcttttttacattgctagcataaaaatgggtgccctttaaagatttttttaagattaagaaactagaagacaggaggagccaaatcaggactgtaaggtggatgcctaatgatttcccatcgaaactcttgcaaatggcccttgtttgatgagaggaatgagcaggaacattgttgtggtggaaaaggactctctggtgaagctttcctgggcatttttctgctaatgctttggctagctttctcagaacactctcataataagcagttgttacctttcttcggccctccagaaagtcagcaagcaaaatgccttgagcatccccaacaactgttgccatgacctttgctcttatctggtctgcttttgctttgactggaccacttccaccacttgttagccattgctttcattgtgctttgtcttcaggattgtactggtaaagccacattccatcacctcctgttacaattctttgaagaaatgctttaggaacttgatcccacttattgaggaagttctgctgttgtctgcagctgatctggaagcagtgattttgggcatccatcaagtagaacgtttactcaactttaatttttcagtcagaattgtgtaacctgaatcaattgaggtgtctatggtgttggctattgtttctgctgttaatcattgatcttcttcagttagggcatgaagaagatgattttttttcctcacaaattgatgtgaacagtctgtcactgtgggcttcatctttaatatcgtctcatcccttcttaaactgagttatccatttgtaaactgctgatttgtttggggcattgatctcataaacttgttgtaaagtatcaatgatttcaccattcttccacccacacttcaccataaatttgatacttgttcttgcttcagtttaattggggctcttttcaaactgatgtcttaaccttgttagtgccttaaactagatcctattcagacatgttataacaagttagtatgagtttgtttcagtgcaaaacattttgaacttcatgcatagttttttttataatacacattttccatgaacattttgaagacccctcatattttgcaaattaagtaaaatggtaacggatagtaatttaggcctcttgtcccttgaaaatttgtagacctatgaagattaaaatttaaaaattctattttcatttctgtgagtaatccattataaaaagtgatcatgtttctcagatgttaccttggatagtggttggataagcgggtcaaaaattccacacagatttttgaggaaagtagaaggacttggctttggtggtgtttaatctgtgtttcttgtggaagtatctgtgagggaatacaatattggagtttgaaattcaggagattggaagttgttgctatgtaagggatactcaaagtcattagtatgtcaccttgagagagttatgcaaagggaaggagttacaattagattcctgggaagcacaaacatttaaaatgttagcaggcaaaggaaaaggagcaagtgaaggaaactgggatgtgcccagggaaccagggtgagagccagatagctgtggtgtctaggtgccttgggaaaatagtcttcaaggagaaggtcaacagtgtttggtgctacgtagaggtagagtaagatgaagactgtacttggcacttaggtcactggtgatcttgatgagaagtgctcaagggagtctaggataatgaaaatatcatcatattagttacttttttccaaatgtttactgtgactcaggatgggtagtcatgatgaagaagcatgtgtgcagtcacacacatttatctgaaacaaatttctcaaagtagtacatatacatacagcctactccaatatattaccgtctattctgtttcatttttaaaaaatatgctgaatacattaaattgattacatggtagctaatgcatctaaacctgcaaattgaaaaaccatgttatgtgtgagtattgaggttggctaggatgatgtttaagaattaaagtggggataaattgtactagtaagcaaaatctttgatgaatgagagggaatgactgatctggacgcaagtggatgacagcaacaaggagggggaggatacaaaagaaacagtatttacaggagagtaaggaagtagtatttgtgaaaggactaaagggaattacggggatgttctcttgtcttctttctgtccaatagtcctagcaagcatcttgctgaggcttaacctgggatcaaagaccatgaacccccagaaaccaggcagaattctgtgtacatttttctgggagcaggcccatgagtaggactggcaggtgagtcagtgtcctagggggagagttaaggcagaagtggactagtccctcaacttctgaaaaaaattatttggtcataccaaactcttgtcatgatttgttggcagaatttgtcttgtttttgcctactcaaattttcaaactaatttctcctattttaaaatgaaaatccatatttgctcttattttagcaaggaactagcttcatctgagcagaataaaaatcatataaataatgaactaaaaagaaaggaagagcagttgtccagttacgaagacaagctgtttgatgtttgtggtagccaggattttgaaagtgatttagacaggcttaaagaggaaattgaaaaatcatcaaaacagcgaggtaagttgtctactttatattatcaggatactttgacacctttgaattttcattcacaggtaactgttaaggatggggaatttaaaaacctggttatggagcctaatggcttggatttcagtcctggctctacaacttactcactgtgtgactttaggcaagttactgaaaccttcctgtgtttcattgtctataaaatgaggacacaactaccacctgtggtactgaggtgtgaatgagattgtaattataaagcccttagaacagtgcctggcacatagaaagctctcagtaggcattttgttatacttataatgtgttaccaaaaaatatttatacaaatctgaatgtatcatgctctttggaagcgaatatcggaattttaaatatcagaatttttatttcttttataatatatttataaagcaagaataatcatatatttatagaaaaagatacaaccgtattcagaatactgtattttatgtttttttctcattggtgatataatttattttcttaaaatagccatgctggctggagccacagcagtttactcccagttcattactcagctaacagacgaaaaccagtcatgttgccccgtttgtcagagagtttttcagacagaggctgagttacaagaagtcatcagtgatttgcagtctaaactgcgacttgctccagataaactcaagtcaacagaatcagagctaaaaaaaaaggaaaagcggcgtgatgaaatgctgggacttgtgcccatgaggtaagaatgggatttaccttcactgtacatgtagcagcacattgtaaaaggtacccatctcatgcctgggcagatggtagttactcagtaaggactctgagctggtatgccctgtcttatatcacttctatgataagaagattcaattattttgtttaaagataagcttgtttcctgtctttttttctttttcttttttttttctgagacagagtctctctctgtcacctaagctggagtgcagtggcatgatcttggctcattgcaacctccacctcccagaagcgattcccatgcctcagcctcttcagtagctgggattacaggcatgtaccaccacgcccagctaatttttgtaatttttagtagagatggagtttcaccatgttggccaggctaatctcgagctcctggcctcaaagtgattggcccacctcggcctcccaaagtgctgggatcacaggtgtgagcaccgtgcatagccagtaagcttatttcttaaactatgaggtagacacagtctttacgttcttttgtatgtgtgtttaattcccaagacttagcttgtgggcatagattttcacagatttaggactgtctgttgacatgccactttctgaacccagcaaaagaatttaagtattgaaaagttctcccagaagacagattttaaactatgtttttaatgtcttttccacttgctaaaagaatgaatcatagatgattttcggttgtttatattttccatcacttatacaagaaattcgtgttatgttctgtttacaaacaaaaatcaagtcaggaaatatgtgatgattgccttagtgtctcccagaacatagagaacaaggctagtgccagagacctaagacatgaccctccaggagctaatggtctgattaagaagacaagctctcagaattcaacatttagaaagctaggcttaataaagtgcttaaaaaatgattcaaacagatgtgttaggtaagaagggaggagccaatggatacagaatgagaagaatattttgagaatgaggcaggaagaggaatataagacctggagaagttcattcagctcaactgagaggagacggaagtcagaacacggtgcaaagggaagaggagtatgacctatgctgcagtagaaatgttatctggagtttggggaattatttatagggattgagtcctgtatgttggggagatagggctacattatattcaggtctagttgtaactctgataggtgatgaggagccaacctaagggagttagtgaaagatgtattttaggaaaattaatctaatattaatatattgactgaaacaggctgagaaaagctcaggaagcagaaaaaccaggagagtgaaagtgattgtcctggaaaaccaaggaggagtttcaggaaaaggagaaagaaaggcctaagaagatgtggtttgtggcagccaacttctaagatggtccctagtaatctcggcctcttggtatttatactcttgtatagtcccatctcatgctgttgcatgattggtctatataactgataaaacaggcagaagtgatagcatggcctttccaacattaggttatttaaggtactatggcttcttctgttctcgcaatgtgcttgtacccttgtgtgaactcgctcactctcccccactcctcccctctctcactcactctgtctccctctgtctcttgtctgagggaagctagctgccatgttgcaagcagccctctggagaggcccatatgccaaggacctgaggcctttgagcaagtgagtttggaagcagactttgtagcagtcaagccttaagatgactgcagtcctggctgacagcttgattgcgacttcatgcgagaccctgagtcagaagcgtatctcttgatcctcatatctctgagaaataataagtgctgttattttaagctgctaagttttgggatactttgttatgcaacaatagataaccaacacaagcatcaagggtgaaaaccagattattggggccacagagatgaggagacagaggcagtagtttgagaataaaaaggaaggagaggaataaggtagtatcttgaaaagaaaaagatcaaatggataaaatttgaaattggtagaaagtacacgtagtagaaatatgagcttagttctgtgttagactgttatacaataaatggcagaaattaacatcgtattatattttaggaccctagctatcacggctccttttttttttttttgagacagagttttgctttgtcgcccaggctggagtacagtggcgcagtcttggctcactgcaatctccacctccccggttcaagcaattcccctgcctcagcctcccaagtagctgggattacaggcgcacgtcaccaggctcggctaattttttttgtatttttagtagagagagggtttcaccatgttggccagactggtttcaaactcctcacctcaggcaatcgcctgcctcagcctcccaaagtgctgggattacaggcgtgagccaccgtgctgggccacagtttcccctctaagagtaaggtgcatgtcttactcgttgtatctccacagttccttgtatattgcaactttgataactatttgctaaatgaatgagaactgtaatgtctgttccaattatttattgctatgtaacaaacctcaaatctgtctcacaataatttttcatggttctgtggtatgactgggctcagctaggtggctttcacttggggtcttacggttgcagtcagatgttggctgcagtcgtctcaaagcataaccgagctggatgttcttgatggctcacatgactgacagtgatgctcactattgtctgggagctcagctggggctgtcaaaataggacatcttcacatggcctctgcatgcgtcttgggcttttggcagcacagtgactgggttactaaacagagtatcctaagggtaagtattccatgaacaggaagtagaagctgcaagtcctttaaggcctagaccaagaaactggcatggtgacacttctttttctgttggttagagtggtcacagaaactcccaagattcagtgagggaggatactgtatctcttgatgggaagagtgtcgaagtacttgtggctgacttgaatctgcctaaccctatatctgcagtagcatctgtgtgccattctggttacctagagactaggcaaccacacatttgtatattctatattgtaactttgataactatttgctgaatgaatgagaactgtagtgtctattcccgttattgattgcttgtaacaaaccccctcaaaactgtctcgcagtgattagtttttcatggtttcatgggatgactgggctcagctaggttagccaggtaaatggctggttaccacacattttaagagaacctgaagctagaaaaggcctacaggaagcactgaaaatggaccaagatgctggcagggctgctaagtgaggacacatgtgtgaggaaaccatttttataaagaaaccaaaacttgaagacccgaagagcagggaaatgatgaacccctgtttgtttagcaagctctaacagaatgtcagtgggccattctggaaaactggagaaggatgagtttgggacaaatgagagaggaagtcttcttcccaatagtaggaaataacattataaaacactttttttaagtttaaataaatccacaaatgaaaggtcaataatgaattaagaggacttgattgattgatagatagggtcttgctcctgtcacccaggctggagtgtagtggtgtgattgattatagctcatcgaagcctcgaactcctaagctcaagcaatcctcctacctcagcctcccaaagtgctaggattacaggcataagccaccatgcccaaccaagaggactttttttttttttaaatatgggaaagcaattgcctaagagtgcagtcaggttgacttcaaattccaactctgctgggtgaccttagggatgttacttaacccatttgggccttcgtatcccccacgtaaagtgaggggattgatttacatgatcattaagcttccttccacctctggttaggatactactttcaaatatcccgtggggtcactttcagagacattgtggaggtctatttatgatagtcacttaggtggaaggttattggtgaagaggggtaaagtaacaagattaaatttatctgtgcaccatttgctttttcacctttagaatatgcccttgatgccaccactatcatgagaactgtctattcatgcaaccaatataggcagtctactggagtgcaggtaatacagcagtaaacaaaatggacaaagtccctgccctcatggagtttatatcccagtggggaggagatggatgacaaataagtaaatatataatatgccaggggatgatcaggggcattgagaaaactacagcaagataagggaatagggactagctgaagggtggtaggaggggacttgatgaaggtggcagtggagtggaaacttgagagaagtgagggagtcagccatgcagttgtccataagaagaatattctaggcagtgcaaaatctctgagacatatttgacctgaaggccaaagggaaaagttgtggaagatgagctcagagaggtagtggggagccatatcttgcttatcttctttgcgggaaatattttcatttaaagcctcaaattcgccagtatctaatataaacctaacatcatgactgagatctcagctgaaaatgtacctgtttatcattttgtctagtactgactcagattcatttattatagcacctcatttaaatgcaaactcaattggtatttctcccacaggtttttttcagtaccatatctgtgtgagcctttttacacacaatccccttagaaaaggaatgttgtctaaaaataggtgaattgagtttctgaaaaaacagaaatccaaagagtaaatttcaaatgtctgtctataaaaaatgataggcaggcaaggtaatggatatgttaaattacctttatttaatcattgtgcattgtgtacatatatcagaacatcacattgtaccccataaatgtttgcaattatgatttatctattgaaaataattttaaaaaaccttgtgaatcgtgagaaaaattaactcttgaaaataaaaaataaaatgtcataaatttaaaaaaaagaaaaacaaacccagagagtgcagtggcacaatctcagctcactgcaacctccacctcccgggtttaagcagttctcttgcctcagcttcccaagtagctgggattacaggcgcccttcaccacgcccaactgattttttgtatttttagtagagatggggtttcaccatgttggccaggctggtcttgaactcctgacctcaggtgattcaccagcctcagcctcccaaagtgctcatattacaggcgtgagccgtcacacccggccagaaaacttcttttaacatcttatgtaatcatcaaaaaagaaggcaccaaaacctagaccatattgatgaaagattttgtgtgtgtgtaggaaaatgtaaaaatagggttaaaattgtatgtatacctacagttcttcacagagatgtccccagtttaataaatgcttggccatcattattaggctgtcatagctgtgtcactttttagatattgggcacataatttaaggccaactactaatctgtgacaacagtgttcaagaggaaacattggcatggaattactcataacctgcataccttcatatttattatgtggaatacaaatacctcctatttctgtggtataaaaaaaaactgtaggtctgacatgcacacatatgtttattgcggcactgttcacgatagcaaagacttggaaccaacccaaatgaccatcaatgatagactagataaagaaaatgtggcacatatacaccatggagtaactatgcagccatataaaaggatgagttcatgtcccttgcagggacatggatgaagctggaaaccatcattctcagcaaactaacacaggagcagaaaaccaaacattgcatgttctcactcataaatgggagttgaacaatgagagcacatggacacagggaggggaacatcacacacactggggcctgtctgctggtggggggctaggggagggatagcattaggagaaatacctaatgtagatgatgggttcatgggtgcagcaaaccaccatggcacgtgtatacctatgtaacaaacccacacgttctgcacgtgtatcccagaacttaaagcataaaaataaataaataattaaaaaattttaaaaaactataggtctgttgccacaggtcaggttggcatttcttggtcatagtttgcatttttaaaaaatcattaagtaatagccacttgagtttctggttattctttaagtttataataagactcctattagagaccagtttaatttattctactgctttgtcatactaattcaatataattttaaataagaatttggaatatttctgaagtaaattttttttaaaagattaaatacatattattgtttcagaggcatcagcaaaaatagttgtcagtacctgccatggaggtggtaattcattagctacagtagtgagtaccagtaaaatgggttgacattttgtaccttaaacccatgtagcatttcacttagtggctggcttccttcctttttttcctgtaatttaaaaaatttttattttgaaataatgttaggattacagaaaaattataaaaataatacaaattattcatatatatccctcatccagctcctcctgatgttaacaatttatgtactctgttataatacagttatcaaaaccaggattaacattgatataatgctactaactaaattacagaccatatcgaatttagcagtttttccatcaatgccttttctgtttcagggttccatgcaggatcccacgtagcatctagttgttatttctccttaggctcctgcagtctgtaacaatctgtctttatctttcatgaccttaacacttttggtcaatatgaccagttcattagtagaatatttctcagtttgacaaacaccacagtaataattattgcaagcaagatctgtcagtggatactaaaatcagtaggcagaaagttgagaagcaagatatttacatagtctcaacatttctctcctaagatacttgttaattacaaagactaaaacagtaactttacagtggagaaacctggccaacaccatctaagccaagtgaataaggattaacatcatcagtaataagacatattgatatcatgattccatatccactgatatgataccctgaaaagaacacaatgtcacttctgtggtattcttcctaaaaatacataacctcagtctaactgtgagaaacatcagatactttatttttaattgtgttttctatttaggcaaagcataattgatttgaaggagaaggaaataccagaattaagaaacaaactgcagaatgtcaatagagacatacagcgcctaaagaacgacatagaagaacaagaaacactcttgggtacaataatgcctgaagaagaaagtgccaaagtatgcctgacagatgttacaattatggagaggttccaggtaagtttattgtagtttaaggcagaataaaacttgttccatggtggcttgaatttgaagtgtgagagttaaaaatagtagctagtattcaggtacaggttgtgtttagaattccccatcctgaatttcagataccctcagggagaaactgcttagtttacatccctgggtttaaactttttaattcataaatttaaaaattaagacagttctgtttgtttttcatctttagtcagcttccttttgtttacatcatttgaattgctgataattaatttcacttttatcctattaaactttgctaaaattgtatctagaaatggtttataagtttagatttaaaaaataaatgataagagcaattaatttttaaagattttgaataatgcagtaagtttattaaaggaaatcattttgttatattcttaagatggaacttaaagatgttgaaagaaaaattgcacaacaagcagctaagctacaaggaatagacttagatcgaactgtccaacaagtcaaccaggagaaacaagagaaacagcacaagttagacacaggtaatacagtctgtgtccttctgtactcatagagactttgacattgcgagcacatgccttttacagtcaattttatatctgttacatggacaacgaagttccttcctgtccacatatatttgctctttttttctgaaaagcatcacttctctttgttctcttactttgcacaacagattttgaacagtaggagagtatgaaataagctgtattctcttttccttttttttttttttaagatagagtttcacttttgtcgcccaggctggagtgcaatggtgcaatcttggctcactgcaacctccgcctcccgggttcaagtgattctcctgcctcaccctcctgagtagctggggttacaggcacacatcactatgcccagctaatttttgtattttttcgtagagatggggtttcactgtgtttgtcaggctgatctcgaactcctgacctcaggtgatccacctgcctcagtctcccaaagtgctgggattacaagtgtgagccagtgcgcctggccatgagctgtattctttctcattcatacctgccctgtaagctttccctgtgagtggccagcagggaacatcaagctgatttgagaactagcagggttctcattgtatttttgttgcagtgggtggggcccacagaaatagcatttgtggattccatagaccgataaaaatgggaagaatgatacaaatagtattttctatgcccttacattaattactgtgataatatgtttttgtgtagtttctagtaagattgaattgaatcgtaagcttatacaggaccagcaggaacagattcaacatctaaaaagtacaacaaatgagctaaaatctgagaaacttcagatatccactaatttgcaacgtcgtcagcaactggaggagcagactgtggaattatccactgaagttcagtctttgtacagagagataaaggtaagaatatccatacatgttttttgtaaaattattttaattatttatttttatttttattttttgagacagtctcgttctgtcacccaggctggagtgcagtagcacgatctcggctcactgcaacctccatctcctgggttcaagtgattctcttgcctcagcctctggagtagctgggattacaggcgtgcaccaccatgcctggctaatttttgttcttttagtagagacgggttttcgccattggacaagctggtttcaaactcctgaactaaggtgatccgcctaccttggcctcccaaagtgctgggattacaggcgtgagccagcatgccccgccccattcttctcttttagagacagagtcttcatcagtcttccaagctggaatgcagtggtacagtcacagctcactcactgcagcctcgacctcctgagctcaagcaatcctcctgcctcagcctctcaagtagatgggactacaggcacacaccaccacgcctggctaatttttaaaatttttctagagacagggtctcactatgttgttcaggctggtctcaaactcatggcctcaagcaatgcagccttggcctcccaaaattacaggcttacatcacctcacccagcccatgtttctttaatatgaaatgctctttattagtgtaatggccagaactctcagcacctcatcgcacttattctaaaattgaccacataattggaagtaaaacactctcagcaaatgcaaaagaacagaaatcataacaaacagtctctcagaccacagtgcaatcaaattagaactcaggattaagaaactcactcaaaaccgcacaactacaaggaaactgaacaacctgctcccgaatgactaccggttaaataacgaaatgaaggcagaaataaagatgttctttgaaaccagtgagaacaaagatacaatgtaccagaatctctgagacacatttaaagcactgtgtagagggaaatttatagcactaaatgcccacaagagaaagcaggaaataactgaattcaacaccttaacatcaaaattaaaagaactagagaaacaagagcaaacaaattcaaaagccagcagaagacaagaaataactaagattagagcagaactgaaggagatacacgaaaaacccttcaaaaaaatcaatgaatccaggaactggttttttaaaaagatcaacaaaatagaccactagcaagactaatacagaagaaaagagagaagaatcaaatagatgcaataaaaaatgataaaggggatatcaccacccatcccacagaaatacaaactaccatcagagaatactataaacacctctacgcaaataaactagaaaataataaatggataaattcgtggatacatacaccctcccaagtctaatccaggaagaagtcaaatccccaaatggaccaacaacaagttctgaaattgaggcagtaattaatagcctgccaaccaaaagaagtccaggaccagacagattcacagccgaattctaccagaggtacaaagaggagctggtaccattccttctgaaactattcctaacaatagaaaaagagggaatcctccctaactcattttataaggccagcatcatcctgataccaaaacctagcagagacacaacaaaaaaagaaaatttcaggccaatatccctgatgaacatcgatgcaaaaatcctcaataaaatactggcaaaccgaatccagcagcacgtcaaaaagcttatccaccacgatcaagtcggctttattcctgggatgcaaggctggttcaacatatgcaaatcaataaatgtaatccatcacatgaacagaaccaaagacaaaaaccacatgattatcccaatagatggagaaaaggccttcgataaaattcaacaccgcttcatgctaaaagctctcaataaactaggtatcgatggaatgtatttcaaaataatacgagctatttatgacagacccacagccaatatcatactgaatgggcaaaaactggaagcattccctttgaaaaccagctattatgaggatcaaatgaaaatggtataataattatttgtgtggttcctaagtgatagaacttgtactagtaagtaaagatttctggaagaaggagtttgccataataaggaagaactggctgcctggttaagtagtaaatgttattggaggtggtcaggtggtggttggttaattctgtataaggattcctgcttgtacaggaggtttgtcttatctgcagatcctttatctatggcggtcactctcagtcatagcactctttccatttgattccggatgtggtttcagaacccttaccaatacagtgagcaggcactcagttgccactggaatgcatttgacatcccttatatagattaatcacatctaagactcaaccagttataaacagttataaacaatcttacctaggtttatataattatgcgtactcattcaataagcactaagtatattactgaataattactataaatttttattaaattttagattacaaaatatcagaggttcagaatataatataaaatagtacttgcatctgtataattttttactatttataaagcactttgacattgaaccattcagtgcctcagcaaccctatttagatgatgaaatctctttatagaaaaattgagatttacaaatgtctcatgagtgcctaagtttatgcagctaataggaagcagagttgattttctgatagatcttttgacactgagggcatttgacttcctaacacaccataccacttcccagtatgataaaatagacctatattgaagtaattactaaataattgtatctacctctatagattcactcagtacttcagaatcttaaagtgcttgaggacctctgttttgaactgtggttatcatataactacgttgtagatttagtgttacaaggctaaataatggggacttctatttagtaaaatagtttattacttgaaagccccgttccttccaaaatagttgtggagacaccaacattagtttaacagtatgcttttattaccatgaaatatctgcgtagccttagcaggctaagcttaaggacagaagtgtttttaccatcatgttttcatctgaaaaagaaaagtctggactgaatgagctttcctattctttgatcatgcagcagtgacgggcacctataaaatcatgaaaactcatgcttgaagccacacgctaatataattgggagcacatggcctagattaagaatcaaattagtggttgatgcagtatagcatgcgtagtggttaagagcgtgaactctggagctggactgggttaaaatcttggctgcttcatttactggctgttgtgaccctggacaaatcattctctgtgtctgtttgctcgtttgaaatataggactgaaaatgatggtactgtcctcatagggtcattgaaaggagcaaatgagttgacttttagagcctggcacatagaaagtgcttttattaagactgtgaagtctgacccctaaagtaagataatggaatattatataatactttatcttttttatatttttaggatgctaaagagcaggtaagccctttggaaacaacattggaaaagttccagcaagaaaaagaagaattaatcaacaaaaaaaatacaagcaacaaaatagcacaggataaagtaagatttcatttatatatttacttatcaaatatctgtattaaacttatgttcatagcaccacgtcggacacttatttcacatgaaattaaatagcataagataaatagtattttcagattcatggtataattttgacattagaaattcttgttagaacaaggatttgatgtaaattattttgctgcttgatctacaatagaagttaagaaatgagactaattaatcaattcctataggtgagaaagggacttgtctgcgatcataaaattcagtagtggtggaaactggaacccaatgttcataacttcccagccagtgttttactgtgctctcctgttatgtgcccttaagtacaaccagtgtaaatttaatgaatatttttctacagctgaatgatattaaagagaaggttaaaaatattcatggctatatgaaagacattgagaattatattcaagatgggaaagacgactataagaaggtaatttaaaacttaaaattatttatttgattgtatttttattcatgtgcttaaagaattttcttttttgtagcaaaaagaaactgaacttaataaagtaatagctcaactaagtgaatgcgagaaacacaaagaaaagataaatgaagatatgagactcatgagacaagatattgatacacagaaggtaggtctgttttgcttatgatatcacttacacctatgacattcttttctatagttttattttcaatagaagatccattgaatagaaatgcaaaaaggaaagaggccaagcgtggtggctcacacctgtaatccctgcactttggaaggccgaggcgggtggatcacttgaggccaggagatcaagaccagcctggccaacacagtgaaaccctgtctgtactgaaaatacaaaaattagctggccgtggcggcgcgcacctgtagtcccagctactcgggaagctgaggcatgagaatcacctgaacctgggaggcagaggttgcagtgagctgtgattgtaccactgcactctagcctgggcgacacagcgagactctgtctctaaaaagaaatgcaaaaagtaaagaaaaataattccaataacattcttacttcatttattttttatttttattttcagtaaaagactcatggtaaaagttcgaacataaaggcataaaagtgttcctccccttctcctaattctcaatcttacttctacatgtcattaactgttacacttatttgttcttaaagaagttttttattcatataccagcagataggtagataaatttaggtgtgtgtgtatatatatatatatatatttaaatttacttttatggatggggtcgtatcatgttattctgtaccttttttcacttaacataatttgattttacctatcaactcacagatgtatcacattctttttaatgattataaaatagtccattttgtgtatataccagcacttactcagattgatttcatttccttatcacaaactgtgtgacaatgaacatctttaacatgtatctgtatcttttcttattctaacatatctttatgtagcataaattcacaaaagacggattaaggtttaataatcttgaaagtaatctgtaaggaaaatatttatatattaagtcattttccagttgattcctatatcatttattttctctattaaagaaattaatttctatagtataatcaaaatcatattaagaagccatcatcacatgctttatgcaagcatggtagttaatgcctttaaaaactataccatttctctgttcttactgttttaaacaaaatttactatttgaatgccttaaccacttggttataagtggttgcttaaaatcatttggaagattagttacattagttttctgctgggtctctttctgtaccaccaagaatttcaaatatatgaaatatcagtcaaagggagatcaaatctctgcctggcctaatacatattgaataactgtataaatttatgatgcatatataacaaaataattatcactagcttttatgtagttgcctatataaaaatcacaatctgtaaattcgcagcagctctctgtatatatatacgaaattgttaagattaatgatctatgaccccttttaaagtgatggtctaaacttagtggatctgatggtattagtttactttgtaaccttccttgttccagaaattatttacttagttatatacaatagagcaaagataaatgtatttcaaattaatgggaaaacaaggcagtgtagaaataagggcaagaaagtaatgaaaccaggagagaagtgtataaaaagtatgcatgaagtctgatatgcttgctgaagattctagtagtcaaataaagagaggaggccaggcgcagtgactcatgcctgtaatcccagcactttgggaggccaaggcagacggatcacctgaggtcaggagttcaagactagcctggccaatatggtaaaaccccatctctactgaaaatagaaaaattagccaggtgtggtgacacgcgcctgtaatcccaggtactcaggaggctgaggcaggagaatcgcttgaacctgggaggcagagattgcagtgagccgagatcacaccattgcacttcagcctgggtgacaagagtgaaactccgtctcaaacaaacaaacaaacaaacagaaacaaaaacagccaggcgtggtggctcacgcctgtaatcccagcactttgggaggccaaggcgggcagatcacgaggtcaggagatcgagaccatcctggctaacacgccgaaaccccgtctctactaaaaaatacaaaaaattagccaggcctggtggtgggcgcctgtagtcccagctactcaggaagctgaggcaggagaatggcgtgaacctgggaggcagagcttgcagtgagccgagatcgcaccactgcactccagcctgggtgacagagccagactccgtcttaaaaaaaaaaaaaaaaaaaaaaaagtcacaattagtcaagattcacattgtgtcaatgctaaaagaaaaccagtttcctatactgactacaggataatgtctctattcatagaaaggaagacatgtatagtcttcaacagacttcgcagggctttaaaaaaaatacagtgtatctcagcatcattattccttgatacgaggttctgtagagggtggtatgattgaagcctgaagtaaatgttaatgtttagaaagcaaaggttcttagctaggggcacctgtaaatcgtctgagtttttccacttctaggtatagaactaagaaaattgaaaacatatgttcccacaacaacttgtacaagaatgctcatagcagcattatttgtaatagtcaaaatatggacacacccaaatggccatcaactgatgatcagataaacaaaatgtggtatacccatacaatggaatattattcagccataaaaaggatacatgctaccacatgaatgaacccttaaaacatgctaagcaaaagaagccagtcacaaaaggtcacataatgtacgattccacttataataaatgtacagattaggtaaatccagtgacagcagattaatgtttccagggggctagaggtgaggaaggaatagagtgactgctattgaatatgagatttccttttgggatgatcaaatgctctggaattggatagtggtgatggttgtataaccttgtaaataaagtaaaactgctaaattgtacacgtttaaacagtgaattttgtggaatattaattacatctcagtttttaaaaaatgacttaggttattaaaaatacatgtgttggccgggcacagtggctcatgcctgtaatcctagcactttgggaggccgaggcgggcagattgcttgagcctgggagttccagactatcctgggcaatatggcgaaaccccatctctacaaaaaaattagccaggtgtgatggtgcatacctgtagtcccagctactcaggaggctgaggtgggaggattgcttgagctggggagttcaaggctgcagtgagcccttactacgccactgcactccagcctgggcaacagagcaagaccctgtctcaaaaaatatatatatatatatgtctatgtctccaatccacaccagtaaatcagaatcttgggggtttgggcagagatatgtgtgttttgttgaaattccttagaggttctaatatatccctttagctgtcaataactgagccagcactggatggactgcatagctttcaggcagtcttgtagaagtggtgttattcccagctagacttttggtggacattggactgtaatctgttcagcatgccactctctcacaggtatctagaatgcagctaatttttatgtttccataggtgaccagctgcatgcattaactgtcatctgagttggatgattggggttaatatttaagagctgaggagcctaacagtcacttatttacgtactgatttaagccctgctaaatttagtccacagaataaaataatttggaaacttaactgcctttctcagttttcagctgaaggaatatatgaagagaactgtaggtgacctgacttgtccaaggtcacaaaaagtagtaacaggtagaactggaccctacactatcaaatttctagtagaatggaaaaacatttgtggtatactataactgcatctgattttttttcccttcctttctctgatacattttgtagactataattggaattctcactgcttacagtacaaaggacaaatttgacccaaaaggcattttattagcaattattgagtcaggcactatactgattacatacactcattcctttaatcttcacaatagtctttttttttttttttttttttttaaattagatggagtcttgctctctcacccaggctggagtgcagtggcacaatctcggctcactgcaacattcgcctcccgggttcaagtgattctcctgcctcaacctgcctggggctacaggcgagtgccaccaggcctggctaatttttgtatttttagtagaggtggggtttcactatgttggccaggatgatctcgaactcctgacctcaagtaatccatctgccttggcctcccaaagtgctgggattacaggtatgagccaccacgcccggccacacaatagttctttatgatagatagtatcattattgaccatgttataagcaaactgaggttcagagaatttaaactaatttgcccaaagttatccagtttaaaagtaataacactgtgatttgagcctagatgtatctgacttcaaagcattacactcttgatgtggtatatactgtctttcaaaactagaagaataatggaagctgacctaaaacaaagaaatgcctagctgtctggtaacaatgcaggtagacagaccagcaacaatattttgtgccaaaaatcagtctcatctaaaaatgtgatagcactttaaagagtcctttcatgcaattgtgaaaacaaattcaaatgttctggggtattagatgaaagtaagcagtagcacattcccttgttcctaataaggaacaacaagcatagtaccccatagtagaaccttggtaagtcacaccagctacagtggtacattagattgctttagcaacaaaggacatttataaccatgtcattttagtcacctttaactgcctataataatgcctttagtagatacatattcagttgtctcggtatctctgggagggattggttccaggatcccccgataaaacagataccgaaatctaggatgctcaagtcccttatataaaatggcatatctagtgtttacatatagcctatccatatcctctgatatactttaatctctagattgcttttgatattaatatgtaaatgatacgtagtttttatattgtattattttaaatttgtatttttttattgtactattactttttattttttttccccaatatttttgatccatggttagttgaatccgtagatgtggaccctgtggataaattgtatgtttatattatttccaggaaaaatgaaagtagccttactttgtgactgttaaaaaagaaaaaaaaaactctaaaaatagtcacgcatagaggggcaggattggatatgaacattaagcatgtgagagaaatccttgatttccctctctcatctaccagtccctggcctttactgttggtgcaagatattgccacaggtctgtccatctctctcacttcccatgtcactgagtttagcttagctgcaagggctattgcaggagggtcccagctccctctttgagaaatccttactccaaattcagaataagttttctatacacatgatttgtgggccaaatcacccttctttctgcaggaaattttttttcctctaaattccaaagaatcaacttaaaaactgttttctaatgattgtctcttgacaacatagttcattttaatcaccaggaaaaccactgaaataattttgttgttgttgctgctgctgctaagtgttattgagtctcttttgaaggacaaaactactcaacaagaacagccaattttttgaaatttcatttcggtggctaaggaggtaccaagttcatagatatatgctactattgtggcacttcttactgccttgagtgattacaatttgtcaacctaaaggtagaagttgcaggtaacatatacctaacaggttctaatggtcttggtacatgttgggagacagaactaggacgaaaaagttggggaagacttcagtagtagtattgatctcttataatctttcaggtcagtaggctttatcatggggttcctatgcaaaatgatccactggggatgtaggtattaaaatatctagttatatttttaatttcaccatttaaaatgtctgttttgtatgtttttaatactttataagtaaataagtacacagatatatgctcaaatctttatgagactccccatcaaacagtagacctggtttttagattatggttgtgaaagagcagtaaaagctgcgctacaggaggtattacacttgtcactgtggatggggatgggccatccagattgccccagacctgtagattccttcacactggcttattctccctctgttgaatttcacatgattctaagtaagacagaaatggcacttgctgtcaccagttgcctgttacagatttcatgttagtaacttggttatttttgttaactaatttaatgtttacctttagatacaagaaaggtggctacaagataaccttactttaagaaaaagaaatgaggaactaaaagaagttgaagaagaaagaaaacaacatttgaaggaaatgggtcaaatgcaggttttgcaaatgaaaaggtatgcttttaaaataatcttcagtttaaataaacgtctttattactggaatgtgaagaatattaaatacctgttttaaaagaattttagcctcagcctggtatcctttgagagttactagaaggtgaacagtgttttgatacaattatatttcatggccttaagaactttattactgaagaagtgatatagaattggtaatcacactgtagtgatgggccttagttattcagtattgaacatgcttagcccccatacatctgctagcctgctgcacagaatagtggtactaagcataaagaatatggagctgtggaccttgtctgggtcagagcttgtacagtctataatattgtcaatggagttgttgccagagtgatttatccacagagattcattttagattttctcatttgtaattatgtgtccaccagagcatttcttttgaaagatgagcctcattcttcctttatctggtcttattgttacttattgtagttgctaccttcctggtacagcagaaaagattttattcctgccttgactgccttagagttagttgccttaggaattctgtaagaaccttgttgatgctaaggcactagactggtataaaaggttgtactaggcaaatacttagattgtcaaccacctcagctggttaaatccaggcctctcatttattaaacccttccttgtagagttttcatgtcttcttgaatttatacagaaatctgaatgaaaaaatgcccaggcttttctaaaggatatagtaaagtgaattttaatttataaagcctaacaaatggttaatcctgtgttttggttaagtactcttagctatttaaaatctctttcctatatcagggaaatcagatttttaactagaagagctcatcatcttcagagtcttcatttttgtatgcattatgcacacttagacccagaaaaatcacagaggaaattatgatgaaagccaagaatgtgaccctaatatcctagttcccaagcctcagttcttttacacgatactctccatggcaagttggaaaagtaatgcttctagaagaaattttgatataaaataatatattcgtggctactaaagaccaaaaccagatatttaaaaaatttcttctgtaattggtacataacagtactttttacattcattcacattactaagtacaactatttttcaaacgtttcttcaaccaggacataacagaaatgccaacaagacttgtaatccagtcgactctgtaaggatgcccataagcttgagagtagtgcctgacacataagaggatgcttaataagtgataataaataaatgaagatttttaaagcatacattgaaatttgtataatctgccaaaatatcagaaaagtttgaatattttacttttttggtcattattatggtttttacacttgtgcaagagaaattttgttttcatggaggaatctaaatttttaataagtattactgcagaaaattaatatatgatttaattcgtattgtgcctttgacatgagcaaaatgatgatgaagcctgttatccataacttcttagtgttgataattgtgcattctcagttcacaatcagaagattgtgaatttgtaatattaatcaccagagtgctttacttagcgtctaaaggccaggaactttatcagtgatcacatgctatgagggttctgtaatacacaaaattagctatttagcaacctatgtgcggcagagatatggaaggaagagaggggttttctttagtaccaaagccctaaataataagcaaggagagactctgttataatatactgattgctaaggagaatgatacttaacctatctaaagaaatctatgacttttccacttcaggttgttaaaagctaaaaaatggtcctcatttgtcatttttcttttttacagtgaacatcagaagttggaagagaacatagacaatataaaaagaaatcataatttggcattagggcgacagaaaggttatgaagaagaaattattcattttaagaaagaacttcgagaaccacaatttcgggatgctgaggaaaagtatagagaaatgatgattgttatgaggacaacagaacttgtgaacaaggatctggatatttattataagactcttgaccagtaagtattagactggggattttcttattgcagttaatattaactaacatactttagtcatcttttctctcatttttttctttttttcttttttattttttgagacagagtttcactcttgtttcccaggctggagtgcaatggcacgatctcagctcactgcaacctctgcctcccgggttcaaatgattctcctgcctcatcctcccaagtagctggtattacaggtgcatgccaccacgctgggctaatcttgtatttttagtagagacggggtttctccatgtaggtcaggctggtctcgaactcctgacctgaggtgatccacccgcctcggcctcccaaagtgctgggattacaggcatgagccactgcgcccagcccctcattttttctctttaaatatggtattttatgtataccatggattggaaaatatatgtatgtatgtatgtaaacacacactagcttaagttatgaagttaagatataaagcatattaatatctacgagtattcatgatactacctccctctaaccaatctaccattatcactgattggcatccacttagatgctcccttcttatctcaaccttctgtcatccccattccctataaccagtgacaaagatttttactttctctgcttttttaaaaaacagttttatcatatatatgtcatattttgagctttttaaaaatgatatgatattctaggacttgcttttttatttggatttgcttttgtttatccatgttgtttatggccgtagttgattcattttcactgatgtacataatctactatgggaatagaccacaatgcattcattctcctacagatggacatttggggtttttttccaggtcttgtcatgtcttctggaggaaaggtataaggttatatttgtgggagtgcattgtggagtatgctcaattttacaaaataatattgttttccagaaatgactactgatttataccactagcagtatataagggtttatttgatggatcctctgacattggttttataaatttcttaatgtttgccaacctcataggtttaaaatgatgaatcgttgtttatacattattagtcttgtctttttgtgtgttttgggacagagtctctctttgtcacctaggctagagtgcaatggtgcaatcatagttcagtgtaacctcaaactcctgggctcaggcattcctcccacttcggcctcccaaagtgctggggtcacaggtgtgaggcattgttcctggccctattggtcttttcttattgatttaaatgtgttctttatctcttctgcatttcaattccttttcagttatatgtattacaaatgtcttttcaaacattatgcttatcttttttacttagcatcttttgatgacactggatttgattttgagttagttgaatttagcagccttttctggttagctctttgtgtgtcttgttaagaaatccttccctactcctctctctctctctctctctctctctctactcctctctctctctctctctctctatatatatatatataaagatatatatatataaagatatatatatatatagagagagagagagagagatatatcttttttttttttgagacggagtctcactcagtcgcccaggctggagtgcagtggcgccatctcggctcactgcaagctctgcctcccaggttcacgccattctcctgcctcagcctcctgagtagctgggactacaggcgcccgccactacgcccggctaattttattgcatttttagtagagatggggtttcaccgtgttagccaggatggtctcgatttcctgacctcgtgatccacctgtattggcctcccaaagtgctgggattacaggcgtgagctgccacgccctacttctatatttttgtctaaaagttttaaattttgcctttcacatgtaagtacatttaagtatttaattctaagttgaattttttccgttatgaataactggttgtcttggctctatttattgtagactatccttctctcagtgacctacagtgtcatttctgtcatatatcagaattccctatgtgcctgggttggcctgggttctctgttctacttaattcatcactttgtctatctctgtgccatttctctcaccatcttaattacatatagcagaattttctttatccagtgtatgtctgtcttttaaccagtgaatttaggcctttcatattcattctgattactcaattgagttggatttatttctgccatctttttttcctttcctgcctttttgagatggatttatttttcttgactcctcctttttcccttctttgggttatccagttgaccatataacatggggattagggacactaagccccccacgcagtcagaaatccacatataacttttgattccctcagaacttaactactaatagcctactgttgactggaagccttactgataacagaaacagttgattaacatatattttgtatgttatgtgtattatatgcagtattctttcacaataaagtaaactggagacaagaaaaaattataagggaaaatatattttctgttaagtggaaatgaatcatcataaaggtcttcatccttgtcctcttcacattgaagaggaggaggaagaagaggaggggtcagtcttgctgtctcggatggcagaggtggaagaaaatctacataaacatagacccacatggttcaaacctgtgttcaaggatcggttgtattctactttagttatttgagtgtttactttttaatttttaaatacttatttgacttaaaatcatatgcattagttctcaaagtggtcgtggagcaccattatcagtatcaccttggaacatgttagaaatgcctctcagcttctaccccagacctcgatcaaaaatttgagaggtagggcccagcagtctatttttgacagacattttgggtgattctgatgcacatcaaagtttaaaaaccatagctttaatgtgaattgttttatctttttcctgaatactaattatcttctctcatctgcattatttcttttgtctaatattttagttttaccttgtttttaaatcatcacaaatgagtaataattattgtggtggtttcataagcccgcatgtttcccaatttctttgttcattcttgctttttaaatcccactcctcccttctttaggttcagttttctttttttggagtatattcttcaatagttttttcagtgaatgactgttagtggtaaacaatcagtctttgagaagtttttccccttaatttgatagtttagctgagcatagagttctagattgacagttttgttctcttggcactttgaaaatatttcattttttgttggcctctatggttacagttgagaaatcattttaattattcctttaaaagtaatctgcctttttcccctggttctcttaggatttttccctttgtcttcagtgttctgtatttttataatagtgtgtctagactcagctttagttcttctgctcataaattatgctttttgatctgaggattgatatcttccatcaattttggggatttttcatacattatctcttcaaatattattctttctccatttctcactattttccccttcttcactttttattagacataacctcctctttcctctacattgcttaacccctcttgcatatactgggctctgggtaaatatcttgttaaataaattatttagctgctacttatactgcctattgagttgtcattttttcctccatttttttctataagttctattttgttctttttcagaaactcacatggtttttttataattttttttttttaaaacagagtctggctctgtcgcccaggctagagtgcagtggcatgatctcggctcactgcagcctccacctcctgagttcaagcagttctcattcctcagcctcccagatagctggaattacagatgcatgccaccactcggctaatttttgtatttttattacagatggggttttgtcatgttgccccggctggtcttgaactcctggcctcaagcgatcctcctgcctaggtctcccaaaatgctaggattacagatgcgagccactgcgccaggcctatgatgtattttcttcctttgtattttgattccttcttgaatgtgtctttactcattttatacacattttatacctaggcctcccaaagtgctaggattacagatgtgagccactgtgccaggcttatgatgtattttcttccttagtattttgattccttcttgaatgtgtctttactcattttaactatacacattttatattctctttcagattgttattttttaatttcacattttgaggagtctgcttctgctgttttgtatgttgattctatcccctagtgaagtttctgtgttttattaacatttaattgtgtgcttatctttagtagtgttgttttttctatgagactcccttgtgacctttccttgtagaggtccatctacacagaaattttggttttatattaactaagagctccagagaaaacattggcctgcatgtagggtttttgttaatttcttagttggtaggttcctagactatactcactggtagcataactttgaaccccaaaactatataaagcatttgcccaagactttgaattttcaactcattaattttccactctttcattgaggattgatgttatagctcttgaagagtcccattttttgtgtgttgggagtcacttctaatcttcttccttacttgggtcctatccttcatcttctgtcctggatgataagaaccaatccctaggttataaaaacaataacgccaagttcatggctgggcacggtggctcatgcctgtaagcccagcactttgggagaccgaggtgggcggatcacttgaggtgaggagttcaagaccagcctggccaacatggtgaaaccccgtctgtactaaaaaaaatacaaaaattagctggctgtagtggtgcacacctgtaatgccagctactcaggaggctgaggcaggagaatcgcttgaactgggaagtagaggttgcagtgagccaagattgcaccactgcactccagcctgggcaacagaacgagactctgtctcaaaactaacaataacagtaataataataaccccaagtttagtttgtctgtcaggttacatactgactggtctggttttcacttctatcttcgtttctattatgtagggatttccctttctttcttgtgagctcaactatgaatttaaaataagttttgttataagtctatctagtagttctgttcatttgtggcaggagaattattacttaccttagattttggtggtggttgttttttccagaatggcaaatatcttccttagcactaagagagttacacagagagcttctcttctaagacttctggtcagatacagcatagtcaacagaccaacctgagcagtggcattcagaccacagggctcaggaagacaggagaactctggtttcagtatgaggacttttttagttagtgatgataacaaaggtggtcccagaattgcctaggcatatttttggcatatacaagttttaggaagtacgtaatcatgtaagacaaattagatccatttactgtgaaatattgggagtgagccaattaacatgttattttttaaaaataaattatactaagatttttgttagattaagtttaacttttaaaacaattttttgagagtattccatggatatatcttttgtcccatttcattgtgagtgggtacgttaacattacaatgttccctgggtccaaaatggctcatagaattatatgcctgcaccaaatgagaacttttgttttttaacttctttgaatattgccatctctcctagatattagatccagcagtttaaagtggttagtcttggaatttaaggtgctgaaacaagaacataagcaaaacttaaggaattcttgcccagtagactacacatacatatatttgttttttgttttttggttttttttgcctttaataattctttttagtcttctcagctacctcatttatgcctttaggggactttttagtttttcttagttctttaacaacagatgctgtgtatctaatagacttatcaaacattcattgagcattaaggaataggagatccagtaacttctagcaaggatattatagtttatttgaagagacacaaatcaaaacagatttttgttggtaaaaacctattttgccaggcttagtggcttacgcctgtaatcctagcactttgggagtccaaagtgggtggattgcttaagtccaggagtttgagaccaacctgggcaacatggcgaaaccccatcactacaaaaaaatacaaaaattatctgggcgtggtagcacacacctgtaatcccagctactcagaagcccgtggcgggttgcaatgagccaagattgtgccagtgcactccagcgtgggtgacagaaagagaccctgtctcaaaaaaaaaaaaaaaaaaaaaatcaccaaaacttctatttggaataagataagttggttgtgatggaaaaataaaaatggatattaaaagcaagacattggactttgtataaaagtccaacatgataagttttaccttttttaaaaagcctcagaagtccataatacatggttaaaagtgctgtctctgaacactacagatgtccagattttgaattctttttttttttttttgagacggagtctcgctctgtcgcccaggctggagtgcagtggcgggatctcggctcactgcaagctccgcctcccgggttcacgccattctcctgcctcagcctcccaagtagctgggactacaggcgcccgccactacgcccggctaattttttgtatttttagtagagacggggtttcaccgttttagccgggatggtctcgatctcctgacctcgtgatccgcccgcctcggcctcccaaagtgctgggattacaggcgtgagccaccgcgcccggccgaattcttttttttaaaaaaagttttattcttattttttatggctatatagccggtatatttatgtggtacgtgagatattttgatgcaggcatacaatgcataataatcacatcagggtaaatgaggtttccatcacctcaagcatttatccttccttttgttacagacattccaattatactatttagttatttttaaatgtacaatacattgttgactgtagtcactctgttgtgctataatatactagatcttattcttactatatttttgtacttgttaaccatctccactgcccttcctagtctctggtaactatcatctccactatctccatgagttcaattgttttaatttttcactcccacaaatgaatgagaacatgcaaagtttgtctttctgtgcctggcttatttcacctaacataatgtccttcagttccatccatgttattccagatgacaggatctcattttattttatggctgaatagcactccattgtatatatgaacaacttttttttttttttgagacggagtctctgtctcccaggctgaagtgcagtggtgtgatttcagctcactgcaacctccacctcagcctccgagtagctggaattacaggttcctgccaccacacctggctaatttttgtatttttagtagaaacagggttttgccatgtaggccatattgatctcgaactcctgacctcaaatgatccacccgcctcagcctcccacagtgctggaattagacgtgagccaccgcgcccgagaggaaccacattttctttatccatttatctgttgatggacacttaggttgcttccaaatcttaggtattatgaacagtgctgcaataaatatgggagtgcagatatctcctcaacctaatgatttcatttcctttgcgtaaatatccagtaagtgggattgcagaatcatatggtagttctgtctttagtttttttaggaacctccatactattctccatagtggtgattttgagtcctgactgaagatatttagcaaattatttagacactctgagtttccgtttcctcatctataaaatagaatttttaaaaatctatactattattcagtatagagtcagaaaagctcagaggcgatttagtccagcttcctttgtcatgttccattctttaatgtaagttaagttcttaaattctctattctttaatagcactaaagaactaaattcattaagaaaacgtaggtttctgttcccatttaaacattctttgaggttgagggctgtgcatagaagacaataatagcaattgaatactacatgatagcataatcgatttaattattgtatctaactctgttttaaagggcaagtatttatcagacagattaagcaggctacccaagattacccaggtaaatggtagagataaaattagatatcagaaccactgtgacatgctgctaccatagtggccccctgcttttttttttatttttctggagacggagtctcactggttctctcagctctctcaggctggagtgcagtggcgtgatctctgctcactgtaacctctgcctcttgggttcaagcgattctcatgcctcagccttctaagtagctgggattacaggcatgtgctaccacactgggctaatttttgtatttttagtagaaacgaggtttcgccatgatgaccaggctagttttgaactcctggcctcaagtgatccaccctcctcagcctcccaaagtgctgggattacgggcatgacctttttttataaccgttaaaaaactagtatttatataaaagcattttaactgttacttatacttcctggtttagaaccataacttatttctatatattttgtaactcttcagtgaggtgcttgtgtacataatacatagttgtatattaggattttgttcaataaaaatttgagtacataaatgcttgatactgttctagatactaagtatataaggatgaagaaacaaaattaagaaataaattaataacaaaatgggtagtagtggtaggtattacagtgaaaatgaacaatgtgagcataacagatgggcctttaagctgggacctgattgatgagaagggagcaagatatgcaaaaaatggggtgcaggcgttccaggtagagagaatagttactgcagcagccaagaccagtacgaacagaaagtgttcaaggaccaggaagaaggcaagcatgggtggaatatagtcagggatagaccattcccagagtatgtcatgccttgtagccttggtaaacaaacagttttatttcattctaactgcattgggcagtcactggagggtttgaagcagggaagtaatataatctgatttctagttggaagaaattgcactggctgctgggtgtggagaatggattgtaaagggcaagagtaaaagcagagactgatgaggagacttgtagtaaccaagagatggtggtgggctagatcaggtggtagcagtgaaaatggagagaagtgatagacttgggatttgttctggagagagagttgacaggccttgcttctgaattgagtgtaagggagggaaagtaaaataaccaaaggttgctcctacatatttttgcttgaacaacaggatattgggagaacaggttgccattccctaaaatgggtgggactggggagagaaaatcagtagttccgttttgtacactttaagtttgaagtgcctgtagatatctaagcagagctgtcaagcaggcagttggatatataacctcgagcctagagttcaagtgaaaggtgtacactggggagtcatcagcatatccacggcatttaacccatgagatgagatcacatgtggaatgagcatagagagagaagggaaaggtcccaccactagttatgtttgcaaatccagtaaataagcagctggtgatgtgggaaaagattttaaaagatgtggtatcttgaaaaccaagtgaagcaaatatatcaagaatctaatgctatttggagtcaaataagataaggactaagaagtggcccttaaatttgacaaaatggaagttgttaatgactgaggagcagtcagtggcacagttggaactgaagcccggtcaagttgggtggggagagaatgggtagtaagaaatggagacagcagccgggcacggtggctcacacctgtaatcccagcactttgggaggccagggcgggtggatcacctgaagtcaggagttcgagaccagcctgaccaacatggggaaaccacgtctctactaaaaatgcaaaaattagctgggcctggtggtgcctagcctgtaatcccagctactcaggaggctgaggcaggagaatcgcctgaacccgggaggcggaggttgcagtgagccaagatcgtgccattgtactccagcctgggcaacaagagaaaaaaactgtctcagaaaaaaaaaagaaaaagaaatggagacagagaatatagataattcttataacaacttctcctgtgacggggagcaagaaaaatggggcaatggttagagtggaccagggaccaagttaaataggcaggttggttttgttttcaattttacttgtaagtattttgctgcaaggtcagctcttctcttacagcccattgacctgcagacctggggtttcatatgtattcactgaatagaaaaacatacgtaggagctctccagctatccctgcataccctgagaaccagtggcagcaggaataagaattcccttcacttccaagattaggctataagagaaaaaataaaaaagaattcaacaacccttgctctgccactttcttgtcaggctctgggaaaacaggaatatctttccctgtccctcctccaaactgctgacagtctgtctgatggagaccttggtaggtgctccatagtctgtttttgacctgggcctgggataagaaggaagggcttttcagcagagaaaagtgcctcagtcacagaggcatgctgagcagaatgaggacctatgagggagcttggtggagcctggcggggtggagaggtacaggagtgctttctagcaatttaggcttgttaaggaacaaagccaggctgtttactgagttctcttacctggtactcagatggattcttctaaatgaaaagaggtgatacaaatttccccaaaattgagtctttgtggcttatgctcgcaaacagtggccttctcaagatttatacggtgagccctaaatttgccttctcacccagaagaaagtaaggtacaaaatttccctcattctttcacgtcttagaataaagcatgcagtcagtgtaattgttgcgttcagctgtctatttaaggtaacacaggaagtcagcagtgcattttcaagaaaagctgattaccatctgttattagtaatcatctaaaaacatcactaagtataagcattggcagtggtcagagacacatagatgaaaagggggaaattatccatcatttggaatgtattaccccatactaatacaatataccaatttaaatgatgttagaatatatcactcaagatatggtgttctaccccatgcccaaaatgttctactctcatttttccccagatgtggaaggttgcatattaggtaatacttttttttttttttttgagacagagtttcgctctttttgcccaggctggactccaatggtgcgatctcagctcactgccatctccacctcccgggttcaagcaattcttctgcctcggcctcccaagtagctgggattacaggcgcctgccaccacacccggctaattttttgtatttttagtagagacggggtttcaccatgttggccaggatggtcttgatctcttgaccttgtgatccacctgccttggcctcccaaagtgctgggattacaagcatgagccacgcacctggccaggtcatgcttcttttaagactcattgtaaacacgtaacctttacagttttgcatccaaggtagccagctttctgtgaggctcttcagagcctgggtccctgcattcgaggggagcttcagatgagggctttattcagggctcaccttagagtcaccatctctatcatgaccatggatgcagtaaggtttcacagtagctcctgcaacctcaagagggtagattacaaaacccaaagatagccagtggtgtttcacacctaaacaaatgtttatcttgccatagtgattgaaccataggctgaattgtaaaagctgatgtttgggagtctagctaaagaaaactaagttaataggtttaaagaagcaagagctggaagggtcttctcctggaaggtgagatattggtctgtggggtgtccaagggagagaatccagtcatgggttcttagcttctctttctggttggaccagtaaagcctcttcctcatccctcttttctgctcatcactagagacaaaactaaaaaccatggcttcagtctgctaaaagcctagaacaaaacagaacaacaaaataaggcaggctggacaagcttgttaagactttcatggattaccagaaatataaatgccattaaagccatcatttttcctcataaaatgcaatcgattgttactgaaatttttaatgaaatctttcagactcttaatgagtatttaaatatcagactaaagtaatttataaatcattattttctgagctccgagagagtctcacttttttttttttttttttttaagacagagtctggctctgtcacccaggctggagttcattcttgcaaactcggctcactgtaacctccacctcccaggttcaagcgatcctcctgcctcagcctcccaaatagctgggattacaggtgcccaccaccacaccggctaatttttgtatttttagtagagatagagttttaccatgttggccagggtggtctctaacatctgacctcaagtgatttacccaccttggcctcccaaagtgctgggattacaggcgtgagccacctcacctggcctctcactttaagagccagttttcacaaagaaatcatactacttcgcatgagttagtatatgcatttaactgagagatgtgcatactccaggcaggtggtggagctgatacactagccagatggctacttgaccataacagtttgcagcccatgaaattcaaatctttgcctcaccagacagtcatggactttcaaggtcattctgtaagttatttgatgttaaatgcctgtaaagtccaagtgataaaagcgtgttaagttaattgggccactatatgtcactcaatagctcctatagggttcttgtacaggatctcactctgtcacccaggctggagtgcagtgctatgatcacagctcactgcagccttgacttcctgggatcaagctatcctcccaccttagcttcccaaagtgctgggattgcaggtgtgagccaccgcacccagcccagagctgccttctttccatggcttcagcctaagtaactctcacctattaccgtggcacctttcccacctcttatctcttaccgtccttcctacccccacctccacccattatacttctgccagcttcattttcctaaagctggtggtccctattcccttctaattttaggaatgacttccatacctgggctttcccatttcaattcctactaccaagtgtgttctaaccaaacaattttgtcccatattttcctgtgctatctctcccatccttggaatgttatgttgattaagcccttcccaaacatatgtgatttttttcctacctttgtacttaataatattttgtaccacttatacaactaaagccattcagccttgtattacagatatttgggcttccccacgctccataactgcaaaccacagaacacacttcaaggtagacttaggctcatttccatgacagtgtctaactttgattcagcccttaagaattattaagttggtgacatattttcatttccctcacaatggctttgcacatagtacacccaaatacatcttttttgttctttgtaagcattatcacaaggtagatatttttctgagtttttttttccatttaacgtggtgataatcttttacgttcatatattcaagtaccttgtatttttaatggctgcatattctgtaaaatgcatgatatctactttatttaaccactattgaacatattagaaagcttttaaatatgtgctactacagataatgctgcagagtgtgtctttgcacactaaagcagatatgtcaaaaagacagcttcctagaaatggagttactggctcagatgttatgtatattttttagttaatgccaaattgccttctaaaaacacttagaaaatttccaccaatagtatatgaaagtgcccattccatgtctggattttgttactgacattttattggctgcacaaaaaaagcttgcactttaatttacatttccctctttactagtgaagttaaatgtctttttgtatgttgtctatttgtatttcttctccaagaattacctattcatatctctttgccagtttttctactaggttgtctgtttcttgatttgtcacattttaatagattctagatgttaattattttcacatacattgcaagtacctattcccagtttatcgtttgtccatcaattttctttcgttttttcttttttttttttttttttttgagacagagtctagctctgtcgtccaggctggagtgcagtggcacaatctcagcttacttccttccgcctccatctcccgggttgaagcgattctcctgcctcagcctcccgagtagctgggactacaggcatgtaccaccacgcctggctaattcttgtatctttagtagagacagggttacaccatgttggtcaggctggtctcaaactcctgacctcaagtgatctgcctgccttggcctcctaaagtgttgggattacaggtgtgagccaccgcacccagctgcctcagctttctttatggtatcttttgtaacttttaatttttaggtagtcaaatctttagtcttttgatttatggcttctcaattttgttccttatttagaaaggcttcccaatcctaaaattatcaaaatgttttcatctgattgttttattttaccttagcttttgttttttgttttttgttttttcagacagggtcttactctgtcaccgaggctggagtgcagtggcatgatcacagcttactgtagcttcaacttcccgggctcagttgatcctctcacctcagcctcccaagtagctgggactacaggcactcaccaccacacccagctaatttttaaatttttttgtagagatgggatctcactatgttgcccaggctggtctcaaactccaggctcaagcaatcctcccacctcagctgcccaaatactttagcttttaatcctttcattcatttggattttattttgaggttggataacgggtaataattttttttttatcttttgtaacactgttgaaaactttccagttgatttgaactgttgcagttataaactaacgttctatatgcatttgggtttgtttctggattttcctttgtataccaacttttaaaatttattttttttcttttgtattatctcttctatatgaactttagagtcagcttatggattctgttaagcattttttaattttattggggtttctgtttggattgcatttaatttatggattatttgaggagaacggacatctttgtaatatcacatctaccattctggactccttagtatgcatctcctgctcaatcatttccttttatcctattgtaaagttttacagctttttcctctagctcctatacccttttgttagacttattcctaggcattttagggtttttatcgccactgtgaataggatcctttttttttctattgcctttcctattggtgtttgcctctagataataaaacttcatttttatatatttatctctggctatctcattagtctgaataatttttcagttgattttcttggattttctaagcatacaattctgtcacctgcaaaaataatgacaggcttttctctctttttttcatttctcatttctttttaggtagggatttgaatcgtgaaatccctgaatcgttagggatttccaggaccttattttagagcagccataataggaggcatctttctcttcttagttttaggaggaacacttctatagattttaaattaaatttgatgcttgctgtggatatctgagggagtcattttgtccagttaagaaaacattctttgatttttcacttaagatattttatcaaaattcagtgttacagtgtatcaaatgtttttatgacatctattgaaaaattatttttttctttttaatctgctactatattagttgaattattttccccagttttactgtttctttcttgttgtaaacactacttggtcatgatatattctttttactacccttactactaaatttcgttttatttagaatgtttatattcataagaaaaatagccttgtacttttttccccttatgtttctccttgctgtgtcataccttatatacttgggagctaggtgtgtcttgaagatttgataacattccctcataaaactgagtctggtggctttaaaagatggaattttgactgccttttcaattttaactgtcatattcaagggctgttaatatcctagccacttttctctgatcttgaacaagtcactgatttcattgaatcttagttttgttaatggtaaatagagataacagtatctaattcccagtattgtcgtaaggattaaatgaaattgattatttagcatagttttgtctcgcatatggtaaatggtcatcaataataatcattattatcattgttattcccttatgtagattactgtagcgaccttagtcatccccatctcttacacagtacagctgtaaattccatagtagacagagaggatacgaagatgagttaatggtccgtcccacagtggtagtcatcaactccatccgacacactctttggtgggttgagacctctccctgaactagatctttttcccgcagtgctgtgtctcagcagacctggccatgggacaggatgcaccacctgtgttgtataagggagccaaggcagactgcacgtgtgcgccttggccacccctgccttgtctggagcttgttctccacattagaatgcttatgttagtttttgaagatttttaacttgaatggaaagataacttttttttaatgtcatttgaaaaatcaggatcatgatatataagctatggaaaggcagtctttacatgattggtctaacattccatcagttttgttttgtttttaggaaatacttagatgttttgtctccttttgaaaggagcataaaatgttaggctgagataaatgtataaggtagaaaatggagacttgttgcattctcatcaacaagcagaatatggttttttccagtcttctactacttcacagtccttcatctgatatttaaaatgtatttatgttgagtcatttctttctctcttgctggtgaaccagaagatcacgaaatgattctacagaggcagtagcattatattcagtttctttttttgtatgcatcagataagaggcctgcaaatggaagtaagtcgcctcacatcctcacatcctttgtatgatgatcgcagtaatgtttgcctttttaccactggtgcaacatttattagttcataaacccgcttccaaagaacctaagggctttttgatgaaaggtgactgtggtgggaacaatgttaggttttgacaggctacttttgcttttacaaacatttctcctctttgtttttagtgtttagaaactactaccttaaaagagagttgaggacagggacatgtctggactaagtggaatttagtgcttagagttaggatttggaatataaatatggaagttaatatttagaattaggatttctgaatctgtgaaggaaaggtaaaataaaattttgatgtcagttcagcttaagcttctaaatcattctcgctgaaccaaagcttccagttggtaaaaatctaagatctgaggaataaaaccaacataagaagctgacttttggtaagccttaacagtgatagaagagggacaaggtggcagttcgattctcctattttccccatagactgcaggccccttggctaaccgtaaaccttctaccctttaactccctgtcgtccattcagcaggccttcctgtgacccgtgagtatcagtggaagcattccctccaataagttaccacggcctaagaaaaaagtctaaaaaattatgtttcctgaagttttcacagtatttaagtatttacgtaaaggagtatttgttgtatcctagagagtgaatatggagaagggtacccctggagcactagaaataagcctgccaattttcagtattagccaagcagcaaagttttgctgctgtttatttttgtagctcttactatattctacttttaccattgaaaatattgaggaagttatttatatttctattttttatatattatatattttatgtattttaatattactattacacataattattttttatatatatgaagtaccaatgacttccttttccagagcaataatgaaatttcacagtatgaaaatggaagaaatcaataaaattatacgtgacctgtggcgaagtacctatcgtggacaaggtgagtaccatggtgtatcacaaatgctctttccaaagccctctccgcagctcttccccttatgacctctcatcatgccagcattacctccctggacccctttctaagcatgtctttgagattttctaagaattcttatcttggcaacatcttgtagcaagaaaatgtaaagttttctgttccagagcctaacaggacttacatatttgactgcagtaggcattatatttagctgatgacataataggttctgtcatagtgtagatagggataagccaaaatgcaataagaaaaaccatccagaggaaactcttttttttttctttttcttttttttttttccagatggagtctcgcacttctctgtcacccgggctggagcgcagtggtgcaatcttggctcactgcaacctccacctcctgggttcaggtgattctcccacctcagcctcccgagtagtagctggaattacaggtgcgcgctcccacacctggctaattttttgtattcttagtagagatggggtttcaccatgttggccaggctggtctcaaactcctgccctcaggtgatctgcccaccttggcctcccagtgttgggtttacaggcgtgagccaccgcgcctggcctggaggaaactcttaacagggaaactaagaaagagttgaggctgaggaactggggcatctgggttgcttctggccagaccaccaggctcttgaatcctcccagccagagaaagagtttccacaccagccattgttttcctctggtaatgtcagcctcatctgttgttcctaggcttacttgatatgtttgtaaatgacaaaaggctacagagcataggttcctctaaaatattcttcttcctgtgtcagatattgaatacatagaaatacggtctgatgccgatgaaaatgtatcagcttctgataaaaggcggaattataactaccgagtggtgatgctgaagggagacacagccttggatatgcgaggacgatgcagtgctggacaaaaggcaggtatctcaaaagcctggggagccaactcacccaagtaactgaaagagagaaacaaacatcagtgcagtggaagcacccaaggctacacctgaatggtgggaagctctttgctgctatataaaatgaatcaggctcagctactattattacactctcctgaagctaaccaacatttcctgcaacattatgtagacttttaaaagaagggcctgaagcattctcacaggataggctaaatgtagaacaagaagctgaagacccgttagagttttcatggcactccttatcagaataaggtcactgtctcatcagttataagacataccactattttatgtgccagcaggaatgaaaaaatgcaattataaccataagatgtttcagaatcaatgacataatagtattgcaaaccagattctagcttaagctagaatgaatattccagtatagtaaggagtctcattaagaaagtagcccctcatagaactaagtccctaccacagcatacacaaagacttagctgctgggtcaggccatctggcttcaggtaaggctctgtgaggacagcctacattggaaatcaggaagaggaatgaagttttaaagaatcaggaatatggcatccttggggaacaaggctggatccttcactgtgcacaggtttgtaacaaagatgtcacagatacttgagctttctgctttcagatcaaggcagaagattacacttgataacacctctaggcccttgactttttttaaataaaattctaaaatcatagaaatagatgcttacattatctaactcattttcatagtttgcagtttttgcttaaagaacatgccatgcagctgggcatggtgtctcacacctgtaatcgcagcactttggaaggccgaggcgggcagatcacctgaggtcaggagttcgagaccagcctaacatggtgaaactccgtctctattaaaaatacaaaaattagctgggcatggtagcatgtgcctgtaatcccagctactcgggaggctgaggcaggagaattgcttgaacctgggaggcggaggttgcagtgagccgagatcgtgccattgcactccagcccaggcaacaagagcgaaactccgtctcaaaaaaaaaaaaaaaaaagaacatgccatgcatatatgtattatgttgtcagcctagacagctgatcccaatttaaagcatctgcagattactgtctaaatcatagtctacaaaaatgacaaacttgtgatctgtaatcagtatccctacgtgctttgatgatttttagtggtaattataaatgagaaaatacagagtttgaaacatggtctctttgaattaaaaatactttcaaaaatatcttgaggaaaaagattttttgtagctattctgagttatgaaaattaattagcaataattgtctccttggtgtgaggggagagaacaaataatggaggtgggcctccagcctacctaacactggcttttgctgaggctctagcagccagccaggggctctgcatgtgagtgggtggtggtagagttgacagcagtttggattcaaagacaggaaggaaatgcctgtccctcacagggccaagctgtggccctgtcttctggcttgcctaggcattaaagaaaagacataaactattctaaaattaccaactcactgatgtgtgcgcacccacccacaaactgagggggaaaggggacttacagctcacaccagagtagtttatacttcctagaatagccctactctctcaattctgtgtgtcttgtatcctcagatggtttcagtgggtctgagggttttagtattaggtttctagtaaccacgaaaatgcctaacagttccagttacttggattttctacaggtaagcttaactgaaaccacatttctatactcctgatactttgacctaggattttcttttttattctctcagtctcaggattatacacaagaatatggaaatttaaaggtagcagagaaaaagtgagaggctctagaaaacgtgtcgaagttttctaacagatcccattatcaggcaaatagccaggtcaagaatttttaaggttgctcatcttacaggattattaaaattacagataaatggcattgtctctgtttctagcctttggtctcaagttggttgtagctgatgtaattttttatgtgagagcatcagcgttgttctgagcattttgttttgtggtgaatgataggctgagatcatgcaggttctccttctggaggacataagaatctggtcccagtgctgggctctcccagagggcagtgctttacctaacagtgaacctgtgacgtttcccacttttccctgctgaaaagatcatgtcaggactgcttgcctgccatgagatgagaaggtctgtgctgggcttctcacataggggcttttttccaggtattagcctcactcatcattcgcctggccctggctgaaacgttctgcctcaactgtggcatcattgccttggatgagccaacaacaaatcttgaccgagaaaacattgaatctcttgcacatgctctggttgagtaagtatctcttgcacatgctctggttgagtaagtatctcacatttggggacaggttgtgatagttcttcaaaaccaagagagttctgtgatgaaaacgttctctagctgtgttccccacttcttggggaagccagttggtgccaggccctgggctttaccttttgatagtaattcttcagatccctcctaaaggaactagatggtgaacagcagccccagacacatcctgcagctccccaagtgtgttcacagggagagagtcactgtgaggggttcctggcctggttttcctgtaaacctaccagaggaacccacatgtcatgcacagcaattagcatgccctgctaagacatctgcaggtagtggtagtgggtttaggactgtctccccagctttccacatgtgtcagagaactgtgaggaatgacagagctcttactcaaaaagcttatttgagattaggtaaagtccagtgagggtaaaattgcacaccttttaccacattcacctggggtcagtgtagacgccaaggttgtcaagcagctcttgcataaggactatgctggcagagaaaaaggcagtttccctgaggtcaaaggaggtgtttcaggcactcctggctccagacagtccctttctggcagagagggccagaaggagagctcagcagcgcagggccacctttctgcagccatcatcacaagtaagggcgagtgcttttgaaacctcaaatgcatccagctccaggaaggggataagtggctagctaaaagaaaaagtctttcaggtttcagtcacattgctggttacctcagcaaaatgttcccagaacacccactcaggtccctgtgtgtcatagtaatgatgcatctagtgactggtggtggcagaattctaagtagacccagctcttaagaaagcagtgttattccccttacctgtagtttgtctttattacttttaaatttttcttccagagaaaagtagtaacaggtcaggaaaatcccaggcgaaggagtaagccttctatagttgaacagtttggatattaaggaaaactcaataaaatatttatacctgctttagtgagaacttctgatctggaagaaactagttcttgtattcctgtgagtccctaagccagacctaagtgaggagtcaggccatgtgtccctactgtctggagaggagaagagactcctgcctggctggcctgaaggcctggggccacccctccacttcctgcagggtagctggggccctgacacacagcacaagttcatgtgtctgacaaggtttgcggtgacttttcaaatcaaagaaggggttatgctctttactaataatatgttctgaatatattgttgcaggataataaaaagtcgctcacagcagcgtaacttccagcttctggtaatcactcatgatgaagattttgtggagcttttaggacgttctgaatatgtggagaaattctacaggattaaaaagaacatcgatcagtgctcagagattgtgaaatgcagtgttagctccctgggattcaatgttcattaaaaatatccaagatttaaatgccatagaaatgtaggtcctcagaaagtgtataataagaaacttatttctcatatcaacttagtcaataagaaaatatattctttcaaaggaacattgtgtctaggattttggatgttgagaggttctaaaatcatgaaacttgtttcactgaaaattggacagattgcctgtttctgatttgctgctcttcatcccattccaggcagcctctgtcaggccttcagggttcagcagtacagccgagactcgactctgtgcctccctccccagtgcaaatgcatgcttcttctcaaagcactgttgagaaggagataattactgccttgaaaatttatggttttggtatttttttaaatcatagttaaatgttacctctgaatttacttccttgcatgtggtttgaaaaactgagtattaatatctgaggatgaccagaaatggtgagatgtatgtttggctctgcttttaactttataaatccagtgacctctctctctgggacttggtttccccaactaaaatttgaagtagttgaatggggtctcaaagtttgacaggaaccttaagtaatcatctaagtcagtacccaccaccttcttctcctacatatcccttccagatggtcatccagactcagagctctctctacagagaggaaattctccactgtgcacacccacctttggaaagctctgaccacttgaggcctgatctgcccatcgtgaagaagcctgtaacactcctctgcgtctatcctgtgtagcatactggcttcaccatcaatcctgattcctctctaagtgggcattgccatgtggaaggcaagccaggctcactcacagagtcaaggcctgctccctgtagggtccaaccagacctggaagaacaggcctctccatttgctcttcagatgccacttctaagaaaagcctaatcacagtttttcctggaattgccagctgacatcttgaatccttccattccacacagaatgcaaccaagtcacacgcttttgaattatgctttgtagagttttgtcattcagagtcagccaggaccataccgggtcttgattcagtcacatggcatggttttgtgccatctgtagctataatgagcatgtttgcctagacagcttttctcaactgggtccagaagagaattaagccctaaggtcctaaggcatctatctgtgctaggttaaatggttggcccccaaagatagacaggtcctgatttctagaacccgtgactgttactttatacagcaaaggaaactttgcagatgtgattaaagctaaggaccttaagacagagtatcctgggggtggtggtggggtgggggggggtcctaaatgtaatcacgagtaagattaagagcaaatcaattctagtcatatattaaacatccacaataaccaagatatttttatcccaagaatgcaagatttcagaaaatgaaaaatctgttgataaatccatcactataataaaaccgaaggtgaaaaaaattctgaaaaaattctagcagctatatttgataaaattcaacatctcctagctttagcaaactcacagttttgcaaataatattttcttaatgttatctgttgctaaatcaaaattaaacagtcatcttaactgcaaaataaaacatttctcagtaaatattaaagccagttaccttctatcaacatgttaatgaaagtgctagttgttgcagcaaagaataacaaaggcaatacacgatcaatataggcagtgaaacaaaagtatcatttgcaagttaaaacagacttcccaattttaaatctggtttccccctgaatatgtggcatccttggcagcacttctgagagtggctgctttcattccaagaagcccatgggtttggaggtgggataggtgcctttctggcttctcattgctgcttctagatcagtctccaaatatcccccttccccacattggaatgaatagccatcacagcatggatggaggttagaatgagccagactgcctgggctcaaatcctagcacaccactcactagctggggaccttgagcaagttatttgtcctgttttctgtttccttatatgtaaaagtgggtaaaatggtacatattttgtagggttgttatgaagattgaatgacattatttacaaactgcttagaactgcttgccacctactaaatactgtgtaagtgttcaagaaaaagctgtcttcatttca

SEQ ID NO: 2717 - DNA, 66331 bp, Homo sapiens
  source 1..66331: mol_type = genomic DNA
cacagtggtcctccgccggctacggcgctgcgtcactggtttgcaggcgctttcctcttggaagtggcgactgctgcgggcctgagcgctggtctcacgcgcctcgggagccaggttggcggcgcgatgaggcgcagcaaggctgacgtggagcggtacatcgcctcggtgcagggctccaccccgtcgcctcgacaggtgagtgggtctcgaagagaccgacggcctcgacctggccgggcggcggcctcgcgctgctcaggcgtcatggctcccgacgggcgctgctccctggcgcgctctgttgaggcgccggccggctggcgcagtcctgtgggcggcgtggcgcttgcaagcgcatgaagagtcctggggggacagcggtgggcgggagacctttggcgccggcgcttcctctttctcccggcttgttcccgacgcttgttcccgacggtgctcgctcctggggccgccctggcccgggctttctggccgatcgcgcaccccgtagtacccgcgcggcctagttctcgggggcttgggcacccgggtgctgtatcggcgggtttcttcccatctcctggacatatactttatatgctgcggcggaggtcgtacctccttggcctggaggaacccagtggggactgacgcagctccgggtgagctttggcggctgcgtcgagtgacaaggtaggcatctcagcgcggacatttgcaatggcccgacggcgcaaatgacactgaaagtccccttgttttgagtatgaggtgtttgtcgctgtccctttgtaagggtccagctccactccgctcctcatactcacctccctcgcccccctccccgcccggaacactttggtagctgcctttgcttaaaaaaaaaaaattctaaagttcttacaaatcgttagtatggcttgcaatttttaaccttttccacaaatgttttaagggtatttttcctctttacatgtaaataatgtgatctattttggattcaataagactttagtaattggatctaaagagtgacggaagaagctattaaaggtggatgtgcgcagaatcttgagtcagtttgctttggcttgaataatcacagcactgtcgtttataagctgggtatttggggccagttacacttttcatccatagatggagttgtaacattaatagaatttgataggatgatccattttaaacatttagggtattgcttgacacatagcactaaatgttagctacaagtcactttttattgttgatgttaaaaggatattggcggggcgcagtggctcacgcctgtaatcccaccactttgggaggccgaggagggcggattgcctgaggtcaggagttcgtgaccagcctggctaacatgttgatacctcgtctctactaaaaatacaaaaaaagttagccgggcgtggtggcgcatgcctgtagtcccagctacccgggaggctgaggcaggagagtcgcttgaacccgggaggcggaggttccagtgagccgagatcgcgctactgcactccagcctgggcgacagagggagactccaaaaaaacaaaaacaaaaacaaaaaaaacccggaaactcacggatgaccatgattataatagtagcataattgtgtctcttatcgtaactaagcataggttatcttattttgcgcttccagcagccctgtggatattgagacctgtagagatttaagatacttgttcagggtcaaatagatagtgcagcagaattttggcagtgggtctgatttagtttctcttgggaacagtggagtaagttacagtctattcctccagaggaggaggatagatatctacttgtacattgtaatttcaaactgctagcatagtataaatatgaatgtgatgatagagtctaaaacagaccttaattgagggttcctgtaactcctgaaattaaagactttaatttttgtgttattttattttttttgaggtggggtctcactctgtcacccagctggatgcagtggcgctatctcgactcactgcaccttccgcctccccagctcaagcgatgctcccacctcagtctcccgagtagttgggaccacaggtgtacccaccacacccgctgttttgttttgttttgtatttttggtagagactgggtttcaccatgttgcccaggctgttcttgaactcctgggctcaagtgatttccccgcctccacttcccaaagtgttgggattataggcgtgagccactgcaccggccattattttatttttgagacaaggtctctttctgtctcccaggctggagtgctgtggcgggatcgtggctcactgcagcgttgacgtcctgggctcaatccatcctcccaccttagcctcctgggtagctgagactacaggcatgtgccaccatgcccggcttttttctttaatgtagagacggggtcttatcatgttacccaggctggtctccaactcctgggctcaagtgatcctcccgccttggccccaagtgctgagattacaggtgtgagccactctgctcagcctgatttttttttttttaaacaagcttaaaaaaaaaaaaaagcaagcttagagcctttctgagattcttagtggggaccttggcttccaaaagattaaaaaccactggtctagacagaagttagaatgttctttcaactacataacttctccattaaataaagtggagtggtggcagaattttgaggattggttattatgacacctctcttacacttagagtcttttttttcccccaaatttaaagtcatttacattagaacctggggatttcagcggaatatggattaactagtgagtaactttggaacatgtgaagctattctgtaaagttaggtttgagtgaaatgacaaaacagggtgctttggatagaaggtaaagaatggagggagaagaggcagtggctgtgaagaatatgaagaggttagtattctcccccagtttggcagaggctggccatctgtgaactgcccatgctttctagaatgtcggagttttggagtgtgatgatgcgtctgtatatcatatctttctagtctttcattgtgctttcatttgttagtcttctcttgttttgccatttttctactccctcacatgtgcttttgcccttaaaaatattcttcgtctgtaatctgagcactttgggaggccgagagaccagcctgaccaatatggtgaaaatccgtctctattaaaaatacaaaaatgagccgggcgtggtggcagcgcctgtagtcccacctactcggtaggctgagacaggagaattgcttgaaccctggaggcagaggttgtggtgagcagagattgcaccactgcactccagcctgtgtgacagagcgagactctgtctccaaaaaagaaaaaaagaaaaaaaaatataattctttctctagtttttctttttccagatggcttctgtttagtttttctatgttctgtcaagttgatttcttattctgcagctgattcctacttctcaaagtctacttgacagctcttatttttatttatttgttttttagaatagggtcttgctgtgttgcccaggctgccatcaaatttttgggcgtaaatgatccacctacctctgtttcctgagtacttaggactacaggcaggcacctttgacagctgttagttgttttttctgccctttacagctatacttcatacttctgagtaacacacatatatacttttgttatttttaatttcctttctcccattttagacattttcttttcttttttttttttttgagacggagactcgctctatcgtccaggctggagtgcagtggcgcgatctcggctcactgcaaactctgcctcccgggttcacaccattctcctgccccagcctgtagctgggactacaggcacccgccaccacacccggctaattttttagtatttttagtagagacggggtttcaccgtgttagccaggatagtctcgatctcctgacctcatgatccgcccgcctcagcctcccaaagtgccggggttacaggcgtgagccaccgcgccgggccccattttagacattctgtactggttattatgctcctccaaaactgtcctcagacactttggtttgcccctcattctttcagtactgttattgcagtttttgtttaaatgaatatttaacatttatataaatataaggtaaatatttttgcatttgaattgcccttgttgtgcggttttgtttttcctggactgaataattgctttattttttggtttgcttgtatgttgtgttactacttgcttacttaaactcagcaatttacaccctcaaatgtggtcaaactggtcacataatcccatcaattgcagcttaaaacattgattgattgattgattgattgattgtctgtctacctggaatacccttactaactgacttctccaaccaggattggtttttcttcctctttgctacacagctgtgctcttgggacttccctttatcatcagtttgagaattcctttcatcttttttctgagttagaccctttgtttcttgtatctcatgtcctcttcatttactttctttgttttggtgtagcatagtctcacttgctttgaggaaaagtagatgagaggtttttttgtttgtttgtttttgttttgggacagagtcttgctctgttgcccaggctggagtgcagtggcatggtctcagctcactgcaacttccgcctcccgggttcaagcgattctcctgcctcagcctcctgagtagtgggattacaggtgtgtgccaccatgcccggctaattttttctatttttagtagagatgggatttcaccatgttggtcaggctggtcttgaaactaatggtatgtctttaaaatgtctttacttaatttagttgatcatttggttatcgaattctgagtttgaaataatttttttttcgcaattttgaaagcattgctccattttctagaagttctgttgttaggagtccgatgagattcttgttcttggtaacttaaaggttttctggaagtgtcctttcaattgggaaactcatttctttcagttctgtagcatttcttgtattatttctttgaccatttcttaccctttttttaatgacgtttacctgaaagctggagtttctctaatttttctcttattctcctcttttgtttgttctgccttttgagagatttccttacccttatgttccaggggaagaagattggggaactcatggttcagtatctagacttttcctcattgtcctgtataatcgcggccttcacccttgttgggactccacagatttggagctgatcagatgggtttgttgagaacagctgatcagatgggtttttggaggattttagggggagggagattcatttgactgtgcaagatgggcgacagagtgagactccatctgaattaaaaaaaaaatttagaactgcatagtgaaaaagtaggccacaaatattaagttttggacaattacaattacatctctatcttactgtgcaagatagagatgatgtggcatctcttagggtcttactgttcctgttttcagccctgcatcagttcttgatatttggcagcttaagtgaattcaggtatttgcttatagtgacatctgctgtcatgtaaagaagtactgcttgcatcagatattgtcctgtttacataacatgggctgtgctccttcctagctgtgtatctttaaacaaggcatttacctgcttgagcttcagttcccttgtaaagtgagcaggttagaggcaaaagatcatatagaagaataatttgtaaagttgtttaattatcttaagattgtctactttaataacatagttggaagcaaagaaggtaatggaattatttttctattatgttttggcattgtaccttgaatctatttcttcattttgaaaagggggaactggctgggctcaatggctgacgcctgtaatcccagcactttgggaggtggaggaagtcagatcacaaggtcaagagatcgagaccatcttggccaacatggtgaaaccccatctctactaaaaatacaaaaattagctgggcatggtggcgtgcgcctgtagtcccagcttgtacccgggaggcagaggttgcagtgagctgagatcgagccactgcactgcagcctggcgacagagcaagactccatctcaaaaaaaaaaaggaaggggggaacaagccttgttcctttacgtgctgtcctgactgctgtgtattatttttgttaagattgctgtagttctttttttttttgagacggaggcttgctctgtcgccagtgctgggattgcaggtgttagcctggcattgagcaacgttttgtaatttaagcatacaagtctctcacctccttgtttacatttattcccaggcatttttttcttttagatgcgattgtaaatggaattgctttcttaatttccttttctgattgttcgttgctggtacagtagtcccttcttatccacagtattgccttacgtggttttacttagctgtgtcacccgtggtccaaaaatattgaatggaagattatataaataaacatttcatgagttttaaattgcaaacggttctgaataacatggtaaaaatctcacggcctcctgctccgtcctacctaggacacaagtcatccctttgtccgacatattcatgctgtatgtgctcgccacccgctagttacatactagtcatctcagttatcagatcagttgttggagtattgcagtgcttgtgttcaagtaacctttattttatttaaaatggcaccaaagagcaagagtagcgatgctggcagttcacatatgcagagagaagccatatagtgcttcctttaagtgaagaggtgagtttttttgtttttttttttttttggcttaaacaacagaaatttattttctcatggttctggaggctagaagcggcagatcagggtgctgctgctttggttcctgatgagggctttcttcctggcttataggttggctggcatcttgtcctcacatggcagagggagagtactgtagtctcaccttgctttttattattattatttttttaatttatttttttattgataattcttgggtgtttctcacagagggggatttggcagggtcatgggacaatagtggagggaaggtcagcagataaacaagtgaacaaaggtctctggttttcctaggcagaggaccctgcagccttccgcagtgtttgtgtccctgattacttgagattagggagtggtgatgactcttaacgagcatgctgccttcaagcatctgtttaacaaagcacatcttgcaccgcccttaatccatttaaccctgggtggacacagcacatgtttcagagagcacagggttgggggtaaggtcacagatcaacaagatcccaaggcagaagaatttttcttagtgcagaacaaaatgaaaagtctcccatgtctacttctttctacacagacacggcaaccatccgatttctcaatcttttccccacctttcccgcctttctattccacaaaaccgccattgtcatcatggcccgttctcaatgagctgttgagtacacctcccagacggggtggtggccgggcagaggggctcctcacttcccagtaggggcggccgggcagaggcgcccctcagaagaggtgagtttttgacttaggaaagaaaaaagatcatatactggagttgctaagatctatggtaagaacaaatcttttgtccatgaaattgtgaagaaggaaaaagaaatttgtgctagttttgttgtgacaccccaaactgcaaaagttacagccatagtgtgtgataagtgcttagttgagatggacaagacattaaatttgtgggtggaggacacaaacaggaaacatgtttcgattgacggcaacctggtttgatactattcatcgttttggacattcactggggtcttggaatttcaaaaataagatgtttgagtagctgtatactctttatcacatggatggaacatactctggttgtatcagcattttttttttttttttttttgagatggaatcattctgttgcccacgctggagtgcagtggtgcgatcttggcccactgcagcctctgcctcccggattcaagcgattctttgcctcagcctcccaagcagtggggattacaggggtgtgccaccatgcccagctaatttttgtatttttagtagaaaggaggtttctgcatgttggccaggctggtctcgaactcttggcttcaggtgatccgcccgcctcggtctccgaaagtgctgggattacaggtgtgagccaccgcacccagcctggtgtgcatcagcattttggactttggagtttatgtaaccaaggagccaggctgtggacctcgtttattacttgaagaattcaatatttatttctgcctttttgactccttgactgtaaaatactgatctgatctgtagagagaacagtacatggaccagggaatcctcagtgccttaatagatcctaagtacttacttattctttcccatagaggcttacacatggtaggaaaagagatttctggaatacctttcctccccaaagaaagctggtttcttttgtttgttaagtgagagagtggtaccacagggtttccaagatttccaaggctgatgaaaattcttctgttgtctgcttgtcttactttcttgaatttattttttgtatgttatgtatttattatttagagagaggatctccctgtgtcacccacgctggagtgcagtgtcacagtcataactcacggcagtgtcaacctcctgggctcaagtgattctccttccttggcctcctgagtagctaggaacacaggcatgctccactatgcctggctatttttttctccctggagacaggatcttgttgtgttgcacaggctggtttcaaactcttggcctcaaagctagcctcccaccttggtctctgaaagtgctagaattaaaggtgtgaccaactgcacccagcttatttatgatgatgatgatgatgatgatgatgatgatgatgatgatgatgtttgggagatggagtctcgctctgtcgcccaggctggagtgcaatggcacgatctcagctcactgcaacctctggctcactgcaacctccacctcctgggttcaactgattctcgtgccttagcctcccgagtagctggggttacaggcacccaccatcatgcctggctaatttttgtatttttgtcaagacggggtttcaccatgttagccaggctggtctcaaactcctgacctcaggtgatccgcccacttcggcctcccaaagtgctgggattacaggcatgagccgctgcacccagctctattttttgttttgtgataggaaattataaaacatggaattatgcatttgtcagcctttaaaaaaacttttaagtgaatgaaagtggcgtatttgaacatcaacttaggacagatttttactacttttgaaaaaatgttggaaaatatttctgtatgaaaagtaaaacaacttttaattttttttagaagtcaatgaaaggattctattttgcaaagctgtattatgaagctaaagaatatgatcttgctaaaaagtaagtacaaactgtaacatgtattttttttttaaaatcaatgccttttctcattttcttctttgaaataggtaaaaatatgttcttagtagttcttcctaagtgtattctggaataagggatttatcactcagactgatgctaaggaccagcctagattccattgagattgaaaccgtaattagtgttttctgcatgctgctgctttataccaagggcaagaaattgtttggcttcaaatactttttctaaaaattgtcttctgttggagtaaaagaggaccatgcctatatcttaatttgtttttggttagatatctgataccttaatcagatggaaaatagcaatgaataaaaaattaaaccgtaattgtaaggcaggagaatagcttgtataaaagatgtttaattgacacaatatgtgatgctctaaggctctatcctagggataagaagcttggtgattctgatttcctgacttggagtggattaaagcaggaaattaagagggagtcaggctttttttttttttttttaggcagtatctgtctctcttgctcaggctggagtgcagcagctggctccatctttgctcactgtaacctctgccttctgggctcaagagatcttcccacctcagcgccccaagtagctggggatacagatgcgcaccaccacacctggctaaggtttgcattttttggtagagacaggtgtcactatgttgcccaggctagtcttgaacttctgagcacagcagtctgcctgcctcggcctcccgtagtgttgggactacaggtgtgtgttactgctcccagctgggaggcaggcttttaaaggcatccaaaggaagatggaaatgctggtaagaaaggaaaatggtggtacataaattatgtaactagcagcactgtgactgttaactcttgtacctttttactgtgagactttaatcccttagtttaggtctggcctaatttctctgatcgtaatactgtcaaggaacctagaggatatttacttattttagttgttacttgatttgagaaatggaaatttcctgtatttggtactgtaatgagtaatttttcttctgttcgattttagctggatatagtactgttagaaattactttcttgcttaaagggtaaatgtatttccctttgttgtttgggaaattgttgctgtttagtattttgcattatgataactttaaaaatgtttactataatcacttctaatttattcgcaaaactgttagtgctttattaaaatgtgatcaggaagaaaaagcaatttatatgttcatttcttatgtgtggataacactggagaaaaatttggtaaatgtgacatttaatggtaaaatgagtatgtggtcaactctatgtacgtgtttttaagtattatctatttctatgagtacttctgagttatctgtatgaatagcggtagttttgagtaacaatataaacgagtttagtggttgctttggtttaagatgtattcttcggttagcatttaaaagtacagttctaagtttaatttacttttgtattacttttaaaaaacagatacatatgtacttacattaatgtgcaagagagggatcccaaagctcacagatttctgggtcttctttatgaattggaagaaaacacagacaaagccgttgaatgttacagggtaagttacaggattcaaatatagcctttgcatagccaaacacatgatgcccagagaaatttatataagtaagtcaaatatattttatgaatatcataaaacaggcattggtatcatagtacagttacgtgacacagcttggaacagatttagaattgtttaacacctataaattgtaagtctaacacggtcagaaatggtgttcttttgtgttttttgtattcaaatgacacaaatataatttttatttgattcatttccagagaattccaagacacttttattttaacacctttgaagtaacatgttttctctagaagtagaattttttaagggttggagtgataattttttaacctttatatataagtatatatactcctacatacatacatacaatttatttactaatctttaatttcttttctgatattagcgttcagtggaattaaacccaacacaaaaagatcttgtgttgaagattgcagaattgctttgtaaaaatgatgttactgatggaagagcaaaatactggcttgaaagagcagccaaacttttcccaggaagtcctgcaatttataaactaaaggtaaacaaacaaaacataaagggagaaaacttaagacataaccatttctaatatttggaatttaaattacttttcaatagcaaaccttaagcccaggtgttagtgtttcctttaaaaattttcttttaaaaagtgtgttaaaacctttctgagcatctactgtcttattaggcattgttatactttataagtgacatctcatttacctttctggaataattaatattttagggattttacagtttagtagctgtaaactaagtagagctaagatttacattaagttccgtctggtatacaatttttgcttcattaagtgaaaattacctacaggatgacaatttagggatattttaaagaagtgttttctaataactattgtctgaaagtagaagggattgcattttgagatagtaaggttttcaagcaaaagacaaaaggtggtttctctagtatataagacgtaattactaaaaatggtaggaagttcttgctagtgtgttgactggtcctgatattctttatagagtaaaatatagtttactaagtaactgttctggagaaaatctacacaaatatgtttggcaaacatttaaaatgtatattgtaatgttttatatattaatgtatactttatcgtgtgtgtacaatattaaattataaatgtatatttgcctttagcctccttctatccccattatatatgtttctgataggaatttaaaaaattttaattttgaaataattatagatttttttgcacaggaagttgcaaagattgtacagaaagattctgtatgctacttcatttttccccaatgcttatacaggttgagcatttaaaatccgaaatcctaaatgctccagaatctgaaattttttgagcactgacatgatgctcaaaggaaatgctcattggagaattttggatttcagattttcagatttgggatgctctacctgctaagtatcctgcaaatattccaaagtctgaaaaaattcaaaatctgaaatacttctggtctcaagcattttgcataagggatactcaacctgtttaacccgaccaaagcacactatcaaaatcaggaattttgacattggtacaatgtgtatgtatagttttctttcattttatcacgtgtagattcataccaccactgcagtcaagatacagaactactctattaccacagagatcttcctcatgctgccccttttgtagtgatgctatttacttctcttcactatgcctgacctctggcaaccattaatctgttctccatctttatactttggtgatttcaaaatgttatgtaaatgtcatcatgaagtatgtgacgtttttttcttttttcattttttttgagacggagtctcgctctattgcccaggttagagttcactggcgcaatcttggctcactgccacctccgcctcccaggttcaagcgattctcctgcctcagccttccgggtagctgggactacaggcacgtgttaccatgtcccgcttatttttgtatttttagtagaaacggggtttcaccatgttggcctggctggtctcgaactcctgacctcatgtgatctgcctgccccagcctcccaaagtgctaggattacaggcgtgagccactgcacccagccaagcacatgacgttttgaggttggcttcttcagtcaccataataccatttgtgatccatattaagttttgtatatccatagttggttcctttacttctgagtagtatttcatggtccacaatttaaccattcccttttttttttttttttttttttttttgagacagagtcttgcttagtcacccatgctggagtgcagtggtgctacctcggctcactgcaacttctgcctcccgggttctcaggtgatccacccacttcggcctcccaaagtgctgggattacaggtgtgagccactgtgcccagccttaaccattcacttttgagggacattttggttatttctaggttttggctattgttcagctgctatgaacaatcaagtacagatttttgaagctgaaaaagcattgaagatgcttccaaagataaatattactgataagtttttctccccagtaataagcagctggattttaaatattaatctaaaacgtgaggtctaattgtgcagatttctttactctcttaggtgttatgcctcaaacataactcccatattgggcgtggcaatccagttaatctggtgtcagtagtgttaaagaacatatgtaatgataggagattcttttcttgcagtgtaacaagttagatactttgaagcattctttaaagattttctttaataacttgaaggcactgttacacctttcctgtatcagattttttttttttggaattgaaatccatgagatttataactgtcatgcaaagtaattccatttctcctaaaatttaaggcttgctaaggtaaacagtttctgacatttgtttaatgaatgagagtattactgttgagaaggctttttctctcaagtatgagatagaactttttaaaaagcactcatagtggtttttaaaaatatttttaacatagagtcaaagactagggcttttgcaatagggagaggccagggtttcatccatctcatccagaagaggagaaattgataaaggagagaggggaatgaaatacagagtagtaatgggcggcttggtcttgagagttggggaaagacgagtttaagtaggtaaggtaaaatggaatttatatgtgatagcatcaggtttctcagtgaaggatgaatctaggttataagttgaaagtgagggtcaaaggaaggtatggggaagttgaggaaataggaggtgtgaagtgtcagagtggagaaagtgagtattagtactaaaatggtattttgttttaggcagcaccagtttgatggttgagataatgcaaatgaaatcagttagcttggggttatgatttcccaaatctaagcacacagaaaccagtttgggggttcttctgaggaaaagagggaattagttgaagggatctgtaagcaaacagtaattatggatataagggattatagcattttttgcctgacagaagaaagtgtgtatatttatatgtgtttacaggtgtttaaaacttgatgatgttattgtcttgaagggaacttgtcatgtggtggagaagtatatttctgaaagtaagggtatgtaggccctcagtgaggtagaagaataacaagggtggtatggtggtttcggtggtatgaccaaaatacagattttgaagacctgtgtcagtggcaagtggatggttgaggttcgagtggaggataacatcactggagatgaggtgattaaggaactgagtagtcagcctgggcaacacagcaagaccccatctctacagaacgttaaaaaaaaattagccgggcacggtggtgcatgcctgtggtcctagcttcttgagaggctgatggaagagcatcgcaaatgagaagtgagtggccacaaaccctacttcctctccttgtatgtaagttcagagagaaaaagccatcatggtagtgggggttatcctgagatgatactgtcttcatttaaggtcaggaggtgatgacagtgctttgagatggtgatgaaggtaacagaacagtgggaggagaggggatgcgggattgagtcagatttaaggagatacagagcagtttgaacataaggaccttgttgctgaggattgactggggaggtctaggcttctggtggtgactcagatggacaggaatgtgtggcattagtcctggtagtctctgaagagagtatgagctactgcagtaatcacagatgcttttcttcacatacagttcttgaggcttagtttctgggttgtaagcaactctcagaagggatgaataaggtatataggatggtgtttttggtggcatcatcataaaactagacatagtggaatggtgctctttgggagcatgacttgtttaaaattgcacaagtgttactctaataatttttctttttcccctctaaataggaacagcttctagattgtgaaggtgaagatggatggaataaactttttgacttgattcagtcagaactttatgtaagacctgatgacgtccatgtgaacatccggctagtggaggtgtatcgctcaactaaaagattgaaggatgctgtggcccactgccatgaggcagagaggaacatagctttgcgttcaagtttagaatggaattcgtgtgttgtacagacccttaaggtagataaaagctattgggtctttacatttctatgtaggcaattagcatacatctttttgtactaaagcagcagtgccccgcaggacttaaaatttcttttatttatgtagaacagttataaaatgaaatttttaccaggatcagttaaatttataatgggaagattggggagataactatgataaatgtatatatttttggtgttttataaggtcgatataaaaatcaatatagtttcacaaatgtggttggagtgagaaaaggaatttgtaggcttaaaatgattaatttcttaacatttgattaagttttgtaacttactgttcattccacaaaataggaatatctggagtctttacagtgtttggagtctgataaaagtgactggcgagcaaccaatacagacttactgctggcctatgctaatcttatgcttcttacgctttccactagagatgtgcaggaaagtagagaattactgcaaaggtacgttgactttgagaagaatgctttagtataaattgcagtttttctttttgcagtaagttcattgctctaaacttcttcactgaatcattatttgtataatgtacctaggagttatagttaatacagtgaacaactaggaggcaatcttatttttcttcttttacggggaagttctaattggttttatatgactttcctttttagagaactcttatagttcaagcttgattaaaattagccttatggttaaatactcagttttgtcatagtcaagcctaaaatgaatgttctaactgctatttcatattttattttttaaaatagtataatcttgagtgaaaattaaagttcatctgtcatcagatggctaggttcacatgtattagtataagcacttagcatcactggtatttcagaaaatactgttttagctgagaaacaaaataactcaactatgtgatttaccttttttcctaaattttgattttgaaaaccagtgtctccattttgaaaataaattccattgaacaaaaacatcacttggatttgtataaagatgttagtttagagcaggggttgattagaacttgtgggccaaatatggcccctgcctaattttgttaatatttattggaatgcagcatgcctctgtttatgtattgtctgtggctgcttacatactacaaggttggagttgagtggttgcagcagagattgtatgcctgtaaagccagattagtattctcctcctttttgtagaaaaagtttactgattgctagtttaggctgtccatgtggaagttaatttatttccccatctggtataaggaaagaagttcatttcactgagtgcagggagtaggtaattttcttgaaaaagtacataaaagtacctaaattggtagggtaagagcagtatctaaaagaactaacataactttaagattattttagaaaacatgtaggatgttttattttgtattctttgtatactcaaatttttggtcacaagttccttttacatttttgttaaggacatcgaagatctttgtatgtgggttcctttttttctttctttctttcttttttttttttttgtttttttgagatggagtcttgctgtgtcaccaggctggagtgcaatggaacgaccttggctcactgtaacctccgcctccctggttcaggcgattctcctgcctcagcctcccgagtagctgggactacaggcgcacaccaccatacccagctaatttttgtatttttagtagagacggggttcaggatggtctcaagctcttttttttttttttttttgagactgagtcttgctctcgccaggctggcatgcagtggtgcagtctcggctcactgcaacctctgcctcctgggttcaagtgattctcctgtctctgcctccggaataggtgggactacaggtgcccgccaccacacctggctaattttttttttttttttgagacagagtctcgctctgtcacccaggctggagtactgtggggcaatctcggctcactgcaagctctgcctgccaggttcatgccattcttctgcctcagcctcctgagtagctgggactacaggcgcccaccaccacgctccgctaatttttttgtatttttagtagagacggggtttcaccgtgttagccaggatggtctcgatctcctgacctcgtgatctgccctcctcggcctcccaaagtgttgggattacaggcgtgagccaccgcgcccagcccacacctggctaatttttgtatttttagtagaaacagggtttcatcatgttggccaggttggtctcaatcttttttttttgagacggagtctcgctctgtcgcccaggctggagtgcggtggcgccatctcggctcactgcaagctctgtttccagggttcacgccattctcctgcctcagcctcccaagtagctgggcctacaggtgcccgccaccacacccagctaattttttgtatttttagtagagatggggtttcaccgcgttagccaggatggtcttgatctcctgaccttgtgatccgcccgcctcggcctcccaaagtgctgggattacaggtgtgagccaccgcgcccagctggtcctgatctcttgacctcttgatccgtctaccttggcctcccaaagtactggaaggtctcaatctcttgaccttccagtaccttgtgatccgcttgccttggccttccaaagtgctgggattgcaggtctgagccactgcacccggctgtatgtgggttatttctatcagtgtttattacattagaaattaaaacaaaaaatgtaatccattaaaaatgtaagaagctctattgtgtgttaataataatagctttttttttttttttttgagacggagttttgctcttgttgcccaggctagagtgcaacagtgtgatcttggatcactgcaacctctgcttcccaggttcaagcaattctcctgcctcagcctcccaagtacctggaattacaggtgcctaccaccacgcctggctaattttttgtatttttagtagagaaggggtttcaccatgttggcaaggctggtcttgaactcctgacctcaggtgatccacccgccttggcctcccaaagagctggaattacttgtgtgagccaccgcacagggccaataatagcattttttatgaaaaataattatttttcaacagcaaaaaagtagtcagaaagtgtcattgcttttgcatttttgtgaatctttttaatgtctcgcttaatagaacatagctagattctcatttacttcctctttcagtctgtaaaactattacatgtcatgaagcctctagaaaactcagctcagcggggcgcggtggctcagccctgtaatcccagcactttgggaggccgaggcgggtggatcacgaagtcaggagatcgagaccatcccagctaacaatggtgaaaccttgtctctactaaaaatacaaaaaattagccgggtatgttggcacgcacttacagtcccagctgctcgggaggctgaggcagaagaatcgcttgaacctgggagtcagaggttgcagtaagccaagattgtgccactgcactccagccttgtgacagagtgagattctgtctccaaaaacaaaaacaaaaaaactcagctctacatacatgagaaaatgagtatgtaaaatataaatttttttttggtattatcgtaaaagtaattttaacttcatggatcccctgaaggggtttttgagcaccctcagagatctttagacctcacttgctctggttgctttattgtaagccactttaaaatcatgcttcacgtttaagtgtttgctttttgcttttacttttcttccaaagtgaggatttggagaaacaataggatttagaagaactaatttagaatatagattacaaataataggccaggcgtagtggctcatgcctgtaatcccagcacattggtaaactgaggtgggtggattgtgaggtcaggagttgaagaccagcctggccaacgtagtgaaaccctgtctctactagaaatataaaaaaagtttagcggggcatggtggcaggtgcctgtaatcccagctactcagaaggctgagtcaggagaatcacttgaacctgggaggtggaggttgcagtgagcttagatcgtgccattgcactccagcccaggcgatagtgagagactccgtctcaaaaaaaaaaaaggcagactattttaaacgctgtaatgatctatatagtaaaaagagcaattactgtattgatacgcaaatacctgtcagttatttacttataatttggaaatggtatgtctaatttgagaaattacaactgttaattaaataatgaaattatatgatcaggaagaaactacaaaatagtctcccaactttatcctggtttattttgaaatgtgcacctataatcactgatcttatatttatcctgtgattggagggctggaaataactgggaatatcatttgagaggttaagcatgaagtataggaagtatgcaggataaaaaaaagcattagatgattcataatttataacatggggaataagaattattagttgaatgtggaagatgaagcttgaaataaaatttttattttgttttgaattaaataaaccatgattattcacagtgcagtaagtgtgtattatctgtttgatattttcatattacagttttgatagtgctcttcagtctgtgaaatctttgggtggaaatgatgaactgtcagctactttcttagaaatgaaaggacatttctacatgcatgctggttctctgcttttgaagatgggtcagcatagtagtaatgttcaatggcgagctctttctgagctggctgcattgtgctatctcatagcatttcaggtaagtcttccacttgtaggagcaattgacatttcactgagtcttgatgtgtttgaaatgaaggtgtgctctggtatgtaatgacaatatgtgaacaaacctgtggaattaaagttgaaatagtcaatttgatacagtggaaaataactaagcatacacaatactggtgaggctggtgaaacagggatgttgaatgcactcttgttgaaagcctgcattgccatgatttgtttgtagacaaatttgaagagtttgatctttttactctgccatttttgggaacatgataaagatgtaatctcgtattatgggtaaagcttgattcagaaagatgtgttacttggacaaaatcttaataagtagatgtagggcaatggctttatagcctatgatagaagaatatgattgcaatttaacatgttaattgaaacacatgtatataacatttatgactgtattgtgtatatgtaacagtatatctattaatctttgaaaacataaaaccttttcttaatttttatttttttattttttttgagaccaagtctctctgtcaccaggctggagtgcagtggcgtgatctcggctcactgcagcctccacctcctgggttcaagtgattctcctgcctcagtctcccgagtagctgggactacaggcccgtgctaccacacccagctaattttttgtatttttaatagagatggcgtttcaccatgttggccaggatggtcgccatctcttgacctcgtgatctgcctgccttggtctcccaaagtgctgggattacaggcgcaagccactgcgcctggccttttttttttttttttttttttttttttgagatggaatcttgctctgtcgcccagtctggagtgcagtggcacgatctcggctccctgcaagctccacctcccgagttcacgccattttcctgcctcagcctcccgagtagctgggactacaggcacctgccagcatgcccagctaattttttttttgtacttttagtataagagacggggtttcactgtgttagccaggatggtctcaatctcctgacctagtcatccacctgcctcggcctcccaaagtgctgggattacaggcgtgagccaccacacccagcctttttttttttttttttttttaatgagcttgcataacttttgaaaggaaaagaaataagtagtcttccaaaaaagcattaaaccacgcttagaaaaatgattgttaattttagagaaggattttttgcttggggagggaaaaaaaggattcattacttttagagaaggcgcctccttctaatataaatctttttttctttttgagacggggttttgctcttgttgcccaggctggagtgcagtggcgcgatctggctcactgcaacctctgccttcccgggttcaagcgattgtcctgcttcagcctcccgagtagctgggattacaggcatgcgccaccacgcccgtctaattttgtatttttagtagagacggggtttctccatgttggtcaggctgatctcgaactcctgacctcaggtgatcttcgcgcctcagcctctccaagtgctgggattacaggcagtgagccaccatgccctgcctaatataaatctttttatttttatttgagacggagtctcgctctgtcaccaggctggagtgcagtggcgcaatctcagctcactgcaacctgtgcctcctgggttcaagtgattctcctgcttcagcctgtcacgtatctgggattacaggcacacaccaccatgcctggctaattttttgtattttttaatagagacggggtttcaccatgttagccaggatggtctcgatcttctgacctcgcgatccacccgacttggcctctcaaagtgctgggattacaggcataagccaccgagcccggcctgtaaatcttttaaaaacaccgttgatagacagttcacatgttaagtgctaatatttgctcagtagaaacttctgtgttcataaggaattggattagtgaaaattaatggatttagtgaggttcactaggtaataccaacattaaaaggttcttatagaaattctcaagtaactgatagttcttatttttatttattttttttgagacggagtctcactctgttgcccaggctggagcacagtggcacgacctcggctcactgcaagctccacctcctgggttcacgccattctcctgcctcagcctcccgagtagctgggactacaggcacccaccaccacgcccagctaatttttttgtattttcagtagagatggggtttcaccatgttagccaggatggtctcgatctcctgacctcatgatccgcccaccttggcctcccaaagtgctggcattataggcgtgagccaccgcgccctgccaatagttcttatttttaatggaaactttaaaatttatctgtctgtgtgtctattagagtcttgctgtgtcacccgggctggagtgcagttgcataatcatagctcactgtaacgttgaactgggctcaagcttcccagagtgctgggattgtaggtgtgagctactatgcacagcctaaaattttttgatatgtagttttgggaggcagagtctcttgttgctctggctggagtgcagtggcatgatcatagctcactgcatcctcgaactcctgggctcaagtgatcctctcctgcttcagcctcagctcagtagctgggactacaggtgcctgccaccatgcctggctacattgttaaattttttgtaaagacaaggtcttgctatgtttcccaggctggttagtcttgaactcctggcttcaagtgatccttctgccttgccctcccaaagtgctgggattacaggtatgagccaccacacctgactgtgaacttttaataataaaaagttagtttccctcttaatccattcactcaggtctcctttcctagatgacaactactgttaggagtttcttgggtgttcagaaatattttttgcatatgcaaatgtgcaatacattctttctctgcttttaaaaaatattgtgcctcaatgtgggtgtgctttacctattgccagatgccttgcttttctaaatgtttcttcattgttccacttcagcacagagatacctacttcagtctttattaactaccacatatttctgtagaatgaatatataatagaaacatcttagatgcttgtattttattttatcagtttattttaaagcttaatgatcaaatgattataagcataaaatgtaggttatgtgctggcatttgggtatttaagaattggctaacttttatggcaagattttcagactcttaatcagaggaatactgtggttctagtaagtgcatctgcattgcagctaggtagttaacaaagtatcttgaaaccttttagttaagatgaggaaatagccaggcacggtggctcacgcctatgatcttagcactttgggaggctgaggcgggcggatcacttgaggtcaggagtttgagaccatcctgaccaacatggtcaaaccccatctctactaaaaatacaaaaattagccacgcatggtggcgggtgcctgtaatcccagctacttgagaggccgagacaggagaattgcttgaaaccaggaggcggaggttgcagtgagctgaaatcgtgccactgcagcactgcagcctggcgacagagcgagactccatctcaaaaaaaaaaaaaggaaatagtgaattgagatgatttgattgagtggattcacaactaattaactggtcacagattcaactgttgaataattttgtaaaagaggccgggtttatgaattgaggtcagtttcaaaacaaaaagaatgatgtcaacattttgtttcttattttgtgtgctcttttcaacatatagatgacaaagggctttgacatgatgtttagaaaacttgtgagtaaaaggataggcaatatgaatatttctaaaattcaaaatcagaagcttttaggttcataaatcatatattttgaaaaatgaacatgtttggaaagaattatatatacatggtttaaaattctggcggctcttaagaatatgctatgaagactcctttctgttccctagttatttactttctccacctccaaagaaactaatgttattgctttcttgtgtgttcttcaggaaatgttttatgcatctccaagtaaacacatatatatctcctgtctttaaaagaaggaggaaaacatttgaacattgcatttactttatttccattaactgtatcttggagatgtttccatgtcagtatatataaagggcattctcattagtttggatgcttgcatattattccattgtatggatgtactgtagttttggagtttttaaaaccagggtcctaaaaccaggacattagctggcttttacttttttttttttttaatgctacttcaagtaatttagcaatgattaacttgtgccatgaattcctgaaagaattgcagtatcaaagtatatctgtgcatttataatttttagagctgttgccaaatatctaaccctaaagaggttgtatcaaattacatttccaccaccaattaagaaagtggtgatagaattaaaagccgatgctctagtcacccatatagttacttttggcatgtttctagtaagtgggcattgcctatgactggacgttttcagtgatggacattcattacttttcaagatagcccagtgcatctttaggtggtttggctcttggtacttccttatatagaataaaaatattcttcaagccttctacctgttggtcttgtttcttcttttgatgatttcttttataaaataattttaatatttgaaggcagctgtcacgtcttccctttgccattctattcatcatgctttttttttttcataggttattgcatgaggatctctttaatttcctggttgtcccatttattccagtgctatcccatattatccatactctgaaaatgtgttatctacaatgtggcatttccaagtgtcatttcacctgtactttttaaagtagggtgtcatatctactcaaataggacaacatctgctgttgtcctatttatgcagggtcgaaaagtaatgtaattaaattttccatttctctgaatgtaacatgaatgtgcttttagtagaaactaatttctcagagttgctctgtgtatgcttttttttttttttctttttttggagatagggtctcactctgtcgcccaagctggagcacagtggcatgatcatggctcactgcagccttgacctcctggatttaagtgatcctcctgcctcagcctcctgagtagctgggaccacaggtgtgggccaccatgcctggctaattaaaaaaaacattttttagagatagggtctcaccgtgttgttcaggctgttcttgaactctgggctcaagcgatccccccaccttggccttccaaagtgctgggattacaggtgtgagccaccatgtctggcccttttttttttttttttttttttgcgatggagcctcgctctttcacccaggctggagtgcaatggcgcagtctcagcccactacaacctctgcctcccaggttcaaactatccttgtgcctcagccttccatgtagctggaattaataggtgtgtgccaccacgcctggctctttgttttttttttattatttttagtagagactgggtttcaccatgttggccaggctggtctcgaactcctgacctcaagtgatcagcccaccttggcctcccagagtgttgggattacaggtgtgagccaccacgcctgtacctggcctatctttcataggttatataaattccttggttcccagtttttgcagtcttttccaattcagtttaattaatggttaactgtttattcattatcaaaaaaagtacagtgtaatagataagaccatgttactattagaagtatgggtatcatcaaattaagatttttgattctaaaattattaggttccaagaccaaagattaaattaataaaaggtgaagctggacaaaatctgctggaaatgatggcctgtgaccgactgagccaatcaggtaatagtaatattaaactaatttaatttaaaaagaaaaaggaatttctgttaaggcatatcttatgataaaatcttcatctgtccaggagataatttgtcaaaattatttctttttgccgtatcagttaagagcaataggtatggaagagatgtgaaaaatagcacattctttaaaaaaatgaatatttgatattgtttgttcctaggtggagaggatttcttaactctttctttatctggctgctagagcctctatcctgaatatttagtcacttcctgaactaagtataattattggtttgccaaccatttaacaccagctgattctaaaaacactgctgtggggatataaagatgaagaagatacggatctgtcttaaagagctgagagcgtagggaggaagatagaagatatatacttaccttatattaggctcttggaatttgtggattttttcccccatttttggcttgggataaatcctaaaggtctgttgcgtattacctgtgattttgctaagatacaaactttaaggtagttaggtggccattgaatcaagcagtgaactgaagaaacataatgctttctataaggagcagttttgatataaaattggatgaattttgtaaagagcaagatgtaatattaaatcaaagttattataagctttggtgtatagttaggctgttggccagagctcacattgctcttttattccatagctcacttttttttgtgggagttaggctttcagtccttaaagtgactttctacttttttccttttctcttttccttctacccttgcagggctctcataagtgcctttgcgtggtgtcacagttagataaaaattgcctgtattttttttaatgtctttgatctgggcatcccgagggtgcctctgtaagtgtgctgagacacaactgtgtagtggtaaccaaacctaattgcccagcagaattaactcgaaggagggtttttaaaaaaagttcaattgaaatataattcatataccatacgcttcacccatttaaagtgtacggttcagtggcttttagtatgttcatagagtattaccactgtcaccacagtcagttttagaagattttcatcactccatgaggaattccttacctattagcagttacttcccattttacccaaacctctcagccttggcaactgctaatctgtctctgtaggtttgcctcttctgaacatttcacataaatggaatcatatagtatgtggtcttttgtgactggcttctttcatttagcaaggttttcaaggttcatctgtgttatagcatgtatcagtactttatccgagactatgattttttgattgcttactgtaaacctatggaataaaaaactctgggaacgaggcctggaaataattcttttttttttttttcctgagacagagtcttactctgtcgcccgggctggagtgcagtggcgtgatctcggctcactgcaagctccacctcctgggttcatgccattctcctccctcagcctccccagtagctgggactacaggcgccagccaccagggccggctaattttttttttttttttttttgtatttttagtagagatggagtttcactgtgttagccaggatggtcttgatctcctgacctcattatccacccagcttggcctcccaaagtgctgggattacaggcatgagccaccgtgcccagccggaaataattcttaaaagctgtttaaaggaggattctgatcagccaggttcagaaatcagtgtatcagatcagagaataagagtttgtccctgttctcctatggccacttaaatccagaccttttcatctgaaatgcaaatatgtttggcatttttcatacacattcctgtcttttttcccccttctgctgtcttatgtagatactgagaatattaaacctgtactcttctcatttgctacataagcaccggttttgttgtccagctgtattttttgggttggagggttaggtatgcagtaatcatgttatttcccctttgggtatacaaatgagacaacgtgagcaaatacaatctgtaattttaaagtgatggaaataacttaaatttttttttcagggcacatgttgctaaacttaagtcgtggcaagcaagattttttaaaagagattgttgaaacttttgccaacaaaagcgggcagtctgcattatatgatgctctgttttctagtcagtcacctaaggatacatcttttcttggtagcgatgatattggaaacattgatgtacgagaaccagagcttgaagatttgactagatacgatgttggtaagttatatgtttcagaggaaatggtctccgtcttaattcttataaattgcccataatcttattacccagaaataacgacttaatattttcctgtattccttttgtgtgtgggttgggctggggggagtttgaatgtggtgctgtgggggtggcatgtattttttgttgttgttgttgtttttaagaccaagttttgctcttgtcgcccatgctggagtgcagtggtgcgatctcggctcactgtaacctctgcctcccaggttcaagtgattctgctgcctcagtctcccaagtagcgggattacaaatgcccgccatcacgcccggctaattttttgtatttttagtagagacggggtttcatcatgttggtcaggctggtctcaaactcctgacctcaggtgatccacctgccttggcctcccaaagtgctgggattacaggtgtgagccactgcgaccagccttgttgtattttgagacagggtctcgctgtgtcacctgggctggagtgtagtggcatgatcgtaggtcactgataccttgaacttctgggctcaagggattctcttgcctcagcctcctgagtagctggtaccataggcacatgccactcggcccagataatttttttttttaattggtagagacagggtctccctttgttgcccaggctagtcttgaactcctaggctcaagtgatcctcctacctaagcccccaaagtgttgggattaggcctggcacagtggctcatatctgtaatcccagcactttgggaggccgaggcaggcagatcacctgagatcaggagttcgagaccatcctggccaacatggtgaaaccccgtctctactaaaaatacaaaaattatccgggggtggtggcatgtgcctgtagtcctactcaggaggctgaggcaggggaatcgcttcaacccgggaggcggaggttgcagtgagccaagatcacactgctgcacgacagcctgggcgacagagcgagacttcgtctcaaaaacaaaaagtgttggaattataggcatgagccactgcatctggccatatttttcatctaaatggttgtttatgtatgatttatcttgcttccttcatgaattctctcccacagtctctgtattaaaactataaatatcacttttattggcaatataatcttttttatgaagtagtcataatttgcttgctactttctgttattgggcatccaagttttctcaacttttccactgttaataatcatactctgataaaaacttcaacaaaaagtgtcttcattgcaagttatttccatagagatacctaaaaacagaattagagacaaaggccatgaacatctttaagtcttgcaaattgccaaaatgacagaaagattatacctctttatgcttccagaagcacataaccttttcttttcttttcttttcttttcttttcttttcttttcttttctttgagacagagtctcgctctgtcacccaggctggagtgcagtggcgcaatctcggctcactgcaacttccgcctgccaggttcaagcaattgtcttgcctcagcctcccaagtagctgggactataggcacgtgacaccatgctcggctaattttttgtgtttttagtagagacggagtttcaccatgctggccaggctggtctcgaactcctgactgcgcagaaccttttcaatattgactttcttgtagaaaaacagatttctttactgtaccgatggattaatatagtggtgttccattgctttaatgacttaaaggaaaacccatcgttttggggtttcttattaggttaggtgttctttatttggcttttgtcagttgattttggtttattgagttctagtcagtgtcattttttaagatggacttaaacattcttcatcactactatttttattaaaatttctagaaataatcaagtgagaatgcatttaataagaacatgagattttgcctaacatagaattcccttcagctttgatatagaaaagcagttatataattaagatatatataatgtgaattgtttatgttggcaaaactaatggcacaaggaaaaatttcaaacccttaagccaattttttaattttatttcaggtgctattcgagcacataatggtagtcttcagcaccttacttggcttggcttacagtggaattcattgcctgctttacctggaatccgaaaatggctaaaacagcttttccatcatttgccccatgaaacctcaaggcttgaaacaaatgcacctgaatcaatatgtattttagatcttgaagtaagcaaagattttaacaaattaaatattctgaattttgtttaattttttttctaacttaacttttccttaaataaaacaggtatttctccttggagtagtatataccagccacttacaattaaaggagaaatgtaattctcaccacagctcctatcagccgttatgcctgccccttcctgtgtgtaaacagctttgtacagaaagacaaaaatcttggtgggatgcggtttgtactctgattcacagaaaagcagtgtaagtagtaaaacaaaaatattgctttcacttagtgcgtaggttttaccggggatttaatcctcatgtgaagatttaatttgtcatgtgacccattaacatatatgtatgtaagccctgaactgtgtatttagaaagcaattttagtaaattgaactattttttagacctggaaacgtagcaaaattgagacttctagttcagcatgaaataaacactctaagagcccaggaaaaacatggccttcaacctgctctgcttgtacattgggcagaatgccttcagaaaacggtgagttttaaagtataagcatttttaaagaacattaccttaattttttaaaatcatgaactttttattgaaagtttttttgttctgaaaacagcagcttggtcacattatgacagatgtgttttttattgctgcaaaatagttaatgtagttaaatataagcacttagaggagcaatgcctggcacacagtgaatgttacatattagctgagctgttactgttattccttaataattaagttctgataattattcagcctgaaaattaaaaaaaaaaattagcacaaggctttgtaggtaagaccattatagatctttctatatacttaaggtgtgttttgtgtcaccatgaggtgtagatggtcagccttttgaacaaactgacactacagaagaggcaggtttcagctatctaaaaatggcaactgttaaaaagtagtttggattgctacgttaggatggtatcattagaagcgtttaaaagttgagtgtagaggccgggtgcggtggctcacacctgtaatcccagcacgttaggaggccgaggcgggcagatcacaaggtcaggagatcgagatcattcctggctaacacggtgaaaccccgtctctactaaaaatacaaaaaaaaaaaaaaaaaaagaaaaaattagccgggcgtggtggcaggcatctgtagtcccagctacttgggaggctgaggcaagagaatggtgtgaacccaggaggcggagcttgcagtgagccgagatcacgccactgcactccagcctgggctacagagcaagactctgtctcaaaaaaaaaaaaaagttgagtgtagaatgatcactggtgttaaggtggtttagttattacagtatttggaagttgaacaaatgactattgagataccatttggttttgacttgaaattttagccagttctttcaacttgtaaatgaactttagatctaatcatgcgtgttccttaaagttgtgtgcttttaactttcttttttagggcagcggtcttaattctttttatgatcaacgagaatacatagggagaagtgttcattattggaagaaagttttgccattgttgaagataataaaaaagaagaacagtattcctgaacctattgatcctctgtttaaacattttcatagtgtagacattcaggtaacagagttcctttatgaatttattggagatgggaatttccagtttataaacaaagacatagagctatacactgcttaaattaattgccttgttatttaatggtaatcttgttttctaaattcactagctctcacacataagatatgacagagaagaataatgagatgtttgtctcttaagatcatataaaatctttggaaaatcatttgggttttatattctgagtataaacaatttgactaaaaactattctgtgtgtttaggcatcagaaattgttgaatatgaagaagacgcacacataacttttgctatattggatgcagtaaatggaaatatagaagatgctgtgactgcttttgaatctataaaaagtgttgtttcttattggaatcttgcactggtaagtagatgcagtacttgagctaaaagttttatttatttatttattatttttttaaaagacggggtttctctgttggtcgggctagagtgcagtggcacaatcttggctcactgcaacctctgcttcccaggctcaagcgattcttgtgcctcagctcccgagtagctgggattacaggcatgagccaccatgcgtggccaagctaaaagttttttgttttaaaaacctaatgatttcataaaagcactatttgtatagatttttcacaggaaggcagaagacattgaaaatgatgccctttctcctgaagaacaagaagaatgcaaaaattatctgagaaagaccagggactacctaataaagattatagatgacagtgattcaaatctttcagtggtcaagaaagtaagtagcaggttgttgtatgtacgttcttactgataacccactggtcaatgtttttgcgttggtcttatattttggtaatttcaaaaatactcagtaatatgttgttattaatgcacagaagggatatgtgtgtctaaatgcttatatttgcttgctttgtcttaggtttggtgtgtctttttaaacttgggaatctaggtatatgctcttaaaaagtacttcttggggaattagaaaagatttctaagataagacattgattttgttatcttagcagtgtaatcaaaacaaatattataacctcaggactaattcttaatgaactttgctgaaattgaaagttgttgctgacaacttaagagcatttcttctcatcctcatcagccattgtgaacgcccttgttttcttgctgtcagctgtttgagattgtcatgatgatgttaaattatgttcagtcttctgagtgttttgttgattaatttgtgttactactcttttattaggatttatgttgtctggtgtattgtagcatctgtatttctgtcaccattgaaaatcagttagaaaacatcagtaacttattttgttcacttggaaaagctttccaagttaacattcctctacaattatcatggttaacagaagtaatagaaagagcatggactttagaatcagaagatgttagattgtacaacacttttctgtgttcatgaagaaaaaaatataataaaggcaaaaaataataataatacaaaacaacagaaaaagaaaaaagataattaaaaaacactttcacgtgtattatttaaagtgtaaagtgcctattaaagtggcaaaaatgtaaataagataaaatatatcattttagagtttttacttttggaattttttgcaaatgaaagcccttaattaatgtcttttatttttagttgcctgtgcccctggagtctgtaaaagagatgcttaattcagtcatgcaggaactcgaagactatagtgaaggaggtcctctctataaaaatggttctttgcgaaatgcagattcagaaataaaacattctacaccgtctcctaccagatattcactatcaccaagtaaaagttacaaggtaaacaggaaagaatggaatcatttcattgtgaaattgtttctgttctaagtgttttaaatgctgttttgttatttttatttttttttagtattctcccaaaacaccacctcgatgggcagaagatcagaattctttactgaaaatgatttgccaacaagtagaggccattaaggtaagtcacttaatttctctagctgtactttttattccaagattccttccctggccactctctcactttttttctgaagctggtcagaatgtccccttgccatccaaatagtatggcaaggggacattttggtctttttttttttttttaagacagggtcttgttctgttgtgcaggctggagtacagtggtatgatcacagcttactgtggcttcgacctcctagctcaagagaggctcttggctcagcctgccacgaagccaggactacagacagtcacacgccaccaggcccagctaattgttgtattttttatagagatgggattttgccatgttgcccagggtggccttgaactcctggctcaaagaatcctcctgcttcagcctcccaaagtgctgggattgcaggtgtgagccactgtgcccagcctacatacctcggtcttgaccctttaccatattttgttttgttttgttttgagatggagtctcactctgttgcccagtctggagtgcagtggtgcgatcttggctcactgcaacctccacctcccaggttcaagcgactctcctgcctcagcctcctgagtagctgggattacaggcacccgccaccaggcccagctaatttttgtatgtttagtagacacagagtttcaccatgttggccaagctgtttttgaacttctgacctcaggtgatctgcccgccttggcctcccaaagtgctgggattacaggtgtaaacccccgagcccagccctttaccgtatttttgaaagtactttatgtgtctctctcttcatcttccacaaaatttgagaccttcaaaggtagaaactgttttatttaaaatataagagttcgtggcacagagaaggttcctgagtgattgaactgctaccatgtactaatcatactctggtctatgagttcattcccagattagctgtggattacatgtgtttcaaatgtatagctaggaattgaaaagtggtctgagcttcaaaaagtcttactatattttaatacttccatatgaatttgacttcattatgtaaggaaatagttatgtatatatatcttattttaacaatagggttcaaaggagcttgacttttttggaattggaaataaaagtaggttctttcatgtttatcaggcaagaactaaattactcatactgctaaggttacatcaaggatatgctgatgtgtggcgattattacagtgtgatcagcagtatttgcaacttaagagaatactgtgtggtggggaagacatttttgaatttgcacaaaaattttgaatgttaattctgtgtagtcatggcctatgacaattacatacaattttgacttaacatacaggtttcaggctcccaacattgtattctgtggaagtatcgtggagcactaatccatgagcttgaaaagcttggtactagtactgactctgccattaattaatgatcttgggccagtcacttccattgtgactgtttggcttcttatctttaaaatgagagaattactgaagccagttctcatcacactgaatgttaaaaattacagttacagcagtgattgcaaattcaaagctctggtgcggataccaacagtgaccataaagttttctaggtgattccactagtttcttattggatgtgtatgtgtagcatctggactaggcactgtagatggatgagtgggggaaattttatttagcttgaaaattgagatagttttggacctcatggttaggtctttctgggaaatttttaattgaaacacttgtagaaaaagaaagcagacatgctagatctgtccctgacctcacttgttagaactggtcggattcctgggctgatacagagaagtttgaaacttttcaaaatttacctgttttctgataccactacaatttctttggaaaaagaatttcctgttaagtgtctgttttgtaaggggacattttgtaggttctagggttgggtatggtgctgtcatttagttttcttcagcagagatgaggtagccacatagctacactagacggcattgtatctatctgccatcttgtcaaggcagcagagttgtgttaagaaaacatttttggagtcagatctggttcaaattccagctgttattccctgcatccgtttctctcattttaagataggagctaatattgtttacctaacagtgtagatagtataaaaattaagagtttaagtgcattggacgtattattatatacataataaattctctgcagctactacttttttccctttcctggtggagcatttgaacatcaccttgagaattagttgtattttgtttcagcatggggttaagtgaaaagctaatttggggaggtaacgcggaatgtcaggtagtccagattgcagtgcagaaagaacacactgaaaggatggtcagtgtaatgttagaggactgtgaaagttgaggaaagaagtttagtttgtagatacttgtttttttgagcagggaattgtcttggctggaggtgaacgtcagaaaggttaatgtaggcaagtgtagaatggaaatgaaggtgtgatcatttaggaggttatttgtttaggtgagagttaataaattaggttttgtattaataaatgaaaatgggagcagataaatttttaacaaattaagaatcatattttaaaatcagcaccaggtacctagaactcactggcaaatagaaactttcaaaagatataatcaggtccgggcgtggtgggtcacacctataatcccagcactttgggaggctgaggtggtgggtcacttgaggtcaggagttcaagactagcctggcaaacatggtgaaaccccatctctactattacacaaaaaattagccaggcgtgctggctgacgcctgtaatccgagctactcagggcgctgaagtgggagaattgcttgagcccaggaggtggaggttgcggtgagccaagattgtgccattgcactccagcctggacgacagatcgagacaccatctcaaaaaaaaaaaaaaaaatcagttatttaaatttaaaagagtaagtttccccagcactgtttctgtcatgatataattaaatgtttaaaattatttgatttttttttcttccaatagaaagaaatgcaggagttgaaactaaatagcagtaactcagcatcccctcatcgttggcccacagagaattatggaccagactcagtgcctgatggatatcaggggtcacagacatttcatggggctccactaacaggtgagctggcaagtggataatcgcatattttagtaaaactactttacttccctcttttaagtagataacgtgtgaaatcaccttgtttatatatgtttgttaatatacatgtcaacgtctgtttatatgtgacttcaaaagctgtatttggtgttacggagatttttataatcccaagcagaaaaaacgagccgtatgtgatcacgtgtatataaaggcttaaagaacacttaatccacacctcagatgagctgagatgagattattccttaaattgaaaaatgttaatgaatagagttatgcactaagaaatgcttaattaagaacctacacctctggggaattattttgatgataatgatgagaggcaggacgttatataggaaatcttacttaatttgaaatattatggttatataaagaaagaaaaggagtttggacctgaatcatactgggtttttaagttctgctctatcacttactataatagctgtgtaagataacctgtctgaaacgtggagataatacttgccttacataattactatgagcatttgtgtatgtgcaggtgggcgtgggtgtgtatcagacatttattagagtatacagtaaacagttaatgaactaaggttactaatagtgtttactgtgggttggctatgtgcaaaagtgctttgtgaatgtaattttatttaattacagtaacttagaatggccggtaccattattaatcccttttttataaataaggaaattaaagaaaggttaggtaacttactcattattatacagctagttattgatagagctgagattcacactccggtggtgtaactccaaagcacttgccagtataatacattgctcccaggcagcgagaaataacaaaattgttccttttacgtacgacagacttctgaaatggtagtagtagtagtgccctttttttttctctttttagcccaggaaagatttagaataaaatctagtttagatgagcacatttgtgtgatggttcatatagttaaggcaaccccactagccttttgtgatagtatcttctcaacacaagcaaaataacagaaaatctttgtgaaatcaagcttattaaatgtcataagtcatagataagtatatgaaatgtctaacgttcaaaccttgttttcttaaaaccttacacatcatataggtccttgtaagaggataaacaaaccggctagcctttcctggggcttttttagtgatgtgtgcagtcagttatttggtgccttgtgggtcatgatttccatttcttctgtgtacaggcataaaagatcttctgttcttatacaagcatgtaaatccaacattctcattgtctcattttattcttgcaatgaccctgtgaaatgtgtagaagcagcacatcctcattttacaattgagaaacatggagactccaaatggattatttacaggttcacaaaacagctttgtggcactgaaagggcgagagccaagatctcctgatttctgttcctgtgttcatagattctttttccttaataaaagtaaacatatatcaagatggtccttgttttttaaaaataagatgattaaaattaaagattaatgagctcataggagatactcagaagtactgaacagggtgaagaaaactaaaagctaaccaccttattaacatttcctatatttgagagcatttccttctagttctttctctatacatatagtattttttatgagattgttaccatgttactatgttgtgtgtagatgagctagcctgttttttaaatgttactttagttctgagcatttttaaacttaaatgttttttgaacattaatgagttcatggtatcccatcacatggaagtactgtaaattctgttcctttatttatgttgtttctggtttatgccattacaaattctaggacactgtcctagttttatagggtattcagaatattcagtttatgctcttaccactagtatctgatagtgccattttcgcactttgctaatgctgacttactggtttataaaatcctttgccaatttgtaggaacaaaagtgatatcaatttttaagtttttttaatactagtcatggtcaacaattcatgcaaatggcagttggtagttttgccatcttcaacgtgggtacctcccagttgtttggtttcttggtaaaactcacacaaaacagatggagaagagtttgtatatcaacatgaatgttaatgtgatttttttaaagcccgcgaacacatttgtgttccttgtgatctcctttgcatgaatttgtcaggtaatttttttgacctgaacattctcataatagcttcagtttgcccaatgcaacctcatcattttgcggatttttcaaggctcacttcaaaaacatgttccttgaggcctattaacatttctttcctaaattgtctattcatatggtgcttttaaaagttagattacttttagtagatttattagagccgcacagtttagagtcagtagtcaattaaagtccctacttaaacttcagactaagattttttttttatttaatattttattttttctttttgctttcatgcagacagacatcttgcaagactttaagattcttgggccatttctgtcaggttgttctgtgttctgtgcctgcttcctccccatagtaatttcaaaatagctatcctcacctctgtaaggtttccaaaatcaaacttgggcttctggctagccttttctaggtcttgatttttcagtgctttccagaggcaattgtttggaacctcttggcacagtttctgtttctttttccatgtacaggcataaaaggtcttttggttgttttctggtaaaactatcataaaacagttcaagcaaatgactattggtagttttgccattaacatgggtgccttctagtcattttgtttcctggtaaaacacacaaaacagagggagcagacagtttgtacatcagcatgagtgttgatgtgctttttattttaagccagggaacacattttatgttatttatgacatcctgtccatgaatttgtcaggtgatttttgagctgaacattctcagtaatagctttagtttacaaaatacaacctagtctttctgcagattttctaggcccacttcaaatgcattgaccatcagatggcatcttggttccttacgtcctttctgtgactgaatgtccataattccacatcatactgatctttcttagaaaaggcaacagttactttcttctttattccttttttaatgcttgtgaggtagttgttcttgttgatcacagcaatgctattctcttattcttcatgtcatatttagcagtttttttctagtttgtcatttgataatcttgattggtgtattttgatgtacagaaatttaaaatttatgtagttaaatctttctttaatttctattgcctttgtatttatagctcttgcctagatagtcttaactgtagtatagactttaacagtgttttctttattttctttttgtttttttagttgcaactactggcccttcagtatattatagtcagtcaccagcatataattcccagtatcttctcagaccagcagctaatgttactcccacaaaggtaacaaaggaataatttatacatttataattatttcctttttaaattgtttagggttccttcaaataaattcaagagagcagttcactattaaaacttttatgtcccttaaaatgtagatattttaaatttatctccaaatacagaaattatccttcttagtcaccttatttttgtgttaataagtgtgaatatttagaatattttaaaaatgggagtggtggtggtggatccttcatcgttctgttttaacagaaatagaactgtaatgcccttgctgacccactatgtggtaagtactttcaggcctgatacagctatatatataacaattgattgaagactcaatattacagtggtagttgaatgtgacagctttgaggacagagtgttggggtgcatttagacccttgctcttctgcttattttgaccacaggcaagtttcttaacctctcaatgcatcagttgcctcatatgtaaaatgaggataataataataccttaattcatagggtttttgaggatattaaaatgagataataatgtaaagtgcttagaacagtgcccagctggcacattaataaatgctcaataaatgttaccatcatcatcatcatcatcatcatcatcattaacatcatttgataaattaggaatgaagaaggtatttattttatgactttagctgtagattttaagatgctatacataattttcattatatgccaagtatatatgcaagtatctttgtagtaatgtggttttctcttaacctacttatgcctagtgctccattattggaacactaagcttatgggagttatttatatcctactgctcaaggtcattgccaaggtctgatttttcacacagaaaatttgcagcctctggcataaacgggttaatgatgtgtactacatcccctaatgagatcttcttcacttcatattcatgtttgaagtttgtgagaattggtttgcatttagttatctgtagttttgtagacaatctacaaaatgttttaactttctgtcttttagggcccagtctatggcatgaataggcttccaccccaacagcatatttatgcctatccgcaacagatgcacacaccgccagtgcaaagctcatctgcttgtatgttctctcaggagatgtatggtcctcctgcattgcgttttgagtctcctgcaacgggaattctatcgcccaggggtgatgattactttaattacaatgttcaacagacaagcacaaatccacctttgccagaaccaggatatttcacaaaacctccgattgcagctcatgcttcaagatctgcagaatctaagactatagaatttgggaaaactaattttgttcagcccatgccgggtgaaggattaaggccatctttgccaacacaagcacacacaacacagccaactccttttaaatttaactcaaatttcaaatcaaatgatggtgacttcacgttttcctcaccacaggttgtgacacagccccctcctgcagcttacagtaacagtgaaagccttttaggtctcctgacttcagataaacccttgcaaggagatggctatagtggagccaaaccaattcctggtggtcaaaccattgggcctcgaaatacattcaattttggaagcaaaaatgtgtctggaatttcatttacagaaaacatggggtcgagtcagcaaaagaattctggttttcggcgaagtgatgatatgtttactttccatggtccagggaaatcagtatttggaacacccactttagagacagcaaacaagaatcatgagacagatggaggaagtgcccatggggatgatgatgatgacggtcctcactttgagcctgtagtacctcttcctgataagattgaagtaaaaactggtgaggaagatgaagaagaattcttttgcaaccgcgcgaaattgtttcgtttcgatgtagaatccaaagaatggaaagaacgtgggattggcaatgtaaaaatactgaggcataaaacatctggtaaaattcgccttctaatgagacgagagcaagtattgaaaatctgtgcaaatcattacatcagtccagatatgaaattgacaccaaatgctggatcagacagatcttttgtatggcatgcccttgattatgcagatgagttgccaaaaccagaacaacttgctattaggttcaaaactcctgaggaagcagcactttttaaatgcaagtttgaagaagcccagagcattttaaaagccccaggaacaaatgtagccatggcgtcaaatcaggctgtcagaattgtaaaagaacccacaagtcatgataacaaggatatttgcaaatctgatgctggaaacctgaattttgaatttcaggttgcaaagaaagaagggtcttggtggcattgtaacagctgctcattaaagaatgcttcaactgctaagaaatgtgtatcatgccaaaatctaaacccaagcaataaagagctcgttggcccaccattagctgaaactgtttttactcctaaaaccagcccagagaatgttcaagatcgatttgcattggtgactccaaagaaagaaggtcactgggattgtagtatttgtttagtaagaaatgaacctactgtatctaggtgcattgcgtgtcagaatacaaaatctgctaacaaaagtggatcttcatttgttcatcaagcttcatttaaatttggccagggagatcttcctaaacctattaacagtgatttcagatctgttttttctacaaaggaaggacagtgggattgcagtgcatgtttggtacaaaatgaggggagctctacaaaatgtgctgcttgtcagaatccgagaaaacagagtctacctgctacttctattccaacacctgcctcttttaagtttggtacttcagagacaagtaaaactctaaaaagtggatttgaagacatgtttgctaagaaggaaggacagtgggattgcagttcatgcttagtgcgaaatgaagcaaatgctacaagatgtgttgcttgtcagaatccggataaaccaagtccatctacttctgttccagctcctgcctcttttaagtttggtacttcagagacaagcaaggctccaaagagcggatttgagggaatgttcactaagaaggagggacagtgggattgcagtgtgtgcttagtaagaaatgaagccagtgctaccaaatgtattgcttgtcagaatccaggtaaacaaaatcaaactacttctgcagtttcaacacctgcctcttcagagacaagcaaggctccaaagagcggatttgagggaatgttcactaagaaggagggacagtgggattgcagtgtgtgcttagtaagaaatgaagccagtgctaccaaatgtattgcttgtcagaatccaggtaaacaaaatcaaactacttctgcagtttcaacacctgcctcttcagagacaagcaaggctccaaagagcggatttgagggaatgttcactaagaaggaaggacagtgggattgcagtgtgtgcttagtaagaaatgaagccagtgctaccaaatgtattgcttgtcagtgtccaagtaaacaaaatcaaacaactgcaatttcaacacctgcctcttcggagataagcaaggctccaaagagtggatttgaaggaatgttcatcaggaaaggacagtgggattgtagtgtttgctgtgtacaaaatgagagttcttccttaaaatgtgtggcttgtgatgcctctaaaccaactcataaacctattgcagaagctccttcagctttcacactgggctcagaaatgaagttgcatgactcttctggaagtcaggtgggaacaggatttaaaagtaatttctcagaaaaagcttctaagtttggcaatacagagcaaggattcaaatttgggcatgtggatcaagaaaattcaccttcatttatgtttcagggttcttctaatacagaatttaagtcaaccaaagaaggattttccatccctgtgtctgctgatggatttaaatttggcatttcggaaccaggaaatcaagaaaagaaaagtgaaaagcctcttgaaaatggtactggcttccaggctcaggatattagtggccagaagaatggccgtggtgtgatttttggccaaacaagtagcacttttacatttgcagatcttgcaaaatcaacttcaggagaaggatttcagtttggcaaaaaagaccccaatttcaagggattttcaggtgctggagaaaaattattctcatcacaatacggtaaaatggccaataaagcaaacacttccggtgactttgagaaagatgatgatgcctataagactgaggacagcgatgacatccattttgaaccagtagttcaaatgcccgaaaaagtagaacttgtaacaggagaagaagatgaaaaagttctgtattcacagcgggtaaaactatttagatttgatgctgaggtaagtcagtggaaagaaaggggcttggggaacttaaaaattctcaaaaacgaggtcaatggcaaactaagaatgctgatgcgaagagaacaagtactaaaagtgtgtgctaatcattggataacgactacgatgaacctgaagcctctctctggatcagatagagcatggatgtggttagccagtgatttctctgatggtgatgccaaactagagcagttggcagcaaaatttaaaacaccagagctggctgaagaattcaagcagaaatttgaggaatgccagcggcttctgttagacataccacttcaaactccccataaacttgtagatactggcagagctgccaagttaatacagagagctgaagaaatgaagagtggactgaaagatttcaaaacatttttgacaaatgatcaaacaaaagtcactgaggaagaaaataagggttcaggtacaggtgcggccggtgcctcagacacaacaataaaacccaatcctgaaaacactgggcccacattagaatgggataactatgatttaagggaagatgctttggatgatagtgtcagtagtagctcagtacatgcttctccattggcaagtagccctgtgagaaaaaatcttttccgttttggtgagtcaacaacaggatttaacttcagttttaaatctgctttgagtccatctaagtctcctgccaagttgaatcagagtgggacttcagttggcactgatgaagaatctgatgttactcaagaagaagagagagatggacagtactttgaacctgttgttcctttacctgatctagttgaagtatccagtggtgaggaaaatgaacaagttgtttttagtcacagggcaaaactctacagatatgataaagatgttggtcaatggaaagaaaggggcattggtgatataaagattttacagaattatgataataagcaagttcgtatagtgatgagaagggaccaagtattaaaactttgtgccaatcacagaataactccagacatgactttgcaaaatatgaaagggacagaaagagtatggttgtggactgcatgtgattttgcagatggagaaagaaaagtagagcatttagctgttcgttttaaactacaggatgttgcagactcgtttaagaaaatttttgatgaagcaaaaacagcccaggaaaaagattctttgataacacctcatgtttctcggtcaagcactcccagagagtcaccatgtggcaaaattgctgtagctgtattagaagaaaccacaagagagaggacagatgttattcagggtgatgatgtagcagatgcaacttcagaagttgaagtgtctagcacatctgaaacaacaccaaaagcagtggtttctcctccaaagtttgtatttggttcagagtctgttaaaagcatttttagtagtgaaaaatcaaaaccatttgcattcggcaacagttcagccactgggtctttgtttggatttagttttaatgcacctttgaaaagtaacaatagtgaaactagttcagtagcccagagtggatctgaaagcaaagtggaacctaaaaaatgtgaactgtcaaagaactctgatatcgaacagtcttcagatagcaaagtcaaaaatctctttgcttcctttccaacggaagaatcttcaatcaactacacatttaaaacaccagaaaagggtaagtactttgttgttaaagttaagcacaatttttctttcttttaatgtttagcttgatgcagactctttgtaggatactaatgttgggatataaatgatgctttgtgaacacccccaaaatatttgagcaattttttttctcccttaataagttcacggtgaggtttcaaagagcaagagaacttagtttaagacatttcagtaactggaagatacttttatcatgctagggcagagcaaaagaactcggtacggtatacggactcatgcttgaatcatgcacattaacgtgagtctttttttaaagtgttcattttcatttgttcagtttcttttgtcactcagaaaacatgatattgaggctgggcacggtggctcactcctagaatgccagcactttgggaggttgaggtgggcagatcacttgagctcaagagttcgagaccagcctggccagcatggtgaaaccctgtttctactgaaaatacaaaaatgagccgggcgtcgtggtgcgtgcctataattagcagctacttaggaggctgaggcaggaggatcacttgagcacaggagatggaggtagcagtgagctgaaatcatgccactgcactccagcctgactgagtgactgagactttgtctccaaaaaaaaaaaaacaacgtgatattgagatgttctcattttatatgttgtatgtcagtcttgctcatgtattaaatgagcaaagaatgaaactacagggataaatgaatatgtaagacaatcagattggtggtataaattgagggattctggctttttatgttttaaaagcatattcattttgtttcctaaaatgttaaaaaacgaaatattctttattttctaggatttaattttagcctttttaaatctaatcccatggccttttggactagcaccccttcctcacagcctgagagcaaaggtatagaactagcattctcagtatgagataacagcagtttttagcagctgggtagcccttagcaaagtattaataactgtggctgtatgaaatgaagtacttaccactacaacatgcatgttaaagaatgccagtttaagcaaagtaccttttgactggtggcatgacacccttgttggtttgttttttaaaatgtactgggatgctgatttgtaatgtacttcattgctctgctatttcaggtctgctcaatgaagacctatgttttatctaatgtttatgtttagccactaacgtctgccagtattcaaatgtagtggcaacggcatgtatacaatatggaagagtgtccctgtagggctgttcttttgtgcatggtttagaaaaatgttgtatttgaaaatggaccccgtttttaacagccagcattctacagcttgcatattatatatgttgcaccgatcaattttagaagtgtggctactagagtggaacaagaagtgggatctgttgaaggccttcaagaacaggttagggaagtgaaatctcacccttagtgaccagtaacacatcttagccatgccaaacaagtacaatgataaagtagcaatctctgatttttttttttaagtataccagttttattactagctaaggtagctcttaatcttttatttttaaagatacggtctttgagaaatgtgaaaagtgttaacttaaaagtggatgtatacttgcgtacagtttctgtgagctctaggttaggaatccctgacctaagaatgaatgtgcctatatactactgtagaacatagagccttattttgttttgaatctgataatgtcattgtcccaagggaccttagaaatgaagactttagacatgagtaaactgaggccaagagaggctatctgatttacccaaggtgtctttactgagtaatagcagaagtggaacaagaatctgtatcttacggtgtactgttatttctcctagctagaaaatgatactaagtttttgtttataatgaaggagagggacaaatttaacattgtaaaaggaagggcactggttctgcagagcagtgtcatccagtagaaataaaatataacctgtgtatgtaatttaaaattgtcatttggtgcaatggcttgtgcctataatcccagttacttgggaggctgaggcagagggatcacttgagcccacaagttccaggctttagtgaactgtgatcacatcactgcactccagctctgggtgacaaagcaagactgcatctcaaataaataaataaataaataaattttctagtagccatattaaaaagaataaaaagaaacagttaaaaagggaaacagatgaaagtaactttattgatagatttgatttaacttatgtccaaaatatcattttaacttctaattaatataaaaattaatgatattttacattattgtttttcaccaagtcttcaaaatccagtgtgtgtgtttacacttactgttagcacgtcttgatttggactagccaccttgtgaggttttaatagaatgtggctaggctaccatattggacaccatagctctcagaatgtttccctatcactagttggtatacatggcatgcttcatgactggcttgctttattaaactcctttagccagaagttcagaacaggttgcatatagaagttttttctctttctaattttttgccctttgcattgatggtggctggggatgggttgtttttagccatatgaatggtcttagattttatagtgttagctacctatagagtcacagttgttatttaattttacttagtatcatgcttgaacataggcaaactagatgcaactctagtcaccttccattcttggcaattgttaactttccttacagaaactaatcacagttggctttggattagtttcatatgtatagtaatacttgcctatgttttaagatttttttcaattgctgcaaatgcatggatattttggtaaactattgtatgctaagtatagttaggcaacactttaaaatttttaacctttataaattctagaaatttatagtaattcttttcaatgactattaagtaaacacaaatttttttttgttttctttggttttaaatagattctgtgttcacttagggtttttggtagaacactaaatcaggatgctaattctagttcatgattatcatacatctctgcatcaaagtatatgtgttttttatcagtatgctgttttaacctatagataggttccatggtttttattttcagttagagtattaacgtcaatacttaataccttatctttgtcaatttttttgactggtgttacagcaaaagagaagaaaaaacctgaagattctccctcagatgatgatgttctcattgtatatgaactaactccaaccgctgagcagaaagcccttgcaaccaaacttaaacttcctccaactttcttctgctacaagaatagaccagattatgttagtgaagaagaggaggatggtaaaacttttgttatttcaaaaatcctctgttcccgctaatcttagtaaaattgggagtatggtttaattattttaagcctgcctcttagaacttatcactaatatccttgcaggtagatatttaccctaaatgtatgtgtaaatggtcaatggatatagtgatcaaaaggactgcaatcattaagcaagcattttttggatggctaatgtgccaggcacgtgttttgaggggatttaaaataattataattttgctggagtcttaaagatgtggaagagagagagaaggcggacaaggttccagtggaaaactttgtatgcagtaacagtttttaagctggacagttaaataaaagtctcaatagaatcagttggacagtggtatatagtattgggttatgggacaaggagatcggaagatgaactaaaatgagagcagctcaaacaagatgagaggctgagctaaagctctagcagaaagagaggtattaaagatataaaattggctgcaattcagatgtggagagtgagaaatggtgaagttggaggtagtccctaagcaaggaaaaccccccaaaattaactagaaattcttttaatcaattgtattttaagatgaagatttcgaaacagctgtcaagaaacttaatggaaaactatatttggatggctcagaaaaatgtagacccttggaagaaaatacagcaggtatgttaagtgtaaaggacatttataatgcttttaacaagtcttctatttagaaggaataacctagtctgataatttctataattatcgattttacgatgcccatggtgatttaaaaaacttaaaactaacaggtgaaaatattcttttctgggtggtccttgtttttcattagtatgtacaggtcttgttacctgggtctgtggattatgttgatgactaccattgttgtagagaagttgggcttcatctaatttcgtttgcttgtgttgtactgatttttcagataatgagaaagaatgtattattgtttgggaaaagaaaccaacagttgaagagaaggcaaaagcagatacgttaaaacttccacctacatttttttgtggagtctgtagtgatactgatgaagacaatggaaatggggaggactttcaatcagagcttcaaaaagttcaggaagctcaagtaagaacatctctaataaattttccttctagttccattgcctttgttgatgcagtaaactttagaatgttcttatttatttatttttgagacagaattttactcttgttgcccaggctggagtgcaatggcatgctcgtggctcaatgcagccttcatctcccaggttcaagtgaatctccttcctcagcctcccgagtagttgggattacaggtgcctgccaccacgcctggctaatttttgtatttttagtagagacgggatttcgccatgttgggccaggctggtctcgaactccggacctcaggtgatgcgcctgacctagaatgttcttaccaaataataataatgggttgtggctactaaatgggtttaagggtctagactaatcagctatggccaggaaagaaggaattttaattttgttctacacaggggctatatgccaaaagctacaaaacactgatgaaataaaaaatctaaattaatggaaaggtatatactgtttatggattggaaaactcaaaataactagaatatcaattttccgaaattgatctatagatttaacacaacaccagtcaaaacccctccaggaattttttttttttttggggggggatggagtttcgctctgtcgccaggctggagtgcagtggggcgatctctgctcgctgcaacctctgcctcccaggttcaagtgattctcctgcctcagcctcccaagcagctgggactacaggcatgcgccaccacgcccagctaatttttgtatttttttagtagagacagggtttcaccatgttgaccaggatggtctcaatctcttgacctcgtgatccacccaccttggcctcccaaagtgctgggattacaggcgtgagccaccgcgcctggccaggaattctttatggatgtacacaagtgaattctaaaatttctatggtaagaaaagattgtatatttgttacagttgatgaatctacattgacacatcatcacctaatgtttttacctttttgtcaaaaatttttaactattgatacaatcgtgatttttattaaatctgtgaatgacattgcattttcaaatgttcagaaaactaactttgcattccagcgtaaacctcacttggtcatggtacaattttgttatgtggttgcattcaatttgcataaatcttgttataaatttttgggtttatatttatcaggatactagtagttttctgatactgtctttggtttccatgtaagagtaatgctggttgggctcagtgatatgtgtgtgtagtcccagctatttgggaggctgagtaggaggattgctcgggagtccaggagttccaggctgcagtgcgctatgattgtgcctgtgtatagccactgctctccagcctggacaacaacatagtgagaccgcctcttaaaaaaatggtaatactggtatcataaaatgaattgagaagtattttctgtattgctgttttctggaagagacttggttgttgacttggtgccattttccctttaaatgttgagcagtttttaccaatgaaaccacgtctggagttttcttaagttttaaaaaacactattgatttctcttctttattatttccttcttgccttggattttgcactttttttctagtttcttttttttttttttggcttttgagacagtctcgctctgtctcccaggctggagtgcagtggcatgatctcagctcactgcaacctctgcctcctgggttcaagcaattctcatgtctcagccacccgagtatctgcgattataggcgtggctaatttttgtatttttagtagagacggggtttcaccatgttggtaaggctggtcttgaactcctgacttcaagtgttcctcctgacttggcctcccaaagtgctgggattgcaggcatgagccactgggcccggcctagtttcttaatttaaaaaaagcttaaattatgaatttaagatcattctttatttctagtataagtatttaattctataagtttccttctaagcacttcctagctgcaactggcaagttttaatatgtgatattttctctttcatgcagtttgaaatattttattttccttgagacgttctttttgatctgtacgttagatgctactgtgccatttccaaatatttggtgattttccttctgtatatcattctcttattgatttctagtttaattcctttatggtttatgaaaatattttgaataatttcagttctcttaaatgttgtgaggtctgtcttggtgaatgtcttctgtgcacttgagaagaaagtagagtctctttttttgctgacattgtgccattggcagttccagtttttttgggctgctgtagcacccaggctgggttacaggagtggcagaaaaactccgtgtggatcttaacctccagattatctctctggtcccaagatccttattcttcctgtttttatccacctttctaaggcttcttagaggtgctctgtatgtttcagtgtaggcatttagttataggttttgaggagagatagggtgaagtgtgtttattctatcttctccagaagcccaagttctcaattccctttgaaatagattatataatctgttttgtaaattagcatttaagtggcatagtattttgtgacttcctctttgcagaaatctcagacagaagaaataactagcacaactgacagtgtatatacaggtgggactgaagtgatggtaccttctttctgtaaatctgaagaacctgattctattaccaaatccattagttcaccatctgtttcctctgaaactatggacaaacctgtagatttgtcaactagaaaggaaattgatacagattctacaagccaaggtaaatcttgatatatgtttatcatgtgttacataagggacaccttatatttgagaagatagacttttaaaggctgatcctgaaaactccctttaaaacacattttgatatgtataaaggggcatcttagtagtagtagtaataataaccagaaaaattatactgtgttgccaacaaataaacatgtttttattgatagagttgtggttattagggaatacaaagcattatgattctgacctattttcctgagtttaaaagacaatagtgttgttacatgtaatttcctttgtgatagtgttttcatttaaatattgtttgaattatattatcactcaagcatattcaaagtgttttaattatgaaggaattgtagaaatattacggatttaagaaagttttatggtactacttaaatgtttcttattttctctaatacttttaaagcttgttaaattaattattcagttacagtaacatatttggtattgctttctctctttttcatttcgattttggggatggaagtgggaagtttaagttgtattgctttgtgtaccttacctactttttaaaaatagccttcagtgtcacaaatattacatttataggcatttgagagtcttaatgtgctaaaagaggaagacgacttcatacctaaaacctcatacattttcatatgaggaaaataaggcatggggctttcagagatcatgcagcttcacattagcagaattaagagaagaccgcaaaagtccttatgacgaagtgtaaatgagacatttggtttttatgagcttatttatagtacagaacacaaaaagtttttatacagatgtttcctaaaaccctgcctttgactgaatgcttgctttagagtatagtaggctccatagagcagaaactgtagtttaatatctggcttaatatagatagctctccttctcatttataaaaaataatttttggcatgcatttggtgtagtattgtagtattctttgtgaatagcacctgtaaaattagtaatactgaagtagctcagaattggatgtattttgtaacttgacagaatttaaataactcccctcatcccagagtatacaagtctctactgttctctctaggtcctggggtaaagctttgatattcagcacaaattaaatagtaaattgttctttttttcttttgccaggggaaagcaagatagtttcatttggatttggaagtagcacagggctctcatttgcagacttggcttccagtaattctggagattttgcttttggttctaaaggtaagatcaagaggagagacttttaatgacattgttacagaatcaagcacaactgaaaaactagttttttgttgcagtatataactaagttagaagtttcttcccttaccccccagtttgttttagtgttttaataatgaagggcttctacactttattttttgacgtcaatataatcttaagaattttctcttaattttatataagccatgctgatagtcctccccattctgaaatgcagaaccatttttgagctttggaatgactctgactttgatccttactcttttaactatactttcatatgtgatttgttaatatttcaggttttgtgagtttatactttttaaggatatgattttgtagttttcttttttgtactatctttggatttcagtattagggttgtgctaatttattgtgctaagtttataattggtgtgcttgcccatcttctttagtggagtttctatttttaatccattttggtaacatttctagaaaagaatccatttccctgattgtatccggtttactagtgtaaggccatccattatattttttcattcttgtaatatctttcacattgctctttatagcaccccttaaatagttctagtacaaggtgtttgatttatggaatacattttattgaggatatgtgcttaaatgattaatgcagttcagaattctgttctttcctcctctatatttgcacttttttcacagctcctgccacctagaaacacataaaacttttagaaattaccttcagatgtgatgttatgttggaattcatggcttcactgatgtcgtttatttttaatttatgaaatagcctgaaatcaaagggtaatgtgtcagtaaataagcaatatagtaggtacacttacacaaaaaaaatcccaaaaaaatagataggctccttgttactcagtgtagcctctttgaagtattatgtcaatattggacactaaagtgaaaagtaggcagtactcacatatcgggaggaaaccatgcctaaataagccttatgcattaacattcacttctcactaccacttgtcatttttattcaccaagctcttgtgtattgaatgcttactttagttaatttagattgtgcttgttaaaaatagtatttgaaactgtaaatgccttgcagtcagttttgtttgtatccacaggttttcatagggaatctttatacttttgtaaatttccagataatttagagtttcaatcttattttctctaatgtctcaaagcttgccaaattaattattcacttacagtaacattactgtaggcccagttatgacctgtgagacccagatattgatatattacaaatacttttacaagtgggtgattctaatgtgttcccagggtagagaaccactattttgaaataattttgaattcttctgccacatgtcccttggggttattttttaaatttttgcttttggcaaaaaagttgctgaacaattttgtttttgtttttgtttttgagacaggatgtcactctgttgcccaggctggagtgcagtggcatgaacacagctcactgctgccttgacctcctgggctctaaagcaatccttccacctcagcttcccaagtagctgggaccacaggtgtgtaccaccatgcctagctaatttttacattttttgtagagacaggggtctcactatgttacccaggctggtctcaaactcctgggctcaagcagtcctgccaccttggccttgcacagtgctgggattgtaggcatgagccactgcacctggccctgaacagttatttttgagcccccaagttggtatctcatccagatcagtggttactgttctcaggaagttcccatgcaacctgtggcttttgttctcagatcattcctttgcaatatgtccttaagaatttttgtctttctgtctcttttttttgagacgatcattctgttgcccaggctggagtgcagtggcgcagatctcagtttactgcaacctctgcttgctaggttcaagtgatctcctgcctcagcctcctgagtagctgggattacaggcatgcactgcaacaccccgctaattcttttagtatttttagtagagatggggtttcgccatgttggccaggcttgtctcgaactcctgacctcaagtgaccagcccgcctcggcctcctaaagtgctgggattacaggcatgagccaccacacccggccctctctcctctttaaaaacatttttttttcccctccattaaatctgtctgaaagagagttgattttttattgtgttctttaaggtactgagttatgtatcctgtgacattttttctttttcatgagagtttttagcagaaggtgtagggttctttaagacagtgattcagcaagtgataaaaagttgagaggtgtttctttcctctaagatagtggggacttggtcatctaaattgaggtatgggatggagaagtttctagttttcaccttcttgcaggtatgcgagagtgagaccatcattgttcccccatacagaagtaggatgcttaacaatctaataccctttgggcagttgaagtcagtgagattctcccaaggctgctttccaccagcccaaccaagaaatctacattccagcattagcttcttcaggaagaagtagagatgcagaaattataaacatgtttaggccattgtggctaatttggaagtagcaggtttggcctgctgagctaagtttacaaaatttcaaggtgggtacttgaaattttagaagtaggtaaaaagaacctacttctttacttggaagtccttgtgtagtttagtattaggaagtttatccaaggcagtgacagtcttatctttgtatcgctaagcataacaataataaatgtactctgtactcaacagtatgagttgaatttactagcttttttttttttcctttttttcctttttttttttggtgacagagtcttgctctgtcacccaggctggagtacaatggcacgatctctgctcattgcaacctccgcctcccaagttcaagcgattctcctgccttagcttcctgagtagctgggattacaggcacccgccaccacgcccggctaattttttttttttttttttttttaaagacagagtcttgctctgtcgtccaggctggagtgcagtggggcggtatctgatcactgcaacctctgcctctcaagttaaagtgattctcctgccccagcctcctgagtagctgggatcagtcacccatgaccacacactgctaacttttttttttttttttaaagacagaatcttgctctgttgcccaggctggagtgcagtggggcaatctcagctcactgcaacttctgccccccaggttgaagcgattcttctgcctcagcctctcaagtagctgggaccacaggcgcataccaccactcccggcttttcttttctttctttctttctttttttttttgagacggagtttcactcttgttgcccaggctggagtgcaatggtgccatcttggctcaccgcaacctccgcctcctgggttcaagcgattctcctgccccagcctcccgagtagctgggattacaggcatatgccaccatgcctggttaattttgtatttttagtagagacggggtttctccatgttggtcaggctggtcttgaactcctgacctcaggagatgcgctcacctcggcctcacaaagtgctgggattacaggcgtgagccactgcgcccagcctaatttttgtattattagtagagatggggtttcaccatgttggccaggctggtctcgaacccctgacctcaggtgacctcggcctcccaaagtgctgggattacaggcgtgaggaatttactagaataatataattttaaacatttaaaattgatgtacatattacatcatcaggaattagagggattgataaaataagagggggatgaaaaatgtaaaaaatagatactagtgtttaaatatcctgatttattcatcagataaaaatttccaatgggcaaatactggagcagctgtgtttggaacacagtcagtcggaacccagtcagccggtaaagttggtgaagatgaagatggtagtgatgaagaagtagttcataatgaagatatccattttgaaccaatagtgtcactaccagaggtaaatgttaaggaattaaccttttactaataacttatttttcatttttaagttttaccctggcttgatctgtcagggtataattgtttgcatttaagaatgtttactgtttgaaatggaagctctatttattagatgtctagcctttaagtataaattatctttttacagtttttacataaatattggtttgtaaattctatatgtaattattggtaagaaataattttttcttatgtttctagaatatcatgtttgtttttataacatgattctggggaaaaattaacctcatactcactaaagtcctttcaataaatgttaaccttgtatgttttttggacaagaacattgttctaggaaaattactttgtcattttttaacctcagtcagtagctaatatttctcttcagtagcaaacacttttgaaacctctctgtcctataaagaaaagcatttaatttccaaagggaaaatgaatattatataaaagaaaatgtttaatgataaatcaggtctttactccctcagccaaatcagatatattcctagccctaagatatataaccagttatcacattaacaaattctctttgtcatcacaaagaaaatgccttaaaagaatttggatctttgaaatttgtcatggaatttattataagcagcagcttatagagaatttcatctcctattataggtagaagtaaaatctggagaagaagatgaagaaattttgtttaaagagagagccaaactttatagatgggatcgggatgtcagtcagtggaaggagcgcggtgttggagatataaagattctttggcatacaatgaagaattattaccggatcctaatgagaagagaccaggtttttaaagtgtgtgcaaaccacgttattactaaaacaatggaattaaagcccttaaatgtttcaaataatgctttagtttggactgcctcagattatgctggtgagtttttacattcaaatgctacttttcattttttggacttttctaaaatctataacaaacaaaacaacttataacagttattttaatactaaggtcactgcttcccctttccctccctgccagatggagaagcaaaagtagaacagcttgcagtgagatttaaaactaaagaagtagctgattgtttcaagaaaacatttgaagaatgtcagcagaatttaatgaaactccagaaaggacatgtatcactggcagcagaattatcaaaggagaccaatcctgtggtgttttttgatgtttgtgcggacggtgaacctctagggcggataactatggaattattttcaaacattgttcctcggactgctgagaacttcagagcactatgcactggagagaaaggctttggtttcaagaattccatttttcacagagtaattccagattttgtttgccaagtaggtattattaagtacataccacaattgaggtcttgaagagtgcaccacactaatgggaaatttgagtgtttttccttgacctcatcctgtagttttgttaaagatttctttaggttttccacacatggaatcacatggcatcactacccattccctgctcctgcctaaaactttcaacctaaaataattgaggctgggcacaatgactcatacctgtaattccagcactttaggaggccaaggcaggcagattgcttgagccccggaatttgagaccagcctgggtaacatggcaaaaatctcgtctggacaaaaaaatacaaaaattagccaggtgtggtggtgtgcgtctgtgatcccagctacaaggaagctgaggtgggagcatccaggaggccaaggctgcagtgagctaggtttgcaccactgcactccatcctgggcgacagagtgagacagcctgtcattaaaaaaaaaaaaaaaaaaaaaaaaaaaaatcaaattttcagtacttgagatctagtagaaactaagggatgggaaaaaccttttcatttttcatcttctttccaacaatatgaatttcttagttttcaaactatactcaggaaagctgggctttaggatttaacatgtagtgatgagttctgtgtgtattttaatattttactcaggattcctattaattgaaaaaaatttttaacttttttattataaatctttttttcagggaggagatatcaccaaacatgatggaacaggcggacagtccatttatggagacaaatttgaagatgaaaattttgatgtgaaacatactggtcctggtttactatccatggccaatcaaggccagaataccaataattctcaatttgttataacactgaagaaagcagaacatttggactttaagcatgtagtatttgggtttgttaaggatggcatggatactgtgaaaaagattgaatcatttggttctcccaaagggtctgtttgtcgaagaataactatcacagaatgtggacagatataaaatcattgttgttcatagaaaatttcatctgtataagcagttggattgaagcttagctattacaatttgatagttatgttcagcttttgaaaatggacgtttccgatttacaaatgtaaaattgcagcttatagctgttgtcactttttaatgtgttataattgaccttgcatggtgtgaaataaaagtttaaacactggtgtatttcaggtgtacttgtgtttatgtactcctgacgtattaaaatggaataatactaatcttgttaaaagcaatagacctcaaactattgaaggaatatgatatatgcaatttaattttaattccttttaagatatttggacttcctgcatggatatacttaccatttgaataaagggaccacaacttggataatttaattttaggtttgaaatatatttggtaatcttaactattggtgtactcatttatgcatagagactcgtttatgaatgggtagagccacagaacgtatagagttaaccaaagtgctcttctctagaatctttacacctcctgtgtggttacaagttaactttgtaagtagcgtaccttccttccttaaaatatctagcttcctgtgccctttcatagatattcgattaatttttacattttaaacaagttgactatttcctttaggggttttgtttcaaacttttctgtcatctgtctctactacctcagaaactgcagcttggttctgatgatagaaattgaatttttccttgtagttattgtgataaagtatgaatatttttagaaagtctataccatgttctttcgttaaagatttgctttatacaagattgttgcagtacctttttctggtaaattttgtagcagaaataaaatgacaattcctaagagccactgacatccaaaaaattcattacttacgcttcgggttcattctaaagtaaggaagacaatttaaaggcagtaaattcaaactgctgcataatttccagagctcctagtttctcaagtttgatacacaccaaaaacgtatttggaaatggcttgtatcaaatgttaggcaaattgctaaagaaaagaggatgttcttattggcctactcaatatggaactacaaagaatccaggtagaacacaaaattttgtatattgcaattatgaatattgactgtcttccacccatctgtgttctttcgggtgaaattacctcattttatttagtgaggaaagacaggtttattccctgttacatggggatttggaaattgggtatcctaaagcaagtaactgttcaaccaccagtcaaaagaggggagggatgttgtgcgagtaatgagtgatggtataccatcaccattccactcggccacaaagccagatacttgaaataaacctactccaaatgtatcagttcagtcttgaaccatggattacatatgtttacactaaatatttcaaattggcttatttggaaatctatgtaatataaactgatgtaaagtgtgttgtaacttttcagctgagacagttgatgccttcgtcatgattttagaataaattcttaagttaatgcaagtgctttttaagagactttttacagatttgtatgctttcctaaagcactaaagttacaaattaaaaagctttaaaaactttgaccaaaaatttgacaaaatgacatgtaaactgacttttcccgtattagtattccaaagatgcttaaaagtggcttgtggcatttatgagaaagtctttgtgtcacatttcaggaaaggactttgatttctctttgttatttaatcactgatgtggtctaaacccacgataatatgtatctttccttttaaactggattttatgttgtctcattaaaatctgcttaaagatagaataaaattcattatttgtaca

SEQ ID NO: 2718 - DNA, 76706 bp, Homo sapiens
  source 1..76706: mol_type = genomic DNA
tgttgtagggatcctaatgtcttttatcatataaatattacacaaagaaaacttacattaggtatcaaaaaactttacaatctgtacatttgtttttttcttgcatttctatattatacattttgagacagaaattcacaacggtcagtaaaaaggtaagtcagcaaagaaaatgagaagtgaccctgctgttaatacaacaagatttgtccttgttttggcagataaatacctggccaaactaaagtcgtgtgagatgcagaaatttacactaggcttgataagccaaagccttttttttttttttccagatttctgtgatcccactagccccatgttgctcaacacaaatactattaacttgtatactatacctctttggcccttgctggactgtaaaaacctgtgactaaactatttcctcttatccatttcagtgataaattctgcagtacttgatactgtttagccattgctaatttgactaattaagtggactgtgacaccttttgaatccctatagattatttatataaaaactaactggggatctttacttcgaatggagaggaggaagaatgaaaaaaattgtgttccattactgttttaaaaaattagagtacaccatctttggtctatatcaatcaaaggaaaacaagaatagtgaagaatatgaatttttagagtttgtcctaactcatgcttgtcctattaaaaagaaagtaacaaagtgttactataagtttatatgccaggtagtgggcttaagcaggcctgctttgggtatttctgagtttaaatttggaaaacggtaaatacgtgtgtaaaactattctttataatgtaatgaaacactaactacaagctagttctatatcactaaaactcagtgcaaggaggaactcaaatgggaactgatctttcatcaaagagaattcctaaatgatctgaatcctccaggtaagcaatactgtatgtatactttgtattcttatgaagacttggtgctattggctttagtttggaacttttaattgttaacatattcttggcaattggacaacttgtttatgaatttcaagtcagtctggtaccagactttataggcatggaagctaagtacccccaaaaaggaaaatgatcatatgatttttttttttttaagagaactaaaaagaggctgacaaatgaatttgtgaataggtgcccaggcaactaaatgagcccatttattattaaccttcataatagaaaactcacaggattgttacttgtgattttgccaaacaatacaattttaccttgtgagcaatttaatcttgtgacaaactgaactttatatttgtgactttgtataaatgactaaaacttgtttaattcacttccacattttatggaggaaacaaaattccaagccacatgcatgcctgatattgtatatacatattatatacatatgtacacacagtcagctattatttaagccactgatccaattagcttatttctaaatagtattaatagtgaagacagttaagcacaaattcatttcaaaaagagaactttcaaaatagtttacttcagaagagaaagatggaacatgaagagttaaacagactcttcatagacttttttttttaagccatcaattcctaattctatccactgtagaatatataaggacaaacatgtttgcgttatgtttattttaattagacagtaatatgagatggtaatagctatgtttccaggtacctaatttgattacttattttctgatgcctgtaagttgtaaggctacaactataagttgacctgcaattggataacgtcatgtttaataggcctctaaaaagttgtggctacatcagtagaaattggcttctaggtagatatgctcatgtgttatgactgtagtgaggaaggagggtacatggactaattgattagatctgaggtagtgaagaaggagccaggttcacaaagtatgctgggatacagaggaaatctacttttggaatatgggtagttttctattattagcaagctttggctggaacaaagtaagtcagtttgcagaaaacacagggtaagaagcaaatccattttccagagattttagttttaaggaagaatcagccaggcaggccaccgagatgccccattgtcaggaaatgatagtcatgttttagatcgcatacttttgatgaacatcagtggtatgaatagcaaaagttttgcattctttagttttccccctttgagtcaactaactgaaagagaaaacagtgctgcacattaggaatcttttaggtaaataaacagtaacaggcttttccttttaaagtactgttttaaagctggtcagtgtaaagttcctcaggtctgtgcattacagtttaggaaatgagatcactatactcatctacagattgtgctacttagtttctgggctaagaacagtcaccctgctccatttgagctaagacatgattgcttttttcaagctggagggattctattttcttctgtgcatatttcagttggatctttagggcatcattatctgctttcagagtatttatttcctaaagggaaaggagaatgaggtatgttaataaagcagcaatgaatagcaaatgaattacaaattgagagctacttttgattggcatttcctattcactgtggctgagaattaacaaccattttcaagatagttattttgccctgaatagaaaatagcaagttaaatatcaaacgagcatttgtaagcagcagttagtctttgttatcatatcaaagtttgtgagtggttagcaggcagaataaaccatttccgagcaataggtagataatgacaaaacttttggatgttttctcgcgggagatctcaacttggcagaaacagtctctggtcaggtctgagccatgaaagcatgactgagaattctgtaatgcaaggtgttagttaattttatctaagtttcccccccacaaattattgaaaacaaatttaactttttgatgatgttaagaatttcaccccacccctaagttgagatttagtggtctaatttgtagtggtatcattatagagccaacagttgatttccagtcttctgattttgagtccagtgttcttatgttatcctatactgattactccaagagaatattatatatagacagtgtctgggtaatttgggatacactgggttgtttctcaatctgaattatctacatagctgtctcagctgccatataatagtgagcacttgctatgtgcctgcgctgtgtgacataatggactgccttaacctacacaaacaccctgaaaataggttgtatacctcaatcttataaaggcaaatgttgccgtatagtataaaactgcagagttgagccttggtatatctaaacataaaagcttttatttgcttattcttttgtcccatgctggttcagtggtacattatacttaaaataatacataatatttattcttattaatatacgttatatattgtaaatactgatttaatttgactagttattatggataggactgttgaattacacatagactagtcattgtaaggattatacttaatgggaaagtgggacacataattgttcctctaaaatacacacagtgaattctggaccttaggtctatctgacaagcctaaaaagtaaagagaggcggtggtcaaaatggtgagagggtttactggctctgatgttgctgagtaggaattctaatctttctgcgagccacttcttaaagcattgttgccaaccacatttttccttttcatcggcatgtaaaatgtcaagatttgaggcaaacctttcagaacatggaatcccagccctgtatttcacaaggaccaaataggctgtagagtttaacagctggtgtaagaaatgtctgggactgaaaacacaaatctttgcctccaagaccaaagttctttctattctaccgagttcatttttcgaggtttctttcatcatttttagaagttgcatttggcagtttctatccctaaagaggaaggggtttgtctaacccacgttttgccaccttctcattgacttggtttttacagcacatcttaacaataactctgagcaagagagtaccattcatccagaaaatctgttgttcttttttcgtatgtttctcttaatattatgttctttgtaccaagcaccaaatcaagagttccacatacgttatctaacttgtttcttcagatgtttctctaattcagtttctgggggtctgacagggaaggtagagcattgaggacaatgcagggaatcctgaagccctcgtggacagtttttcagtctgtagaatgtagaattatataaggaattctactagctggatattggttttgtgtttgcactgacaggtctccaaaaacacagtgcaaaccttgatgtttttgggaaaagccagaaaggcattcctcctcctgtaataaagtgaatagtagtgttgatattaacgtatccttgcttccctgtctctaaaatggcttagttatctataattaagaaactactatgccatgggacagtagtttcttaccatttgtaggttcttaccaattataggtaacctcttgagccagccctgtgagttgtgtactgtactcgaaacaaaaagaagtatagtaatgattgaaccttcagaattgagtatcttgacagttggctgttggctctttttccttctgctgttcccgtctcctactcctccccacccgctttttttttttttgagttggagtctcactcagtcgcccaggctggagtgcagtggtgccatttcggctcactgcaagctccgcctcccaggttcatgccatcctcctgcctcagcctcccaagtagctgggactacaggcgcccattaccacgcctggctaattttttatatttttagtagagatggggtttcaccgtgttagccaggatggtcttgatctcgtgacctcgtgatccgcccaccttggcctcccaaagtgctaggataacaggcgtgagccaccacgccgggccttttttttttttttttttttttaagatggagtctgttgcctaggctagagtgccgtggcttggtctcagctcactgcaacctccacctcccgggttcaagtgattctcctgcctcagcctcctgagtagctgggattacaggcacctgccatcatgcccagctaatttttgtatttttagtagagacggggtttcaccacgttggccaggctgctctcgaactcctgacctcaagtgatccacccacctctgcctcccaaagtgctgggggcatgagccaccacgcccagccctattttcctgtttttaatgtcattattcccttctctcaaaccttggcaccatgtttccaaactcttggtctcctttccttggtaaactttattttgtcttttccattgtctctgttaggtacctgataattaggacattgtgagcctaacattgaaaagcagctcctcttgtcatgattgttaacattttatagattatattgctctatattatattccactgtgtgtttgcctgctactgttgctttcactattctaatatgtgtaaaagatcagcatattccctgatgtgttagaaaagattctcttcgtttatatttaggagggaggcgttttctatggtgagccacaatacactcacctttctcttgttgttgttgctataggactaagatcactaacttctcttaggaagatgcttaggtaaccatgatgatcctaaaccataaccctgatgaacatgttaaagagacctctagggaaggaggatttaggcaagttcattttagttccatctagaaaaggagtggtatcagcacagtaaagctaaccagtagatactgtggtttttctctgtgagcctactaaacagggctttgggcactggcaccagcactctgaaatgccaccacctgtgtggtgatagggagccctgtatagcctgtgctacttgtgtaatgtgaaccaaggcccccagtgggttgtgagaaagctggaatcaatcatcctttcttccttccctccctctcttcctccctgtttctccctccctgtttctcccctcctccttttttgttttagactgcttgtaatcagcctgatctgaatcttcagtccacatgctctttcctggtttggccccacttctctaagatagtctgaaaaaaaggaaaatgaaaaggaaggtacctgttccagttcttggtaggtaggcagtctgaggtgacggagctcctcctttgattttatgagggagtctttattctcccacttgacaaaagcccgctttctgaccaagactgggctaggacatggagaggtgggactgggaagcacatatagagtatcctgggctgtcttccttggggaagacagcacaaagggacctgaagggccctcactgccaatccaaggctgtgattcagtctgggtggccttgtgggcaacagccctcttcagccgaagagaaatcttctgtgaggacactcccatcagcatgatggtccgatccttactctcctcaccatgttccacagcctccccattagggaatgtaaaaggtccttcctcaggtgctgtaggaagatacaggacatgctagtactctagctcaggaaagcagagactcaagactgagacattagtttcaatgagacctttcttattgttactggagttccatatgttcaaagaggacccattttcaggcacccagtttagggggtgagggctaaatccaggggctttggccaagacatggccactggtgtcaagctacatccaccctgagaaagagcatcttctgtttgcacaaaggttgcttagagggtttctgtttttggaggtaagttgaagcccctgcctcagtgccacagagtttcataaaataaagagaacaagaacaatatctagacagaaatgctccataaatacttttttggaccctggaatttgggagctctccacattcatgtctcagtcctgatacagacaccctctagcaggtaagtactctctgggaacccgtttgtacagtgggcacagcttaaccatgagaaagaagttttagctttgtggaaatgtaccttaaaatgtattgcccctgtttgatactgagaggaaaaaggtaagttactctggttttctttaactaagacccactacccaggatccagcctagtaatgttagccataaggagtaatttcctggaaaagtaaagtaagagcagatgtatttgaggtgggcgatagataggctttaagataaactgaagatcatctcagtttactttttggaaagactcagcagtgattaaaacattggatagtctgactttgaagacattggattagtatagtcaagatggctttaaaaaacaacaaaaaagttttctaattagtatttgaccagaatcaaccagttgtaaaactagaaatcttacaaagatcttagtttaattcttgccaaagagaacataatttaaattaacatttaatatttatccaataaagctcaaaattgtaattacatagttatttaagtgctcaaatatttaaattgttatggtcaccctaaaataattacattttttttttggaggagtattatgggtgattattttttatatctccattttccaacttttctgtaatacagttatacattctttttaccaacctagattgtcaaattatgaatataatcccctccattatttaggttgaattcctagacatacagggagcttgggacagaaattcaggcactatacactttgaggagcaaaaggaagaaagcagtaagaacaaaaagcaacagaaagcccttaaaattgcaggaagagtcctgagagatgacagtgttaacagaaattaggagaggtacaagtttcaagaaagtgaaagttgatgagattgagaaagatagtaatgggctaaaagaaatcactggaaattttgatttgataagcagaaaccatccccgataataatgagatagaaataactaagaatggatgatatccaatagtcatttttgccattataaatagaccttgacttttagcaactttataataatatagtaattttcattttgttgcccatgatacatgtatgtttatcctacctattggtctacttcctgacaagtacttatcttaccactgtggggcagggtttggaaaaggggagagatggcctggagaggagaaatctctaacaactgccccttcagggattcctttttgaggcctcagattcaggctgttctctgctgtcttttccacttgaaaatctgcattttatgtgacagaattgtggtgccctaaggttatgtgtaactctgaaaatacagagtgcatgaatgaaatacagggtacaggcctatttttcacaatggtgtttgtgatttctattaaaagttgaacatcaaattcttagttgattagcatattctttcttagaaaagaccctaagaggattttttccccctaagaacaaaacaccccaaaagtttgaagtcagcctgtgtttagatagatagtaaggggaaagatttaggaagacagaaaatttttacttggctgatgtgataaaaaggaatgtgcatttcttacatggaagtgaagcacttaagctttgatctaattgatcaataaatgcatgtggatatttaccactgaacattagaagtgctttaaatgcagaatgtatactatatggactttttctctaggcatctgttgtaacgatagtggccttaccactttagggagcttatttcaaaagagtaatgatattaacatatggtacatacgtgttaagcccgattttaagtgctttatataaataaactcatttcttatttccctttttggttctacttagaagtcacacagcttcttatattaaactggcactaacctaataagcactggatttttgctgaagacctatatgttctttagttagtcaaggtgatcagtgttttgacatgctggctaaccagccagcccagagatcagggcctagtatagcactatgaagccttgtgccccaaccgtccccaacaagcccttcatgttacccttttttaaatagctcctcattttatcatacagacaggcacctgtcatttaagactctctagactgtctcatttttctacttcatctcttacctaaatcgccttaacacctttttttttttcccactatcccaatagtactaaagctgttctgcccttggccttttgctcctactgtacatcctatctggaatgtgctctgtcctcctcccataacttaattctacccttccttcaagacttagctgaaattccaccttctccataaagtcccaacagccccagtacagcgatctctctgctatgtcctcctgtcatttgctgtcactgcaacctatttggctcttagcatatactcttgcattgtttctaaactgctctatatttgtatattatcttccccctaactagaactactccatgaagacagagacagtctattctgcttctttgcactttagatctggggcatctcaaacatactcaaagtcatttccttattgtactgttgtttgcattttaatgtaagtgaatttgctagtttatttcttgaatgttgaatgttttgtctcagtcctaggattttccttgtatgatttggaattttaatctgcaagctccacttgagtgggagtttgccccccgcccttcctttctacatttagccttctgtttctagaattttgacaattacctgctacctggcccctcagggttcctcagactaggacctggtcttaaattaatggcttggggttcctctcctggagaaaaattggggctatcatagacagtcactcagctagtagaactctgtctgtggctaagtctgcttcctgctgctaagtgacagtcacagttttttaagcattggatttttccttctcaattttaagcagtaagtctggttctggtcacctttcacgcataggtggtctctgttactatgcagaaatcaaattcgcagctgcctctacctgcttctagacatgcagccaagcagaccagtagctttagcatctactccttgcagtatgtttctagtacatgtgtaaccttgagatatctgtttttgaatgcactatgccttttaatgtgatttatatattatatatgttaatttacattatatatacacacacatatacatatgcatgtacatacatattttccctagtcactgttttgggtttggagctggggatagggtgggatagttaactgttaacttgaggcactatcttggccagaagtcagtatctgtgcttggtgtaggtgctcaataagtacctgctgatttttatgcctaactaggactctgctattctcacaccttaagtctaagacataggcatggagctaaaatccaaaactgtgggaggggtcagccctggcctagctgttgaggttacatttaaactcaaacacagagtcatgaggtaatctttccgtctctaaaacttttcccttcctacttcactttccaagatgaatgttcccagtgcctacttaccatggagcagatctttggctcccaatgagcaaaggttggacactggccccacagaagtgttgttctctgtgggagctactgggttcttggctcgcttcttacactcaaacacaaccagatctttgcattgtttgtgacagttcatcccgcagtctgtggacaagacatcctgggtcaagaagtctttcacttttctctcttccccagtgtgtctcacaaccaaattcatgcagtgctttcttgtcacacatgtctgttctatcttctggagctaagacacttaacattcctaatgaagctagcattcttctcacttggtgaagcccagagctcacactcttgatgtagcccttatcagtgaatctcagcatcagaagcagtatcctgatatcttggagggaagagatggtgtcctggtatcccatacattctgcctactctagggagaccctccggaaacactcagctgttaggtcttattttctttcttgcagtaaaaggtttcctctctttcactcctgaattctcctagtcacaaggaaggacagttatgtcctgagtgataaaggaaagctgacaagggcctttagtaatcatttatcttctgttgcagaagagattctatctttttcactggggacccacccttccatgactatatgagagcaccatctcctacctgctatccctgttctaggccagccacgacagaaagaggattttatacagagaaaatgcctatctgtgcaaccaggcatttctctcttcggtgtggcggtcattcaccgggggtgtccgagggaaaccactttggggatgagactctgaactatgctgagaagttgtggactaaatggacaactactatgggtaaaaaatgttttagaggtgggactctaagaccagctgatatggtttagctctgtgtccccatccaaacctcaccttgtagtgcccataatccccatgtgtcatgggagggacccaatgggaggtaaatgaatcctgggggcggttaccctcatgttgttctcatgatagtgagtgactgctcatgagatctgttggcttcataagggcttttcccccttttgctcagcacttctccttcctgccagcatgtgaagaaggatgtgtttgcttccccttctgccatgattgtgagtttccttaggcctcaccagccctgtggaactgtgagtcaattaaacctcttgcctttataaattacccagtctcaggcagttctctatagcagcgtgagaatggactgatacaccaggaatatgtcaacaatattgagtcttacctttacatcgatatccttgtttgatcactccccagagctatgaaacaagagacagaatgcaccacatgtcattcatccatctggtgtgaggctacaaggtgacattcctttattttccttcattttactctctagctcaagtgggaaggaaacctcatttatctctcatgtcttgtcccttctgaccttaaatccatgagaagagtttatgctgatcaaagtttctcaagaagcaggttttttttgttttgttttttttgagacagtcttgcccagttgcccaggctggagtgcagtggtgcgatctcggctcactgcaacctccacctcctgggttcaagcaattctcctgtctcagtttcccaagtagctgggactaccaggcatgttccaccacacctggctaaatttttttgtatttttagtagagacgggttttcaccatgttaggtgggctggtctcgaactcggggcctcaagtgatctgcctgccttggcctcccaaagtgctgggattacaggcatgagccaccacacctggctctcactagcagccttatgacccagacattctcgagaaatggatgaatcatcgggcaaacaggttcctcaggactccaaactgagaaggatatagagccttgcatcaggacccgagtttagggggaaacgattggtcaggagtggaacggaagaggggcatagccaaggttatctcctaaagacagaaggtatctcatatgtctttgttataacacttgaaacagcacatgaatattatactttaaaagtatatcctaattcagcatttctggtaccatttatctaaggcctcattgcaatagaaaagaaaaaacaggaagaagcgagagatgatgagtgcaggtaaaaaccacacgcttgagctctaggttattctaggtgtctgtctgggctccaagctgggatgggttcataaggattgtgaggtctgtgcctgtcttaaagtatcccacactcttccccaaattcagccctggagcaccctaagaacaacttacaaatccagcacagttgtcacaaaaagtgggcttcaggtaggtggtctcttggaagttgtgaggaaagcccaggcccagcttggaatagattgagctggctctcatgaagtaggctgtgatctcatccctgctgatgaggccttccctgccggcagatgaccaaggcaaggatgtgagtataaggggcatggaggcaggtagcaagggggggcttctagccttagaaactcacctttctttttatcctcagtggtaatatggtatgtgctacctcatgattacttccatgggccctactcttaacaaggatacaagatgacatgtggtaagtaggtaaggcagcattactcatttccacagaggtgttctttggccaaactaggtttccctaactaacttgaccactatctataagacttgaaaaagaaacaatgtaacatgtacatgtgtatagggagggaaatgtcttatgctacagtttctgactttagacagtacctaactggaacccactaaccatatgattagtttcctatagagaaccaagatagaatttatttaaccttgagaaaagtaaaaatgcaaagtatgaataagtattagttgtttcccaaaatctgtaatgacaaagcaagaaggaagactaaactttttcttatttatagttgactatttataaagtggcagatttatggaatgttcaattcagtttttgttttttttttttttgagacaggtttttgctcttgtggcccaggctggagtgcagtggcatgatctcggctcactgcaacctccgcctcctgggttcaaacaactctcctgcctcagcctcccgagtagctgggattacaggtgcccaccaccacacctggctaatttttgtatttttagtagagacagggtttcaccatgttggccaggttggtctcgaactcctgagctcaggtgatctgcccacctcggcctcccaaagtgttgggattacaggcgtgagccactgtgcccaggcccagaatatttttaaaagaatgcatatttcatggtctgttctttaagtgatcacagcagcaacatatctgagttttcaaattcttctagtgacatacctataaacctattctcaccaatgggctcataaccacatattcctaagtacaaaccctcacctgtctttgtccatcacacagaaggaaaatggaaaactcgcagcaatcttttcaaattcttcctgagaaatgtatccatcctggtcgtgatcatagttcttgaagacagactgtgaaaaaggagtttttttggtgattactaaagagaaaccggtcttctctccctttagtcaaatgacaaagagctggggcagttggataaaagccttttaacaacctgaacgagaggaacagggaaacctgctcctttagctgtggcaaagatgtggcaggtcacatctcaggcctttgctggtagcagcatgtggggggtggccatgtactttgaatcattagcacgtcaattatactatcacgctggctactcctagttcactgcgcagagggatgttctcctttcactctaccctttttttcatcactcagctccagttgtaccttctttgagaagcttctacaaacagcccagttggaagtgctctgtccccactgttaatcctcttgtttctcaccgttacgctcttagttttccattgttacatgtgagttgtccacgaggatacatgcataagtatgagaatatataccccttcctcagcaattagcacagagaattgaattaagcagtacaaaggttttcagttttaggtttacctgattaccccttactatactcaaatgcatcccaatacttctgtactcctaaatcaactgacaacctttaagcatatgctcttttgctaggtcttgaagaggaggcacaactgccttcatatgagtccagtgtgtgttgtcaaaatgtaacttttgaattgttctaaagccacagtaagagaagtaagtggttcaagtttcgtgcctttacatttccaccattgtgctttcctctccctttaccccacatacaaaactgagccaggcaatgcctagtttttgtgtgctgaacacagctgtacttacatccaccatcctctggacgtgtttgctaatggtttttggatcaggtttgggagacactccagaagcccagtccactactactggtggctttgaaggtgttagtggctaaaatgaaatatttagagaaatcctcatgactacaatgcaatattataacctatagctctttcttttcccactacctgacggttacatttatggacaatcttcaattatgttcagtggcaaggagcagagaacccacaggcaattgaaatctctactaataattttggctaacaaggcattgtgcttacggtttccagagtgctcttcacatacattatctgcagctacagataatttgaaattctcaatctgcctgagttgcaattccctctccattaaaccctttgtcagagctatcaacaaagagtaaagtggatcatttatgattcctctctattctccagtcacattttgcagtagaaatgtgaataaggaaaagcttagctaaaaggcaggaaggcacaagaaaaatcatcggaagcctggacaagctcttttctaaatacagtcatgcatcacttaatgactgggatatgttctgagaaatgtgtcatgaggtgattttgtcattgtatgagcaccacagtgtgtacttacacaaacctagatggtatagcctgctacacacctaggctatttggtatagcctactgctcctaggctacatacctatacagcaggttattatactcagtactgtaggcaattgtaatgatggtatttgtgtatcttaacatatctaaacatagaaaaggtaaaaatatggtatagaaatttttttttaatgttacacctgtatagggcacttaaccatgaatagagctttcaagattagaaattactgtggcaagtcgtgagtggtgagtgaatgtggaggcctaacattactgtatactcctatatactttataaatactgtacacttagactacactaagtttcttaaattttttcttcaatgataaattaccttattttactgtaaaagcttttaatttttttaacttttactcttttgttatgacacttagcttaaagcacacattgtatagcttatagctgtaccagttatttcctttatagccatattctataaacttttttctattttaaaaatgtttaattttttaaatctttgttataaactaaggtacaattacactcattggcctatgtctatatagagtcaagatcatcaatatcactgtcttccactccacatcttatcctattggaaggtctttaggggcaataacatgcatggagctgtcaccttctggaggacttgcctgaggctgttttacagttaatttttctaagtagaaggaatgcactctaaaataatgataaaaagtattgtatagtaagtgcataaaccggtaatacttactatcaagtattatgtactgtacgtaagtgtataacctagactttttacagctcagtaggtttgtttacaccagtataatcacagacatagtgagtaatgtgttgtgctacaatgttacaattgttctgtcactaggcagtagtaatttttctgctccattataatcttaagggaccactgtggtatatgaggtctatcactgaccaaaatgtcattatgtggtgcatgactgtatttgaaactcagcccaaattaaaatctctctgaaaaaacagaatgtaccctttccattgaaatgcctctaacctgaaaatggaatctaccaaatattttcagtggaatctttcattacaatagaaagctagaacttgatctttctgtgtggaggagtgcaatttagccaccccaatagatgagctggatttcttaagtgtgggcaactctcttcccttgagtatcacttgttttggggtttggaaacgtcccaggagactgaagtgattttacttgcctgtgggagggtagggcagataacctgtgaagttcctactgcaggcagtgccaggactgtgtactattttgaggacttctcagcataggaggtcaaaagactcagcagactgttcttttcacccagaacattacaggaaaatggggcttttctatctaccaacctggaaatcttcagaaatttagcttctgattagtacgcatattactctcattatcatcaatgaatcatagaaaagaaatttatgtggggactcttcttaatgcgggggggatgtcactctggtgcacaatagtatcttccttctctactttgtaaaccactgactgattccaccacacctggcattctgatgatatagttatttactgttcactagttattcactggtcacacattaggcttatcccttcaactatatcacagctttttaatggacaggaactattcctcagacatatgttgaaaagctttctctgttcctagcataaggttgagcactaagaaaaacagtacatgtattaaactgaactgaaagtctgttcctgaggatgaatgaactcgaggagaagcttgtaaagcacctgttacatgtggagtcttaatatgaaaaactcactggagctctgtggttccttggttcccgggcataggaaagctcatagatttcatcctcagtgtagtaaagatccagggataactgcagatcaaagcagaacagggttcattgctaagatgctgtttgcctctcccacagctgatggttctttcttggattttccttgccagtagtttactcttttaggttctaaacagtttgtttttaaaagtcacaaaacaggtataacacctactattgcaatagggcaagcattaattctcattgaaatgtttttaattttggacataggatgccctctttttaactatgatttaaatctaagcctctatatagagcttaggccaaaggccttgtctggacagatgactaatacatcacttgttctctctcaaagcagacagatgatctgaaaggatggtgtgtatagtctgagactattaaatttgagtccagcaataaaatccagtttaaatggtaagacatattaattgctattaagagttaatgagtctgggtgcatggtggctcatgcctgtattcccagcattttgggaggccagggcaggttgattgcttgagctcaggagtttgagaccagcctgggcaacatagcaaaaccctgtctctacaaaaaatacaaaagttaaccgggcgtggtggcgtgtgcccgtggtcccagctactcaggaggctgaggtgggaggatggcttggacctggaagatagaggttgcagtgagctgagattgcactactgcactccagtctaggtcatagagccagaccttgtctccaaaaaaaaaaaaaaaaaaaaaaatagtgagtttcatgtatcttagaactataaaattttaggagagaagtccttaggaataatattattcttaaccttgagtctatggataggcttcaaggatttcagaacttgaaattacatgcatatttaaaaataaatggcttatgtacatttttctgggaagaaggttcacagctttcatcacaagatttataatccaaagaatgttaagattcactccatgtttttacaaatgatgtctgagacacagacctgccaaggtcacctggctaataagtgaaagggctaggatcacacaccagctgatgtgaagcccagggttctatcaaaatgctgctgtgaggcagaaagaggttatgatcattattctactctccaaaaacagcaggttaaaaactgtgtaactttagaactggaagagaagttcgaagtcatcccagagactaattcgtttgaggagaggaatcttggacggttatatgtccatagtcacacagctggtaaactacggaattgcaggtctggaagggagttcatcatctgatctcaccccatatgcaaaatgcaaatcctggtctcccacaccattgacaagtgttcatcttcacttgaatatctccaagagcaaagatctaagccaggaaccaaataataaccctgggtgttttttgtttgttttttaaattactgcctgccctttttatgagagcacattcattctctccatctgttaccaagacttgtatcctgatttgccatcagctcctcccagagagcttaggactgcttttgtagaggtagtgaaacagtcctagaagtctgaagggcacagtctctagagtcccaccacctgggtctgaatcaaggctctgctacttaataatgtgtggtctcctggcaaggtatatctttgtgctttagtatccctagctatatgttggagatagtaataggatctgcttcatagagcctttatgaggactaacagctaatatttggtaaggggtatagaatggcacctggcacacagaaagtgcttagtaattgtcctccagtgtgagcctcaccgtcagcaagtgtaccaagtccttgttagcctccaagggtggggccacctcttgcagctggaccaattcactgatatgattgtatagggccagtagcttatggacgttcactttcccgtcctccagatagtcaggcatggcttcatacagggagatgaggtccttgagatgcacacccagaatggggatcttgaagtcggtgcactctccataggctcgccggtaattgtcgtagtttctggaggaggacagcagctcagtcatctcaccgagaacctacaaagcagaacagaccaatcacaggtacccgctaggcagtgtgcattgtctgtaatgaggaccttgcatgtttgcatcctgtgccatgatctcaccccatccagaatttgttgagcagggggtaattcatgtaaaaggtacagattatgactccccagttaaaacctcagctatgtcaaatatcacagaatatatttataaacacaagatatgcttgaatctgttatataacttaaacattataaatcggggttttatcatttttatgttaaaatttccttcttttcaaaaacaaggacctgatacaaaaattaaaaaggtacaagaatatatagtgaacactatccctctaactcctgtccccaagccatgtgattcccttccttggtgtcttctgaatgcttccagagacactgcattgattaacagttgaaatgtgatgtcaggaaatgctgactatgttgctggcatggggaagagcatgtattttaagagtggagcttcagtagtctattgtgtgttattctctatgaggtgcttgatgggcctttcaagattctcagaatgggcctatgactagaaagcaagtgacattccattcacagactaaaaccttgaactaaaaagactgaatagactagatcaattctgagcaaaggacaggagagaggacattagaggttacaccctgcttcaaacctggaagtgggaacggctgctcaccagcacagaaagggagcagccagatctagttttcttttcaatcacttgtcattcaagtcagcaagcagttcacagaatccattccccatgagtgataaccagctttctcagaagcaaagacatgaagtgactgtctgccaatcatgttatcatacaacataaggagtcctctcttatccttagggggatacagtccaagacgcctaattgatgcctgaaactgtgcatagtaacaaacccgattgctgtcaagtggaacacatttctgttcatgtttcccacccacaaatgtaatgccattcccatcatgcactgtggccataactttttgcagtatgaagtacaaaagagaaactagaatgaacttcttttctttttcacaatttcatagatgaaattccttcttacttagatcttagcaacctcagcatatgatttttttccttccttattaagtaaagaacttagaggaaacactttagggctgctctttggcatatccaaattgccaacatcattactcttgcactgtgaggccattattaaacaaagtgagagttacttgaacacaagcactgcaataccatgacagtcaatctgatgaccaagacggctacttagtgactgatatgaaggagtcccagaaagaatggaatgggatggcttaagatttcatcatgctactcagcacagcatgcattttaaaacttatgaattggccaggcgtggtggttcatgcctgtaatcccagcactttgggagaccgaggtggacggatcacctgaggtccaaagttcaagaccagcctggctaacatggtgaaaccccgtctctactaaaaatacaaaattaacccggcgtggtggcacacgcctgtagtcccagctacttgggagcctgaggcaggaggattacttgaacctgggaggcggagattccagtgagctgagactgagccactgcactccagcctgggtgacagagtgagactgtctcaatcaataaataaataataaaatttatgaattatttctgggattttccattaaattttttttggactgcagttgacctcagataactgaaactacaggagacaaaacctcagataagggggactactgtaacccttttagacactgtgcccaaacttaataaaattgtggcctacgaagtaccatttctccacaatgaagaacttggagttcttggagtcagaccccttcaaatcactgggagatggcaagagagcttcttcttcataaacctctaccaatggtgcaggtgagccctaggcatggaaggggctcacaagacaagagtgtaacagcaaaaatgataaagatatttttattcccctccgaaggtgaaatcaacaacttggggacttttgcttcaaccctggacttactaattcactatgcagaccaccctgagggtcaagtagctaccgacaggaagcactgctgtggggggaccccaagctgaagaggagcaagctctctcttataagctaaatgacatgaaggcttcttaatctctgtgactatttctctctgtcacctctgagatgtgggcaatcttttcaactgttccacctggtttcagcagaaccgttaaggaatgaagaggtgactaaagatgatgcccttttgatcagaccactgggaagtggggggcctccccagaggcccagcattgtgataacagagataataaaagactccccaaaagggagctgaacacctgggaaaaacagatggggtaatgagcttaggtatctctccctaaaaagagagttcctctccatgctagtttggaaggattggggcttgagtatagtaaggtcctcttacatgaaagtgctcaaagagcagtcattatctaacccatgccatacatttatatcctcggtatattacagtggtttatatttataacaacagctccagctggactcagtggctcatgcctgtaattccaatactttaggaggccgagatgggaggatcgcttgaggccaagagttggagaccagtctggacaacatagggagacccttatctctacaaaaattttaaaaaatagctgggcataatggtgtgcacccatggtcctagctacttggtaggctgaggtgggaggattgcttgagcccaggagtttgagactgcagtgagctatgatcgtgccagcctgtgctccagccttgatgacagaggaagaccctgtttctataaaaaagagaaacaagcaaaacagccctatgtcataaaagataaaagtatattctgtaaaatctaataatgtaggaaaatgtacaggacatttaagaaaaatattcattaataaaacattatgtattacaaaatggtatctgaagaactcatatccaattatctggtaaaattcaactatccggaatgtcattcttcaagggttctggatagctaagtttttaatatatcactatataactacactcaatgtgcaaactgacctatggtcaaccgaaccacaattccttttgagaacacattttagagcaaggagctggagcgagggaatcagtgtcaaagatggtaactgaatattccatggcctatgaacatgggaagaggcacacattgtttcaactggtccagcaggaatgtttgcagtgacactgtctgaggccagacaaaatcacagttactctaaaaaatgtgacttctccatcctatggatttccttaaggtttgcctccctgccacttagcctggttgacaagggatggtgtggttggaaatgctctctgggctgcccaccaaggagaaaatgttggcacacatcttgagaatgctgctaagggccccagagaagacagtagcactgaccttattgatttcatgtgggacatgcgaacttgtctccttgagcctcgagattgagctgtgacacagcccacctatcacagccatcagtgtattgaagttctgtagttggtggagcttctgtgacacagaagacagatgacagcagagtcactgtacatgtcagttatatggggagcttagaggctgcctcttgtctctgtgccgtgagtctcccttacgctggttaaagactagttacgaggcattgcaatttcctgtccatgtctccccttctgctttattcagactggtggattccacatctgggaggcattacatctctctccttttgttgttgctgatctgtggaccaccttctagatcagtgctttcttagaatcacctcaagtatttgtttaacacaatggtttctggacctaacccagacattctgattgcctggatctggggttaggcttggagatctgtacttttaatatacctttagttaatatcagagcaggtgatccaaagtcagagctgttgactttgagaaacactggtctagaccatccagagttggagaaagatattattaagtgtaatcttttatttattccaaatttaccagacttttatttttgagggtaaggactttgtcttattttcccatgcaatgccagtgcctatataggacagtaactgggacagagaagctagaatctctggggaacttcaaatatgggttcatagtacttgttttcctcttataaaatgcccctcaaacattaaatgcagccattcagcactgcatgggcttaaagacctaagacaatccaggatggtccagctccagtaaatcttagaattgccctttcctttgccatgtgggccagactcgggaaaataatgtaggctggtaagcatcttttgaaaaatgttaaaggtctaaacagatctaaaactggatcctgacccctgatatggcctgtatggccccctcccctccacactgtccttgtatggaagaagagacaagtcaccatatctagatctggttgaaggcacacaaacctctccaccccctcgccatggttcaggagggaaaaaacagctctaattaatagactaagctggaggaaaaggggatagaaagtttaccttatagcccaagccaaatgtcttaaaccagttattcacctgagccacctggatgaacttgatgaagacttctgctcggagctgcggcgtggggcggctgagaaccatcagttgtacccactgggagatgccgttgcacagagcaatagatcgctccatggtggggttttccttcacacagctatttacaaggtaattctgataatcagagaactgcaggaaaagaaacaacaacaacaaaaaaaacctatcagtactgtactctggtattccagaagatttaagggacaagtccagtctgctcagttgatggctgggaactgccatggaacagaggagctcctggtgctcttctgcatcttggccacttgccaacaagcatgatgggagggaaatcttccttattctacccacagcatgatttctctacatcgaaagttattaggaataagtggatgtgtagacacattagttaatccaaatgctgtatttcagtagatattgttactgactattctaaattctaaagaatacagtacagaataaagatcagtattgctgctaaggttaagggaataaaaggtaattcccctgacaaaaacaaatctctctctccccagctgttttcttaccttaaaaatgtgatcataaaatctgccctatctaggacatagaattgttatgaagatcaaagaagataatgtgtgaaagctttaactttttaaagtgttacatatatgtaaggttgcgctaatggagtagttatgaaccttatgctaatacaagcctgtttgtatttccttctactcaccaactggagcagaggcaaatggagtacttaaaatttggttagctatatgtttgctgatcatggtttcccaagttgacaatagcattgactacagttggcaatgaaacaacatgtgtaaaactggaaatgtccctgaagatctagtctaagtgatgtttgtagctattgtgtccctgtcacaaagaatccctctgctcaaatcacagtctgtttctcttcaactttcctatggaagtctttggtgcttttccccaattatttccaactcttcccttctcaactcttccctttgaaagaaggtgtgaccatatgacatggttcagccagcagaatgttgagtggaagcgatgtaactttggaggcaaagatgtaagagccagtgagtggtctgccatgttgccttcctactgctgcagagatcttggaaattcctggcaagatgaagcctccatcatctgggttcctggggaactctgatcagcctctgctgacccatgttagacatgcagtgtgagtgaaaaataaacttttgcttaattaagccactgagattgtacaggaggtgggtgggtggggggttattactacagtacaccttagttctgcctaagtagtaaatatatagatgagaagtcacaacccaaataaaatagctgcaaattaactgagccccattttactgtgctatatggctgctgatgggtggaaaacctatgagtaggaccaaaatcgctccttaagagagatatataaagcaaacatcttactggttctaaaagaaagtagccacaactcattgcatatattttgaatatattcattcaattaatatattccagtgaatacatttaatacccccctcccactataaatataactttaaatccacttgtttttttaaaacaattatcccagtaacatcctcactacccctaaagttttgtaataaacagaagatatcaaatgcctttcaattcacagcacagataaatttccctccaacctcatgttggagagaaaacttgtgtttggtaaaactgtttagcactgtacaggaaaaacaaaaaaaccctgagatagtcttctatgaagggaccaagccactcaaaagaaatgaaggttgaaactgatgttttcacttgcaaatagaacactgttcaacccctggggacactggctgggattcctcgttctgcactgatttttcacttctgcctccactgatgtgagcattggcatcaagcagacatcctgcaggcctgaccaagcagcctgccagtttgacccctgcagagctcagatttcctgtgtgataaatggcttttttcagtggctcagctctgactgctgtccttccctgtgacggggaggcactgccaaatgggaactcctgaggcagagcttttcaatttgggtctggggtactgaggggtgcagagaatggagagttaatgcttggagaagttatttccaaatggaagctgggagcttcctggctgagtgaccaaacagctgcgtgaaaacagaagggctgtcaatattatgaatgaaaatgtaaaataacctttgtaacctgatttgcaggtctccttccagacacaactgagctcaacaaattggtgctgagtgactgagagaggcatgtagtcctagccccagctttgactgtaatcagctgtgtcgaccttgttcaagtcagccctctgggcctccatcccctcaccaggagaatactggtcattttaataaatggacccagcaactaggtggtcactatttttagcacggaggtgaagactgtatctgttggtaggggtaggggctaagtggaataagggtttcatttctcaggaaagcacattagccagtgagggtctgttggcatctgacatgttgacaagttctcttgcatagaactaatattctttgggatcacatatggattgcagtgaggaaaggatgaacctgtactctttctgtacctgatgatcaactgaaatctctctccctttgactctgcttagttgccccagttgaaaggttttgggtcagcacagcttatctctagaatcacagtgacttctgggccaggaccacttcaaggatttaggtatgttctgggctagggcagtagaatctattttgggatttcccagagccattcaaagcttaccccagaatgaattcaaactctgagaggacatatcctctccccgcccccgcacccccccccctttttttttttgaggaagattttaaaaagagttgttgaagcctaatgattatcaggggtatgaggattatcaggggtatgagggtagaatgagagagacagagagagagagagagagagagagtgtgtgtgtgtgtgtgtgatgtgtgcccacagtatggtaacttgagtgagtggtgggatggtatggggcgggggcatggaagaagagagatgggagaagcacaggagtcacaatcaaaggaattcagatggtactgattttttcagactctatgatgtctggcaggaaagcctgccacgacttgagggggcctctaaggttatgaagcggatgggctgttgaattatcatcttattttcagaaatatcccagggaagatttttctcctgccccttgcatacataccgatatcctccggaaagacttgaactcaaggtaggtgaggtgctcggatagctcttctggttccagatggtcaaagagcagggagactttccgtttcttgctggtatttgattttatcctttgagtaagtttcctggaccagtcacgggcattgcttttgtgggtaaatgtgaaagggagaagacagggaaaaggaataaatcgctttttgcaagtaaatccattaacatttctcacaagaatatacaaaacaccattagctaactttccttgtgaatgccaaaacagtgcattcacagagtttctccaaatcagtttttttccatggcagcctccaggaggtcttgctggttttcagtgagccttttaagtgtgcagttgggtacaggataaatgagtttactttaaggcagtgggaaggaaggagtctcaggtatcggtcagtttccttgcctttggtcctggctcctttgtgtatcatctggtatgtctgctccctccattctgcttgtgtgttccttcattcttgtgtgaatgatagggactctctatctggttggaaatcccaaggcagtgaaacagttttcatgccagaaagagagctcaaagaaccacagcaagatgtcataaagggagggaatcacgcgtagaaacatatggtcactcttggcagagttgtgtcattttcctcaaatgtcctcagctactgaaatgaccaaggaagcctagctgaccctagagtgcgccctgcccccattattttcttgtaatcaacccatgcatttcttattcagtttccttcactaaacaagcaaagggaagcggccccattttgaaagacagcaggttgcctgtcttccaaactggtattcctgggaaccttgtctcttgataaaagggttctgtggtcaatgagcttgggaagtgctataaattctgtagcctctttggccagtgagcatattacacactctgaaaagcactgcaaaaggaaagtttaactcattattcctcagttatatctggccaagtaatatcccacagactaataattcctacagaatataatgtggaaaattttggtcaagaaaagtcagctaggaaatactgggacaaggagagctggggttgagaattgccctgggctctaatttcatctttaaaatgaagaaactattactttgaataatctcttatctttcaagttgtgtaattttaagcagagaagtacagagaatccaaactgataaacagacttatttggggctctggaatgtaatcttgaaatcatttctacgtggctacagtgcatcatggacaggacctcagaggctagctgctgctctgtcactagcttaactagctggaccctagatgagtcacattcttgctgagcctcaatttcccagtcagaaaaatcaggatgttggatgaaatgatctctagaatatatatcagttctagaattctatttcttagggatttgtactatttcaaaataaagcagccacactgtgaaaaccctggcatacaaagcatacattcccctccccctaattaggaaaggcactcattttcccagaatgggtcagtcttataaataagaattccaaggaataatttaaaacattcctggaatcccatccagctctggaagtctaagtgtctttcatagacatccatatatgttataagccttctcctgaatacattttttagtcctgtcccatttacaagttcaggtgtgcctcctggcattaagcgtgggttcagtcatttgcactttcagtttttcattatctggattaattttagtcaatatcttgctacctgatttctttttgactgggacttactttttctgctcctggatatgtcacctactgctttatcaccatgaggcctctctgcttttctgttaaatgccaagccttcactttggtgaggcagtttgaacctgtgtatttgaggggcttctcagagtggagaaagagagcagcagtcaccgctgggggtcagaagcccaacaagcaactgggattatattacaggagggaggtggtttcgaaagatgagtcaagaccttgacactcacatttgagttgtgtcaatcaggcggcaatgtaactcctcacccttagctttcaccagttcctgaaactcctccatagtgtctgtcaagctggcgtccattttaaacatgacccagaattctgttatccaatacctacaaggagggggttaaaaaacacaatccaaaactgataccaaggactcacaatttgttgggttccaaaaggaatttactgccacaaagagaactcagaaaaagacaaagtctgattcgtctattagtatattgaaggagctggggtgggagcagggaaggaagaaaacccatccactgaaaatcttctgtccctccacacaaatgctgtggtaggataaggcatagcataatcaaaggagccatgacaaagattcaggcacaatcatgtgggttggagataattataagggagagaactatagataaaccaaatgtccaaaatgagacaatctattcatagattatgctttatcatattcgaatattacatggctattaaaaagaatgtttacaaaaagtctttaatgactagagaagattctcatgctataaagctaagtgaaaactataagatataaaaccgtatatatattttcatctcaaaaaaattgacatgaaaacaagacaaaggaaatacaccaaaataggtaactggatatgagtgatcattattatagttatattcttttctacatttttaaaaatgttctataatgagctatattacttgtataattaagaacaaaaataaagaaaataacagacctttaattatttctgtattccctccttcatgtcatttgataccaaagactgaaaaaaggttggtataaaataattaagctcaagtacaccagagaaaattcactgttatgaaggactacccttttccatctgtccaaaggtgttctatagaggtcaggaaaggcagggaaagtcccttgcttcacctttcatttcaccttgctccacaaagtcttgaaatacataaagaaacattaccttacaaaataacagatcttcaggcaaagtcctggtgaattctttgccaaagcatccttataggtagggctgtggttaagggaaatggagacctctgttacagaaaccaaacgacttttcatctttggaagtatttgctgaaactacctcccaaaatattttttctaaaaaatgaaaatgtgatgctttatctttctggccaaaggataaaaaccaacttgatgtgtacagctgtatgcatattattgcctagaaaggcgatgatggtaattttctctccagcccacgtcgacctggcttacggaaggaagcagcagcactgcagaactaagaaatgaatcatgtaaagaggtcctgagacaggtaacttataaaaagtgaagaaggggcaaatgactccttgcctgtgctcaaaaagcagcccctatgaaggaaaaatgaagcagaaaaaaaagaaaaaacagcagccccatttatcttttacaatgtttcttttaactgatacacatgtatgcagtgaattcgaagaggaaaaaatacatattcaatattcagatatgtcatgataatgaagaacaataatatgaaagttacaatatatacacctagaggatgtcagtagactgacctcatagattgtaacggcaagtcagataaaccgtgtgaataatcgaaaacaaaactggaggtcaccttaaggatccttttcattctgagcattccaagaatatgaaagaatagcaagatctcatcaagttcacatgtctttaaagataaatggaaaaaaatattcatctattttaagagtcaaagagatgagaactccaatgcagtgatgagcccgaataggtcctgccatttcccatcaacagactgaggcatcaggctatgtgggctctgtgcccgcccgtaaaggccatgccttgttttccttctaaaagctgtgcataatgactacaatatagggttcagtgaattccagctgggcccatgagaggaatccagtgaacaacccagcaaacattttaattaactgggacaggactggtcttccttctgtgggtgtatatattttaacctttggaaaatttagagttaaataaagaaaagcaaaagagagtcaaagtcatagtactgatcttttttgtcaggaaggagatctgtgcattttgaaattgtatatgcttgtaatgtttaaaagcatattagaatgatagccttgaaacttcaatttgcaatatataattaagtgctttacacttgtggttttaaattgaaaccttattaagtttatgcatagctttggaacatctaagataatgatagctttactgtttataaatttaatctattagagttataaaaaactatttagaattcagggaggtatctgaagcacttaaaaattatctaagatataaaatgcagaactgtagtttaaaatcattgggaatatttaattaacattattcaaattaacgaaacatttttcaaagtcccttaaaaatgcttgctgaaacatgctagacttatggaaacagtaagatttgcaagctaaacttgaaaccctaaacaagaactatggttataaaatttgtaattttaataaaatgacttctagttttaaaaattaaattttaatacatatactgcctataaaatctgccctttagatcagagcaccaaaacaaaacaaaaacccaaaaaaccctacacatcaacaaaggtaattgacataaaaataagtgcagggaactggcaaacttcatgaagtagaaagtttttatgcctgcctttctttgggtggaaaagtagaagtgagaatgagatggctttatgtttctttatgccacatcactaagaaaatgcatcacttcaatgcaaagagattcaggcaaaaggcacatagataaatacctctcagattctatatttttatcatttgttctacttgttgaaatttttattcttccattttaaaggggaaggcacaaaaaccacacttctgttttaaagctaagtagatacattaaatcgacatggtgacttttaccgtgtcattcaccttctcccagtggctccttatccttcccttcaaaagtatattctgacagtgcacgttggctgcatgtggtgcagcgtcagtgttgtaaatccagtcagtctacacgtgagtgctgagcctgggcatcattcagaggtccttagagcccctatgccatggcaaaggctgccccccacagggagcagggcaccctctttctcacttcattcaggagctgaagcaaacaccagcacatgcaggctaaatagtaagaggctcaggcatctgctgatcttggtaaacttcagtgtttgctggaaccctcagaccccatacctttttcttttcttcatagctagtactgtggctataaagtaccagtacagttctgactgtacttttcaggcacctaaactattcaaagcacattttcaaatttatccctctcttcttttcacaatggtaatcaggagaccatctgagcttatttaactaaaaattctattacttccaggtcagagaacagggaaactaagcgtaaagaaagaaaataattttgccttcaatgtttaacctggctttcattacaggagtattatttcatactctcagaatccctttccctaccccaggttacatcttcacctgagcaaagcccagatatcacaggtaaaagttcttgtaaatataaaaagtatcccaatgtttgcacccatagtaatgcaacatttattgtgtcctaccatgaaacagccactaaactaagttctagatacaaagataaataagccttgctccctgcccttgaaagacagagtctagcgggggagacgacacacaaataggtaagttacagtgtacatacttttaaaatacaaaaatatatctttcttaatttgtaattcaatcaatttttcagtacccttgcaatcttttatattattaaccaaattgaaatcacagcagctagacacaaacgttctgtactttacttgaaacggtcatctataaagaccagagtacataggcactacattgcaaaacggactgaagtttaggtagatacatttatttagctaacagaataaaaacacttcacactttctgtgagtttttcaatgcagattacatccaggccagagatatgagaaacgcactttgacttaagcagtacaaaactaaaatcaaaggaattaaatagattgtcaatcaataatactattttaaaacattagaagtatttttaaaaggggagaagggctggaaaagtctagaaaagcttcccagaagggtcttgaaagagcttctaaacaaagagggtagaaaggctttcaaggcacaggaatgataaaaggccccattacatccagtatattgagaagttcagtgaggaagggaaagggtttctcagagagctacggaatgaagcaggaaaaactcgctgggaacagactgaggaggcccttttgctggcaagctaaggagttgacattaactccgtagtctgcagaggctcagaaacaatggcctgcccaatttgctttgtaggaaagaatttcaagggtagctaccatgagacggggtaggcggaccatgtagatacaaagactggagtgggacagtggttcaggagagagaccacggagacatgaactaaggcatggtatgggaatggagagcagagaccagataagagtcatttctgaagtagaaaccctaggatcaggtgacagactgtaggaggtgaaagcaggggagaagtcaagagtgcttctgatgttactggtttaggcaagaatagatactaacactattaactgaaattgaccatgaaaatacagtcatgtgctgcataacattttggtccatgacggaccacatatatgacagtggtcccatgagattacaatgaagttgaaaaattcctattgcctcatcctgtcttcataatcctgacccaatataggcctaggctactgtgtatacttgtgtcttagattttgacaacaaagtttaaaaagttaataaacattaaacatttttaaaacagaaagaagcttacagaagaatataaagaaaatatttttacacagctgtacactgtgtagagtcaaagttttaaaaattaagtttataacataaagtcacagtaagctaaattattattgaagaaagaaaaatattttttatcaatttagtatagcctaagtatatagtgtttataaaacctacagttatgtacagtaatgtcctaggccttcacattcactcaccactcacccctgactacccagagcaacttccagtcctgcaagctccattcatggtaagtgcccccctatacatatcattttttaatcttttataccatatttttactgtactttttctatgtttagatatataaatacttaccatgtgctacaaccacctacagtattcagtacagtaacctgctgtacaggtttgtagcctaggagcaacaggctgtaccgtctagcctagaagtgtagcaggctatgccatctaggtttgtgtaagtacactctatggtgttcacacaatgacagagtcgcccaatgatgtatttctcagaatgtgtcttaggcaaaacaaggctgtactggtgtcgaagcagaattaatgaggtagtggctgtgggtggggacagtgggctaatgcatatattaaagtcttaagtgttagcaggacaaactggtataaacctaagaaaaatggtttaggttagatggctgggtgccgtggctcatgcctggaatcccagtactttgggaggctgaggtgggaggatgacttgatgccaggagtttgagaccagactaggcaatatagtgagacccctctccccgcaccaatttccaaaaaaaaaaggaaaggtttaagttagagaaatccagacttgaaagtcaccatcagcacagaagaatggtggaaacagtggtaggaattctggtgagaaatcacccacagaaaggaagctgagtaagaggaaaaccaggacattacaccatatgtaagcagagctcgaagaagcctctagatgaaaagctggagaaggcccaacccaagaggtaggaaagccaggagggtgtcgttccgggagccttggagggagagctgggaggagaacggggttgtcagtcatgcctaatgcttctgggggtcaatggaaacaaggatgagaaaaagccattgggctttgcaatcaggaggttactggtgacatcagaggaaagttcgaatactgggggccaacttcacacagttacgaagtgaggagtagtaaagagattggagatagtgagtgtagactattttaagacgctttcacatcaaatttttaaccctaacaatggaatgaaggggaggtagggttaagagttgatttttagatgaggagacttgaatgtgttttaggctgaggggcaggtgccattgaagaggtagagtttaaaagtataggaggggtgatagctggtggagtaagattctgtgagaagtacgagggaccatgggaaagggagggggggtctgccccaatatgtaggcagccagtagtgcactaagggcaggaaccccgaggtacaattttctttctttttttttttttttgagacagagtctcacttcattgcccaggctggagtgcagtggtgtgatctcagctcactgcaacctccacttcccaggttcaagtgattctcctgcctcagcctcatgagtagctggaattacaggcatatgtcaccatgcccggctaattttcatatttttagtagagatggggtttcaccatgttggccaggctggtctcaaactcctgaccttaagtgatctgcccactttggccttccaaagtgctgggattacagatgtgagctactgtgcccagacaccccaggaacaatttagtccctaggccaacaaataagtttttagggaggaatatttaatcactgacattgtttataatcactggtacatgaaattaataaaaagtagacactgagttggtttcatgatggtttaaaattctctgcagaagaggcacccacttattacctgcacctcttatttatgtgcacttctcgcaatgctcccccactttgtgtgctactggaaaacacctcctttgagatgagaggtaaagactcatgagtaggtatagagaagggattcagtcctgatggtttttattttttctgtgtgctgtaagatgaaacgcggggaattaggagagtggaaaagtgttagagcagctacaagtcatgacacagtaccagggacctgcgccttgggtgctaaacggtctcactccgcctacaactcttcttttgtgggggctgctgcttacagtgtcatcagtgagaaaaagcaagcaggagctttctcctccctacttgattcatatcccgtaataaggttaaagtccagcaggttttgcttggcacatagtcagtcctcctgcctgaagcaataaggcaccagcagattctccagatgctgtggcactgggaatctttcttcagaacctggagaaagttgaagaattggacaggaaggccagaaagaaatttatccttgagtcatgcttgcacctttgtcaatttgcacaggatgaatatctattttgcacactctacagaaaaaatattttttactattaagagcctgaagattgtgcttgcatattgatttctttgaccaccccccagagcaatcagcatcaataacattgccccacccaacagaggatacatgaacacacccccaacacatgcacccatacccctgaaaggacatatgaacctatttgccactcagggttattccaaaccaataaaaataaaagcatacttcaaatttcaagctactttttgggtggatcccattttgggattgccagtcactatgttaaaggatatagggtgataactttttggagcagttctgcagaggagatgacaattcggtgcatggtcagcatgacttgcaacagttggttacttcgacacaggtttccatctgcatctgaaaatataaagagcagcacctgagttaggccctggagggaaactagtcacctggtagacacctgcaaaccctctgtgactcaggtgcaatccttcaggcacagtgattttcttccactgcccctagcacagcccccctctgtttttctcatcctcctgctacattcttcccttgcagaatgtccattttgatgctcattaactaccccttttcctctccacagtggtaaaatcgggaaagggataaaatctgcatcagcacacttgagtctcactgaaagcagaagcagatccaggttttgtggggcctaaagttcatataactggttggggggtgggcagggagagaattctctggggtcagagtgagaaaagttggtttttaatagattgcagttaaaatatcttacctttacaaattttacaaaaacaaatgaccatatgaatacatttctagggccgtcccatggccttggaaggggctcatgcaagtgaggagccctgaaatatatgcttctccagttttatggttaatatgcctctggatggaaataaaagaagactatgggcaaacattacattttaagattgcaagtggattacaagtactcatgatgatttgtattaaagaacatggttagctaggttttctaaatcccagctggcacaaaataataagatgcatttatacactggcattgggtaaaaagattccccttggagtggttttcaaaatcttttcaacatttatggcatgaagtgttaggagctctgctggttattctctgccagatctattctttcaccatgaaaaatatcagcccactcacttgccagctggcttccagttgggtttagccattgggaagcaccagcaagagactgggagtggagggaagtcaggatatttgtttttcattccctctctgcattgacaccactcccctgacagtgactacatatcttttcaatgaatgatcatgctggttggtcctcccttcatggcaccagctctcgttggatctaatactattaatctcctttggccccctggccccaagggtggtaatgactcctgagtgttgatagtttctggatacatctcttaattccactctcatctctgtaaatagtcccttcattacaatgtcttcatttatacgaactgaattctgttccagactgggaacttcaattattcaaggcaagagtatcaaatgaaagaatatacatgaattgttttgtcatctgtattgctctttatattaaaggggttatcatgttcactctgcttcaaatgtaccaaatggtaaatgaaggacacagtgcttttgggctcaggattcagaagtcttggctcctcaaacgacgatctaaagtcatatctcattgagaaaatataagtggctgggcacagtggctcatgcttgtaatcccagtgctttgggaggtcaaggtgggaggatcgcttgaggtcaggagtttgaggctgcagtgagctatgataacatcactgcactctgtctgggtgacagagcatgagcccatctcaataattaaagtgtatatattaaaatgtatatatatatgtatatgtaaactgacagtgtctttcatcttcccatccccaaatccaccatttcactggtactctgttgcccttatcccctgccctctcctgttagcatggaaggccaacacttcactgtgctctgggtctccccctttctcaaggacgttgatcctgcatttgtccattttctctcccacaatatcaacttttctctctgtgggtttatttccattgtcattgaaatatgcctctgcatctccaattcaaaaccaaataaaacaaaaccttaaactctcatcctctctagctacttatttctctattcccatttttagcaaaacctcactgttatcagtttcttttctcccatttacttttcaatcattccatttgacttctgtgtccattattccactaaatcttttatttttcaaagttaccaatcagctccacactgccaaatccagcagttactccttgatccttatcttactttatgactcagtagcattcaacccaacacaacccaagttgatgactctctttcctggaacactttcttctcttggcttccatagcatcacactctctcagcctctctctcaggctcttcttctgtctcctctttttctgctaagcttttaaatgtcagcatgctctgtggttgagtcctcccgctttttcttttatttattttttgacagtttttaaaatttaaaacttcttaaattttaaattaaaaataaaacactttcactactattttctagatgaactcatttagtctcttggctaaaataccatctatatgctgatgactgcccaactggtatcttcagccttcgctacccaattagtatgtccagcagcctacctggcaaatccaattcaacgtctaagttcagacttaactcattcaaacaaaactcctgatctctccctcccctgagttcattgttcctcgcatctgcctcatctccagaaatggcaccaccaaccatcctctcagttaccccaactaaaaacctagccattatcctttatttctcatgttccttcacatccaatccatcaggaagtcttgattctacctccaatatatatctcaaacctgttcatttctctccatccttggcctcaccctagttgtagccaccatgatgcaatgacttaatcgacctccttgcttccactcttgtccacctacaatctattccctatacagaagtcaggacaaactcctaaaacctataaatcaagtcatgcacttagtacacttcagtggattccattccacttggaataaaacggactccttactgtggccaaaaaagcactacatgtcctggcctctttaaatatcatccacttcatttcataccacattgctcctctccacacctctaattgtacctcaaacactcccagcttattcctacctcagggcctttgcatttgctattttcttcaatgtagtctttcttcccttgaattactgatgtcattttggtcttagtttcaatgtcacatcctcagagaagtcttttctaaactacctaaggtattccttaccctgcctgagttttctcatggtacttaccattatctgaagttatctgctttatttatttaattttttattttctaaatctccagtagaatacaagtttcatgagacctgggccttgtccactttttccacaactatatttccagggcctagaatggtactgacacatgattcattcaacatttcttgagtaaatgagtgaactatatcgaataggaaacacgttaacttttcacagatatttagaaattgagtttgctttcgtcattacctatttcattcgtgaaatgtaatatacacatttatcttcttcctggtcacagtttgcaaaagaaattcaaagttacaatttggtaaatcatttttaaaaagtgttcatctagcttggttatagttttgtaaatctttcattaattcttctaaacttgtactctgtccaggtagggttagtattactttatgttttctggccccacataatttccataataattatttcttgccacaaaaattctgcataaccaaccaccccaaaactcagtgccttaaaacagtaatcacttacttttgctcaagtttctgtgagttggttacaatcagctagtgcaggctgggtgctgctgggggccctagcctacatgcctccctgcttccttgggccagtaggctagtgggggtaggttatctcatgatgatggcagaacactgaagagtaactggaaatacccagggcctctgaagcctaggtttggagctggcgtgctgtttcttctgactcattctgttggccaaagcaagtcacactactgaatataaagtcaaagggcaggaactgcaaagtcacatggaacatagcactgacatagagaaggtaaaaagtcagggggcaataatgcaatcaaacctaccacaattacaaggggtggcttttcaatgcagcatttgacaatacagtctttacagtgtacccttcctcacaggtagcagtgttcatattcctgaacactctggtgaaactacagtgaaaagaaggaactgtgacatatacttgtagggtatgcattagaatgttcacaagaaccatggacaaaagccagcttattcagtatggatggcatctaaaacttgccatctcaactttcctttatggctggttagcatcttcccatagatactcatatgtgaggaaaagggacttagacgtgtcctgggtgagatcaaaactaagtcacctatggaaggattccaggaactaaagggtttaccatgaagaaaacttggggaagagattaaaattgtcttcaaatatctgaagtgttctttgtgggagttggtttagacttgttctatggggccacaaaaggcagcaccagagtagatggatagaaattataggaaataggattgggcacaacatgtggcagaaaattctagccatcagcactgtctaatgatggaagcattgccatcacagagatattaaaaaagagcctgaagagcaacacttaataagcattattgtaattagcatagcagctatcatttattgaagccctactaaataccaggagctgtgctaaacactttaaccatgttctaactctcaacaacaagcattgttcacaactcacagctgaggaaatcaaagcatagagagattaggtaatttgttctaggtcaaagggacaatgggtggaggagctgggacctggcccaaggtctgtctgattccagagccccttctctttccactatacctggctgcatgctgaatcaccattcgtcaggataaggaattcaagaataaagtgggagctgagctttacgaactcttccagtccttatggctacaagtctaagaaatctcactaaggtcacagccactgcacatttcgtgaaatagcttttgtactctggtgatttctgaaaaactcttgtgaactttggttgatggatactaatcttaaaaattgcctttaagaactcagggttctgtgcttaagattcacaatcatattcacacttcacctttaccttgcactgcttttccacagtttcagtgacgttcccaaagtacggcttgttaatcctcacatggtctctgtgggagtgagtgctggcaaatggtaaggctggcagaggatgactcactcagccaagggaggcagagatgtggttagggaaagagcagacagaaacactctctctctacacccagtccagaactccgaggtaactcctctccagtcctggttctacttttcaacgagagaatggttcagtgtagtcacttgccctcattcccaccaccagctctcccacacataagctccagctctatacaacctcatcagggatatgtcccttcctgccctcattccgtacagcatgctcttcttcctttttgaacaacctcatcggggatacgtcccttcctgccctcattctgtacagcatgctcttcttcctttttgagaggaagagcctccctttgaaagacgagattttcaaagtgggtggtcaaggaagatctaccttccaggctgctagattttattttcatattttgagataattgctgcaagctgatttaaatatttcaaagaataattccattttgttttcatctttaggctttttaaaatgcagggtgtcatactaaaaattctaataagtaaaatgtgcaacgcataataaaatgtgcgtattttttcattaccatctgcttctccttacacttacaggaaaagacttctttaaagggttgaagcctcagtggggtacacaatgttgatcttacatactctgccatttgactaggggagtaatgtaagctgctagagaagcatattaattaaagactcactcaacctgcagaccacttgctcaagaaaacagaaaaactaagcggattctggagagtcatctgtctctgggccaacagcctattttccaccgttagactcagtgctggcatcccatagtttatgagatcacaatcagggtggaaaaggctagccatcttctacctcttctttctatccaaatgcattattccctcctaaaaccatcacaggtaagtggttgtctggcctctacttggacccctccaatgacaggatatggcttcctaactattctatatagcaactgttcattctacttcaagtagaaataatttttgacaccactaaccaacattgataatgaatctaccctatggaaagcactgtcctaggtactaaaggagatctgaagaaccatatgaaaactgctgttattgcctgaaataagctccttgcctctgagagagaagacctgctccctgatgatcagagtctcgtgagagaaaactggcaaagggtggtgatgcagaccctgctccttgctgataagaggtgggggccagctttcctacagtgaaggcttgtctgggggatgagatggaaatgccttgctgcaagatgaacatgaaacatgaaaacaaacgtccagcaccaggcagcaactccggaacagtcacttcttctcctttgttttggtttccaaggaaatctcttgatgtgtgaaggtattttgagtgtaccagagacagatcagcatatgaaggataggcaagctgtcagcattgagggcctaacatgaaataacaggtgtgccacaaccagaggccagagggtggtaatgggaaagctaggatcagaaaacctaggggcaaggttagagcagagcctgtggtaaggctgaggttgataatggaggtcagtatctccagaaacatggttaggctgggtctaggttgaacctggtaggtatacacacagaattctaaataaataactatgtgataaatattccaaagaagtaaaacctatttgtcagcaagattattacattcattaaatcctgtttggagactgtataaaaattggcaagctgaaaataagatcagtagagtttgttttctggtcgttgtttgtttagttttttagagcggacggcagcaacttaggcaggaagtgcatgtgaagaaacaatgtggtgatacaaactttgaacttgtataccgtctatgacctgagccacttcatacatatcaccaaggccactttggtctctgttagtccccagcccctcaagactcaggggaggagaacaatcgggagaaagcaagtgatctgctaaggattaagtcctgcttttcagggaaagtgagaatccattatggttgccaccagcaggatgcttgcaagagtttaatgtaaagctctcctgggagagaagtgagaggaaccctggtttgtagtgttcacgtatttgcatggtgtaaatacttccactatggccagtttcaagctaccaacatgaagtcactgaacatgcacctaggaagagatgcttgcagtcagctctcaggacaggtgtgggccacctccagcatgcacccacagcagctgcaagcctcctcaagagggctggtgcttgctgggcttccttttgtattccttcctgtctggtttccttgctccccaggtgttcctgaacccattccactcctcatctcactcctaatctcatgccctctgggccttgcccaatgactggacagttaatccagatcaacaaattcctctgcaggagacaaggacttcaagggtgaatcctctcagagaaatccacattgcaacagcagtttcttgaagtggttggtgctctaaaccaagaacaaaaatgttaatataaggtgagaatttgggagaagggaagctcagttccttgtaaagcttgtcctgttcttctttctgggataacctggtatgtcataccctggcccacataggacagcctgccatatagttagactagtgtctatttcttgtcatattatggtgtccaggaatttatggagctctgaatatcttggttacaattggcttttaattatttacttgtaatggctgggggacaccataacatggacaatacacaagctttaaattaaccctgacctgcaatttcaaacttttacaacaggcctttaagcggagtcttactaaagcaggagaggggctggccaggctcatctcttctctcccacccaactgctggggcagtgatgacagctggtgccacaaccaaggccacagacacagaagagggaaaaatctggttaacccacccccagacaaaggtgatttgttctaaccaagcctccctcaactcctgttgcagagaagccaacgtggaaaagacttgaaggaaaagaacccatgcttcctgcctctgttctattgatattcactgtcctgctggggccagagtagtagagcaggaaggaggagcaggcctttcaagttgcacagcatctaggtacacaggaacagacctgtacaaaatgagcacatgcccacacaaaccatccctgaagcaagcgagtggctgaagaaccacactattctctctgggtgagaacacctgataatgatatgttacgtttttgtggcacttaggttcaacaaacagcttcacttgtgttgaacatttgcattgtacagcagctcaatgcagcagcagaaccatgagctgaaatttaaaaatgagaaaactgaagcaacatgcctcagccatggtgagtagaggaacctccacaagaagggccctctcactcccagcccaaggctctttctttggcatgtccttctcctcggggcttaggaggcaggtaggaatatacttggaagagctctaccattttggccatccatgttacatggctaaacctctcacccacacctctattctttcttcctccccaggaagccctacacccccaacagacccacccagcccttctcactggaattatggtacatactttaaaaatgtccttagaaagcctaatccttaaacccaccacttttcatgacatcaacacaaggcagctattattggcaccatttactcagagactctgtgagtcagtggccagggggtgaaaattcacgtcccctaagggcccacagtgcctgcgctggtccatctctccctcttcccacagcagaagcactctctactgcctcagccaaaccagacatcaacagaaacgctcctccctgggcctggctttccttccaaagtgtgaagctctatgtaaagaatgacctagattttttggatgagcagttgaagtctataaatgtctaaccaagtgcatgaattgcctaaagtgagaaagagcttttagctgtattgtctctgctgagcaagacagctggccttccttggggattgcagtctcgatctggacttgtcatgtctgaagaatcatgagtctcagaagtcaggagggaagttggtcctcttcagttctggaaattggacacaagtctgtgggtggggtttggggactggggctaggaaataaacagaagagcagggaagaggtactgcaagtcccgagcagacccagtgagctgactctgggacaacgctatgacttcaaactctaagagcatttgttgaagtcagtgccgactgaatatacctggtggctacttcttctgggtcccatcaaactctctaggaacaattgaattatctggctgggtagttatgctacagtttgattctttgatgagctgccatgcacgcaaccccatggctcatagacattgaccattcccatgcagcactatagacatgagccaggcaagggaagaaggagcagcggggccctgtcctagcttcccagaaggacacagagagctgccagcagcttgctgggaggagggctggcaaagggccagtggacccaaagaaaaagaaataaacaaactgggaagaaaatctgggtcaggctcttaccttgctcactggagcatatttgtatcacgtcattcttatctattaaattcttggccttttttgcatattttcagacatgcccaataggcacgaagaagcaacttggagaacttcccaaatacttacacaacaaaataatataaggcccatctgagaattactggttagccatgacctcagccttcctcagacaatttttctcaatgagtgacttggtcccatcagacccacaagcctagataatagataacctcattccagtgcatgatggaattgtgggaaacagtgtatgctgacataaaatagaaatccactgaccatagtcttattgtaaaatatgcttttcaccacagaaactgttctttaattgcttataattctctgcaatgaacagtctcgtacaaaaaaacatcacatcaccatgtagggtaaaaagtaactgaacagagtcttttgaaatcagatagaaattattctgaaagtttcctcaccccttctttggttgtggttaggattagatgatgtttgattaaatacataaaaatgcttagaaaagtgtgaagcactataacagtgatgaattattcttatttctcttgctagatttaagcactattttgtttttttttcctttgttctggctattttttttctttgtttggctattccagactggaaccatgatttttttgtcccttaactatgaccactactcaaggagtggctgtccactgtagttcatcactgtgccagcgagactggacccctcaagcatggggtcctccttggcagttagttggtggctgtgttagtccattcttgcattgctataaagaaaatataatttataaagaaaagaaatttaattggttcaaggttctgcaggctgaataagaaacatagcagcatttgcttctgggaagccctcaggaagcttacaatcatggtagagggtgaaaaagcaggcacgtcacatggtgaaagcaggagcaagagggagagggaggaagtgccacacatctggctgggtagttatgctacagtttgattctttgatgagctgccatgcacgcaaccccatggctcatagacattgaccattcccatgcagcactatagacatgagccaggcaagggaagcaggagcagtggggccctgtcctagcttcccagagggacatatatctcatgagaactcactatcatggggacagtaccaagaggagggtactaaaccattcatgagaaacctacccccatgatccaggcatctcccaccaggccccatctccaacattacatttcaacatgagatttgggcaggaacaacatcccaactatattagtagccttccaagcttcccttcaatcctaggttttaagcgcactcccccaacgccagaaccctcaagagtttacagaggtgctagagagaagtgagcaggaggacctggagagccactctgaagtgagaactgcaccggtgagtgaggaatctcttactattcaaaggaaagaaactggtctctattcagtagtcaagagctgaataggaatgtgcttcaaggggctgggcacggtggctcatgcctgtaatcccagcactttgggaggctgaggcaggcagattacccgaggtcaggagttcaagaccagcctagccaacatgacaaaacctcgtctctactaaaaatacaaaaattagctgggtgtggtggtgggcgcctgtaatctcagctactcaggaggctgaggcatgagaatagcttgaacctgggaggcggaggttgcagtgagccaagattgcaccactgcactctagcctgggggatagagcaagactctgtctccataaacaaaatgaaacaaaaaagaatgtgcttcagaacatcctaagtcatgaattgatgtgttgtatcactgtcctacagaaatagccaaaatgcaacactgaaactaacaatgttgttacttattggaagatgggggagaccaggagaaatatttgagattgttggaagaaatgcagcatctaaccagaagaaatgaactacattcaaggtttagccacccccgtcttctctttttgctaacatacttggagcacttcctgtgtaccagacactgtttcaagacagcctttacgtatattaaccctgtgagacaggtgccatctgacagatgaagaaactgaggcaaggaagtaaggtaatttgtccaagtttacacagctagtaagtagtagacctgagattcaaacccaggctgcctggctctgggatggccctgattgtttctgagcctcaatttgctctttgcagaatgagagcttcataatgtcttacgcccaccccttccaacagagagataatccagagatggcactcaagataagaaaaaagtgttaatatcttttgaggagaacaaggttctgaactgagttcacaccacggatgtctggttaacttgtgggtcccaaatagttacggtgcctgacagttgtcacgtaggcacatgaaaccctcaccctggtgctgaagtactaataacctctatttattagcgttttatgaatgaccactctcctcacacgttgcctcatctgagcctcacaactctgagagatgggtattatttgcattattttataggtgaggaaacagagagtaaggtggtatgacttgcctaaagtcacccatcttatgagtgacagtgctgtgacttgagttccagtcttctgaggtaaaccctgccctttccaccagataccactgcctctcaccctgacagctgtaaagataaaaagcacatagtctacctgggtattgagggtttccagagctggcctgcatgctaaatgagaatataataaatgccaccatatactgaaccatccaccatgtgccaggagtgaactaggccatgttacagacatgctctcaatatttactacaattctgcatgatcgatgttttctctgtttcacacatgaagaaacagagtcaagagaggtaaaaatatctagtcaatgtcccacagctaggaagtagcaagaaggggctacaaattatcaccctggttattttatcattatgttttaaagttattaatatctaccacagtcctgcattgccgtttttttttttgtttttatttatttatttattattattatactttaagttttagggtacatgtgcacaatgtgcaggttagttacatatgtatacatgtgccatgctggtgtgccgcacccactaactcgtcatctagcattaggtatatctcccaatgctatccctccccgctcctcccaccccacaacagtccccagagtgtgatgttccccttcctgtgtccatgtgttctcattgttcaattcccacctatgagtgagaatatgcggtgtttggttttttgttcttgcgatagtttactgagaatgatgatttccaatttcatccatgtccctacaaaggacatgaactcatctttgccgtttgtttttatttttattttttgagacaaggtctcactctattgcccaggccggagtgcagtggtataatcatggctcactgcacacttgacttcctgggctcaagtaaccttcccacctcagcctcctaagtatctgggactataggcacacatcaccatgccaggctaattcttttttattattattatattttgtagagatgaggtcctgctgtgttgcccaggctggtcttgaactcctgggctcaagcgatcctcccacctcggccggccaaagttctgggattataggcatgagtcactgtggccatccctgcattgccttttaaatgggaatccttcaagagtaagtaaaagggttgtgtctattttctgtctgttccctacagtctctagttctctgctgtacacactacactggggccatttccttcatttaaatcaaagcatataagaacaaacattaacattgactggcaactaatgataaacacaaaacagtaactgggcactgaatatgaggaaagagtgaaatgcatttggaagagaaaagtggctaaggatttgtatccccaggatctgcagacctgagggcatgtgggaaggcgatggtgaggaaattaagacagtttttaaggaagtaaaagggtaaaaagaggaggcaagaaactataaagacaaagcagtgactaagatttagactgtccctttaatctatgttaatgtctctggcatttaactccatttacagatctaggcagagcagctccttgccatatggtgacaatcagatgagtctgagatgcccagatatctttaaggatcctgaattttaaggtcattgtgcaatagaacaaggtgtcctcaaataaggaaaacttaggttaaaattcaaaaagcctttttaggtttttgttttatttagcttttccaaaatatatgtactgaaacattgatatttttcaggcctaaaaaggggccatccttgaaggagctgatattctgagtttccttaggacctaacaggctgattccaggatttctcagatttgcagtgtcctgctcaattactcaacaactccttggtttgctcctgggagactgctctgagcagagcagagcagaccatgagaccatgttgagggctgggcaaccaaccccacacacgggcactagaaataccaccaggcaaccctgacttacatttgtatagcactttgtactttacagagtactttcacatgcattatctcatttgaccatcacaacaaccttttgaggtgggtagggactgtatccactttaccgacaataaaagcataaagacagggctaatccccagcctggccagcgggcgtctaaatgaagggacatgtgccatgctggttaaatattttgaaggccaggtgtggtgacgtgtaatcacagcacttggggagtctggggcgggaggatcacctgagctcaggagtttgagaccagcctgggcaacgcagcaggacctcatctctactgagaataaaaaaatattagctggcatggtggctcatgactatggtcccagctatttgggaggctgaggtaagaggatcatttgagccagggaagtggaggctgcactgagccgtgattgtgccactgcactccagactgggtgatagagcaagaccctgtcatttattcattcatatatatatatacacacacacataaatattctgaatgtcacccctggataaatcactaacccacggataataccatcaagtggcagagctggcatcctagacttggcttttctcatcacaagaccagagttctttgctcaaagagcactgtgataggtactgtgggattgcagatataataagcaccctgtcccaagcctgaagaagctacaggcaatactacagtacatggtacagtcagggcctagagggaggtaaacacgggcagttcagaggaaggggaaagtcagatttgactggaagaaatggctaaagcttcataaagatggtagcatttgagatggaccttgaaggaagggtcagattctgatagactaagaggcaggtgagacttttcaagacctcctgattagcttaccaacaaaactaaggctgggcctggggtggcagcttacccattaggtgcctataatcccagcactctgggaggccgagatgggaggatcacttgaacccaggagttcaagtcttcaataagctgatactgtcactgcaatccagcttgggtgacacagaggcaaggccctgtctcaaacaaacaacacactaaactaaaaaataacaacaaaagcagaacaaaaactggtctgactgaagtggtgtttacaactaattgatcacaaccagttacaggtttctttgtttcttctccactctcactgcttcattgactggcctaaacaaaacaacaaacaaaaaaccaccaacggaactcaaaatagattccaaggccttacctaatacctactccatcaagagatccagggatggagcagagaatttgcattcttaaaaagctcccaagggatcagatcaagtttgattagactgatttagaccattgagttcatccttgccctggagtagatctacaagctatactagatgaccccatgaagacctcttccaatttcagaaatcggcagtgaagtctttcgcctgttctcagggcaacatgcaagggaagtacttaacacagctgatttggtgcctgcctatattacagactccttgatggggcttggttaattctaatttcaaaagcatgatcagaaatcaatctggtgtgagccagagggtcccaataatggcaattcatctgggccacagggaattttcctttgtatactagcataaaatgaagttcttgtcagatatatacatatatatgtgtatatatatatatgtgtatatatatacacatatatgtgtatatatatacacatatatgtgtatatatatacacatatatatgtgtgtatatatatgtgtgtgtatatatatatatacacacatacatatatatattccccaagtatttttcttccattcatttctttaatggtatcttttgatgagaagtttttgatttttataaagtccaatttgctaaatatattatttatggttagtcctttgtgtcctgtctaaaaaatactctaagtttgcaaaaacattgtcctaaatttccttctagaagacttatcgttttaactttacattcaggttaacattatttacagttacatcatttgattcatctcattttttgtgtatggtgtgagacacaggtcacagttcattttttttcatgactgtcatttgttccatcaccatttgttgagaggatactcctttcttcgttaacctgccctggtgcctttgctgaggatcaactgaccgtatatgtagatttcttccagaacgtgctattctgtaccactgatatatttgtctatccttatatgtatatcacatggacttgattactatagctttatattaagtcttgaaaacaggtagtgtaaattttccacttcattctttttcaagattctggttattccaggtcctttcatgtccatttaaactctggttacatcatctgaaactctagtcttttttttttttttttttttcagcattttctctctgagatattgacctgtcattgactttactgacctttctttttttctttttttctttttttttttttgcatccactatagtattaagcccatccagttaatttttctttttggtatattttatttttcagttctagaattccatttggttcctttaattgttgcaatttatctgctaaggtcatcttactttacttacatctattcatcttactttaaatcctccaacatatttatttataatagctgctttaaattctctatctactaattccaacatttgtgtcatctctgagttcatttctattgatcttttttgttctggttatgagtcacattttcctgcttctttttctgtcttataatttttattacatgctgggcattgtaagtgcaatattgataatttgaattattaatatgttcctttatggtggtatttaattcatgggaccttaaattaatcctgttgaagctcagatttaggcttcattagggtgagtcaagattagctcatattctagggctaaagtagcccaactcctacattgtagtctttttctcatcccacctgaatgcccaaagtgttatgtctctccattttggctggttggaactgcgttatttcccagaccatgagacctcctttaactcaaagacccccaggaactattaggggtcgtagagtctcatcatatccatgcacagtttagtctttggaaataccttctctcttgtatgccactccacaaatgccagccatcccagaatccctgaacacaaactgttctctctgtgctgtggtttgaatgtccctccaaaatttgttgaaatttaatattgtcattgtaacagtattaggaggtgaggcctttaagaggtgactgggtcacgaggggttcaccctcatgaatggattaactccatatcttgggaaagggttagttatcttgggagtttggcccccttcttctctgtcttgcaagcactctctctgtctgtgtgatgccttctgccatgttatgacataacaagatgtggtcccttcattttgcacttcccagcctccagaatcataagccaaataaatctctttataaattacccagtctggtattctgttgcagcagcagaaaacgaactaagatactccgcaaggcaagatgctgctcactgggctccagtttcctgtaccatgatttgtaaagtgctctcaggcagaaagccaagaggagttttgagttaacctcacatctttttattttatccacaatcacatgtctgtcttgttttctgagacccaaaaatagttgcttcagatattttgtccagttttatagctgttggtagcaggaaaataattctaatatccagtattccactatggtcagatatgaaagttctccttttgatgtttaatttttttatgggaagtcccagttctttggtagatttaaatttgtttaccctttatatgtcccactggaggtaaataactcatactagctcttctatggttattactattgagacatacatgtttacattattaagaaaacaaaggggaaaacccacttatttgtcttcttttcaggttctgccatcttatatcctcacagatgttatttctgtataatttcttaactatttatctcctctgcactctctctagcctttccattcccatcttaaaatccagaaactaaacttgaatctaatagcatgctgcactctagtgtttggtcagatcttggttatgacagatactgcttcatatgcccagcacaatagccttcctttaggaaacgctccttccccagattccgtcatgtggttttagagagaaatgctggattattaaatgactccaaccctgtggccacagtcaattcattcaagcagtagccacctggccaaatctgaaccaaagttcttccctgacagttttttttttttcactgaacttgagggaaaaaaatattaaatttctaatggtaagagatgcatgatttacagctgttagtgccatgtagaaaacaaatcttcagtgaaagaaaatgatgagctgacaagcagagagaagcaagtcagacagagaagagacacatacatacacagaacatatgcaatagtctcctaaaagtattatagtacctaatttcaggcactcctaaggcctgcaggcatcctgtactcttcctgtgttttagatatatgaaatactccatattatttctaataaattcccaaagatagttctggttggatttccatcattgtcctaatattttgaaaaatgagagacttttcaggtcttccttactaaacactgcattaatacagctcaaattcatgggaaaatttaaattataacactctcttctagtctcatagctgttcgtgtctattatgacaccatcctggtaatttttttggcatagccattataaccatcttgtatctccatgatgtgattttggatcctctggcaagctgcattattaacctgaaaaagccatacactaacacttaacaagtctatactaataatgattgctactgtttttgagtatgtactgcagattggaattttaataacattttacataaattataactttatttatttatttatttatttttgagatggagtcccgctctgtcaccaggctggagtgcggtggcgcaatcttggctcactgcaacctctgcctcctgggttcaagtgattctcttgcctcagcctccagagtattctgttgcggctggggctacaggtgtgcaccaccacacccagctaatttttgtatttttagtagagacggagtttcaccatgttggccaggatggtttcgatctcttgacctcacgattcgcctgccacctcggcctcccaaagtgctgggattacaggcgtgagccaccgtgctgggccataaattctaactttctggtaagatgcttacttcacgacaatccaggggaagtatctactaactttcaggttgatagaaactgagtctccgaaacattaagacaccggctaagggaataaagttactatgtgtcagcattaggactggacctcaggatagaatggaggcattactcccttaacatggaaaggctatttctgttgaggcaatctctaattattttaacttttggaaagttaatattctggggaagacacacgacactactgactcatgttgaatttacaatctactaaaatctcttggtattggtcataagaactacaattaatacagcttccccccatccagaacatataggaagcactatttttaaacttaagtgcgagactttacgttttattgaagtcctgtttgtctaagttctttgtgctatgttattcacatcctgaattctgctaattatgctatttcccacagtgtgtctaaccaaaaacacagattgtgtttaaatctgatgaaaatgtccacagccactcataaatggttcacctgcagaaggacatccttcaatactcatatctacatgtatacactttgagtacgactataaactagctttgaaactgtttatgtggattttcatgtagcctatatttgcccatctaacatttactttttgacttcgtagcagagcctgtaagttcccacacacatactctcagaccttcccattgtaatgcatgccaactcaacttccaccagcctgagaggtttctggaagcccttcacacccccacctgtgtgcagggcaggccaaatgtgctgcaaacttaacaccctctaaaagcagccctcaaccaatgaccgatgggacttggtacatcaatgctccagttcctttccctcagataagataggtctgaaaagagccttccactctgactcccagagttgtaacttggcaatgcaccctccaagagctgccttccctactcccctaccagtttttcctaggaccaccttccaaagtaaactatttgtacttaaaaatccttgtctcaggatctgctcctgggaaaactcaaactaagacaatcttgttaaatttccacccaaagtaaaaccacctttaaaattttttaccattattctccattttaaaaacgggcaaacaagccccacatgtggtaaatggcagactcagtgactcagcttcagattccaaagactgccatgtgacgtggcctccataatcttttcaccgcttgctgaaatcagctgtggcacagtcatgacatttccctgctcaaaactgtgtgtgtgtgcgcgcgcgcgtgtgtgtgtgtgtgagatggggtgtggaggagagtattacattctcttacttactcaactccaactcccgcctctgacagtagcattaaagattacaagtttccaggttttttttttttttttggtctttttggatacccaggaattgagcatctcagtgctgattggggaatgcgctgtgacacgagatgtcaagtacatgacacgggtgaattattttcatgatgtgtaaccaaagtaaccattttcattctttattttcctctcccttctttaaaacagacacagccactctattttgccacctaagaaaatttagagaaatttcctaaaatccgtttgaatttttgtaatcctaaatcatctatttgtcctaggtttgaggacacttttaattttaatatattgttagaggtcgggtgcagtggctcatgcctgtaatcccaatactttggaaggctgaggtgagcagatcacttgagcccaggagtttggggccagcctgagcaacacagtgagaccctgtctctacaaaaaaatacgcatacacacacaaattagccagacatggtggcacatgcttatagtcccagctactcagaaggctgaggtgaaaggatcacttgagctgggaaggcagagactgcagtgagccaagatggcatcactgtgttccatcctgtgtgacacagcaagaccctgtctcaaaaaaagattatggaaaattataagcatgtataccatagtgagcaaaacaacgtaagggacctccatgcactcagccagctgcaacaatgatcagcatacagcagatgtggatccatctatactcctatgagtgtgtatgtgtacacacacataatttttagaaaaaaggttcacatactatgactgtttgaaatgtcttttaagtctcttttaatccagagggtcctcctccaacatttctccttgcaattttgagggtgcactttctcagttaaatgaagcttagtccatctcaggtagacactggtagttactgacaaggtaatgagactcttaggcactgggacagagagggtggggggaccacagacacaataaatgtagggagcttttcctttagggattaaagcaagccaaacagtcaggtggaccccagcatccattcccgagagcaagtgctcatccttggcaataaacgaagactgagtccagggccagaggcgagggtcctatggctcccatctgggaagcagcccctcagaaatggcagtaattcacagtctggactgaactccccaggactggaggtaaatggtgaacccaccaaggtaggtttggatgaagtaaatatggaatccaattgtggtgctcatgaactgggaaggaggaagggcagagagtgtgaaaaatcccctatgcatttggcatttaataagtgaatccaaaattaaccagtgattaattgctcatcagatttaaggatgttccatagtctataactacattccagcaagatagactcatagatgattaacagggacatttcttggcttcctgaatattgtgggttcccccttaaaatgaggctgttcacaagattacaaaaccaagtcctataccatgattcagatagatcagtgaagaggagacagacatagctccatttgctcctccaactagaaatcctcactttctggcaaagatatacctttgataagttcttggatggcttcatcccaaactgccttacttttctggtgactgcattctttgttacaaaaccggcaatccctgcttccctcttcccctctgcttccctcttccccctctagtctctactccctttgtccatttcaatgaatcactggtgtccttctaagtacatctccatcctaggaagcatcttctgcttgaaggctctagtgagaacctcagcaatctctccagggcccttgactactctttggggaaaaaaaaacaagtagttaacatggcttccttcacaccactgcccaccatctcttctgtgctgctgaagaatcacagatgtaccaaatctttgtgcttctgctacgtatctcacccagttgctaacttaatattcccttagaaggttaataggctgggcacagtggctcatgcctgtaatcccagcactttgagaggacgaggcaggtggatctcttgagctcaggagttcaaggccagcctgggcaacatggtgaaaccccatctctactaaaaatagaaaaattagctggctctggtggtgcacacccagctactcgggtggctgaggcacgagaatcacttgaacccaggaggtggaggttgcagtgagcccagatcatgccaccatactccagcctgggtgagactctgtcgccaaaaaaaaaaaaaaaaagaaaagaaaagaaaaaaaagttaatacagacaaaagatcttttcttgtttctgaaagtaaagtttctcttcagcaaaccccatctcactttcactgtaatacaaaataaaaaaaagttcacatcaagaatttttaatggaagttttgtgtttccttcatttattacaactgtaatcagccatagttactgcaattagcatgtagcattgaaaagaactgagtactcttcttttcttgtaatgtctttaattcctcattaccatcatttcagttgccaagcaaccttcacttttatgtcctatatttgaagggactaagcagaattatttttaaaaaatcaattttaaaatagaagagcaaccttgtgtgctagcatacctctttataaataataatattgatttcaagatcaaaattgtttaagatataaattatgggaagcaaaaagttatagtgagtttatcaccaaaaagttactgtgattataatacatgtaaatatccatagaagagaatcaagaaaggcacacccatgaaagttgatagtgcttatcttgctcttgatggtaaaatgagtgacggtaatttttttctttttgccagtctgtattttctacgttctctatggtgaacatgaataattttaaaagttattaacatttataaagtaagtataaatgctgagggacagttagatctttgcaaatacaagaacttataaaatagtgggaactaaatgagactacatatgtaaaatattaacataaacactgtgttattcatagtaaatgctcaaaagttagctattactaaaataatattttaaaagtctatgctagtggttgatcttatgtatatcttaccacaaagtctatgtaagaacaagaaacagtctaaattaataatttttaaagactgagttaaaaatttgttgggtttctaagactccatcctaagaatattgactcttcaaatatatccaaaagcacattcttaaaatatgcaaattcctgaaggactttcttcaagtttaatatcgtgatggagataccccattacaccttcttccagacactttaagtctcagaaatcattttaatggtatcacagcgagaaacggaggctctgagttacaaagcgaccagtccaagcgctgtggttttaaggaaatgacaatctcagaaacaaaactgaaggcttcttttttgccagcaataacttattgacaagcttgtattgatcatccacgacaatgtatgatatggaattatacactgggttaagtaaaactgattaaaatgacaatggactattaattaaatctttggaatagggatttttttaaggtttagaattttaaaaagctaaatagaaatgggcaaatttaaacacaaaaatccgaagtttctatacatgacaatatcaaaaccaacataaaaatgaaaatgagaacaggaaaaaaaatgcctatagtaaatgatattcaaagagttaacagctttttatataaaaagcttttgcacgcctctaataataaaagcattgagcagcaagtgataaataggcaaaggatatgaacagaccgttcataaaactggaaatacagtaggcaaacaaacttatgaaaacatactcaacaaaagcttggttatagacaccagtagtgcctgttaccatgcagtgggtaatgaaggcaaatgattaagcagatggaatcagaaatcaaaatagagatagcatataatacatgaagaacaaaagttcacaaaattgagggttggtcagaaacgaggctggttaatcttaagagatattttagaggtgaattaaaacaatacaaacacgaaataactttgacttcagaatgagaatctctcatgctgttttcatgttccattgtcacttctttaagaaaacttctcaaccacactgatacatgatttccttatctctaaggtccattgttcctttcctttgaagaacacacagagaggttgttttataagatacatagatgaaagcaaaataatagcagaattattactttctcttaattaagagataaaaaatagaagtctcagcttttagggtcccttcccacctcaacattttgttatgtaagcaccctctgtatctgggaaacagtggtgtgctggtaaatgtttaacaatgggctctccaggggagggattgaaaaggaagccctgattagtgatgtttgttgatttccacggtgtaaatactcccaacagactactaacaagctactaacatgacttcactgaacacggagctgggaaaagatgcatgctagcataccattatatagcgtttgtaccaggtagacataacagacataacctcaaaagcaaagataatagtaaaatgtagtcatgaattaggaagtggtgagttttgagtatttcttatctttgtttttaatataatttaattgtaagcatatataacttaattttcaatcatggctgtgtttaataactagcttgcaaaattcctgaaaatttaacaatctgctcttgtgagctggtatgagccagcccagcacaccactgctaggagataatgaaataatttttgtttcacagttgcatctatgaagaaagaaattaagacataaatccacatcgttctatgtgtcttcaatatatggcaaattatttttgccctctggtcttgtggctcttacacagacctctgactacatagttggtgggactcagtgcaattaaaaatgatggtcccttattcaaaaattattaaaaatttcaagactgtgacagcattaaaccaagcatgggaacctgtgggccttcagaggtggcatgcccaggaagctggctctgcttacattctcactctttccccgttcttttccttccagccactctagggcaagcccaactaggttgtagccaaagctcactgtaactccagaacaagacacagcagctataattgttccgggcaggagtggacaagttctaacatcagcaggtgggctgcggctggggcccgaactgtagatgaccttctccaggggtctcagggtccaacacagctgtttctgtcaattactgaaaagactgtttttgctttcacacagtttcccaatgtgttttcatcacagatttcataaacttcagttcaacatattgccttacataatctgttgccaaagtagtacttttgggtaagtactcaggagaagcactccccagttcctccccagctaagccactactgtagtcctctgacccatggggacgggcataagttacggagtagaccctcccagcaccataggaaactggagtgttgaataaaggtggaaatgtacactaggaatatggcctttgaatgcaagaatcaaactgtagttgtaacagacatccacattctatttacacagccaacagacaggcgtgctgtacattttatagggggcttactgcagttgagaagagataggaatgcagaaaaatctgataaaagtgctcccagggtttcagacctgctcttaggcagggatctcattagatctggctggattattttagagatctccaagaggctggcttcaccatgtgcttttctagttcacatagctgaaaaacctatatgctctattgcttccctggagatttgtgcccttcaggttttcctaggatgtctgagaaaaatgatctgggatgttcaggaagcaagtgtgctatacgacagtatttctcaacatccattcatgggtcacctccatccaaaccagtgactgctggctgaatggcaatctctggggttgactgtgaggaatttgaatgttcaacacactccctgattattcctcacgccaaagttggagaatctctggagtagcagaaagaacgcgaacctcgggggaagactgaccagagttcacatctcagcagctctctcactaatgagctgaaccactttccacaggtcatttaacttccctgagctacaattctctattagttaaaggagcaaaataacaaccacctcatagggttgttgggaggattaattgggtcaagttaggtaaaggctcaggatcctacagagtccacaataagtgttaaactactgtctgtctccagctctctcagaagtaaaactcatctctctggatggctttactgaattgaactgctcagaattcctgagacactgtctaacttacgcataagcattgcctctgttctctacagcggggcctgcaacaaacactgccaagcaggagagcacagatatgaatgaaggggatttcccatctcctcctttctcaggcctggcagtcactgaaacccatgctcatgagaaggcagaccagcgtggagaactggtgatgcctgctcatcaaagatgcagcaaaggcctccttggaataaatagtgtccagtcttataataatgctaattcattctagagggctaagagcggcctgggagctgctctgatgactagaagcctcaggatgcaagtgcccccgaggaccatcctttacacgtgaaatcttgtagccacgactactagcgactgggaggttccactgaggaggcttctgggaaagctgtgttcttcacacagggcctgccatcaacagtggctaaggcttcggccccttcctgacactacaactgactttgttccttggtgttgcctgttattaggtctgcatccccaatgatgtcatggcccttggcttctggtcttatgctcctgttgccctctgggcaccttgctttggtgcacagaccaagttgcagagtggtaagaaatacctaatctttcctttgttacggagagggctatggccctgagtgtgtgtttgccttttgcggctcccattttgaaaagagacggaatgttttactttcaataagctgaggcctataaaatgcttttaatatccaactgctccatggtggagaaaacatacttattagttttggggtatttctagtttggaaggtctttggatagcattagtacaattcacacaagaattcactgattcacactttgctcaatagagaatatcaggcagacacctggtatatagattgggtgcaatcaatatttcttacattgaatggagtttcatttctaactggggagacaccaggattgcagaagagtgggcaccaggtgcagccctgtcctatgtggcatgcaggtctcccctgagtgtaggaaggcctgtcttaggagagagatccaggcttgccccaacccaggttgcaagtggctgctaggggtaggggaaggagaacaggagcagcatatcctctcttgagactgggggcacaaggcaaattctttcagttctcaaaggtttattttcctgtttgttcaatggagagagtaatatctgacctgcctatttcagagctgttctcagtataaaagaaaatcaataaaaatggaactctaagaaaaaataagtcagtccataaatagaagatattaggaagcatttcccttcacactaataggtaagatgaaacatggagtttcttcccacgtctcactgggagtaggaggtctgcttgctggggtggagttgtgtatgtgtgttgggggggcccgttctgaggcaggtgtgcagttttctttccgatgctgtcagaagttgtcttgcattgagagggagataaggaaagagctttgtgaattcagacatttgaagccttccatttggccccaaatgctggcagccctcttgtaaagggaaaaaaaataaaagcccagatgatctcataggtcttttctacctctgaaacagatggtgtgattcacatatatttgacataagtgtaaccaggttgtgatgatttgccttattatgctcagctgaagagaggattaactagcaataatatgctgagaatgtaaagcatgatctctggttagaacagaaggcgggagtgggttgtttcatggttaaagcaatgaactatgactcaaggccgtaagtttctagtcacagatctgtaaccttgtatgtgacactgagaggcttgctagaggcctttgaaagtgctcttaatttatatgtactagccactgcccttaaaagcaatataagtccttcttctgagaacagtgtgggtggtaattaatggttaataatgctaaagagatagccatcagtgagacttctgaatgcccacgatgctttaagcaatactcagactcttatctagaaatgctagcaaaatgcaaatcccacagtttgtagaaaatctattcttttttcctttgcgacaaacatctaccctctccagcattgtccaactgacttttttgcaacaatggaagtgctctctcctctgtccaacagtaggtgccatttgtggctattgcacacttcgcctatggttggtgaggcttagaaatgaaatcttacatttaactttaattgaaatgtatacgaaaatagccacatgtggccagtgcattggacagcacagctgtagccaattcaaacctcctgaaagcaagaaggtgaggttgagaggcagtagaaactaaattaacaattattcagtctttctctttaaaacagtttctttccctcttttattcaagttgctgggtggagtagctgaaattacggtctgaggcaaaagagtcccaataataataatgataataatttcccctccacacttctgtacagtttttcgtgggtttaaaatgagaagacatctaaactcattaacaaaaagctagctagactgctttaatctaaagcaccacttttctctacaaacctgagaaactaaccagtaaggtaaacttcaggagaagcattagcctcactctgttctactgtcagatgacctcttaaagagacctacggaagcacaggcatatattttgctatgggcttttctccctcataaagtctgctgctgattcctggctccatttcctctgtagcccaatttccatgtcccagccccatagatgggtcaactgataaccaaagagcaagaagagagacagacaaaaggtgctggcttctgttccttccagacacagagcgtcttttcttttttgcctctttcatgtactgtgatgagaaactctgcagtacataatacacaaaaccctgagatcttaccttactgacttcccgcagcattcccttggcccgtgagggacttgaacaaatggtggctgttctccttgacctatgtcctcacccatgaggtgcacttactcaaactctacatggtataaaaacttactcttcctgcatgccttcggtatttatcaccctgtcctttgtatatatatgtgtgtgtgtgtgtgtgtgtgtgtgtgtatatatatatatatatttcctgaacagtatgtttctcaggtgttgtaagctctaatggaagggagagtttggtcgctgtaattcttcttgagcactgcctagcacagtgtcagatacaattaagggcttaaccaatgctgcttgataatggataaaagactattagactcaacgggacttttacagctttgggattttaagccattgttttcagttcaacatattccagaacacaatatattgtcgttgcctttggaaggtctgttaaggggattgaattaggcttggttatttggcgggaaggacttcagaatcagtcatgtatttttcaggttgataacatgattctttgaagattagaaaaacagtcttgaactcggccggcagttgcacaacaggtatggaaggaaggaaggtggtgtgataaacatgtttctcgtccctcttttttcaatagtgaaacagaaagaagaaaaatccttattcaggaaatagtcatggtggcctgctaaagccgagtaaatctgactgctgaaatggtgtaaggaactttgcagtttattcaggttgggaaggaagtgagagtggagtacatgatgaacaatggccccacgtcagccgcgcctccccggtctccaccatcctctagtttatctcctcgcagtatattttctaaggagattattttgaaatagaaagccattcattctgctcccagattcatcttaactgaatgattaaagtgtgaaataagattgaagtataaaataaagagaaatctaatgaaaatttaatgctaaactagtaatactaaaaattcttcctcttttccaagttaaaaagtctacaacaaacagcactttaaagcaatgattcgcgaagtgcgcttcttgggtcagatgcaacagcatggcctgggaacttgttagaaatgcaaattcttgtgccccaccccagacctactggagtagaaactctggggttggggcccagcaatgtgtgctaaaaaacaaaacaaagaaacaaacaaaaaacagcctccatgtgtgattctgacactctaatgtttgagaaccagtactttaaaccaacgttgaaatagttgaaactgttcaatgctgtactacattgtactaaatgaatatccctaacatgtcaagtatttcccaattctatacataaggtctgagcaagcacttaacacacacagccactagtccgtcattctgagatctcatggatcatgagctgcctaggatctgactaagcctcccttaggttcccaggaggctcccagggttggggtaggcttgggggggttggtatgtctgagctgtgccacacaggctcctctgcttcaccgtgggagatggagggatacaaaaaggggtccacaggaggaacaggaagctggaaatctttgaattcaatgatttcattgaaatccatcaattttaatcattttttgggaggaaatatttagtacttttcaatcactatttcacaaataaaaatccaaaaatacaccacgcttataacattttaaaaaatcttttcagataattgcttgatggctgcactaagctgtgcctccctcatggtgggcaaaggtgctgacagagtgcagcgtctgaaatgtgcgtgtccacatttatttcccagccccttgaccctgcattgcaacatttattaaccagtgtcttctcgtcacaaacctcctggctttacccagtcctttcctattccaccacatctgccctccagattgcaaggggaattattgggactttattcctccaaatgattccaatttctgtttgataacaaagtttgctcatgtaacagtctttatgtgccccaagaaggcaaggacagaaaagtctcaaagcaccagatgcacaatatcattttatgatatttttcatcacaagaaaaacctccatcctaagaaaaatggaaatgcaaactctcctaacttttctcactttaaaattgcacttctcatcacgacctattacacccacatagtcatgtgccataggctctgcagactgtctccaacatttcaaaggctcaaaagctatttttaaagccaaaatacaatctagattgctgttccgtaaagcacttttaaaggacgaacaaagtaatagagtgatttttatgcctgtgggcagttagccaacttaccaaaagattgaatgcagctgtcaatgagatcgtccaggctggctcctttggctaaatgtcccagagacaccatcattcggaactgggtgatgtgggccaagctgggatgggaggggaaggggctgttggctggctttgcctctagtcttgctttagaggcagctctgcagccatgggaaggtttcctggggaaagagagaaggcagtgaggggacaaacgggcagctccacgctctgaaggcagattggagaggaagggaatggagataagacaattaatctcaggagctgggctgatagaagccatacccctcccacttggcaaatgcaccaaatgactggttggctgttaaagagacatctccccagcaaaggtgagatttcagggttgcaactagtgctcttcatcctggcattaggattgctctgtcctactgtctcccacttcctgaaggggaatggcagaggcaagactatcttggcagtccttagctcccagcaatgtatacattttttcagctactaagccactgacttgaatcttaaaaattatttacattggtttctttggctaactttggcagggcatggtggctcacgtctgtaatcccagcaccttgggaggccaaggcgggtgtatcacctgaggtcgggagttcgagatcatctttggctaacttcattaatcttgagcaatacctgagatactacacaaggtcaggcagcctcagaatcatcgttaaggaccttgggggagaagtcaaagactgaggactcaagtgcaggaagtgaggggtgatgatggtggtgtttagattttaagcgagtcctgcctttcttacaaatcttggttggttttaagatattgtttttcatggttgataatacaggtaaccattatgagtcatttttgttactaaacatcgttttttcaaatccttacttgggtcctgattgaaacagaaagcagagctgtgagagcgttgttccagcactcagtgtaaaagggcaagtttggatctagaaatggcttaagagtccaatggactttcatctactcacacgcagctctatctctggtcatgacctcatcagtacaagtcattttgcgaaatgatttgggaagttgattgtcttctccattaaaaaatacacatacacacacagatccatatctataatcttttatggtttaatagtgatgagtgttgctggtaactctcttgagcatttagttaattctcctctctctactgtggctttggttattttgtagtttactaccaaagcagcaaagagaaaaaggaaaaaaacgtacctctgaagtgtaactttactcactatatatgataaatgcataatggcatcaattaatctctaagtgtttattctatgagtaaggcattgtgattggccagagaagaccacagcgagatagtctaggtgagggtactttatatactcattacatactagctgctgttgttacataatggcagtctagaagttccttaatacaaaaatatagctgaggaatcagactgagataatgaaaagaaagctacataaatgttaaataagtgttctatgagtgtcaagagtaataagcatgatgttcccagagaagaaagaggcagtttgtgggacagtgtctgggaaagctgctctgacaggatataatctcaaccaaaggggctgaagaagtgcttagatcaaaataaaatgctaggcacatgtgggttttgggaaaccagcctgctaagagatggtgtataactgaactatggggccactcagtacacagctagacctgtgcaggggcaccctggcccttcaggttgtttcaaactagctccagggcgctggtctgcagtggccgctcggctctattctgacctgatgcaggtccagtgaaactgaatcaacaattggttattgggcatctgctaaccctaggcagtaattcctgaaagatcaagtcggtggtacaggactcaagtttctggccataattgattttcaaacaggccctgtgatagccccagaattggatcagtctctaaaagcaaaataataatggtgacatgaattgagtacctatgctatggcaggtaccgtgctggggactgaccctgtcttgaggcttacagcccagaaggatgttatccccatctcatgacactgaaactgaatctaaaaaagggtaaatgacatagccaaggttataaaactcatatataatcaacctgagatttgtacccagcacctctctggctttattcatttaataaatattgactgtgcctggaactctgcacatttcacaacatcaggattagtagtagacaatcacagagaggctgaaaaggtcaattcaatttaaaatgaaagcaaaatccttcaaaagcataactggtaatgtaaaggctgaatctcagcccatattcctcttgcaggccctcagaactgtcctcaggtccctagagctggacagactctttatggtcattttccaaagcccccttctacagtgtggaggtccagaatcagaagagcaacgtgcctggccaccactgcagagacaggctagaagccagccccttgtggcccatgcagtgcgccccaggtgggcgcccttcccttcctggaagcactaacaactctctacacctggggctacatagccactgctgggattactcagctttctgccccagctgctgcctttgtcaccattaagacctccaccaaaggcagagtaggggaaaggttttaaaaaaataaagtcattcattgtagaagtctccttctctcaggccttccacaatacttctccctagaccttggagaagaggcaactgcaactagaggctctatctactgacagagctcttcctgctaggggtggaggggaggtggctacagatccaaggaaaattccattttctttcttggttggtgacactgaccattcaagactcctaatcctgccctgttttctaattctggtaaagtttcctagtgtcaccagtaagagaaaccgctttgtttcataagtggattcttgaaggttgatgcttttaccagaactagaagggatcagggtaaagtatagggtagtaaaagggaagaaagggtgacaaaagcaatctgggaagtatggagcccagagagactcagaggactaggccatgagagaacagggagaagagaaagtactaaaagccaaagtgcagcctcagagttctaagaagatggggattatctgcaccatagactaggaaacctggctttcttgctgtacagtctcttaactggttgccttgtgaaaaatcctcaaatcgttctgccttttctggtgaaatgggagtagacaaggatttataaaatgctctattataggcaggtcgaaggtgttttaacaatccatagaatgaatggcctctgagtctgtaaaggcatattttttaaaaaaatacagtagccaaatgttttcctgtaaatgaaaaaaccaaaaccccgagagaaacaaattaacttgaaggtgttttccaagcctaaaagtaaccaaagccccataggtttgctgaaggagaccgtcaaaactctaaactggtttaggtgaaatcctctccaggcataggtatctcagtggaggtcagtttcaggctgagctttttatgaaatccgcctagaaaagtaagagatgaaatggagcaagggaactggaacttccacaactttctttgcagtggaaggtgactctcttgacttctagtatggattccttccagtcccgtcctcttccccttacaatactcaatttaatgtactgaactcctccttctgaatctagtgcaaagtacagtggtggaccctcaggggatacctggatggggagaggcagggcgtgcatacagggccaagaatccttcgttcctgggattataagcacgggaagtccagcatcgcaagcttcctgccgctactgggtatggtggtgcaaggcacagtcccatcagtgtcgatgtgaatggagttgtgaagtgcacaacttgtccagcccctacgccgaggccaggcctttgttcatgcagttgcctagttctggtcctttggctacaaactcaaagctgcctggccaagagccctttcactcactgtccctctttcttcaacttctgttatccaagaccctctatagaatcatagtgagggggagaggagtgcagcttcccatacggaaggcgatatgtttccctgacccacggatctggaaacttccgtggggcaggggcaaccgaggggtgccacctctgcgggctccctgcaagctcctcggccgttctgggcagggccgggaggggccaccaggtggcgcagccggagcccagcgccccagcaggtgcgggcagcgcggaaagtccgcgagtgggagtcccgatgccgggcgtggagatgtgggggaggaagtcggcgggcgggcgccggctccgcgaagagcttcggccctagcagatctcaccggacgagctctggcctcgcggccgcccctctaccacccctcagccccagctccctccccgaaaccccgggcgcagcgcgccgggcgttctggacacgtccgcccgtcgcgctggtgtcccgggactccggccgaccccggcccccctccgccctcaacttccctcggggtgttggggcgacgggcaggggcctctttcccaagaaaggacacaggcgctcccgagggccacggccgcctctactcaccgcggagcctctctcgccttgcccagggtgcccatggccgcggcccgcgctcccggtgccggctcacctagcgcggccgggcgcggcgcatcgcccccgccaccaccgccgccgcctgccggctctctcccccccgggcctcgtagccccggcgcccgccagccctcgagcccggcgagcccgaccgaggtgcaccgcaggcacaaactttgt

SEQ ID NO: 2719 - DNA, 76706 bp, Homo sapiens; identical to SEQ ID NO: 2718
  source 1..76706: mol_type = genomic DNA

SEQ ID NO: 2720 - DNA, 9377 bp, Homo sapiens
  source 1..9377: mol_type = genomic DNA
tctagccagcttggcaacagatttattagttcagagtagaaagagcaagagtccaagtgctttgattgttcagtaaaaactatgcctcctgactggagagctgccagcctgctctcccccactcttaacaacttaccctactattaaggcacttgagaagagggagagcaaggaagtcccagaccaaaccccttctggatcctggagagagccagtgctgttgcactggtttccttcagccatggttgagcaaggaaagagccggcagagacctctgtagggcaggaaggccagcccctcaaacgctggtgttaggcacagggacaatgccagtgccatacaggggctggtatctggggcgttattttgattaagctgtaatgaatccatgatggaagacacttgataaggctttgtgggctcaaaggccttacctccagcctgcttctgtctctaggagagtaccagaagctggaggatggggatgggggaccccagagttccctacagagaagggagctgaccatcaggacaggggaaaagtttgagtttccccagctcccccctttccagagaagttaatgcttctgcttaagcacctccaaaaagagagagagatacagatactgacaataaaagaataaaatatggctcccccctccaaggaagacatccacaaagttgggggcagttggaacacaccccaccagaatccgtaagtgcttttggagggcttcaatcccctgcaacccagtgctctggggagggcaggcgtcacccccttaggagctgatctgactcagcagggctgagaagtccatgtccgcaatggaggagaagtcttcatctcctgaaaggaggccattggggagccccggggcccccagtggagcaggagctgggtcggggggcctctgggcccctgtcactaggcgagttatagcctcagggtactccatcagcatgggctcagttgtgtggggggccacaggtatgccctggttcagcagctgctgaaactcggagttgtcgacggatgccaggtctgtgaacacagctgggtctgtgctgttgccaagcaaggcccccaggtcttcatcatcaaactgcagctgcagcagggcctctgacagcgttccttccccagcctgggtgggcttgggggcaggtggggccacagcctgaggagggcctggggctaggactgggacaggggctggggcctgggccagagctgataccatggctggagcaggggcaggggctggagcctggggcaggacttggggaggggccggggccaaggccgaggcctggctgatctgcccagaaggaaacaccatggtgggaaactcatcatagttgatggtgctcagggatgacgtaaagggatagggctggggtgctggaggagagagacagagaggcaggggtcagagaaagccctagagatccaccccgtcctctgtaccccagcccctcttcatggtgctcaggctcaatccctctctagggagtcactgccaacaccctatctccttcctcttaccccatctgacccagcctgtagggtccagttctagccacacctccaccttggagtcctccctgactactcaagcccacgaaactcttccagccttttagaggaagggacacttggagagataagctggactcctcagtttacagctgaaaaactaagtcctgagaggcaatgagcccatggagcaccaagtgagcagcggcctgaagtgcagagcttgtcagtttttgagcctcgcacaggcacacacatcttgctaatttagaggtgatttttgttcccccaattcaagtgagagatgagagcagagattctgcatttttaacttctgattcccaagatacccaatatagaatttaagtggcacggtggttcccaggcttcagtgtgcattagcatcccaggaagtcgctggttcctgcgccatcctttcaaagcctctgattcagtaggtctgtaatggggcccaggagtcttcatctccactgctcctcagctgaacagagctgaacctgtcgttccagtgggacaaaaggaaatccttacctggcttggggacagaagctgagctgcgggaaggcacagcaatgcgtcgaggtggaggccgggggtcggtgggtcctgtagggcaagggctaggtcagttctcagccccagggtgtcccctccctgcccgctgccttcctctctggctttcccagtccccatctcaccgctgaaaggactcttcttcatgatgctcttgaaggtctcatatgtccttttacgtttctcctcaatccggtgacgatcgtctgggaaagtaagggggagaagtgggacttgctctcctcaggtgggtccccgacgctctcaaaggtccctcaggaggaaggggaggagccaggctttcccaagacccattctcccaaccttctctgccaatgagaagggatgtgtgacactcagcagttctgagaatcccacagcttttggaggcctctgttggctgaatctgcccctctaagaccacatggtgaggccgagtacaggggccatgctctgggcaaagaggagacctggggggccccagcctccagctcacaccttcctgcactgctcacatcctggctcattgtcagcctccacccaggcctggcgagaatttcttggcactctggggcagctgaggcacaactgccttaagacttcagcagagactcttattcttatctctaatggtttcatattttagtcagagctttcagaactgtctttctaattacagtggtatttcagtagctccaaagcacttcaattccatcaattcaaagacaacctcatcatccctcaaaaactaggttctttctcctgcattccctgaccatccgccatctgccctgtcaccaaagctagaaaccttggaatgattatcttcttttctctcactccccgccagtaacttgacatatatttatcaagcacctactatgtgccagcctcccttctagacactggggatgtggccgtgagtatgcacacaaggtgtctgctcccaaaaagttggcatcctagtgaaaaagtgagagggacacaatcatatatacaaaccagaaaatctcggccaggcgtggtggctcacgcctgtaatcccagcactttgggaggtcgaggcgggtggatcacgaggtcaagagatcgagaccaccctggccaacatggtgaaaaccccgtctctactaaaaatacaaaaaattagccggatgtggtggcgggcgcctgtagtcccagctactcgggaggctgaggcagggagaatcacttgaacccgggaggtggaggttgcagtgagccgagattgcaccactgcactccagcctgggcgacaagagtgagactctgtctcaaacaaacaaacaaaaccaaaccagaaaatctcaagtgacggtggtccagggacgatatggtgatgtaacaatactggaagtgaggtcaggacagtctaaatgtagagggaagggctaatttagaggtcagggaaggactggcatgagccacttgcattaaaaccttgggcattccaagcagaggcaacagctagacacaggtcctgaggtgagactgagcttggtctgtaagacgcaaaacggctgcagggctgaagggtaactgaggacagtggtggagatgtgatcttgctctgctattccttctgtaaggtttgtgccgcatcttctcttcctggactacagcaacatttccagaatggcctccctgctttgagtctgtctgtctctgatcttctacacgtggcctcctgagtcaacttccaaatctgctcctgtcacctctctgcttagaggccttcagcttaaccaggccctccaatctctgagcctgctcactgcccaacatcagctcaaaccacgaaggtggccctgaataggccgtgcagttgccaacaccccttcccttccaggtgctgggccacctgcctggagaacacacttctgtgtctttctccagcttcaatgccaccttctccatgcagctgtctccagctccccggaggccactgtgcccccgtgcttctctgcgcacacctccatttcacatgtcattccgtgacttaaggatctgttttgcacatttgtcttcctcaagtgactgagactctgaagggcagggagcatgtcttactcattttttgtattcacaatacctggcacaggccctggtaccaagtggacactcaaacctcgaccaaaatgtggctgggctgtatggtagtgacaagacaaccagtgtggcaaaaggatcctgaagccagatggcctgggttccaacgctgactctgctagactctgctacttactagccacgtgaacccaggcaagttggacactatctcctacttcaaaagggtcatgagattaaaatcaggtaatccagtgaagtgcctggaataggggcagatgtgtagtactagctcaatgtctgaggtatcattattattaaatgaggcaagaaatggattccagtttcttggatcccaagctctgactccagcttctggccctcaaccacagccccagacatgcagtcttggcctctctctcacggcacagagcccagctgccctgatgctgccaccccagctgtgtacctgtatctggcaggtactggaattccatgggctcactgagctcccggtcggaaggccgccgcagctgcatggagacacgcacaggagcctgcaggctggggtctgcgtagggaggggtccggaacacaatggccacttgtcggtgcacatcagcttgcgaaaaggagcctcgggcctcccagcctggtcccgtgaaatacacctcaatgtcctctgcaggagatgcggtggcagtgtgggtcagtgtgtctaaccctccatggtctccccctcaacttctgatgcttgtcttctgatacatcacccttcggcccacctgaggcccccgaggcacaggaggaagtatccaaagccagttacctgacactccacttctctgctcagcttcaccccttgctcccaagagcccacccctgcctcctgatgtatacctttctgcaccttgtcacacagtaggaagatctcatccccaccgaggcagctgccagagtttcggttcactcggcagatcttgagctcggcagtgttgggggcacctgaggcagtgaaaacaagggaggatgacctgagccacgagaggtccccagggtggcctgcaggagatgcaacttccctgcccagcccagagtcaaggttgcccagagcttgccacctacacctttgtagccaaagtcagaccttcttattagctcctcaccccaaccgattcaacaagtatttgcctactgtgcactcaacactgatctaagcaagaatacgaccacacacaaaacccaaacctctctgctctcccggagcttatagtccagtgggtgccaatctgatcacactctttctccacctgaccaaagcaatctttaaggccagtccatacccaccttggcaatgagcccttccctcctgacccccagtttatcctggtttcccatccttggggctccagattcgttttatttccattcatcctgctggttacttaactaaagactgcagctgatcagtcagcccaattcatctgtgggcttccatcactgaatcatcattctcgaacactatcttgttcctgggagttcatttcctagagtcattatcgcagttgtgggcacaccaccttctcatcacacaatactgaaaatgcccatctcccatcagactctctgctagacttcctgccaggccagagctacacctcaaggacagctctgggtcttctttgccctctctccccagccaacaaagagctgggcagagaagagtagacaaatacgcaagatgattgaatgaagccagagcgcctcttgcaggccacactcaccccaacccccttcctcctattcaggcccaccctctccccttcctgcgtctccctcgctactcacgattgtcaaagatgggatgagaaaggacaggcggcaggcggaggggcctgcctgatgggtcccgcactgtcacctggaagcagagccgcacagcattcaggtcgtagtccccacgctgctcttctataggaactgccaagaaaacaggcgatcaggagagcaggggaagtggggatataggtgctatcagtgggggcagggagctctgcgctgggagggccgctggtgcgtgtgtgaaacacaagtcctagaggaggcagaacccagcactgactccactgtggcctgaatgtcatgtcccctcctgggactcagtttcccagtggtaaagtgggagagtactgaatgggcaccaagattccagctttactgtgtcttggccagtgagggagatgcaggaaaggcgggctggggagggtgacagagggtgcgggtgtggcaggcaggtttgccctcaccttggaaggggttgttgttggtctggatgcgctgactgatagcctgctccaggtcccgcttcttcacacactggattcccaggttctggaaactgagcgcccccagtcgtctgtcccactgtctctcacagagcccagaccttcctgccttgcccagcctgctccttcctactctgcccacccctagatcatcgctccatgcctaaccctctccagtggcttcctactgtgctgcaacgaaccctgtcccttcactcagctgacaagcacctccgtgcccctgcccctgccagcctccctgtgggctccctgcttacagccaccggggctccttttccactctctaaacacaggacactcattcccacctcaaggcctttgcacttgtttggtcggcttggaatgttcttttcctacttctctcctccttctcaccattcaagtcttagctgagggaggccttccctgacctcccaatctaaagtcatcacacaccagctcccctaactcccccaccccaggttatccttctatcctatgacctcgttttattttcaggactgaaactgttactctgacagcaccttgtttatttatctgtgtatttatttatttttaagagacacagtgtcgggccgggtgcggtggctcaagcctgtaatcccagcactttgggaggccaagacaggcagatcacaaggtcaggagattgagaccatcctggctaacacggtgaaaccctgtctctactaaaaaatacaaaaaattagccaggcgtggtggcaggcacctgtagtcccagctattcgggaagctgaggcaggagaatggcatgaacccggaaggtggaggttgcagtgagctgagatcgcgccactgcactccagtctggggacagagcaagactctttcttaaaaaaaaaaaaaaaaaaaaaaagacaaggtatcgccctgccacccaagtgcagtggtgcaatcatagcttgccgcagcagtgacctcctgggctcaggcgatcctcccacctcagcctccctgggactataggcgcatgccaccatacccagctaatttcttattttttgtagacatggggtctcactatgttgccttggctagtcttgaattcctaggctcaagagatcttcctgccttggcctcccgaagtgctaggattataagcatgagccactatgcccggcctgtatatttttttacagcctgtctctgtcaactgcaatgtcaactccaggggagagtgctggttcaatggttttcttcctcaaacaagagacgtgactctgagggacttgtccttccagctacaggggtcaggaattcagaagtgattagggacccatccgtatcccctggaactcatctgctagagtaaacgtacaaatagataatttcaagacaaaggcagtttacttgcagagctgagtcagggcaaggagtgaggaattctgccctgggtccagaaaggagtaacactgtagcggctacttcatagcccgcctcctgtcccctcatgctgggcctcctagcctgcagggacctcacctgtggatgcagcggtccgggcagagctcagcctcatagaagccatcccggcagtcctttcctacaagctcgtgggggtgaggccggtgaggagggtccttggtgaccagggagatgcgcactgtccctggtcctgtgtagccattgatctgtccaaagtacagaggcccagacatccaaacctgactcccaaacacagagggctggggttccacagtcccttccccgcacaccctggcgcagtgctgaccttgatggtggggtgggtcttggtggtatctgtgctcctctcgcctgggatgctgcccgcggagcgcccctcgcacttgtagcggaagcgcatgccccgctgcttgggctgctcaatgatctccacataggggccagaggcctgggctggctctgccaggggacaccgcagccccattaggcggctgcccccactgccctaccccagggagcacctccccgaccgccgcgggggccacttacctgccgggaagatgagggggaacagttctgaaaggggagggagatcagggtcagcacacacccaatgcccattctcacaaggaggaatctgctctccacggagaggagaagccaggctccctcccaggggaactgagtcaggacctgctccctagaacctgcggtgaaactaaggggtggaggaaaggaaccagaaacacctgcttcttgagggaaaacggggtaaggaatccttcttctccagagggaagctgaatcagggcctgttgtactttcttaaggaaaattgagggagggcacgccccacctccctccagagaggaaactgaatcagatgcgttctcccctaatagggaaacgaagccagagctgcccccatggacggtgtggagggaaactgagtcaaggttccctctgctcccccacccagggaggatgctgagtcaagggccaccccctccacccagaggggaaactgagtcagacccctccccgcctgccccgccccgcgccaccatccggcaggccgaccgctccctgcgcagcgcccgtcggcgcaggaaggggcggaaagcggcgcgggggctcccgccacagccgcggcggccccggcgatgccaccccgcggggtcagagggcgacctcaccgtccatggccggggtcccgggggcggggccggggtcgcagctgggcccgcggcgtgcactacagacgagccattcgccagaggcggaaatgcgccgcgcggcccgccgtcgcgtcactgcccggaatccggccgcgcctgcgcgct

SEQ ID NO: 2721 - DNA, 9377 bp, Homo sapiens; identical to SEQ ID NO: 2720
  source 1..9377: mol_type = genomic DNA

SEQ ID NO: 2722 - DNA, 9377 bp, Homo sapiens; identical to SEQ ID NO: 2720
  source 1..9377: mol_type = genomic DNA

SEQ ID NO: 2723 - DNA, 9377 bp, Homo sapiens; identical to SEQ ID NO: 2720
  source 1..9377: mol_type = genomic DNA

SEQ ID NO: 2724 - DNA, 36750 bp, Homo sapiens
  source 1..36750: mol_type = genomic DNA
ggccccgcgccccgcgcagccccgggcgccgcgcgtcctgcccggcctgcggccccagcccttgcgccgctcgtccgacccgcgatcgtccaccagaccgtgcctcccggccgcccggccggcccgcgtgcatgcttcggtctgggccagcctctgggccgtccgtccccactggccgggccatgccgagtcgccgcgtcgccagaccgccggctgcgccggagctgggggccttaggtaagcggggctggggttcaggagaggggtctggggcggggctggagatgcggggattctggcggtcccggagtagtctgggggttcctatgggagtctaagggtttcgcgggggcagagtgagggttcctgagacactgtattagggcgtaggaagaaggcagagggtgatgagggggtacggcccgaggttcgagcgaggcgtcccgctgtagagtgagagggggcggggcctgaccctgaggcaaagaagggggcgtggcctgactcagagaaggcggagcgaaagctgctcttgggcggtatcggggcggggccgggcccagagagggagaagaggggcgggatccgacccggactatgagaagagggccgggcctgactcaaaaaaggaagcagggccctacgctgaggggtgagggggcggggcctggccgtgagggcaggaagggggcggggcctgagttggccgaaagaaggggaaggggcggggcctgactctggccgagtggaggggaagggcctgttacccaaaaaagcagggcggggcccgacacagagaatgaggagggggtggggcttgcctccagacggagaagcggagccttgacattgaaaaaattaaaagtggtctgaccctgacaggaggatgtttttttttgtttgttttttgtttttttcttttgagatggagtctcgctctgtcgcccaggctggagtgcagtggcacgatctaggctcactgcaacctctgcctcccgggctcaagcagttctcctgcctcagccccccgagtagctggaattacaggtgcccgccaccacacccggctaatttttgtagttttactagagacggggtttcaccatgctggtcagactggcctcgaacttctgacctcaggtgatccgcacgcctcggcctctcaaagtgctgggattacaggtgtgagcccttgtgcccagcgggatggggactttttaaactgagattgagatggggtcccctccaggcccaactttaagggagaaaaggagcgggccctgagtgtgatgaagggtggggcgaaccacagaaactaaaggccaggacctgtccatgatttagctggtaagcctggccagacgcaggggggcagtcagggcgaggggcctgatccagaggggaagggctagaagaggaaggggtggggcttccttgggatattctctggtcctctggctgccccccatcacctcctgagacgtttctccttctctgcagggtcccccgacctctcctcactctcgctcgccgtttccaggagcacaggtgagcagccctccacagttcctgcccactcgctcatgcaggatgaggttgggaggactccacagagatgtctctgtttgggggttcacgaggtccacctcagctttctcctgacagggtgcatccctccctgccagttgagatgggccccctaggttttcttacctcttggactgttaagagcgtgacaggtggccgggcgcggtggctcacgcctgtagtcccagcactttgggaggccgaggcggacggatcacgaggtcaggagatcgagaccatcctggctaacacggtgaaaccccgtctctactgaaaatacaaaaacaaaattagccgggcgtggtggcgggctcctgtagtcccagctactcgggaggctgaggcaggagaatggcgtgaacctgggaggcggagcttgcagtgagccgagatcgcaccactgcactccagcctgggagacagagcgagactccgactcaaaaaaaaaaaaaaaaaaaaaaaaagcgtgacaggtaaatcttaccacctatccatgcgcaaaggcttctttagagattcactgtggcttagtagaaggtaatcactgccatcctgggctttggagctggggtttacatactgctgtcatcgcccctccctgtgtgaatgtctgcaagtcagttccccagttcaggcctcagttttcctcatctgtaagatggacagaataacagtgcctctctttcagggaaattgagagtattcaatgaattgatacaggtacactttccaagcagtatctggcacacagtaagggttcagtaagtgttaactgttagtggtataataataataacgataataattattattactagacagtctataacagtggttcatttttggtgtgtgtgtgggttttttttgtctgttttttgtgttttttttttttttttttttttttttgagacagagtctcgctgtgtcacccaggctggagtacattgatgcgattttgactcactgcaatctccacctcccgggttcagcaattctcctgcctcagcctcctgagtagctgggattacaggcacccgccaccacaacccactttgtgtctttagtagagatggggtttcaccatgttggccaggctggtcttgaactcctgacctcaggtaatccgcccgcctcagcctcccaaagtgctgggattacaggtgtgagccacctcgcctggccagacagtggttcttttttttttgagacggagtttcattcctgttgcccaggctggagtacaatggcgcgatctcggctcactgcaacctccacctctcaggttcgagcaattctcctgcctcagcctcccaagtagctgggattacagtcatgtgccaccacgctcagctaattttttgtatttttagtagagacagggtttctccatgttggtcaggctggtctcgaactcctgacctcaaaggatccgccctcctcggcctcccaaagtgctgggattacaggcgcgagccaccgtgcctggccagacagtggttcttaaaccatgtgcatcagaatcatccatagcgctagttaaaacataatgtcgcctgatgtggtggctcatgcctgtaatcccggcactttgggaggccgaggtaggctcatcacctgaggtcgggagttctagaccaggctgaccaacatggagaaacaccatctctactaaaaatacaaaattagctgggcgtggtggcgcatgcctgtaatcccaaatattcaggaggctgaggcaggagaatcacttgaacctgggaggtggaggttgccgtgagccgagatcatggcattgcactccagcctgggcaacaagagtgaaactccgtctcaaacaaacaaacaaaaaaacagccggccgtggtggctcactcctgtgatcccagcactttgggaggtcgagacaggcagatcacaaggtcaggagttcaagaccagcctggccaatatgttgaaaccccatctctactaaaaatacaaaaaaaattagccaggcgtggtggcaggcacctgtaatcccagctacttgggaggctgaggcaggagaatcacttgaacccgggaggcggaagttgcagtgagcggggatcgtgccactgcactccagcctgggtgacagagcaagagcctccgtctcaggaaaaaaaacaaaaaaccatgtcaggccccacctctcgagtttctgattcagtaggtttgggatgagaaattatttgcatttttagcaagctcccaagagatgcctagaactactagtctataaagtcccccagccaaaattcagtgctgcccaaggaaatgcagaatctcaaccaaattatgacattttttcttatatacatttgccaggatttggagggcaggggtagtcctgttgttatgaatactcagtggctccagttagctgggtctgggcctttctctggagatataatcttgggatggacccaagttctggcttggccattgaagaagtgaggccggttccccaacaggtctgtgagtttagggaggatggcatcagtgacagacactgcccaagcggtggtcctgcgcaggaacaaggctgagacttttcttttttttgagacagagtctcgctctgtcacccagcctggagtgtagtgtcacaatctcggctcactgcaacctccgcctcccaggttcaagtgattctcctgcctcagcctcccgagtagctgagattataggcgtgtgccaccatgtccacctaatttttgtatttttagtagagacggggttttgccatgttggccaggccggtctggaactcctggcctcaagcgatctgcctgccttggcctcccaaagtgctaggattacaggcatgagccaccgtgcccggccaaggctgagacttttctggtccaagacctagatctttggtttcaaatgagagttatttctgatgtcatccattcaataaatatttattatgcgcctgttctgtacctggccttgtgccgagcagtgctgaggacaggcctggccctggggttccctacctagatgaggaggcagacacgtaaacaataagttaaatatgggattataaaatgtgataagggctatgaagaaaccttggggtcaatgatatttaataacagggtggggatacgagaactagtgagatagaatgggaaggaaaattccctttttgtttttggaggcagagtctcattctgtcgcctacactggagtgcggtggcgtgatctaggcttactgcaacctccgactcccgggttcaagccatcctcctgcctcagcctctcaaacagctgggattccaggcgtgtgccaccacacgcagctgatttttgtacttttagagaaacggggtttcaccacgttggccaggcttgtctcaaaatcctgacctccactgatccagccacctcggcctctcaaagtgctgggattacaggcatgagccactgtgcccagcgagaaaatccccttcattgtgaagggccagacatatgctggaccctggggataaaatgaggagaaacagacattattcccactcttcaatgctcccagtctataggagacaggtatgagtcagtgtaatgtgaggtcatgtgacatcttcatcagcgccatgaaaatgataaaacaggctgggtgtggtggctcatgcctgtaatcccagcactttgggaggccgaggtgggtggatcacctgaggtcaggagttcaagaccagcctgaccaacgtggcaaaacctcatctctactaaaaatacgaaaattagctgggtgtggtggcctgtaatcccagctactcaggaggctgaggcaggagaatcacttgaacctgcgaggcggaggttgtggtgagctgagattgcatcattgcactccagcctgggtgacaacagcaaaactccatctgaaaaaaaaaaaaaaaaagaaaatgataaaacaaaggcacctgactttgagggactggagtgggggataaggggactctcttggataaaatggtcagggaagagctgtctaggatgtgacgtttgaccaaggaactgaagatggaggaggaggaagtcacgccatgcaaagaactgggggaagagcattcaggcagagaccagcctgtgcaaaggctgaggcagcacatacatagtcaatttcctgctctcacatctgctctcacgtggcccatcctggctgcccctgaatggtggcaagtccacgttgggggtaaagggaggcactgctatttgagcagaaacttgaataatttcctggctaatagaggacttgagataataataatattaactaagctttctggaagatgtcgcgtggtcagaacctgcactaagtagtttacctgtgtgattctgaatcctcatgttagttcctgaggtaggagctcacacctcattttgtagaggaagctcagagacggtaagtgacttgcccaaggctgcacagccagtgagtaacagctgagattcaaatcaactctatgtgactctacactccatgctctaaaatcatgcccatggccaggcgtggtggctcacacctgtaatcccagcactttgggaggctggggtgggtgggtcacttgaggccaggagttcgagaccagcctggccaacatggtgaaaccccgtctctactaaaagtacaaaaattagccgggcatggtggtacgagactgtaatcccagctactcaggaggctgaggcaggagaatcgctagaacccgggaggcagaggttgcagtgagccaagaatgcaccacactgtactccagcctgggtgacagagcaagactccatctcaaaaaatagaaaataggctgggcgtggtggctcacgcctgtaatcccagcactttaggaggccgaggtgcgcggatcatgaggtcaggagatcgagactagcctgactaacatagtaaaaccccgtctctgctaaaaatacaaaaaaaaaaaaaaaaaaaaaaagccgggtgtggtggtgtgcacctgtaatctcagctactcgggaggctgagacaggagaatcacttgaacccaggaggcagaggttgcagtgagccaagattgtgccactgcaccctagcctgggtgacagagcaagactccgtctcaaaaaaataaaaataaataaaataaaataaaataaaatattaaataaaagtatcttagcccaacaaggtaggcattattattgtgcccattttacagatgaagaagccaaggcacaaaaaggtgaagtaataggcttatggccccacaactagcaagttgcagagccaggatttgaacagaggcagtgaacccagagctccagccacagccgcccaggactcagtctccccctacagcccgggagcctctggagggtccaaagtctaactctgtctttgggtccccaggttcatccagcacagatgcctaagaaggattttcccagttcaagtgacttgaggttggccctgccactgacctagagcgtgtcccttcctctctgccagcctcagtatccccatctgccaaattggggggaccttggcaccctactggcttcacagatcccatgagataaggggtgcaggaaaactacctttcaaggggcaaaggtctggctgccaggagccactccctgagaacagaggaggacagatctagcagcggaacaggttcgcgtctataaatccccagccagagaccagcgcaggcagccctgggtgggacacctggctgcagctgccttccgttgctgtgtgattctaaggctcactggcggcctctgggcttccccttgtcctgtctatggaatgacgggaggtcggtttcgattcctccacgattctgtgaagggctgagctttcctggggaggtgaaaaggggcttccctgaggacccagcattactgtacctcctcacttaggaagcaggggtgaatctgggattttgggtggtcactgtgggaggacagggctggggtacagagcaagaggctgcctgggttcagatcagcctctttgcatctttttgttgttgttgttgtttgtttttgagacagtctcgctctgttgtccaggctggagtgcagtgacgcaatctcagctcactgcaacctctgcctcctgagttcaagcgattctcctgcctcagcctcccgagtagctgggattacaggtgcccaccacgatacccagctaatttttgtatttttagtagagacggggtttcgccatgttggccaggctggtctcgaactcctgacctcaagtgatctgcccacctcagcctcccaaagtgctgggattacaggcgtgagccaccaggcctggccacctctttgtatctttaaacaccagccagtgacctccaggaccctggggtggacttcagggagggaacacaccccaatttgtttggaaatttgggcatccactttttcctggtgctaagacccctttctaatgggttcccaaaaagacttcataatccctggtctaaatgtttttcgggaggcatttggcttagttggaggataccctgatgctgggaccccaacattagaggttgaaaggatggtagcccagaggagaagatgaggtttggggtttagtgccccagcaagtcagagcccagggtttcccaggacggaggaagacggaagggtcacaggagggacagggttggggaatctgtcttaaaagatgaaaagttgtgaccactttctggaccttacctttctctttctctttctcttccttccacagatgaattgggtgagtatcacagggcaggtttgcggggaggctgagggacccaagtgcctacagaagggggtcttggccttccttgttcagtgggggtgggggagaggtgtcactgtgtgacttccaggactgtggagggatttgaacgaagtcatgctcctaaggtacttagcagtgcttgacacttggaaaacactcagcacgccgggggctgtgtgactcacacctgtaatcctggcactttgggaggcagaggcaggaggactgcttgaggccaggagttcaggactagcctgggtaacatagtgagacccccatctctacacaaaatttttaaaaattagccgggcatggtggtgcgcacctgtagtcccagctgctcaggaggctgaagtgggaggatcacctgagcctgggaggttgccttggaagccgaggctgcagtgagctatgattgcaccactgcactgcagcctgggcggcagagcaagaccgtgtctcaaaaagaaaaccaattaaaataaaataatgttattaatcccctagtgagtacagacagacactgttttaggccctggggatttagccatgaacaaaaccaagtccctgccctcgcagagctgatagcccggtgtgggagacagaggaaaatgaacagatgagcaagataatgttagcctgggctgagagctgtgaaagaaataaacaggacgagggagagatggcctggagaagacacattaggttaggcttttctgaagagataacatacgagctgagaccaggaggagaagcagccagcatgggttgaatgggggaccgtgtggaacaggcagttggaggagcaagttctttcttatttatttatttaagttattttttgagacagagtctcgctctgtcgcccaggctggagtgcagtggtgctgtctcagctcactgcaacctccacctcccaggttcaagcaattctcctgcctcagcctcccgagtagctgggagtacaggcatgcaccaacatacctggctcatttttgtatttatttatctatttatttagagatggaatttcgctcttgttgcccaggctggagtgcaatggcatgatcttggctcactgcaacctccacctcccaggtttaagtgattctcctgcctctgcctcccgagtagctggaactgcaggcacacatcaccatgcccaatttttatatttttagtggagatggggtttcaccatgttcgccaggcaggtctcaaactcctgacctcaggtgatccgcctgcctcggcctcccaaagtgctgggattacaggcgtgagccaccatgcccagcctatttatttatttattattattattttttgagatggagtcttgctctgttgcgcaggatggagtgcagtgacgcaatctcggctcactgcaacctccgcctgacggtttcaagcgattctcctgcctcagcctcctgagttgctgggactacaggcacgtgccaccatgcctggctaattttttgtatttttagtagagacagggtttcactgtgttagccaggatggtctcgatctcctgacctcatgatccgcccgcctcggcctcccgaaatgctgggattacaggcatgagccaccgcgcccagcctattatttattgagagacggagtctcactctgtcgcccaggctggcgtgcagtgtcacgatcttgacttactgcagtgtccgcctcctgggttcaagctgttctcctgcctcagcctcctgagtagctgggattacagacgtgggagaccattcgggctaatttttgtagagacggggtttcactatgttggccaggctggtctcgaactcctgacctcaattgattcacccaccttggcctcccaaggtgttgggattacaggcgtgagccaccgcacctggcctccctgactctgtgtgtgtgtgtgtgtgtgtgtgtgtgtgtgtgtgtgtgtgagagagagagagagagagagagagagagagagagagataaatgggatggaaaacgtctcgggggtaatcaagcctttttttttttttttaattttttaaagaatgggcgtcaccacccgttttttcttctcccgcagagatcatcgacgagtacatcaaggagaacggcttcggcctggacgggggacagccgggcccgggcgaggggctgccacgcctggtgtctcgcggggctgcgtccctgagcacggtcaccctgggccctgtggcgcccccagccacgccgccgccttggggctgccccctgggccgactagtgtccccagcgccgggcccgggcccgcagccgcacctggtcatcacggagcagcccaagcagcgcggcatgcgcttccgctacgagtgcgagggccgctcggccggcagcatccttggggagagcagcaccgaggccagcaagacgctgcccgccatcgaggtgggcccggcgagcggccccgggcgggtgggactggggcttcccctgcaccccggagccatccacatgcatttatacgtttatttgatggtggctgttgttgttattgttggaccagatattaattatactatcacctggcctggaatccaaaaggttcagaaaaaaggaggggtcggacatttggctgggcacggtgactcgcgcctgtaatcccagtactttgggagtctgaggcgggcggatcccttgatgtcaggagttcgagaccagcctggccaacatggtgaaaccccatctgtactaaaagtacacaaattagccgagtgtggtggcacaatcccagctatttaggaggccgaggtgggaggattagctgagcccagggaggtgcaggctgctgtgagctgagattgcaccattgcatagcagtctgggtaacagagtgagaccttgtctcaaaaaaaaagaaaaaaaaaaaagaaggcagatcgtggtgcggtggctcaggcttgtaattctagcactttgggaggtcgaggcgagcggatcactcgagctcaggagttctagatgagcctgggcaagacggcaaaaccccatctctacaaaaaatacaaaaattagccaggtgtggtggcacatggctgtagtcctagctacatggtagggctgaggtgggaggatcgcttgagcctaggaggtcaaggctacagtgagccaagatcgcaccactgcactccagcctgagcaacagagcaataccctgcctccattaaaaaacaaacaaatatatataacactggaagtaaaaaaagcaaaggtgattacttttggcagggtattaatgtattaataaggtacaggtaagttttatttttttgagacggagtcttggtctgttgcccaggctggagtgcagtggtgtgatctcgcctcactgcaacctccacctcccgggttcaagcgattctcctgcctcagcctcccgagtagctgggattacaggtccaccaccacgcctggctaatttttgtatttcttagtagagaaggggttttgccatgttggccaggctggtctcaaacccctgacctcaagtgatccgcatgccttggccttccagagtgctgggattgcaggtgtgagccactgtgcctggcctctttggtgtctgttaatctggatctgttcttcaatctgtctttgtgtttcgtgagttgaacatttgtgcagaacaggacggatgttttgtagaatgtcccacattctgaagctggtcgtggtggctcatgcctgtaatcctagcactttgggaggccgaggcaggcggatcacctgaggtcgggagttcgagaccaccctgaccaacatggagaaaccccatgtctactgaaaatacaaaattagtgcggcgtggtggtgcatgcctgtaatcccagctactcgggaggctgaggcagaagaatcacttgaatccgggaggcagaggctgcggtgagccaagatcgtgccattgctctccggcctgagcgacaagagcaaaactccttctaaaaaaaagaaaaagaaaaagaaaaaaagaatatcccacattctgggtttgttggctgtttccagattaggtcagattatgcatttttggcagaaacactccagcagtgatgctgtggccttctcagtgtctcacatcaagggacgtgggatgtcgttattcccaatattggtgatgctgagttggatcctccagctaatgtggtgactatcaggtctctccatgataaagatacaactttccctttgtaatgaattggtaagttatctatgggatgatatactgagatgtatcatcccatgtttaactgtattccccaacttctaatttctaaggcttttttttttttttttttggagacagggtctctctctgtcacagaggctggagtaaagtggcacaagcacggctcactgcagcctccacctcccaggctcaagagaccctcccacctcagcctcctgagttgctgggactacaggtgcatgccaccgtgcctggctaatttttgtatttttttgaagagttggcatctcaccatgttgtccaggctggtcttgaacttctggcctcaagcaatcctcccactttggcctcccaaagtgttggaattacatgtgtgagccaccgcaccggcctaatttctaagtcttcccaggcagttattctggctcagagtttttttttgttttttggttttttttttgatggaatcttgctctgtcacccaggctggagtgcaatggtgcaatctcagctcacagcaacctccacctcctgggttcaagcgattctcctgcctcagcctcccaagtagctgggattacaggcacgcgccatgatgtccggctaatattttgtacttttagtagagatggggtttcaccatgttggccaggctggtcttgaacttctgaccccaagtgatctgtctgcctcagcctcccaaagtgctgggattacaggtgtgagccaccgtgctcggaccccagagttggttttgatttccaagatttagaatggtaaatgcctaaccatagggaatgacctgtctccaaatctggattcaggatttttttttttttttttgagacggagtcttgctctgttgcccaggctggagtgcagtggtgtgatctcagctcactgcaacttccgcctcctgggttcaagcgattctcctgtcttagcctcccaagtagctgggattacaggtgtgcaccaccatgcccagctaatttttgtatttttagtagagacagggtttcaccacattggccaggctgatgtcaaactcctgccctcaggtaatccacctgcctcggcctcccaaagtgctgggattacaggcatgagccagcatgcctggcttggattcaggatgtttatccccatcttcagagtaggaaactgaggttaaaagaggggcagttacctgcacagggcacacagcaagtttactattgtaattaccgccatttactgagtgcttccatgtaccaggtactttgcatacctattttacacataaagacagtaagacccgagaggtttatcttgtagatggccagtggtagagcctggatttggtgccaggtcggacttattctaaagcctaatgggccaggcatggtggctcatgcctgtgatcccagcaccttgggagactaaggcaggaggatcacttgaggccaggagttcaagaccagcccaggtgacatggcaagatgcccgtctctataaaaataaaaaaattagccaggcgtggtggcatgcgcctggggtcccagcaccatgggaggctgaatggggaggattgcttgagcctgggaagtggaggctgcagtgagccatggtcacaccactgcactccagtctgggtgacagagaaagatgctatctcaaaaaaaaaaaagaaaaaagaaacaactaaagtctaatgttttttccacagtcccaactgacatctcaaggatgaaaagctttcagccctggagtctgcatgagtccgagactgttgactctaagcttttcagaatctcctactattacagcggggagctggttaaatgaatggttttaaccctatctgacccagtgagatttgtagacaatattacctacctctattcacagtcactcccaaagtccatattttattttattttattattattttttttttgagatgcagtctcgctctgtcacccaggctggagtgcagtggcatgcaacctccgcctcctgagttcaagtgattctcctgcctcagcctcccgggtagctgagattacaggcacctgccagcaggcccggctaatttttgtgtttttagtagagacggggtttcaccatgttggccaggctggtctcgaactcctgacctcaagtgatctgcctgcctcagcctcccacagtgctgggattacaggcgtgagccaccgtgcctggccaaaactccatattttacaccaaactgtagtataaaagagaaagaaaaggaaattaatacagcatatataatcacatttatttcaatatgtaaacgccccacaggatatatgaggaaggtggcagttgtttgtgactatatataggctccttgttaatgccgtggccacaaatgcagcctgacccagctgcgcagacttagtgacttatatgtcacacgtgcagggttgcggttggtgaggggattttccaaagtggcgaacaactcttggtctaaacaattagtgtgctggttgcaatctttgaaaattcagtgggtattacagttatgggaaactccagcctgggtgacagagttagacctcgtctcaaaaaagaaaaaggaaaaacaattatgggaaagaatattattggtgtcaaacagagcaagggccaggtgtgatgcatgcctgtaagcccagatgtttgggagactaaagtggaagtattgcttgagtctgggaggcggaggttgcagtgagctgagatcgtgccattgcactccagcctgtgcgagatcctgtcttaaaaacaaacaaacaaacaaacaaacaaatccactcagcaacaatagagcaagtttctgggatctggtcattttaaacaggtttcttattgactcgaatctttggcaggatgttcagaaggcttgctggctgtgggatggctgtgcgggactgtccctggtattataaactgtccagcataactggtcctgtctacttgcggtagggtccacatcagtgtcaaccagccaccccccaaatcccatttttcccctagggggcagcactcccccactgagaccaatggttaatggtattttataggcttgggctttagaagttcagagcaggcttcagaaggtatttaatgccagcagggctgagccagtgactcaaagctgccaagtgggactggccctgcctaacggggctggtttttatttgctgctgcctgtggctgctgagcaaaaattctggcttcacttgctatatcttccttttttaaaaaagaaaaatctggggaggccgaggtgggcggaccacctgaggttaggagttcgaggccctggaggctgggatcgcaccactgcactccagcctgggcaacagagagaatctgtctaaaaaaaaaaaaaacaattctggaaatccgaaataatgtgatgtcttataattttaattgtgggctccaagtttttcctaatcttttacttggaaaaaaaagttttagttttttcctgtctagtttttctttttaagttttattgaggtataattgatgtaagaaaaattgcacatacttaatgtatacattttgatgaatttgttattattcctttttttttttttttgagacagagttttgctcttgttgcccaggctggagtgcaatggtgcgatctctgcctctcaggttcaagcagtcctcttgcctcagcctcctgagttggtaggattacaggcctgtaccatcatgcctggctaattttgtatttttagtagagagggggttttgccatgttgcccaggctggtctcgaactcctggcctcaggtgatccacccgcctcagcctcccaaagtgctgggattgcaggcacgaaccaccgtgcccagcccttttgattagtttggatgataaaagaatttaaacctagagaccaggcgcggtggctcacgcctgtaatcccagcattttgggaggccgaggcaggtggatcacctgaggtcaggagttcgagaccagcctggccaacatggagaaaccccatctatactaaaaatacaaaaattcttggccgagcgtggtggctcaggcctgtaatcccagcactttgggagactaaggcaggcagatcacaaggtcaggaggtggagaccatcctggctaacatggtgaaaccccgtctctactaaaaatacaaaaaattagccaggtgtggtggcgggcgcctatagtcccagctactcgagaggctgaggcaggagaatggcgtgaacccaggaggtggagcgtgcagtgagctgagatcgtgccactgcaccccagcctggccaacagagcgagactccatctcaaaaaagtaaaataaaataaaaatacaaaaattagccaggcatggtggcaggcacctgtaatcttagctacttagaaggtagagacgagaatggcttgaacctgggaggcaggggttgcagtgagctgagatcatgccattgcactccagcctgggcaacagagcaagactccatctcaaaaaaataaataaataagaatttaaacctacagaaaagttaaaaaataatacactgagtatctttgaaaggtgagtgcctgttatttatttatttttttttaattttttttgagacagagtttcgctcttgttgcccaggctgtagtgcaatggcgcgatctcggctcactgcaacttgtgcctcccaggttcaagcgattctcctgcctcagcctcccgagtagctgggattacagacatgtgccaccacgccctgctaattttgtatttttagtagagacggggtttctccatgtcggtcaggctggtctcgaattcctgacctcaggtgatccacccgccagattacaggcgtgagccaccgcgctcggctgaaagctagtgcctttcatctatattcaccagttgacattttgccacatctgctgtgtctctcattctgtctccgcacagccaaacatacacacacacagatacatacatttttgttttgttttgagacagggtcttgctctattgcccaggctggaatacagtgacgccatcacagctcactgaagcccggatctccagggttcaagcagttttcccatcttagcctcctgagtacctgggactacaggtgcattccaccacacctggctgatttttgtattttttgtagagatggggtctgcacatgttgcccaggctggtcttgaactcctgtgctgaagcaacccaccttccctggcctccaaaaagtgctgggattacaggtgtgagccaccacgcctggccgacacattgtttttttgatgactcatttacaaatgaattgtagccatcatgctacttcacccctaattccttcaggatgtatctcctaatcataagctcctctgtagctacaatctcattaatcacctctaggaaaattagtaatcccatcaaatcatgtaatatacagtccatatttcaatttcccaattgtttccaaaatgtgttttatagttgtttcttcctccttaatccaggatttaaccaaggatcatgttgcatttggttgtcctatctcattagtctctctccttctctctttatttatgtatttatgtatttatttattttttgagaaggagtcttgctttgtcacccaggctggagtgcaatggcacgatctgggcccaccgcaacctccatctccagggttcaagtgattctcctgcctcagcctcccgagtagctgggactacaggcatgtgccaccacgtgcggctaattttgtatttttagtagagacggtgtttctccatgttggtcagcctggtctcaaactcccgacctcagttgatccacccacctcggcctcctcaaactcccaacctcaggtgatccacccacctcggcctcctcaaactcccgacctcaggtgatcccccacctcggcctcccaaagcgtcgggattacaggcgtgagccactgtgcgcagcccttctctccttttttaaaaaaattaagatataattgatcatatatagttaagattaaagctctgaatttttacatataatgtatacatatgtagtttacacagtgtaactacctaccacccaggcacccaggtcacaatacatgatttattctctttctctctctctctttttttttttttcttttttgagacagggactttgtcacccaggctggagtgcagtgacgcaatctgggctcattgcaacttccacgtctcaggcttaagtgatcctcccacctcagcttccagagtagctgggattatagatgcctgtcaccacacctggctaatttttgtattttttatagagacggggttgcccaggctggtcttgaactcctggtctcaagcagtcctcccacctcaacctcccaaagtactgggattacaggcgtgagccactgtgcctggcccatcatttgttgtcttttaaccccaaatgtggcacccatcttttttttttttttttttttttgagacggagtctcgctctgtcgcccaggctggagtgcagtggcgcgatcttggctcactgcaagctccgcctcccgggttcacgccattcttctgcctcagcctcccaagtagctgggactacaggtgcccgccaccacgcccagctaattttttgtatttttagtagagatggggtttcaccatgttagccaggatggtctcgatctcctgacctcatgatctgcccgtctcagcctcccaaagtgctgggattacaggcgtgagccaccgcacccggccatggcacccatctttatagtcttccatgacactgaaattttcacgtggtggctcatgcctgtcatcccagcgctttaggaggccaaggcaggcagatcgcttgagttcaggagtttgagaccagcttgggcaatgtagcgaaactccgtctctactgaaaacacaaaaattagccaggcatggtagtgtgcgcctgtagtcccagctactcaggaggctgcggcaggagaatcccttgagcccggaggcggaggttgcagtgagctgagatctcccgccaccgcactctagcttaggtgatacagcgagaccctgtcacaaaaaaatttaaaaaaggccaggcacggtgactcacgcctgtaatcccagcactttgggaggccgaggcgggcggatcacgaggtcaggagatcgagaccatcctggcgaacacggtgaaaccccatctctactaaagatagaaaaaaattagccgggcatggtggtgggcacttgtagtctcagctactcgggaggctgaggcaggagaatggcgtgaacccgcaggcagagcttgcagtgagcggatccagcctgggcgacagagcgagactccatctcaaaaaaaaaaaaaaaaaaagcctgagtggcctaaaaaagcagcctgtagggcagatattatatgaggccccccagttcatcagttggaagcttctggtttaggatatcaaagtggcctttttttttttttttttttttgagaccgtcatattctgtcacccaggctggagtgcagtgtcaagaactcggctcactgcatcctccgcctcccaggttcaggcgattctcctgcctcagcctcccgagcaggtgggattacaggcatgcgccaccatgccgggctaatttttgtattttcagtagagactgggtttcaccatgttagccaggctggtctggaactcccgacctcaggtgatccgcccacctcggccttccaacgtgctgggattgcaggcgtgagccacctcgcccggcccaaagtggtcttaagcaaacacattccatcatcctggtcgcgggagaaggttggggagctcccaacagaggaccctagtggggagaggattggggagctgccaaggaaggccccaaggagtttggatggacgcaggcatcggtgatgggacccccaaagaggacttctcttcctgcagctccgggattgtggagggctgcgggaggtggaggtgactgcctgcctggtgtggaaggactggcctcaccgagtccacccccacagcctcgtggggaaagactgcaccgacggcatctgcagggtgcggctccggcctcacgtcagcccccggcacaggtacccaccccctgacctccgacctctcatccttgatcatggagattctaagcgactggaggccacccatgaaactttagagcagagggcagcttgggtaaaccctccccactgcctcttctaggtgggagacaggcctggggacagtggagggcctcacttaggcctggagccttgccacacacatattcacatacattttatccctattttgtagaggaagaaactgaggctcagagagggtaaggagcacagataattgatgacagagctgggatttgactgcagacctgacttaactgcaaggtctgttctttctcttactttacaattcatctttttttttttttttttgggacggagttttgctcttgttgcccaagctggagtgcaatggttcgatctcagctcactccaacctccacctcccggattcaagtgattctcctgccccagactcccgagtagctgagattacaggcatgcgacactacacccagcgaattttttggatttttagtagaaatggggtttcaccatgttgaccaggctggtctcgaactgctgaccttaggtgatcctcccagctcggcctcccaaagtgctgggattacaggcatgagccaccgtgccggccttttctttctttttaaaacagaagcactgtataacttttattttgcatatgtccacaaatgcttacacaacatacagtggctacatctaaaactttgagcattttttcatagtgcaaagagacagaaaggtagtgacacacttcactgtgttacactgactttgggtagagccctaaaggcagcacgcacttcagaggtagggctgagtattgctcacactcaggtctggaagatttaattttagaaatttttaaacttagtgaaaatataagttccgagagcagagatcttgtctcttacattccctgctgtattccgagtgtctggcatagtaactggcacatagtaggtgctcaggaaatatttgtggaatgaatgaatactgccatgttatgcaatttacagacccatcagtaatgggtgagagcacctgattctccacaacctcaccagcaccgagtattatgaaacattttgatttttgctattttgatgagtgccccaaaacaaaggcatcttcattggtgtttaatttgcagttttctttccttccttccttccttccttccttccttccttccttccgtccttctttctttctttctttcagacagagtctcgctctgtcgcccaggctggaatgcagtggcgcgatctcggctcactgcaagctctgcctcctgggttcaagtgattctcctgcctcagcctcgcaagtagctgggactgcaggcgcccaccaccacacccggctattttttttgtatttttagtacagacggggtttcgccgtgttagccaggatggttaccatctcctgacctcgtgatccgcccgcctcggcctcccaaagtgctgggattacaggtgtgagcccactgtgcccagcctcttttttttttttttttttttttttttttgagaccgagtctcactctgtcacccaggctggagtgcaatggcacgatctctgctcactgcaatctctgcctcctggattcaaacgattctcctgcctcagcctcccaggtagctgggattacaggcgccagccaccacacctggctaatttttgtatttttagtagagacggggtttcaccacgttggtcaggctgatctcaaaattctgaccttgtgacccacccgcctcggcctccaatttttgtatttttagtagagacggggtttcaccacgttggtcaggctgatctcaaaattctgaccttgtgacccacccgcctcggcctcccaaagtgctgggattacaggcgtgagccaccgcacctggccctgaagttttcttattttatttatttatttatttattttgagacggagtctcgctttgtcgcccaggctggagtgcagtggcgcgatctcggctcactgcaaactccgcctcccaggctcacgccattctcctgcctcagcctcccgagtagctgggactacaggcacccgccaccatgcctggctaatttttttgtatttttagtagaggcggggtttcaccgtgttagccaaggtggtctcgatctcctgacctcctgatctgcccgtatcggcctcccaaagtgatgggattacaggcgtgagccaccacgcccggcctgaagttttcctattaaagatgaagttggccagtgttctcacatggtaaagataaggcatgttctggatcttctcaagaacctttgacatgcttatttttattttttgagacagattcttgctctgtcgccaggctgaagtgcagtggcatgatctcatctctctgcaacctctacctcccgggctcaagcaattctcctgcctcagcctcctgagtagctgggattacaggtgtgcgccaccacacccagctaatttttgtatttttagtagagacagggcttcaccatgctggccaggatggtgtccctctcttgacctcgtgatctgcccaccttggcctcccaaagtgctgggattctacagatgtgagccaccacgtctggccaaaaggtttattttattttttattgtttgagatggtgtctaactctgttgcccaggctggagtgcagtggcacaatctcggctcactgcaacctctgcctcccgggttcaagtgattcttttgcctcagcctcccgagtagctgggattacaggcatgcactactatgtctgctaatttttgtatttttagtagagacagggtttcaccatgttggccatgctggtcttgaactactgacctcaagtgatcctcctgcctcggcctcccaaagtgctgggattacaggtgtgagccaccgcgctggccttctgagaggtttaaaccccagaccgtttctaatgctgggacccctgggcctgggatgtcagcccctgagagcctgagccccacagcagcatctgccagagccctcctgcaggttagggccacacttgcctgctcacgagcactcctctccctcccccgtcaccccctcagttttaacaacctgggcatccagtgtgtgaggaagaaggagattgaggctgccattgagcggaagattcaactgggcattgacccctacaacggtgagcaccccctgcctgacctgaccatcccgtcctcccaaaccccttgacttccgtgctcaccctggtcccctcaccactccaggccccaccgtctcctccagccccatcccttccccgttcccctgtaccccagagagggtctccacttcccaccctcagcctccccatatctcccccgacagctgggtccctgaagaaccatcaggaagtagacatgaatgtggtgaggatctgcttccaggcctcatatcgggaccagcagggacagatgcgccggatggatcctgtgctttccgagcccgtctatgacaagagtgagttgagagtgctgtggccgttaggattgcccttggctgcaggtgtcagaatgtcccgcttacagaggcatgaatggctcaggcgctgtggctcacgcctgtaatcccaacactttgggaggtcgaggtgggaggattgcttgagcccaggagttcaagaccagcctgggcaacttggcaaaaccctgtctctataaaaaatttaaaaattagctgggtggccaggcacggtggctcatgccggtaatcccagcactttgggaggccaaggcgggcaggtcacctgagaagtcaggagtttgagaccagcctggccaacatgccaaaaccctgtctactaaaaatacaaaaattagctgggcgcagtggcaggcgactataatcccagctactcaggaggctgaggcagaagaattgcttgaacccgggaggcggaggttgcagtgagccgagatcgcgtcactgcgctccagcctgtgcaacagagtgagattgcatctcaaaaaaaaaaaattagttgggcatggtgacatgcacctgtagtcccagctactttggaggctgaggtgggaagattgcttgagcccaggaggttgaggctgcagtgagctgtgatcatgccactgcagtccagcctgggcaacagagcaagtggtgaaatcctgtctctactaaaaatgcaaaaattagctgggcatggtggcacacgtctgtaatccctgctacctgggaggcggaggttgcagtgagctgagattgcaccactgcactccagcctgggcaatggagagggactccgtctcaaaaaacaagaaaaaaaaacatcaaacccaaaatggaatcttctagtgttgtagaatgaacaatctgtacaactataccaggcagcccaagggaagaggcagcataagtaataatctctctccctttctgagagagtgcattatattccacagaatcaccctggtagacttctgcttatttttcagtggccagagcttggtcccatggccactcctagttgcagggtggtctgggaaagcaagtgcttagatttttcaccctctatagagggatacaggcatagaagaggggactgggaataactggtaggttttagccaacccatagtgactgctgtaagcatcaaaatgggatattaattcagtcagggcatttatggatgcaagtgatagaatcccaacttagccgggcgaggtggcttacgcctgtaatcccagcactttgggaggacgaggtgggcagatcacgaggtcaggagatcgagaccatcctggctaacatggcgaaaccccgtctctactaaaaatccaaaaaaaaaattagccgggcgtcgtggcgggcgcctgtagtcccagctactcaggaggctgaggcaggagaatggcgtgaaccctggaggcggagcttgcagtgagccgagatcgcaccactgcactccagcccgggcaacagagcgagactccttctcaaaaaaaaaaaaaaagaatccttacttaaataggcttaagggggaaaaaagagaataagttattctatttgttctattaacgagaaaaaatgcagatgtagcatagtgcttcaggtctggctgcatccagggcctcagtgatgtcattagatatctgtctctttctgtctctcagctgttcttcctccatgttagaatccatgcttatatcctacctgcctggcacctctccccgactcccaaagctgcttttagcttctcttacctaatagctttgcttaaagtctcaggtctatctctcattggcctggttttggtcatttgctcctttttgacaaatcagctttggccagagggatgcactgctctgattggccaggtctggggcatgcgctcaattactgctgagctaggaagtgggctcagccctgcccaatcccagttactaagatgaggggtggtcccttgagggaaaattggaggctgttaaaagaagaggggtcaggactactagatggggaaaacaacaggtgtccactacatgattacagtctatcaaactctcctcaaggaaccttctctcacctgggaccccatcaactctccctgaggtctgagggtctcccttaaacattttttaaaaattatttttattatttttttttagagatagggtctcactctgttgcctaggcagtcatgcagtggtgcagtcatagcttactgcagcctgaactcctgggctcaagtgatcctcccagttcagcctcacaagtagctgagactacaggcatgtgccaccacacctggctaagttttatttttaaaactttgtagagctagagtctcaccatgttacccaggctggtccagaactcctgggctcaaacgatcctccctcctcggcccctcaagtgctggcattacaggtgtgagccatcatgcctggcaattttttttttcttttttgagagagatgggggtctgctatgttgcccaggctggtcttgaacttctggcctcacgtgatcttcctggctgggcccccaaaagtgctgggattacaggtgtgagctaccttgcctagcaaaggatcttcttttgttttgttatttttttgtttgtttgttttttgttttgagacggagttttcctctgtcacgatggagtgcagtggtgcaatctcagctccctgcaacccctgtctcctgggttcaagtgattcttctgcctcagcctcctgagtaactgggaccacacccagctaatttttgtatttttagtagagtcagggtttcaccatgttggccaggctggtctcaaactcctgacctcaagtgatccacctgcctcggcctcccaaagagctgggattacaggcgtgagccaccatgcccggcaaaagatcttcgttttggacagacactcaccgggcttcagcttgagggctggcgattgttcgttaaccccttctgtccgagtgacttctttctccacctggactatgggttccatgaggatcagatgccctgccttttcaattccctacgtctccagggccccggggatggcacccactgggtgcccagtaaggctttggtgactgaattctcgggattttttttaatacacttcttcctcttgctccttcccagaatccacaaacacatcagagctgcggatttgccgaattaacaaggaaagcgggccgtgcaccggtggcgaggagctctacttgctctgcgacaaggtgcagaaaggtgaggggcctggggcagcaagcttgggcagagcggggtctggcaacttggaggggtagccagggagcccgggaagatgaaaggatgagaaagagctggttaaccagggcaccagagtgcaagggtccagaacactgtctttgcagtcagacacagctgatgggttcattcactccctgagtcgccttctcacccgtctgcgtaggacgacagagactcgtctgtggtgacccatgctgcaagctaggcggtgccatcacagagctcacgacatgtccagaggactctgatgttaagggtggaattgcataaatgaacgctttacggtggttctgataagcgctatgggtaaagcaaataggacaggagaagcaactccacttcattcatctctgttcaaatggcccttcctcaaacaggcttttaaaaaaaaaagacagctggtcaccgtggctcaagcctgtaatcccagcaatttgggaggctgaggtgggtggatcacttgagctcaggagttcgagaccagcctgggcaacatggtgaaaacccatatctactaaaaatacaaaaatgagggctgggcgcagtggctcatgcctgcaatcccagcactttgggaggccaaggtgggcggatcacctgaggtcaggagttcgacaccagcctcccaacatggtgaaaccccatctctactaaaaaacacaaaaatgagctggttgtggtggcatacacctgtaatcccagctactcgggaggctgaggcaggagaatcgcttgaacctgggaggcagaggtttcagtgagccgagatcacgcctctgcactccagcctgggccacagagcaaagctctgtctcaaaaaaaagaaaaaaagaaagaaaagaaaaagacagctgggcacagcagctcatgcctgtaatcctagcacagttttggaggctgaggcgggcagatcacttgaactcaggagttcgagaccagcctgggcaacatggtgaaaccctgtctctacaaaaaataaaaaatttagcaggtgtggtagtgtgcacctgtagtcccagttacttgagaggctgaggtgggaggatcacttgagcccgggaggcggaggctgcagtgagccaagattgcaccactgctctccagccagggcgacagagacagaccctgtctcaaaaaatcaaaaccaaaaacaaaccggctgggctggtggctcatgcctgtaattctagcactttgggaggctgaggtgggaggatcacttgagcccaggagtttgagtccagtctgggcaacatagcaagcccccatctctacaaaaaaaagttctttttaattaaaaaatagccaggcattaggccggctgtggtggctcacacctgtaatcccaatactttgggaggccaaggtgggcgaatcacttatggtcaggagttcaaaaccagcatggccaacatggtgaaaccctgtctctactaaaaatataaaaattagctgggtgtggtggaacacacctgtaattccagctacttgggaggctgaggcacgagaatcacttgaacctgggaggcagaggttgcagtgagccgagatcatgccattgcacaccagcctgggcaacacagtgagactctgtctcaaaaaatgaaataaaatagccaggcatgttggggcatgtgcctgtagtcccagcacttgggaggctgaggtaggaggattgcttaagtgcaggagttggaggttacagtgagctatgatggtgccaccgcactgcagcctgggcaatagagcgagactctgtctcaaaatagaataaagtaaagtgaagaaactggttccagagatatctagtaacttccccaagttataacagagttggtagtgaagagttctagccttcctgggtttccatcttggctctaacacttgccagctgtgtgaccttggacaagtgacttcacctctctgtgccttcattttcgtctttatacaatacggtacctaatagtaccttcttcatagagttgttgtgtgacttagaggcaatctatatgtaactgacacatataaagtctcagtacatggaggtactgtgatgacgggcgatgcagtaagacaagaaaaataaatagcaggcagagtagcatcatgaatcctgactcttccgctaccagttgtgtgatgtctcaacactttcaagcctcagtttccgtttttgtttttttttttaagaaccaggctctcgctctgtctcttaaatagctgggaccacaggcgtgcgccaccatgcctggctaattttttaattttcttgtagagacaaggtcttgctgtgttggccagtctggtcttgaactcctggcctcaagtgatctgccagctttagcctcccaaagggctgggattacaggtgtgggccactatgcctggacaggcaccttttttctctgctgactgtgcctggtatccttttgccataacagatcatagctgtgagtatgactgtatgctgtcttgtgagtcctcttactgaaccacctgagggtgatcttgaggatccctggacatgagggggatattaattcttttgtttgtttgtttgaggcggagtcttgctctgtcccccaggctggagtgcagtggtgcgatcttggctcactgcaagctccgcctcccgggttcacgccattctcctgcctcagcctcctgagtagctgggactacaggcgcctgccaccatgcccggctaatttttttgtatttttagtagagacggggtttcaccatgttagccggggtagtctcgatctcctgacctcgtgatccgcctgcctcggcctcccaaagtgctgggattatgggcgtgagccaccgtgcctggcaagggggatattaattctacctacctcttaaattgttataaggattaaatgagataatatatataaaaatacataaaacaaggccgggtttggtggcttacatctgtaatcccagcactttgggaggccaaggcgggcagatcacgaggtcaggagagcgagaccatcctggccaacgtggtgaaaccccgtctctattaaaaatacaaacattagctgggcgtggttgcacatgcctataatcccagctactcgggagactgaggcaggagaattacttgaaccagggagttggaggttgcagtgagccgagatcatgccactgcacttcagcctggaggcagagtgagactccatctcaaaaacacacaaacaaaaaaaaaccaaaaataaaattagccgggcgtggtggcatatgcctgtaatcccagctattccggaggctgaggcaggagaattgcttgaacccgggaggcagaggttgcagtgagctgagatcgcgccattgcactccagcctgggcaacagagcaagactctcaaaaaaaaaaaattttaaaaagggggaatattagtcttgattttaggggaggctgggcaagttgggagcacagtggtccagatgtcctggcttagctgatgtcccccgtttcctgccagaggacatatcagtggtgttcagcagggcctcctgggaaggtcgggctgacttctcccaggccgacgtgcaccgccagattgccattgtgttcaagacgccgccctacgaggacctggagattgtcgagcccgtgacagtcaacgtcttcctgcagcggctcaccgatggggtctgcagcgagccattgcctttcacgtacctgcctcgcgaccatggtaactacagcaacccagggtgacccaccacctcggagactaggtctttggccttggggagaccccagtggggatgggaaagaggcagaactagaatgcaggctcagagctacaaagacagtgttcagatcctggctctgctgcttactggttgtgtgaccttggcctctctgagcctcattcttctgtgcaaaatggaaataatagtagctgtcctgtgacatttggagagtatttaatctttcctcccctcagcatcctgcacatgcccgggcctgtgctcggtattgctagagacacagcagtgaccagcacggcccctagctgtgtcctcatgaggcttatagtcctgaggataggggacagcctgtccctacagagtgatgaccagagtgggcaggactggaatgaagtgctcaagggctcacattgcccagagggggtacctgacccagctgtaggtgtcagggaatgcttcttggaggaggggacagctgagctgaggacaggaggatgactaagcagggaagttttctagggaaatagtgagagtggaggaagagtgctttaaacagctggaacagcaggtgcaaaggtcctgaggccggattgtgcctggggtgctccaggaacaacaaagaggccagtgtgtaggccgggcgcagtggctcatgcctgtaatcacagcactgtgggaggctgaggcaggcggatcacctgaggttaggagttcgagaccagcctgaacaacatggcgaaaccccgtctctactaaaaatacaaaaattagccgggcgtggtggtgggcgcctatagtcccagctactcgggaggctgaggcaggagaattgcttgaacccgggaggcagaggttgcagtgagccaagattgtgccattgcactccagcctgggcaacagagcaagactcactacaggcacccgccaccatgcccggctaattttagtatttttagtagagaccgggtttcgccgtgttggtcaggctggtctcggactcctgacctcaggtgatccgcccacttcagcctcccaaagtgctgggattgcaggagtgagccaccacgcccagccaagactccatctttaaaaaaaaaaaaaataggcctggcacagcagctcacacctgtaatcccaacacttcgggaggccaaggcaggcagatcacttgaggtcaggagttcaagaccagactggccaacatatagtgaaatcccatctctactaaaaaaatacaaaaattagctgggcgtggtggcgcacacctgtaatccctcctacttgggaagctgaggcaggagaatcacttgaacctggcaggcagaggttgcagtgagccaagaccgtgccactgcactccagcctggtcaacagagcaagactgtctctaaaaataaataaataaataaataaataaaggaattaattattattgatgaattacttcttgtgtgtccctggtatctccttaacagacagctacggcgtggacaagaagcggaaacgggggatgcccgacgtccttggggagctgaacagctctggtgtgtgccctctgcccctttccacccccatccccaggttctggggaggggacagctgaccccactgccctgtcccaccccaggctggggaggaagggctgtcggggaacaggggtcctcatctctgccttccctcagacccccatggcatcgagagcaaacggcggaagaaaaagccggccatcctggaccacttcctgcccaaccacggctcaggtgggtcccagctacacataagcccctgtcccctgggtgggcagagggtaagtggcagccctgcttttctggcctcttcacgccctccaagagcagccacaaggcgagtcactcagcacttagccagcaacatagagtagaaagaatgagggctttggagacagaatggaagttctgatctcttctgggccatttccttgctatgtgaacttcattaagttgttctacctctcagagcctcagggactcctttgaaaaggcccagtacatacttagctcagtggtgttttaaaatttgatctatttcttctttctttttttttttttttggagatggagtctcgctctgtcgcccagactgcagtgcagtggcatgatctcagctcactgcaacttctgcctcctgagttcaagcgattctcctgcttcaggctcccaagtagctgggactaaaggcatacaccaccacacctggctaatttttgtattttttagtagagacggtgttttaccacattggccaggctggtcctgaactcctgacctcaggtgatctgcttgcctcagcctcccaaagtgctgggattacaggcatgagccactgcatcccacctatgatcacatttaactgcatttacagcaaaacccaaaataacaggggcttcaacaggatagaacgttatttcttgtctcacatacatagtctgtagggactgaaagtggctcatgcctgtaatctcagcactttgggaggctgaggcaggtggactgcttcagtccaggagtttgagaccagcctggccaacgtggtaaaaccctgtttctactaaaaatacaaaaattagccgagtgtggtggtgcacacctgtagtcccagctacttggaggctgaggcagacaaatcacttgaacccaggaggtgaaggttgcagtgagccaagattgcaccactgcactttagcctgagcaacagaatgagacccttctcaaaacaacaacaacaacaacaacaaaacaggcctggcactgtggcttacgcctgtaatcccagcactttgggaggccaaggcaggtagatcacgaggtgaagagagagagaccatcctggccaacatggtgaaactccatctctactaaaaacacaaaaattagctggatgtggtggcacatgcctgtagtcccagctacttgggaggctgaggcaggagaatcatttgaacccaaaaggtggaggctgcagtgagccaagatggtgccactgtgttccagcctgtcaacagagcaagactccgtctcaaaaacaagaaacaaaaaacagtccataggtaggtgttccagggatggtctggtgactgcatgatcatcgagagaccgaggcttctgccattttcagttcgccaactcatggtgcaaggtggctgttgtagctccagccattacgcccacgttccagttagcagaccttagtcacatgatcacatcaggctgcaaggaaggctagaaaatagtcccttgtgtctctaaggtttgtcttgttccaaaaagagagtccctctttttttttgagatagtcttgccctgttgcctaggctggagtgcagtggcacaatctcagctcactgcaatgtccacctcccaggttcaagtgattctcctgcctcagcctcctgagtagctgggattacaggtgcccaccaccatgccctgctaatttttgtatttttgggagagaaggggtttcgccatgttggccgggctggtcttgaacttctgacctcaggtaatctgcccgcctcggcctgccaaagtgctgggattacaggcgtgagccaccatgcctggcctgagaatccctcttataatgaaactttttgatttgattgttattttttcttaagtccccattatgcctgagaatgacatttattttttctgacaattttgggactggtgacttcccaacttgtgtctcccatggtctggagatttcactttttgggttgtctctgtatgttggggggctttggaacctcttctcctttctcactctcagggaaaactctccacagctgtgtaggagcatggtttcaaccccagttccacaacagctgtgtgagccttccatttactttccctcagtgccttagtttacttattattaattatttttagagataaggtcttgctctgttgcccaggctggagtgcagtggtgtgatcatacttcgctgcagcctcaaactgggctcaagcaatcctcctgcctcagactgccaggtagctgggactacaggcgggcaccaccacacccagctaacttttaaataatttttttgtagagacagggtctcgtcacgttgtgctgggattacaggtgtgaaccaccacgcttggccttcaatttacttattatctgagaatggtgatagtcccacacggattctccttgggattaagagggcacctaaggccaggcttggtggctcacacctgtaatcccagcactttgggaggccgaagcaggtggatcacctgaggtcaggagttcgagaccagcctggcaaacatggtgaaaccccgtctctactaaaaagataagaattagctgggcatggcacatgcctggcctgtagttccagctactcaggagactgaggcaggggaatcaacttgaactggggaggcagaggttgcagtgagccaagagcacgtcattgcactccagccagggtgacagaatgagactccatctcagaaaaaaaaaaaaaaaggccaccttgatatcacattttgcagggagtagggcatttgatttagggcctgatcagaagttagccctaaatcacactacacttctcttgtcttcatccccgtaggcccgttcctcccgccgtcagccctgctgccagaccctgacttcttctctggcaccgtgtccctgcccggcctggagccccctggcgggcctgacctcctggacgatggctttgcctacgaccctacggcccccacactcttcaccatgctggacctgctgcccccggcaccgccacacgctagcgctgttgtgtgcagcggaggtgccggggccgtggttggggagacccccggccctgaaccactgacactggactcgtaccaggccccgggccccggggatggaggcaccgccagccttgtgggcagcaacatgttccccaatcattaccgcgaggcggcctttgggggcggcctcctatccccggggcctgaagccacgtagccccgcgatgccagaggaggggcactgggtggggagggaggtggaggagccgtgcaatcccaaccaggatgtctagcacccccatccccttggcccttcctcatgcttctgaagtggacatattcagccttggcgagaagctccgttgcacgggtttccccttgagcccattttacagatgaggaaactgagtccggagaggaaaagggacatggctcccgtgcactagcttgttacagctgcctctgtccccacatgtgggggcaccttctccagtaggattcggaaaagattgtacatatgggaggagggggcagattcctggccctccctccccagacttgaaggtggggggtaggttggttgttcagagtcttcccaataaagatgagtttttgagcctccggg

SEQ ID NO: 2725 - DNA, 47755 bp, Homo sapiens
  source 1..47755: mol_type = genomic DNA
tattctaatggagagaaacgcacgtgcacacacacccccctaaacccacacaaatgaaaccccctctgcggagaagccggctacaggaaattgacttaggcacaggaacttgctaatctcttttgtcacattcggattgctcctgctgccccacacacactaacccaaccatcttggggtggactccctgccagcccaactgttgtattttcagttcttccagtgtgaatcagttaatattctcgggaacgagggagaggttgatcctatgaggaaatcaaccacagtgaaaaggcttgggccgcttttgttttcacctgcttttgttgaacaaatttgatttccggagtcagtcattttactgtcaagacatttcttcggcattctgcaacaggtaaggattttgcttccttaaaagtatttctttggtgtcaaaagaaatttttctaattttatttagcttttactctaggccaaacatcgtaatgactctgagctacctgctgtaaggtgtagaatcaatttacagggggacgggggtcgggggggtgagtgttgctttgatattcactgcccctcaccacagtcctaacaagatttttgaaacatgaaaagttacaatagttggctttttggttttccagatattctagagaatgcatatgcttgtgactgtggctgagctcaactgtatgggtagtttaaatactacccaaggtttgatgaagtaaatctaaagatgctctaagttgtgcaaatatgaattttaaagttgtctagttcagaaaagaaacagaaccgaagtctaaatgatgtagatttcaatctggaatttctagcttgtgtttttcacctattgccaatgttaatgaccatttcccaaaagtgctctatgatgtataacatgtattttttaattaaatttaatctttcttctgaggtggtttgatttggagatatgctacgaggtaccagtcagtagcctgagttgtaactaaacaaagtttgggaaatcaccggttttaggtgctttactaaatgaaagttgccattgacgtattcaagcaggcaacaagtagttggtgtccccttattggttctaagctggtgccgtggaggatataagagaaatattttaaaaatctctactttgaaggaccctataatctggtagttgtgataagaagtaaaatttaggaagcaatgcaagatgagaattcagtgatgagtggggcagcacaggcttgaagagttctgtgaattccatggagggggcctgggggcaaactggagttgtcaggaagatctgggctttggaagaatgcgaagtgtcggtagaaggagaaggggcaggtgatttcagactgggaggaccttgtgggcaaaggcacaaaggcgagactgacctggagatgataaggccagttgaagagacactggagaagagaagacagtttgttttacacattgcaggaaatcagattagacagttagggtgtggacacaaaagcgaggaccttgcaggcactggggagaagtgaccccattcaatagtccttggtctccttctgccctgcggctgcgcttcctcggctctcacggcaccagcagaattccatgtgagagggagcttgtcgagcgtggcctcttcccacttggggctgctttctgcatccctgtgcctggctgtgggcctccatttgccctctactgtcttcccttaggacatcatttatgcagagaaaggttcgtgtggctcggggtaccagtaagacctccacctctggtttcttcattttaaggaggcccttcaattatccaggaattaaagtggccttcctcttgggagaacgagttggttgatgaatgataagcaagtctctattcctcaaaagccagtccccaaattccatgaaatatgtgctactttctttgcatgtctaaatgagatggcacgggtatgcttctgttctttttctggacgttgtttagagagtcagtagatcataataattcagacactttttttctggaccataaaatatctgaacccatataataacaaacatacagcacggtgaataagaacccaacttttgagccagatcactttgcatggaatccccattctatcattctatcatttctgggctgtgggaacctcagacaagttacttaacttcttcaatgctcagattaaaaaaaaaattcacaaaatatctctaataacagtaataataactgaaaatacctacctcagagggttgtcgtagagatcaaatgagataaaaatatgtaaagcatgtagcctagtgcctgactgaaaaaaaaatctctcaatagatgcaactcttatgattcttattaaggacttggctattgccacaaatgaaggtgttatgagccctggcttaagagcaagaagcctgcaaagctaactctcctaatcccaacattcctttccagggaaagtagggtgacaggtggaggctgggaattaacgttttttgagcaccaaatatggacaaggcacaggggttgggtgtttttctagtgagaatacatatgaaagaaggaaaacaaacttggaaaccgctattttaagccatttggtaacagtttctctagcttatgagatgagagaggtcctctcagtatccgctgcattacttgtgggcctccttggttgacgtcgctctctgaacgcttggggtggaattctagaggtgcttttcattagaggcagagagcatgacctttcttccttgcccagtttaaattaaattattttatcttacaatgtgttaattttagtgctagcaaggcacagctaaaattccatttctacttaggagtggggatcattgtggcagtgagtgcttatttgggtttgggatgcttggatctgggtgaaagccaggattaaaaagcatcctccttccccattccactctctaggttataaatatttttttggattaaaagcctcctttaaaaaaatgcaaatccacctggcatgttaattgtgcaggggattcctaattatgtgtgcagatgacgtgagtcacacggtgatagtgttccttctagagtcccactggtgtcctaagggaggagactctggagctttgtgtatgaaaagggatgggcacaagtcaggatggggtgcacaggtggaggctgggaggcagcatgacagtgtgggggctggggtgggctgtgagagcaaggagggtgtcagagatggaaaggatgaccccaggggggtggaagggtgccagaaacttagggctcctctgtgagctctttagccatttgactctagcaactgcttgaatgccctgaacaaccttttgacgacttgcacaagaagttgtcatactgttccccggatgtggacagttgttcagagaccacgatcatgtgtctggtgtctcactgtggaatagtggtttctaaagctggctggacagcaaaaccacctggggagcttttaagaaactgaaattccatgtctcataccccagccctcacgtgaggtccaggaatctgtgtgattaaaaaatacaagccccaaaacaacttggaaagtggtcgttttgcaggtggggatttaggaaccaagaatccagaactctcctaccagggccccagaaaccgtaagttgaataagtgctgaaatgaggcaaattgatctactctctattgtgattaatatcttcacacagcaagtattttcctttgttttgagttcattccttgagatgagttatcgggagcggggtgactgggtccaggatatgaggatgtttagctcagtcatacccgcattttaacacgcaaacgtacggtgccgctcatttaaaaaccaaagtgttgtatacatgtagaagctatatattattccggggcagcccaaagaggggatgttgctttcaagcgaaagcaccaaatcacattcttttctggtaaaatagaatactaatgaattgcttttggaagaaatttccagagcattactgaatgttcaagtgcttcttagagcacaagttgaacctttcttatctctgcactcagtttctcgtaaaactgaagtcacagtgacctcttccccatttcgtagaaaagaaacccaaggaagagagtggttaagaaacagaagatacggttctcatcacatttgcctgagaactacgtatagtcatccattcagtgcctcgttaagtaaataaatgattgaatcatttgtatacatgacctcatggaaaaaagcacggtaaaatgaatgtttgagggtgggtagacagaattattcaacccggacaggtgttagatgttcactctatccccccctttttttttgcattaggttttattcattatttgcatcatctatggacctaaaagcatgctcattgtcacacagatgggaacagggtgaattttcaatgatttcaatgaaaaaaaaaaaaagatgtgctgttgcaaaatatcaagggagatgtttacagtggtgttctagaaccggcttgctctcaagtgctgattgtaatattttcagaaattttccaagccagtgacattattgacttctctttatctgtgtgatggaaatgctatataatattgtgctatctgagcatctgttttcaattttgcattcagcgatgtcatgatggtggcttgaaattggctatggtaaaagtacactgtgaaaatcagcaaacacaataaatcaggctccccaccttttttttttcggggcggggggcaagcatgttgttaaacgtttactagcatgctactgaggaactgtgtaaaatacaaatatggcaatttgacgatatgtatcaagagccattaaagtgttcatacactttgatccattcattccacccctggaaatttattccgaataaataattcaaagaaaagtaatatgcatgaacatattcactgtattatcatttatagcagcaaaatctgaaaataccctgaacactaagcaataggagttctggcaacattaactccatgagtttttttttttttttttttttttttaagacagggtcttgttttgtcacccaggctggagtgcagtgtgtaatcacagctcactcagccttgacctcctgtgctcatttgatcctcctgccttagcctcccaagtagctgggaccacaggcgtgtgccaccacacttggctaactttttttttgtagagacggggtctcactttgttgcccagcctggtctccatctcctgggatcaagtgatcctcctgccttggcctcccaaagtgctaggattacaggcacgtcactgcgcacagcccatgggttcttttaaagtcattaaaaatcatagttatgatggttatgaaaatatgtttgatatgatgttaggttagaaaatcagaattaaaaattttaattacattctgattttgttgtgaataagaattaaatgtgagccgtaaaaaaatgaatgacagcatttggtatgttagaatggtgaaatagtagaatttgtttttattttgtttattgtagtcgtggtgtgtgttcatttaagaaatttggagaacacctgttaataagtgatcttgagtagttttaacatttaggaggaaggctatgagttttgtgaaccacatggggctttacctttaaccggtagatgttactgtgaatccctgggcagggtattgtaaagggagtttggagctaggcagtgtgagctgtggatgctaaaggggtttctttagagcagcttaaggaggaggaagaagtaagtaactgtgtcctgaggacttgctaaaagtagactgcaaggactgagaaatagcccagagaaaaactaccatcaaaggccagagagacaggcgagagaaggtttcttaggaagagacaaggagacgctgatctcagaggtgaacaacatggataagaaattaactccattttgacctgaaaaaaataggggctgacaccagaaaggaaatgatttttgtagagcaatggttctcaagttttatttatttatttatttttagttttttttaaattttttattttttgagatggagtctcgctctgttgcccaggctggagtgcagtggcatgatcttggctcactgcaagctccgcttcccgggttcacgccattctcctgcctcagcctccggagtagctgggaatacaggtgcccgccaccaggccccgctaattattttgtatttttagttgagacggagtttcaccgtgttagccaggatggtctcgatctcctgacctcgtgatccgcccgcctcggcctcccaaagtgctgggattacaggcgtgagccaccgcgcccggccagttctcaagttttagtgtgtttaagaatcacctggatgagtgcgggaagagttaactaatttagcatccaggttccatctccatgcattctgatacggttggtctagaggttggcaggaatatgcatttttaacaaatcctcccaccctatgaagactctgatgtgaattgcctgcagattacactttgagaaacactagtggaataaatgcaacagtttggttttgtccagggaaggtatatctgtgagtgtgtgtgtgtgtgtgtgtgtgagagagagagagtgtgtgtgtgtgtgttgaaggtgaagccgctacttaaaggctcagaattgaaggacttataatgtaaaaggggaatgaaaacagagaaagcccagagggacaagttatttatttgttatagaaacaaacagcaaaaaccaggaagctgtacttacgatattccttaaaggaatatagtttgtggcacaaaatcctcttccacagttaaacaattttgtccagcacttgaaccaattaaaagtagctgtgactaggggaactatgagcacagagaaagatggtcatggggagagtctgggacccataaacattctatttcaggccatcgagcggtggttattaaacccgtggtagaatatgggagtgctacggacagaaaacactctggaccttactgtatgataacattatgttaaagaagaaaagaaagtatattttttgatgaaatgtagtattttatatacagaactcagcactcaaaatagtaataacaattagacttatgccacaacaacattatatcacaaaataaacatatgaaagtgaatgacatcgcagtagccactgttctgagattatctgcttcacctggctttggaagtttagtgattgtaatagctttcaaatagccttcaatgtctcgtgctcttcttaaagtggagatgattcttttactttaatcacattccccatcgtcagggcctctgatctcttgagacatgatgtggtaaatcaaggataagttaacaacccatcttcacattggaggcgcaagtcacagggtctgtcggatgtgcaagggtctaacgcctgaaatcagacctctttctacaagcacgcgctgactattctattccccacctaacagggtttttcatggactgattggcttgtgctttggagcaatgtttcctaatcactagttttggtcacagattcgtttgacaatgtgatgagagccaaagactttctcacacagggccatgaacatttgctgcacagtcctaggggatataaggaccctctaaaacccattcatggactctcagggatctagaggcctcaagtgaggagctctgccctcagcagagggagcattgcagaggaagttctggttattactgacatcagattaagcccctaaagacagaaatgctgcttctccaattgatggctgaaatgagggtaagatggcggatacaggtgtagttttatagcatcagatccttaaaatgagtagcatgtggggctagagttgtttcccttcagataacatatgattaatgctctaaatccttagttctgaattctctcatgtgaagccagggttggttcccatttgggaaagcagtctctcaagatgccactttaatgtcttacttatcagctcgtgatgccttgggtggcacaagaaatgcaggcagggccgggcgaggtggctcacacttgtaatcccagcactttgggaggccgaggcaggcagatcatctgaggtcaggagttcgaaatcagcctggccaacatggcaaagccccagctctactaaaaatacaaaattagctgggcgtggtggcacatgagcctgtaatcctagctactctggaggctgaggcaggagaatcgcttgaatccaggagacagaggtttcagtgagccaagatcgtgtcactgcactgcagtctgggcaacaaagtgagactcagtttacaagaaaaagaaatgcaggcaggttgtaagcactgatctggccaactctagagtgtagtgagtagtgtggggtcagctgatgcccctaagcaacgtactggatacccagcccagctgcttttagggtgaaaggcattagcattagccggtgggtaaagtgctcccttctgggtgtaagatgtagttgtcttatctgaagctgaacatctggttgggctttgataactttgaagatagttcttttcctgtgtagccttttgatcacagaagccctgttggtcatcttccattagtgggtatctgacctgcaatttggggaactgagtgttttcagctgaaagctcagggctttgttcatttcctgtcctcccagactgtggtatcaggcagggtatggagacttaccccaaacccgtctgtttaaattagccaaccctactggaagtggtaagatgaggccacattctcatgtcacggtcatacagtggattgacactggatgagaaagagaaacgcacttcatcttcatccctccggagaaaaagaatgtgaaattgactaaatacatggtgagtcaaggttctcttggtgtgggatagcataaaaattggaaatctgtctttgagatagaaagggaaaatctataacaaatatgttccagtaatcagtgtgccttcatgtctataaccattttaattattgcacatccatgactacatttcttgtaagtttcaatatctattttaataataatattgcatcatacagtcacagccctcaaaacacaaatattccatgtacaccaaaggctggtagcaaagtctctactcctcttacctcctggagattattttcccctgccaggtcattatgtctagcaacctagttgcccatgcagagaatggactggcacaaatctcttccttggctcttttcctttctttcaggcaggacccctacttttaatttgtcttccctccaggtccagctgtcaccttcttgagagactctaaatatacaacccttactacgaacctttttctccctttcttgcatttttttttctcagttgccacaaaaaattcttctggtctttgttccagttttgagctgaaaatgatcccaactgtggttgagaagcataagaatgcctgtaattattccttctaacaaggaaaaggaaactcaatatatttagagtcaaatttaaatgatgtaaaatcaattacaaaaacctttaaggggcctaaaagtcccctttggcatactttttcttgataaaacctgattttcctcaagctctactctttgggcagtaacttgctgaaaattatatcaatagtagtctttctctgtcttcttcatgtgataaggaagtaggagagagggttggaggcacgtacaggaaataggaggggaaaagccagaaaaacccttacttattgacaataccacaatttcctatatgtgccaaaacaatattgtcactatattcctaaacacagaatatccggcaatatcagagaaatatctataataatttctactttaaaaatataatagtaatggatatttgttgtagcaaatatgtcatatgccttttaggttaaatatacttgtatacatcttatttgtaagtgtttatgtattaaaattgccatcaggctgggcgcggtggctcatgcctgtaatcccagcactttgggaggctgaagcgggcggatcacgaggtcaggagttcaagaccagcctggccaagatggtgaaaccccgtctcttctaaaactacaaaaattagccaggcatggtggcaggcacctttaatcccagctactcgggaggctgaggcagggaattgcttgaacctgggaggcagagtttgcagtgagcagagatcgtgccactgcactccggcccagacaacagactgagactccatctcaaaaaaaaaaaaaaagtcatcatcccagtgtttttcctccacgatgtgcaaaatctatagaaagaagcataaacattgcttcctaatgtgatagaaatacagctaataattgtaggatcatttgaattaacaaaaggcaactatgagtattttttctgagtcctatagctatctttccttttttttcatcctctacatttcaggaaaagcaattgaaatgtacattgtggcagtgtttctattacattctagagctatgaaaacacatggatggttttcaggatgcagcaggagggttctacgtaaaacgtcggtccagagttcaaaccccaaactaatagttttggatttccccaagtactacccacttaatatgtcaccaggaaagacccatcacacacatatatggaaggaaaaattaaagtttctcctccagcaggggctagatgcttgtggtttctgtttaaaaactagatggtggccgggcactgtggctcacgcctgtaatcccggcactttgggaggccaaggcgaacggattacctgaggtcaggagttcgagaccagcctggccaacatagtgaaacctggtctctactaaaaatacaaaaattagccaggcgtggttgctcacacctgtaatcccagctacatgggaggctgaggcacagaattgcttgaacccaggaggcggaggttgcagtgagctgagatcatgccactgcactccagcctgggcaacagagtgagacttggtctcaaaaaacaaataaataaataataatttaaaaaaactagatggtacaattgtgttaaaaaaaaaaatcaccagcgttttcagcctacgtttatatctacttttttttggacctgtgaccgatcaaccttaaaaagttatattatcttccagcttcctctgatttacttgtcctttctttggaggactaaaatgatcatactctttttatttccctacaatcaatcgagctatttggaatttaaatgttagtgctccttcctttataaatttggtcgtgattgattttatttctcaacaggtacgtagctcattattttatccattaattatagttactttttgtttcctttgccaattttgggagtgcttaacaactcttaagaactgtttcattaacgaattagtaaccaatgtaaaatgcagaataaataacaagttcagttgcctttatagtctttaaggtttgcttagaaacttttaaattataatcaagttttttcttttcctaccaaatattggccaaagtacaatttataaacaatatcatcagccagtcaggaaaacgagctaaatattccttcttctctccacttaatatgctctgttctcaattattattttgaatttttttaggaggctttcgaaaggccttttttcagaaaaattgtgagttttgggcagcaacatgaatgatcagctttaaattgttcatagtctttgaccatgtttaagaattattcctaagacaacaacgcaaggtgttttattataaaagcaagacttctcaacacaatggtgtctgctaataatagagaaaccaagaaacaacttaaaatgcccaacagaaatgtataaggtgataaaggtgacaaagtgagaccctgtctcaaaaaatatatacatataatatttgtatttataatataaaaaggcctatatatgtattcttatacatgaattcagaatatggaggtaaataaatatgttagaaattatctagtgtgtgataagattacatgatttaaaatgtttttcattttttcctgtcttttttataagtagcatatattgtttgtatataaaaaaggccaataatccttattaacagaatgtcagtttttggtgtgaggttaataaagaaattagttaaaatgattctgacatgagagttttttctgacattttgaaagaaacctaatgctttgaaagccctaagtctataattaaattgtatctaataaaatttagaggctctttagatttagagggattttgagtttctcaaagcatagaaaacgacttttagtgagagatgttggaattatcagttaagtttgtgagtggtttctgtttttaaaatatgagataattagcattagctagtatcaggctttaagcaaaatataaaatattcaagtgatgaatacagacgattatttctacattttaacctgtaaaaaggttcccaaagagatttttttttcttttttcttttagtgagacaggatgtcactctgttgcccaggctagagtgcagtggcatgatgatggctcactgcaccttccacctcctggggtcaggtgattctcccacctcagcctcccgaattgctgggactacaggaatgcaccaccatgccggctaagttttgtatttttttgtagagatggggtttcaccatgttgcccagactggtcttgaattcttcaagcatattcacccacctcggcctcccaaagtgctgggattacaggcctgagccatggcgcccagtcaagagatcctttaagaagcacattttccttatgcatcttaaatattcaattagaaaagaattgactttcaaatattttgaaagacatatcttctaggtaaatcataaatatattcattctgtgtaaagtaggaaaataaaggaaaattaccttgtatcttttcatggccatttctctacacagtaataccaaatatctaaaagtttgttaattcaaaatgccaaatattagttggaatatcatataactctttgaaaagttgattcgtttagtgaaaaagacttttcctcttaaacggagtgaaatctcgtgtctgatttgtgtaatattcctgattacattgtgtgcgtgtgtgtgtgtgtgtgtgtgtgtgtgtgtgtgtttctgtgtttctttccggcttggtttaacaataattcatgatcataagaggacagctattgcttgtaatgaacccagctgatcaatgaacaatgctttgtataacaattgtgtaattgaaagtgatacaatacctaccaacggggacttaaagcaaccaggattcatttctccacgtaacaggaattcggaggtctgcgtttccggccctgggccaatggctcaataagactgcctgccattttgttgtcttttgtcatggctgcacgatgattgctgcagcttctagccatgtactccattcaagacgcacgggaaggttggggtggaaaggaggatgagttggcagtggttgtctcattttccaggaaaccaagaattttcccggaggcctcccagatatcagcttccgtgtcattggtagaactaggttacacagccactccagctgccgtgaaggtgggaaacaggaaatagacttattattaacaattcccttagagcatacattcctaacaggcagggtgggtgggtgtggggaacatggtggagaatagggtgagggttgtggtggggcgtagatggggtggtgctgttgatatcatcccttaagggaaggatattgcttttgtgggagggaaaaggcaggaaaaatatcccactctatatgtataaagcacagttatacatacagcatatatgcagacatataatttgtctatggtattaaaatttcatgcatggggcaattaggaaaaaagcgtctaaaaatgctcttagggagatgatgttgaaaaaaagttgagaaatactgggctagaccaaacatgatccattgcctgaagcttacgtattatctattactgatgacaaagagaggcacaggtatggagtggcaaactaacaatgcgtgccgtagagaatgtcatacattaaattaatgaacagcttactttatgttgtaattgttgttggtcttctctcattgtactgtaaacatcttaaaagtgggaactgtgtcttatttcgatgtatatctttgtatattagcacactagtccctcaagaggtatgttttgtaagttgaatggaacaaacaacattttatttaacatatactttatttctattttttttaaattttatttatttatttattttgagacagcctctctctttctcaccgaggccagagtgcagtggtgcaatctcagctcactgcaacctctgcctcctgggctcaagagattcttgtgcctcagcctcacaagtagctgggattacagacgtgtaccaccatgcctggctaatttttttgttgttgtatttttagcagagacgggctttcactatgttggccaggctggtcttgaactcccggcctcaagtgatccgcctgcctcggcctcccaaagtgtaatgttgattatttttaatggcaaaaatgaagtgatgcaggaagacatttaagcgtcataggtgatgtcttgggggtagtttcacaggatttttagcgagctgtttgattgctcttatgtggatggtacaaagaccaaaagaggttttgcaaacagtggagtcataaatgattgtgcatgagataattagttctgatagttccgttagtttgtttgtaagagatgaaaaggaaataaaatggaaaaagagagaagatttgttttgttttgttttactttttagctggattgttttttctgtgcctaagctgcttcagttgtaaaatgggaattataatgtcaaaatccttccttctcgaattgtgatggtcaaatgaaaagctgtctgagaaagctgccccgagctgtctaacagtattcctccagctggactatgcttctgagtcatccgatgctttaaaaatacatcttcccaggaaaacattgtaaacaactcccagggtacataatgatttagatgattaaatttggaggctgccctgacttcactaccctgggcctcaactgctttataaattatgaatacagatacttcctaggactgtagggtggatagcaaatgaagcgaattaactgccaaatccttccttaacatcttcgttatgatcaatattatgaacctaggcaatcttcatccatacattggacacttgaccttgggatggattagacttcctcagtttcctttgtcctctgtgcaaaatctagaatattgccagcctatcgtcagagtgcaacacgtttgaggaattattgcatgattgatattgttgagagttcagattaatgtcacttcagataatccacagatgacatggaaaactggtgggctaccggtgctatttgaagtcaacgagggcttgcacttagctgggaatgggcgagagaataggattaatgcccaggaagatatatcttctgatcctcacctctcttttgtatataggtgattttttaaaaaacttccttctcctccaatcaaaactggctttgaggaaagaatgggactggatgcacatttgtgtaaacatgctaatggtaaaaaaaagtctttacctttcagggatatttgcatttcaacaaagtaccaaacctcaagagaaagggctgctccaaggatggaagatatatttggtagggagaggactttttatcacccttgattcactccatgtaagcagggaccttctggtaagatgctccctgatggggacttgttggatgctggccgtgccagctggctgaaacccccagggtcagacttccttgcaggggatccttatcatgtggatggcagccactgctgatagattggggaactgcttcctttgccatctccctatagggaaggttcccctaaactgagtccctaataatctcagagcgagacgtgtgctgtggggatcttatcatcttatcagatttttctaaactatagtccttcttagaagtgagaggcccagaacactctactttatgcaggaatagcagagatgactcatggttgggaagacactagaattcagccaggagaatatcattaaaagagggagaagggaaaacagactttttgtgtggtacaaaaacaaaaccctctgtatcattatgtgaacaacggtgcaaaaaagaggagacacagtttacccatgggtagctaactatgatagtgaaagttgccttgaaccttgttttagaaaaatggcaagtgtgggtctcactcttctagttcctgacttctctctctctctctctcgtttctctttttttttttttctctctctctctctctcacacacacacccatcttgggccaggtttgtaaagcctcatgggaaatggaacacggaagagtcttctgggaggttttaaaatttaattttagtcagatttagtaagatttcttcatacaaaacaaaacaaaaattctctaaaaaaaatccttgttagggtctggttaagacaactaataacaacagatgtgagggcatagttcctagttaccaaagaatcgctctggtgagagaggagtggaggcaaaaattccagatggtacctgggtagcgattgcactcagatgggtcatctgaggacagctgccctagaccgctgctcctgagcctctccattgtaattttccttcttctagttcctttttaaaaatttttcttttttgttgagatagagtcttgctctgtctcccaggctggagtgcagtggcatgatccccagtcactgcaacttccgcctcccaggtttaagtgattctcctgctcagcctcctgagtagctgggattacaggtgtgtgccaccacgcccggctaatttttgtatttttagtggagacagggtttcaccatgttggccagactgctctcaaactcctgtgctcaagtgatctgcccgcctcagcttcccaaagtgttgggattacaggtgtgagccactgtgcctggcctagttcctttattttaaaagcttaaatgcatgaagcatacagtactgtgaagacttgcttgatgtgatgcaggttccttaatctcctcctttgctatttggttcgcagatggtggtacgggtggcactttggggaaggcggggcggaaggaagctttctgatgaatgtttgcacagtatacgagaaggttacaagatatgggcatcatgcacaggtggcgaggtggttagagaaaggtagatggtgtttggggattaccctctggtacatttcaattcactttggggttatgagatttcagaaggttagctaatgcttacgtcctggggtgggctcttttgtatttctttgttgtctcttttttattttttagagacagagttttactatattgcccagactggtctcagactcctggcctcaagcgatcctcccacctcagcctctgagttacaattgtctcttgaaagtaatttcaggtaggcttggggctaccaaggcaagcctagggaagcctactacatgaagaggattagagtcctctggagaagttggattcatatgaagagatactaatcagaaagttgggagttagtcatccatggaaaacaggcatgtttgagaatcatattctggcagtgcccatccatgcattatcagtggagagagaaccttggctaatggacttccccagttttgatcccatggataagaccatgggggagagggtaaggcttaggctaatgcatattcttggatcattcagtcacctccttccactctgagtccctgttgaccagggaatgtcttggtgtcatagcttggctttccaatggctctccccgtggggaaagaatacacaggctgtgttgatggtattctagtcctgacgagagctgcgtttctcatggtcagcaaatgaattggcatccgatatataagcaaatcttgtgactgtaaagtcatatactttcttgttagttgagggaatcagatttctgagggtaagaggtgaagccaagaacatggcaaattcattatcttgataaaaactacccggtaaggctgcccattttctttcaaactgcaacaccatatgtccagcgaggttcctcttacgagacatcaggggtatcaggagtgggtgccaagctggagtcctgagaatgagggaaataggagaccatgagttttgagcaccaccgcaatttctcttctccttttgtccctcttgctttaggtagtaatgcatgccttaagataataaaaggtctgtctttgtgggctcttcattgccatagaaaaatgattggtatgagtttcccaaggcctcggataaaaatatttcttcagagagggttttgaaaacttatgccagttacctgggtggactccaatctttcaagcactgtgtgtcttttcctggtcctccctcgctccctccttcctttccttccttctctaaacagagtctaaggtaatgcccctctccagtttcttgggatagggaagggggtggaattacttctgactcacccttacccttatggtgtaccctttggggttctggctaaaatatatgtattgggaagtgggacgcagtggctcacgcctgtaatcccagcactttgggaggccaaggcgggtggatcacttgaggtcaagagttcaagaccagcctggccaacacccatctctactaaaaatgcaaaaattagcctggtgtggtggtgcatgcctgtaatcccagctactcaggagactgaggcatgagaatcgcttgaacctgggaggtggagagggtggtgagccaaaatcacgccactgcagtccagcctgggtgacagagcgagactctgtatcaaaaaacaaacaaataagtaaaatatatatattggggtccattagtttttccaccctgggtggactctgacctttgacttctgtcatccttgccccatgaagccatcggaactgcagctcgttttccgctttttcatcgccatttctttcagctgacaaatgctgtttacctcactggcttctcctttattcttaggttttggcctgacagttgctatttttttttttttttttagctctttgatacttttaagaaaatggtttttaggccatgcacaggggctcatgcttgtaatcccagaactttgggagaccgaggtgggtgaattgcttgagctcaggagtttgagaccagcctggccaacatggtgaaaccccgtctcgattaaaaatacaaaaactagccgggcgtggtggcaggtgcctgtaatcccagctactccagaggctgaggcaggagaattgcttcaacccgggaggcagaggtggcagtaagccgagatcgcaccactgcactccagcctgggcgacacagtgagactccatctcaataaaaaaaaagaaacaaaaaataaaaacataaggacttttgacaaaaatatgattctttaggcaagaggtttatttctctaagtgtcagtttctctgaaaactttgaggattggattggatataaatttccccaagcacaatgtgtgtaccaatggtgggaaacaagatctttttagggcaagcatttaaaaaatgtttttagtaggtatatgtttctttgaatgttttcagaaaaaaattataagtgacaatcaaatctatgatttcatctatttaattgcttaggacaaggccatatgagttcacttagagttgatttttaaaacataccacataaatgatagttcaaatatggttatcagatgactgaaatttgggggcaggattagaagatgatctttcagattttgactaacttgactattctggtctcaatgacgaaaggaaacaagttcccataagtcattacagtggaatccaatgatattatccaagaaaccaatattcctaggatcttagttctcctagaaatctttctagcatgctgagcaggatgggttggacacagtccaaatcactggaatattacaaatttaaaaaattgttttgagtggtgtgtgaaagagacctgctctgaggacttctagaatgagtgagaagggaacttacagacctactgagacttgctcctctgtcagatgtggcaggagggtcggggtcttggagttgttcaagtaatttcatcagttaggggttaatcctgacccaggatccagtcctgctgggccatactttcttaaagtgactatccagtgacactagcaaatgttacctcttcccgggaagaaatgacaggatgtgtttgtattttcttttacaaaggatcatgcgattttatttttactttttttttgttatagaagtggtatatgtctgtgaaggaaactcagaaaacatagataagcacacacaaaaaatttgtaattgcaccagtatgagcattgttaaaatcttagtatagtttcttacttttttcctctctctatttttactaaaaaatcaggattacgttgcacataccgatttgaacttgcctttctttgatccatataacaatgttgtcacatacttttccccacattattaaatattgttctacaatagtaaggaattcaatgataaaagaggcatattgtcttcctcccaccttatacaagttattttgtgtggcagcttgacttgtattttagaagtagagacaaattaaggcaaaaataaatagaaatggcaaattaattccacaaggagtgtgttttctgaaagtccctgctgctagaaacggaattaggattatgcctcctggtttcaaacatgtcgataatagctgtgtgtgctactcgagtggcgtcaaagatggatgtccaactccatattggagctgtgggtaacctagtgacagccacaaatcacccttctaagagcagatggtcagggagcacctttccagtttagagcatataccagttgctctcctgatggacatctggtccatgatatttgactgttttaaggtatggagtgctttgtacaaggtacaaaacttctgtccttggtatgaacatttgggaggcaagtgagtgataatgacccacggctgcctttttgtccggcaaagcacgaggatgctttggagaacggaaggatttcatcgagtccaaaggacactcacctctaggcctctcagcctccttggccacgtggttgttctgctactgagagtctgcagatgagctggtggtttctccaagcttccgagagctctctcaggtatttattatatgcacgttctgtctacaatgaccagtggactctaaactgggctggaacatgttcccaggaaaacatgcccaaattctgttctaccttgtgtaaatctaagacaggggctactgaacacagtcttggaaatcagacacgtgctagggccccctgtgcttagctcggctaatgagcccaggctgagggcttttttgcaggcatgccaaaaaatgcagggccaaggctgggggtggagaggtaaggctagggaagtcaaggaaggcatgaggaacagcttgggaggggaaaaagttcatctggtggcaggagctttaggctctctctgctccttcacccttttctctgttcaaatctgctctcaaggcagcatgtgatattgatggttcacagaaacatgaactaccagccttggaggggccctgagagcccatctagttcaatgcctcattttgcggatgaaaaaacaggtttggagtggctaaatggcgtaagcaaggtcgtgtcactaggagtagagctgggattcaagcctgatggtcagtccagggctctgatcaccacaagctgcctctatatacagtatagtgagaaagtctcaaccaccacattgactcttcatttatatttaatattatatttgtattttaagattgatccataatggaaggaattgtttagtcctgtactaaaggaatttagaaagagttgggtgactcaatctactgataaggaaaaagatttacaatctattactaagtgagaaaggcatcatggagtacagtatagtatgctgtagtttgtatataaaaatgtgtgtgtggctgggcgcggtggctcacgcctgtaatcctagcactttgggaggccaaggtgggtggatcacctgaagtcaggagtttgagaccatcctggccaacatggtgaaactccatctctactaaaaatacaaaaattagctgggcatggtggcacatgcctgaagtcccagctacatgggaggctgaggcaggcgaatcacttgaacccaggaggcggaggttgcagtgagccgagatcgcaccactgcactccagcttggggacagagtgagactccatctcaaaaaaaaaaaaaaaaaaagtgtgtgtgataattatacacatacattcatatatatatgcatgtggattcatgtaataatgtaatagctttggaaaaatgcatgagaaacttagtctgatggttgcgtctgggaaaatggcctgggcaccataggagggaggtatatttttcacttttatacttttaaaatgttactataggcatgtaatcactattcaaaaaatgtaaaaacatttaaagatgccatgtgagctcaaataagggagaaatatattgcttattgggaaggcctcatacaagaggtagcatctgagctgggctctgggatgggtagaagttcaccaggaagagccagggcaggaaagcttgcagcagcaggattgaagctgtcaaagcaggaaagaccagggagagtgtcagcaatgttgcatagtctggagaaattgcagcaaagtagtatgctgttgtttgaatataaaaatgtgtgtgtaattattatatgcattcgtacttacagcatgtgaatttatgtaataatgtaatagcttcagaaaaatgcatgagaaactgcattggctaggtaaagcagggacagggccgaggagaaaagtaaagagagagaactcggctggatggaggttatcttatacttaatatggcataaagggctttttacaaattggccccattgtccctttccaacatcatcttccacctgtgcttcagccaccatagccagctgtctattctccaaatacccacgtgcacacctgggcaccagccgcttcctctgcctgcatgcggtccaccagtcctatttctttctctcctccaagaccaagttcaaatgttcctcctctccccctccccaccccaccaccctggaagattttaacactctgtccttagtgttctcttggcattttgcatttacctttattatagaacttggctgtttaaattttaattttttgcaggacgaaccggagagtgaggtcatttatacgcagaacattgcgtctcctctctttaatttagcattttattctctgaggtcctagctatatggtactttatggtgatgaagtacagccacaccattctgcctttgtgtggccattgcatgacctctccaaatgaaatcatttcttctatagagaaaaaaaagtgaggatcagagacattattaactaagtaaaaaaaaaaatttttttaacctctgggcctagtctaaactacattaacattttctttattatcttctgccccattaggctccttaaaagtaggcctagtttaaagacaattaaaggcagatattctgtccctttttttagacttctatggatttgaaatgtcatgttaatagaacactatatatgcgtaagcaatgaactgaaccattaaaaaagaattttgctctggaatatcctggtagtttcagggtcattatatatttgttttgctcagtttcttgatctttctgatccttaatcagaagctgagcatctaaggaaatattttatcctattgctatgtatctataatattatctgtataaaaagtacatatgtctatatttcaaaagaagattgaaaaaattaagaaaatctgaataaacttgtgttcttagattattcctctttgttcctcttctcccttaggcaattgagggagtaactgctatgttcctagtacaatttattctatagagggacatgtgaaaggtgagctgagaattcccagtaaatctcgatttacccatcattgcagagacctttcctctgcctgggccaatgtccttctcggcaagggaagatagatcgcaccagacaaagtttggacatttatctttctacataaatggaaaacccttcccagattgttcaactggttgctttttttcagttactaatacaggaatacctcatttgattgcgctccacagatattgcattttacacaaactgaaggtttgtggcaactctgtgttgagcgagtctatcggcaccattttcccaacagcgtatgctcacttcatggctctgtcacattttggtaattctcaaaataattcaaacgttttcattattattgtatctgttatggtcatctgtgatcagtgatctttgatgttactgttgcaattgttttggggcacgatgaatcatgcccatataagatagcaaacttaatggataaatgttgtacgtgttctgactgctccggctgttcccccacctctcttcctccctttgggcctccctattctctgagacacaatgatattgaaattaggccagttaataaacctataatggcctctcagtgtttaagtgaaaggaagagtcatgtgtctctcactttaaatcaaaagctagaaatcattaagtttaatgaggaaggcatgttgaaagctgagagaggccgaaaactaggtctcttgccagttagccaggttgtcaatgcaaaggaaaatttattgaagaaatgaaaagttcaactcctgggaacacatgaatgataaggaagtgaaacagccttactgcttggacaaagctttagtggtctgggtagaagatcaaaccagctatacaatttctttaagccaaagactaatccagaacaaggccctaacttgcttcaattctatgaaggttgaatgaagtgaggaagctgcagaagaaaagtatgaagatagcagaagttggttcactaggtttaaggaaagaagccatcttcataacaccaaagtataaagagaggcagcaggtcctgatgaataaactacagcaagttatccagaagatctagctaaggtcattgatgaaggtggctacagtgtacaatagaattttcaatggaaacaaaatggccttctattggaagaagatgccatctaggactttcacagctagtaagaggtcaatacttggcttcaaagcttcaaagaacaggctgactgtctagttaggggctaatgcagctggttgctttaaggtaaagccagtactcatttaccattccaacagatcctagggccttaagaattatgctaaatctactttgcctgtgctctataaatggaacaactaaagcctgaatgacaacacatctatttacagcaatgtctactgaataatttaagcccactgttgagacctactgctcaggaaaaagattcctttcaaaatattacagctcatggacaacgcacctagtcacccaagagctctgatggagatgtacaaggagattaatgctgttttcatgcctgttaacacaatatctattctgcaacccatggatcaaggagtcatttcaactttcaaatcttattatttaagaatacattttgtaaggctatagctgctatagatagtgattcctttgatgaatctaggcaaagtaaatttaaaatcttctgaaaggatctaccattttagatgccattcagaacatttgtgattcatggcagaaggtcaaaatagcaacattaactggagtttggaagaagttgattccaagcctcatgactgacttgagggatttaagatgctagtggaggaagtaactgcagatgtggtagaaggagcaagagagctagaattagaagaggaggctgaaggtgggactgaatgtctgtaatctcatgttaaaatttaatgtatgaggaattgcttcttacagatgagccaagaaagtaatttcttgagacagaatctacttctggtgaatatactgtgaaaactgttgaaatggcaacaaaagatttagaatattacataaacttacttgataaagcagtggcagggtttgagaggattagctctaatttgcaagaagttctgctgtggataaaatgcatttcatgctacagagaaatctttcatgaaaggaagaatcaatcagtgtggcaaacttcattgttgtcttattttaagaaatagccacagccactccaacctgcagcaaccactaccctgatcaattggcagccatcaacattgaggcaaaaagattaggacttgctgaaggctcagatgattgttagctttttttttttttttttttttttagagagggtcttgctctgttgcccaggctggagtgcagtggtgcaatcatagctcactgtagcctcccggagtcaagtgatcctcccacctcagcctcctgagtagctgggattacaagtgtgcattaccatacctggctaattaaaaaaaaatttttatctagacagagtcccattgtgttgtccaggctgtattgttagcatttttaagcaataaaatatttttaaattaagccatgtatacttttagacatcatgtatagtgtaaacataacttgttttttttttttttttttttttgagatggagtttcgctcttgttgcccaggctggagtgcaatggcacgatcttggctcactgcaacttctgcctcctgggttcaagcaattctcctgcctcagcctcccaagtagctgggattacaggcatgtgccaccatgcctggctaagtttgtatttttagtagagacagggtttctccatgttggtcaggctggtcttgaactctcgacctcaggtgatctgcctgcctcggcctcccaaagtgctgggattacaggctcgagccactgctcctggccaacataacttttatgtgcactaggaaacaaaaaaaactgtgtgactcactttattgcaagattcactttattgcagtggtctggaactgaacccgcgatatctgtaaggtatgtctgtatatcatacccttcctgggcaatacgaacaggctgacctaattccttctaatgctgagtggattctatcgaatggatatggcataattaatttaacccctgcgtcttaatggacctttcagatctttccagttctttttttgctgtcgtgaataatgtagcaatggaaattcttgcatatcttgactacttgtgtagacacatcagtacaacgtgttgaaagaattggaattgctggattaaaaggtctccgcatttaaaagtttaatagatactggcaaggacttaaaggatggagtggtgcaaggggtcccccctaagtacaggaagtaagggggtatatcatttatatagaattttaaaacagtaataaaaccagtgtgggtctgttttttattatcaccatgcgctggcagtgaaaaagtcagagtaagttcttaatggtgtgtacagctttcactagagctttggggccaagttgcatcttcagcttctatggcacagcatagtcctgagtttaagctgcagattagacataaacaatgatagcacagtgattgtagaaaccccggaacagaactcgagttacctcaattccgttattctctcagagttttgtatttaaatttgaaacaacaaaggagaatgcaaactacaaagtataattaatgctgattggtaagtgcaagttttaattcatacatgaaatatcttactgaattattgttattattttttagagacagggtctcactttgtcatccaggctggagtgcagtgttgtgatcatggctcactgcagccttgatctcctgggctcaagccattccctgtctcagcctcctgagtagctaaggctacaggtacatgctaccatgcccaactaattaaaagaactttttggtagagatgtttgttcatttttgttttttgtttgtttgttttcagacagtctcactttgtcacctaggctggagtgcactggcgaaatcggctcactgcaacctccacctcccaggttcaagtgattctcatatctcagcctcccaagtagctggacttacaggcatgcaccaccacacccggctaatcttgctgtgtttcccaggctggtctcaaactcctggccttgagcaatcctcctgcctcggccttccaaagttctgggattatagatgtcggccagtacacctgacctgaatgatttttttaaagttcaattaaaaaaaaaagtaacttgtttcttttaaagctaaagaaggaataaaaaataaacagtctgttcctgattcttacgcattgctaggaaaataattttgtcacctagaggagagaggttgatagatgatcagttgtgggtgtcaaatacacgaaggacgccgctggattctgttcaagtgcgctctgcaaagatggtggtcttctgctcatcaaatggtgtgtgagagtgtctgactgaggaagaatctttaaaatgctgtaagaaatcaggcttgtagtaagaaggaaatcacccaccagcagaaaaatgtatttccggcctttcttcctcaccctctgccactgttttaggattgctcagtttcatcaaggtttgaaggataggcaggctctcactaagagagaggtagggagaggggaggtagagacctatgaatgggctcagaggctggactgccagagtctgaaccccagcatctcttctcattagcttgtcatcttggacaaggtactttacttctctgtgccctagttcccccagctgtaaaaatgagacaaaaatgatattgaccacatgcagtcttgttgtaatgattaaaggaggtaatttttataaagcacttcaaacagcgtctggcaaatgtgtttattgttatccttatctgctaagggccaggcattcatctaggcatgggagatagattcttttcagttgccttaaaaaaaaaatcctgcaaacgatgcatgattaattcacattttgcagttgtagttatgtgacttgcccaaggttatactgctgctcagcaagggagatgaaaatctaaccgtgactgtctgggtgcggtggctcatgcctgtagtcccagcactttgggaggctgaggcgggcggatcacctgaggtcgggagttcaagactagcctgaccaacatggagaaaccccatctctactaaaaatacaaaattagctgggtgtggtggcgcatgcctgttattccagctacttgggaggctgaggcaggagaatcgcatgaacccaggaggtggagtttgtggtgagccgagatcacgccattgcactccagcctgggtaacaagagtgaaactccatctcaaaaaaaaaaaaaaaaaaagaaaaagaaaaaaatatctaaccgtgactgtcaactccacaacatgggccctttgcaaacaattgcatatcggcagccttacacactgaaactaaaactaaatcacctcactccttccagtgctctgggctgcatatccagaacaaattattaaatgccttgacttcttttatagcttaagcaatctgcaagttaaggggttatcctacttctagagaatgctggaaagcttaatgatttctcctaaaaagagatgatccatctcgaaggaagtggatgagaaagggaacaggtgtttaaaaagtatttttatattaaaactgggagctgtggctgggtgtggtggctcacgcctgtaatctcagcactttgggaggccaaggcaggtggatcacttgaggtcaggagttcgagaccagcctggccaacatggcgaaatcccgtttctactaaaaatacaaaaattatccgggtgtggtggtgcatgcctgtaattccagctactcgggaggctgagacacgagaatcacttgaacctgagaggtggaggttgcagtgagccgatctcgccactgcactccagcctgggtgacagtgagactctgaaaacaagcaaacaaaaaacaaaaacaaaaacaaacaaaaaacattgacagctaccttttgagtaaaaagccatcagtacacaataaaatctttctgtgggaaaaaggcaaagaaataaaggttgctactgtgtgaataatttggcatgtctatctagctatatgagcattgtgcttaaaatattaaggaaattaagtatgggctatacaatgtaggcataatgtgtatctgaaaaaatcctgtgtagatggaaagtgtgctgactcagctggttcagtttctgggcctcgtgtgggcccccagcagcttaaccacttctctcaagtccttggtttcctcatgggagaaatgagtatgttgaattagatgacctttcaggcatctcatcatgctgagttttttttccgcagcagggaacatgctactttacattctgtttagggtttgctcagtgaagggggagtaccaggaatctggggaattcccagaatacctgggcactatatatatatatatatttgcaacacatttaatcataaaagattaatatccttaatctctaaaaggattttaaaagtcattaagaaacaatgaccgtcttgctggaaaagtaggtaaaactgatgacttacaaaagaaaaaatatatgttgtcaagaaacagatgagaaaattttaatcttcaccagttgtaaatgaaatgcaaatgaaaacaagtcaaacttgcaaatattatacccagtgagagttgatagagagatgcagtgataggcccatacatggaatataaattggttcaattttttatctcttctgttccagcagttgctctcatatctatttatcctaaagaaataatcatatatttatattaaaaatattcactcaatgttgctatagtgaaaataaggaattattaaactatccaacagtaggcaattggttaaataaatgatgctatatttacataatgaaattttatgcagccattttctatgtcaagaatcttgacatagaatgttaaattaagacctaaatgttaaattaagaaaaacaagatgccaaactgcatataaagtatggtattcttagttttggaaaaaaatgatgcactgaataaaaaaccccagaaaaatgtatgctaatattttacagcttttggttctaggtggtaactgatttttatcttctttggatcagtgttttcgaaatgttctataatgtgtatgtactacttttataatcagaaaataggatatatagaaatggtctggaaaaaatgaggagagaagttacaatagggaggtcatcttcaatctgtttggaccagcaagtaaaagcaggaaatgctgtccaccaccaatggcttaaatatgtgtgttggatggtggtggtggttggtggttctggggttggggatggggggaaccttgagatgtgatggttttcttagtcagagatggtgctttacagctgggaagtatcttgaacttggtggaggtctatccagacatcaggcagatttcatattttcacagacaaaggctacgtttacgtctaaggggaaaacacaaaatactaagatagaaacctccaaagccccctcaccttttcagacaacaagaacccccagggcagagggtcttcctcactctcagagttactttgacttctcatctggtttcgtgtgggtaatgcattttcactcttgagtttcttttctttttaaggtattttcattatgacgtttgttcttttgcaaagagctaattctgcagaattctacccagggagggccgagggaagttagtgaaggtaacgataccagttagaaagttgagtttgggtcatctcaggggcctcctttggcctcctttggcttatgttctagagatggcccttacttcccaggaatagatagtgatgtcttactgagttgcaggtagagtctgtattgaagcgcaagattttcttccctgacttgtctgggaatccttacccaggactgtggctttcctcttccatatccctccaccaggaggcaggctctaagcctctgtgctgtcatccttttgccacttccatgaacatgccttcaaatacttgaaaaagtcactatagcgtaaagtatacttttctcttttggtgatgcttttctgcattttctctataaccagagagtaagaataaaactacagcttgggacctggcgcggtggctcacacctgtaatcccaacactttggaaggctgaggagggtggatcacctgaggtcgggagtttgagaccagcctgaccaacatggagaaaccccgtctctactaaaagtacaaaattagctggcatggtggcacatgcctgtagtctgagctactcgggaggctgaggcaggagaatcgcttgaaccttgggggtggaggttgcagtgagttgagatcttgccattgcactccagcctgggcaacaagagtgaaacgccatctcaaaaaaaaaaaaaaaaagaaagaaagaaaacaaaagcccccacgctttaaaacttttaacacgaaaagttttgaagctacaccaaagaggagagaataggctaatatacccctgtatacccaccactcaacctcaatagttcttaacacttttccaatcttactttatccattgtttttgcttgttttctggaataatataaaataaatccctgacatcttattgattttcctcatcaatacatcaacatctctatcagataagggccttaaaatacaattgacaaattgattgataaataaggacctgacaatacagttatcacctaacaaaattagcaatagttcttaaatgtcatctaatacccaggccatattcatatttatttgaatatctaaaagaatataaaaaggacttcttttttttttgagacggagtctcactctgccatccaggctggagtgcagtggcacgatcccccctcactgcgacctctgcctcctaagttcaagcgattctcctgctacagcctcctgagtagctgggattattaaccaccatgacgggctaatttttgtatttttagtagaaacggggtttcgccatgttggccaggctggtctagaattcctgacctcaagtgatccacctgccttggcctcccagagtgtgtgaatacaggtgtgagtcatggcacccggcctggacttttttgagtccaggcctccctctgttgtccaggatggagtgcagtagtgtgatctcagctcactgcagcctctgcctcccaggttcaagcgattttcctgacccagcctcccgaatagctgggactacaggcacaggccaccaggcccagctaattttttttgtctgtgtttttagtagagatggggtttcgccatgttgcggctagttcaagactatccgcaacatggcaaaaccccatctctactaaaagtgatccaccccccttagcctcccaaagtgctgggattacagacgtgagccaccgcgcctggctctcagcctggacttttaaaactcttatgagtaagaagaaagaagaggtggcttggggctgaggatagctatgaacagctgtgattcaggaggcagaattattcagctttgctcatctcctttgcaaggaggagagaatgaaacagacctttaaaagggaatcagaagttggagttagtgcttctaggaattgtaaacgaattcagcagtgtagacctagaaaaattttcagagtcactgatagggattcacagaaattttctgtagcttcaagggaccagcccagcctttttgttcccttctgagaccacattaaaaagacaaaacaacatacaggaagcacttcttcaaaactgcgcaaatagcacatgcgtatcgtggacacatttttaaatgcacttaagcaaggagaagaaaatgggaatcacatacaaccccaggacccagagacaagccagtgggcaccactctagacattttcacagctctggaatctcctgtacaggccattttgaaacctgccattttgaaacctgctttccacccatttagcttaggaagccttttcctgtgtctgtgaatagacccgtacgatgttatgttaatggatttcaatataggagcaaattggtttgtgcaagacccacctattcttaggtgattttttttttttttttttttgctatacataacatagaagagaacatgtttctagctaaagatttcatgtcaaagctcatgggagaggaagatgaccctggctaccccacttctcttccccttcattcagtaaacgatagccttgtcatatgacggcagcctgtggctctcctgaaagcgctctgtctcttcagcaggccccccagtgggaaacacccacctcttcatggatctcacagatctgtctctctcctctggtgctgcctatgtttgccagcagcttctcccaggcccccaggcctacagcctcagaatcaccttgtttcaggcctgcgtgtcagttccgcctcgtggatgttgctggggcttctctccctctttcttgtctcacagcatctgctctggataaagtcatccttgatcccaacggcaggagcctcccacttgcctctttggtctttcccacctgcaatccagcctaacctgccacaagaatgagcttcctacagcccagcttgatctcccattctgggctccgccttttagcccaactgagctgcctctcacccttctaggtgccctaggtttttccttcattgctcatgtttctctttcttctctgtgcatctcaagctcagtggttttaagggtcatgttctaataccatggcctccacaaagccttccttgattcctgctagttgcaggtagcacctttttccctttgttggcactttatttgttcctccctcagatccttgctgaagtttatgtctggtgttgccattagactgtaagtttttttgaaggcagaagctgtgttttctttaacttggcttcaatgcctgacacagagtaggtgctcaaagaggttagtaacatttaagttaaaagagaatggattggtaacagtttttttattttttgagacagggtcttgctttgttgcccaggctggagtgcagtggtgtgataatggcttactgcagcttcagcttcctgggctcaagtaatcctcctgcctcagcctcccaactagctgggactataggcatgctccaccatgcctggctaatttttttttttttagtatagacttggtggtgaggcaccggaggcggggggcaggggtctcatcatgttgcccaggctggtcttgaactcctgggttcaggtgatcctcctgccttggcttcccaaagtgctgggattataggcaggagccactgtgcctggctagtaacattttatgtgccaaagacccagggattttaattgactgttaactgattttaactggagtcagctggagctaatagtgtgctgtggctgctgatgagcagaaggcaaccttggattgtataaaatcacaggctcatctcccataatccctccaccggccacttcctgctccccactgagcagcccacagtgcaacctccctgaacttcttctacttccccaaatcaaacatgtattttcatgcccctgggcctttgcacatgcttctccccacccccaaagcctttcttctctgttgcttatcaaaatcttactcatcctacagatcagctgtcaccttttaaatgcggggctcccaaatcaccactcctttctcccatctcgagaattaatgctccctctcctgtgtgtctgtagtactggttcatatcatcatcatcatagcagctactatttgctagtacctgttttgttccaggcactgttttaggctcatgacatacactagctcagaaccatcttacgacaacccctcaaggtaaattataataatggtaaatacttctacggtactcactctgtgccaggcactattcaatgtggtttacatgcactacccatttaattctgtacaaccaccttgtaaggtaggtatcattattttattttaatttttattattaaaaataataccatcaaccaactcacaccaggtaggcaccgttattattgcctatttacaattagggaagaggggcttagagaagttaagtgacctttatgagatcacatagccagtggggctgaaaggcagtatggttccagagtctgtgctgtagacactatgcatagttgactttgttgtcaaaggaaccgaaggtcagagacgttaagtaattgccccaaggtcacacatttaagtggcagacattggagccaaacccaagcctgcctgaccccaggtctacatgccccttcttactctgaactacctttctgtctagtaggagttggcaaacttttttgtgtaaagaccaaattgaaaatattttaggcttggttgcaactttatgttgcagcgagaaagcagtcataggcaacatgtcaatgaatgggcatgactgtgttccaataaaatgctatttgtgaaacctgaaacttgaatttcatataattttcacatgtcataaaatattttcctcctttggatttttttcaaccattaaaaaatgtaaaaaccacctgtaatcccagctacttgggaggctgaggcaggagaatcgcttgaacttgggaggcagaggttgcagtgagccgggatcatgccactgcagtccagcctgggcgacagagtaatactccctctcaaataaaataaaataaaataaaataaaataaaataaaatgaaataaaatgtaaaaaccattctcaatttatggccctacaaaaccaggtggcgggctggattcagccatgcgtgggccatagtttgacaaccttactttatagcatcgtgacattatagaatgattagataggcatgatttgcctttttgctctctttttcctagaacagttcagctcaggccccaaacatggatacccaactgagaaaacacgagtctttggtaaacaagatccacattccctaaaagaagttcagagaccacgtgtccttccctgagcacacctcttggggttgcaccctcaactccaagcagtttttcaggctattccaactattttgagaaaagaagtaggaaatgcatttccccatcactttagttttgagatgagtttctaagggtgctctgggtggttgcctagctggctagtcttgtatttgactctgaaattgaaccggactaagaactctagacctcaggcaacgattccttgattgtgctcctgggagtggaagagaccagtcagggcagagttgctggaccagaggaggggaaggggaccacggtcccggtgtgattggggaccagagggcaggacacacggctcagagaggcttcagagcttaatatgttgaaataataaaaggcttcaggacttggcaatgttttgttttaattcaactataaaggggtttaatatgcttcaggcttaggaacataaatactgcttaacattttttattctggtgaacttatgttaaaagttgcaaatcagcatcttttttttttttttttttttttttttgtagaaacagggtcttgctatgttgcccaggctggcattgaactcctggcctcaagtggtccttccacatcagcctcccaaagcactgggattacaaatgtgagccactgtgcctggccaagcaaaccagcatcttgcaaacaaactttcagaacaaaatctgtttcaaacagagatgatctatgtatgaaagtacactgacttaaaaatgatttctttctgtggttttgagagaaaatctagtgattatttgtagcaattagcaacacagtagggggaattattaagataggattcagattggtgaaataaattcttgcaagtaaaacttaagataaaatgccacttgagaagatgttcaccacaaaggtggtaaccttatttttaaaaatgctttttattgaagttttatctacatacaggaaagtgaacaccacgtgggtatacagcttggtggattttcacaaactgcacacacttgtggaaccagcatccagatcaggaagcaacagatgtcctttaaaacatcaagaactgggccggacatggtggctcacgcctgtaatcccagcactttgggaggccaaggtgggtggatcacctgaggtcaggagtttgagaccagcctggccaacatggtgaaaccccgtctctactaaaattacaaaattagctgggcttggtggcatgcaccttgtaatcccagctactcgggaggctgaggcaggagaatcacttgaacccaggaggtggagattgcagtgagctgagattgcgccattgcattccagcctgggcaaaaagagcgaaacttcatctcaaaaaaaaaaaaaaaaaagaaaaaagaaaaaaaaaaagcaagaactggtttattttcaggaagagaataggagtagagacctggtctgaagagctgggtacaacctagggcagtagctcatgcctgtaatcccagcactttgggaggctgaggcaagaggattgcttgaacccaggagttggagaccagcttgggcaacatagtgagacctttgtttatacaaaaataaaaaataaaaataattagctggtcatagtagcacgcaactgtagtcccagctcttcaggaatgtgaggcaggaggattgtttgaacccgggaggtccaggctgcagtgagctgtgattgtgccactgcactccagcctggcacacagagtaagagcctgtcttaaagaaaaaaaaaaaaagaaaaaaaaaaggggtggctaggaaaaatgtcttgaaactgggtctgcatagaaaacaactttgtttgagatgccttggagaaggctgatgggaattacagtgtgtgttggtgacacttggagctgccaatgctttgaagtcagactctagttgggtctaactttgcctctgccattccttgctgtgtgactgtggccaagattgccaacctcttgaagcctctgtgattgtgacatgataatctctaaaatacagcatctcttgttcacgattatttcctcagaacctgttacagtgcctgccatacaggacaccctaagtaaatgtcttttttaaaggacatgaataaaacaattaataaataatatgtgcaaagtactcagtatagtacttggaagatgttcaataaatgtaaaatcaagtcacaaaatgacccattgacccagtaatgccacacttgtgaatatacacattcccaagaaaatcatcccccataaaagtaacttaccggctggctgcggtggctcatgcctgtaatcccagcactttgggaagctgaggcaggtgaatcacgaggtcaggagatcgagaccatcctggccaacatggtgaaaccccatctcaactaaaaaaatacaaaaattagctgggcgtggtggtgtgctcccgtagtcccaagctacttgggaggctgaggcaaaagaattgcttgaacccgggaggtggaggttgcagtgagccgagatcgtgccagtgcagtccagcctggcgacagagtgagactccattaaaaaaaaaaaaagtaacttacctataccttacgtatataaagttatatctctgcacatacacttatgtacacatatatagctaattatggtgaaatacggaactaacccaaagacagtgaggaataggtgtgcagttaggaattgtcgaaaccgtggaaatctatttagctgaaatctagccagtgtgtagacaatgttgaaattttaaaaagcttaaatctgaaaaatatttagaagatatatacaagtgtctatttgttagatagtgaaaactagtaaggttttggagtgaaaaagtttagagatggttacaccttttttttctaaagttgcttaaggtttttggaattgcttccctttccccacaagaacaaagcactggccgggtaaggtggctcacgcctgtaatcccggcactttgggaggccgaggtgggtggatcacctgaggtcaggcgttcaagaccatcctggccaacatggcaaaaccccttctctactaaaaaatacaaaaaaatagccggtcatggtgatggatgcctgtagtcccagctactcaggagactgaggcaggagaatcacttgaacccgggaggtggaggcggcagtgagccaatatcgtgccactgcatacaagcctgggggacagagtgagactccgtctcaaaaaaaaaaaaaaaagaacaaagcactcagccccacttcccagctggggagccccatggcctcatccatcctgagaaaggcctgcttttgctgtgatgtccctgctaggctatgaaggggctattgaaggtgctggctagagatgggttgctgaggagcatggtgacttcctggccatttaattgtgttagattcatggtggaatcaattttcttagtgaatgaatcagctgctaccagcacaggtcctttgtccaaagctccttgaggaggatgacatttagatgtattctctgtaattgataggccatccccaactggcgatggactcatatttttaaaaaaagacagctgaggattccatcagcattttgaagtaagctacctccaccaaagcccagctaacttcaaacctgcaataataacaatcggttaataatagtcataatttcactttagctctatattatgatgtattgttctaaaaagactttctcgcaaaaccaagaagagagcatttccaaatgtacaaagtattgtaaaagtacaaacggaaattatttctgtattgttatcatttccacctgatccgtatgagctcacagtgaagagggcagggcaaatctgattccattttacaactgagaagacgagccatttcatcagagtggtggtttccatgtcaaatgtacatagaggtattttgggaacacagcagggggcatctgatctggcgggggcatctgatctggcgggggcatctgatctggcagcggctggggagcactggtggtcaaggaaggctttccagaaggagtgggagttgggggctgagtgaagagcaggtctttccagccaataggatggcacagagcgagcctgtggagggcgtcaggtggagaattggtgtctgttagcatggccgttagaattgaggccaaaaggaaaccaggatttcctactgaacagccctcagttctccggaggaggaaatgggttaggatgtctcttcccctaatccctcacttgtgtctatcttggtctctttgccagagtgggcagaagggcccaactctgttgcttttgcaacgtgaagcctcccttccctcctctgtctctgtgcgtgtgaaccctggaggcctgttgagggacccttttctatgaaaatggtagaaagaggaaaaagggcaagagcatcaaattatggagaccccggaggctctggaggtgaaggctcattaattctatctgattcaaagcctgagaagaacggcctggagggccactcagtgtcatcacccatgacgctctcgtaactcttccgtacgaagagacatacttgggccactcttgccagttagccacttgggaaataccacggaagactcactttttttcacccagaagcccttttagggagaatttctttaggagaaattccgctgaattcaagcccatcagactcacatgctgatgatgtaacccgcggcagctcactcctggacacatgtgacccattctgaagattatctgtcatgtccttatagggtatggctctgccttggactgcagctcctcccctacctcccctcctcccacagctccatatttaggcatctgccaaggctcctcccctcctcaaggcttatcatccatctttactgccgcacaatgatgcggtggtttgttttcgtattcactgcagcaggtaataaatgttcctactttggcttcagttttaataaaactatcagaaactgctttacagtttgggaaactgaggccctgaaagctgacttgatgggccacttggggtcagaactggctggcacatgagggtcacttgattgaacagagactttttctcctttctgactctctaggtagcaaagcttagacaggagtctctctctttctttctctttttgtagccatgtctgggtatgagacacacagaacaccctttgctggagaaacctcttttgtgctactttaaattccctacttagagttaataactgtttatcattatatttagtaattgttatttgagaatgttattaatagggactacttactgtgtgtttactatgtacatacaatgtgtttatattatgcacctgctaagaattttgcactctaggccaggcacagtggctcacgcctgtaatcccagcactttgggaggccaaggtgggcagatcacttgagcccaggagtttgagagcagtctggccaacatggtgaaaccccatctccactaaaaatacaaaaattagccaggcgtggtggtggtgcctgtaatcccagctactcgggaggttgaggcaggagaatcacttgaacccgggagttggaggttgcagtgagctgagatcacaccactgcactccagcctgagcaacagagcgagactccgtctcaagaaaaaaaaaaaaagaattttgcactctcagctctaagcacacttaatactctcaacaacctgtgatacagatataatattattacattgattttacagaggaggaaactgaggcttaaggaggttaagaaaatcttccaagttcgtcacataggtagtcggttgggcagctcagattcaatgccaggtccacctgactttaaagcccatgaccttaacaattatgccttattaatttccttttgcagatattcactcaggaaatttggctttagctcagtcagtttattggaaagtttatttaaataaccaaaagggctgagtgtggtgactcatgcctgtaattccaacactttgggaggctgaggcgagaagatcacttgagcccaggagttcgggaccagcctcagcaacatagtgagaccttgtctctacacaaactaaacaaaattagctgatcttggtggtgagtgctcatagtcctagctacttgggaggctgaggtgggaagatcacttgggaggtggaggctgcagtgaaccaccattgtactctgtctccagcatgggagatagagcaagactctgtctcaaaaaataaataaaggtggccagtggctgtgtgtggtgactcacgcctgtaatcccagcactttgggaggccaaggcgggtggatcatttgaggtcaggagttcaagaccaaccttggcaacatggtgaaaccctgtctgtactaaaaatacaaaaattagctgggtatgatagtgcatgcctgtagtcccagctgctcgggaggctgaggcatgagaattgcttaaacccaggaggcagaggttgcagtgagccgagatcgagccactgcactccagcctgggcaacagagcaaaactccatttcaaaaaaataaaattaaaataaataaataaataaatgtccgaagcatgtacatttttcctaattctggccctgctacactggggtcaaataaaacttaaggccaggtgcagtagctcatgcctgtaatcccagcactttgggaggctgaggtgggaggactgcttgagctcaggagtttgagaccagcctgaacaatataatgagacccccactctatttataaaaaataagataattaaattaaattaaaaaaataaaacatagaaatgtcttaagaggtcttggctctggactaagtcacaaatgcatatatttaagttgcctcttggtctaaggatctaaagtttaacggaagcctatggagccctcaaggagtccttcctcaaaggtctagtctcaaatggggtccatgaccacggtgtgtgacagtaacctggtgtgagtctggagaaagagtccaggtaaacatttggcaaagtggtccctccgctatggacattcaggatttggcatttcagatagtagtgaaatggataactcgatggcttcctataattcccagatgccaggttttgtgctaaatcagactctccacattctgaatccttacagtgatcacatgaggaaagtccttttcttattttcatttttatgagaaaaccaaggttcagagaggttaagtaatttggccaaggtcacctggcttacatgtgtttaaaaacatgaatatgtatcatgtgaattatttatatggctaactcatttgcaaaagctattaggtataattaaacaacagggacagtgggttgacgaggataaaaatgtcttggcagccggacgcggtggctcacacctgtaatcccaacactttgggaggctgaggcaggaggatccctgaggccaggagttcatgaccagcctgggcaacatagtgagactgtgtctctacaaaaaaagcaataaattagcccggtgtggtggcacacacatgtagtcccagctactcgggaggctgaggtgggaggatctcttgagcccaggaggtccaggctgcagtgagctgtgatgacaccactgcactccagtctgggcgacagagcgagatcctgtctcagaaaaaagaaaaagaaaaaataaatgttttggaaaggaatgccaggatttagagaagtgacttaaaaattatgtttaaatcagacgtgtaggtttgctttgtattgccctgcatgacacatgtcaggaagatcgccagggaggggaggttacaagcccaggttgcaggaataacctttactctgaattttggtctgaaagacttttccttcgtctggagctgggctggccttgtgatattgtgccacagcagacacgacactgtctccaaggcggagctcattgcctggggctttcccactgcactgaatgagaatttatttggcctttaatgaaattcagattgtcccatttatgcagtcctctgtttaagtgacaggcactgaatatggttgctttcaagcaagttattttgtttaaccaggggcctagcggagttcgggatacacagatggccaccaaaaatgttaaaagaaagaaataacttaatcctcacagcatctctgagaagtggttcctaaatttatcacaatcttgcagatgtgtaagctgaggtgtggagttcaagcagcgtgctcaaagccatgtgtaggtgacagtgcctgatttcagatgcagataactctaaggccagtctgttgcatctcttaccagtttttggaaaaacctcaagggaaaaaccacagcaaatttttagagttctagtaatttcttttcccctattacaacacatattcccataaaccaaggactgtgtgattagtcaataaacaaaaagaaatgcatatagtatctgtcgctcataacgttcttgtttcttgcagtttccaacatggctagatccatcagaaactgaagccgtggagaacgctctcggggcctttgccacttcttggagtagaagccgacagagagctgtttggaaacttctccttcacacaccaggttgctactgaggtctatttcatgttgcagtcagagcagttgcttgtgttttttagtgcttgagtgattttacagataaagtcagcttctgcttcttgaccgggaggcatttgtgtgtgtgtgtgtgtgtgtgtgtgtgtgtgtgtgtgtgtgtgtgtgtgttgggggaagacagatctaagctctccctgtgaggggaagagtggattgcacaagcggggttggatggctacactgagattaccccacatttaatcagtttgccaatgaggaagccccttatcttcaaaaaaggcaagaaagaaagaaagacttcattttcccccttctctttctgttccagttgaagactaggctttggaggttttcaaagcagacggtgcttggatgggcagggagaagtaacattctgcaaatcgccgtcagaggtcctgaggacacagacctacctggcttgcattccccttgctgaatggcgtgtgctgcagctgcccactgagggctcttttccctgggattctggacttcagagtaggacagcaggctgggaagatgctgagttccatcaagtgcgtgttggtgggcgactctgctgtggggaaaacctctctgttggtgcgcttcacctccgagaccttcccggaggcctacaagcccacagtgtacgagaacacaggggtggacgtcttcatggatggcatccagatcagcctgggcctctgggacacagccggcaatgacgccttcagaagcatccggcccctgtcctaccagcaggcagacgtggtgctgatgtgctactctgtggccaaccataactcattcctgaacttgaagaacaagtggattggtgaaattaggagcaacttgccctgtacccctgtgctggtggtggccacccagactgaccagcgggagatggggccccacagggcctcctgcgtcaatgccatggaagggaagaaactggcccaggatgtcagagccaagggctacctggagtgctcagcccttagcaatcggggagtacagcaggtgtttgagtgcgccgtccgaactgccgtcaaccaggccaggagacgaaacagaaggaggctcttctccatcaatgagtgcaagatcttctaaaccccaagagacttcacacaacacttatgtatgcaccccaaagactaatggggagagggagggccgggaagccaggaaagcttggtgttttctctgggtacaccccaagcagcgtctccttttggatacagttattgatgaggcttggccactggatgttttcactaactacactctacaagtgaactccttgcccaggccagttagaaaatcccttggggaactgtgatgaatattccatctttgattaaaaaagtgaaatagtctccataattttggacgatgaagtgagtttttcaaagaattccatatttaaagacacattttatttaactaataacaaaatgtattgcttttgtatatatttagttttcacacttggaaaatcttttcctacatcctcgaaaacataaactcctctgtgagtgaaatgcttgtacgaagctctgccatatgtttgtagtgttattattttcacctcaagtagaaagtctgttgaaaccacttggctgctggatttaaatgggtaatcaaatttaaaaatgaccataaatgaatctttgcaatttgttttctacttacctgttattcacagttggatataaaatacagttccataagatatcctaatactgcctaatgattttaaagttatcactatatttttctgaaatgataaaacatcattcatttatttac

SEQ ID NO: 2726 - DNA, 12443 bp, Homo sapiens
  source 1..12443: mol_type = genomic DNA
tccgccgccggaggagcaggtggctgccgtgcgggtctgggccccaggcttcctgtgtgcgcgctcgtcctctgctgtttcccgccggagctcgttgggcctccccggcccgcccggcccatggcccagacccccgacggcatctcctgtgagctccgaggtaagcgctggcccttcctgccttcttggccgggaggaagtagtgcagccccaaaatcagaggcccacccagcgccccagagggcctggtcagaggtcctccctgctccccaggagggcaggcgccccagatcctctcccctccttcctcgctggccgcagataagccccagggccccagcctggcacagactgtgggcaccagtggcttctgtgcaaggactgaagtcacccagcaggctgcccttccacaggcgagatcaccaggttcctgtggcccaaagaggtggagctgctgctgaaaacctggctacccggggagggtgctgtgcaaaaccatgtcctggtatggggcaggggacagagccggggaggcggctgtggccccacagaaagagcctcttgctctgcccaggatatcagactgtctttccccaggcactgctacgatggagagcctacctgctgcacaccacctgcctcccgctgagggtgagtcccagggcctggccacacccccgcccgccagcagctaccttggcagggggctgcatctgcagagtggtccttcttggccttgtgggccctgactttgcaccagcactgggctctgggcagccgacaggaggggagtccaggcagatctggctctgccccaggctgcccaaaggactggacttccatgagggcggggctgggggcttggtcccagctgatctaggccctttctaggtggactgcacgttcagctacctggaggtccaggccatggcgctgcaggagacaccccctcaggtgagacacctagtaccctacctgggcctgcagcctggtcttcatgctaccaccatcacctgcgcccatgtgtggagccgaggcctagtagtgccccttccctaggtcacctttgagctggagtccctgcgtgagctggtcctggagtttcctggtgtggccgccctggaacagctggcccagcacgtggctgcagccatcaagaaggtcttccctcgctcgacccttgggtgaggcctggcaaattcgaggggctggcaggggaggagggagtgcatgagaagggctgcttcccatcccagaggctggaagtcctttgcccccttctccttaaccccctaccaggaagctattccggaggcccacaccagcctccatgctggctcggctggagagaagcagcccctcggagtccactgacccctgcagcccctgtggtaagggtgaaggcagagccacaggccttccagcctgccccacctctgcctccccagacccgcaagctgggggggccccaaactgaacagagccattcaggtcccagccaccacctagtctgtgggtctggtcttcctccatcgctgatgttttgtctctctccttttccacatcgcacccctatcccctccccaggtggcttcttggagacatacgaggctctgtgtgactacaatggcttccctttccgagaggagattcagtgggtgagggtagggcccttttgaagggctctggagacatctggtcccccatgtgtgctgagcccctccctgccccttgtggccccaggcgaactgtaagcatctccttctcacccaggacgtggacaccatttaccatcgccagggctgccgccatttcagcctgggagacttcagccacctcggcagtcggtgtgtggcctgccaggatgggagaggaggaagatcccggggcccatatccctgggcctcagtttctccatggaggggctgctgggcctgggacctggctggagggccctgagctctgcctctgttcccaccctcccaccagggacctggccttgagtgtggctgccctgtcctacaacctgtggttccggtgcctctcctgtgtggacatgaagctggtgagggggttcggggtaagggcagggaggggccaagggtgtgggccagggtgcagcccgctgagggccagggtgcagcccgtgagccgccgccctctgcttctcagagccttgaggtctcagaacagattctgcacatgatgagtcagtcatcacacctggaggagctggtgctggagacctgcagcctgagggggtgagggggacagggcagggcttggagaggagagtctggaggcttgggactgggggctagtggcctgggaggggttggcaaaccaggggcagaatctcatgcctggggtctggtccccagagactttgtccgacgactggcccaggcgctggcgggacactcaagctctgggctgcgggagctcagcctcgcggggaacctgctggatgaccgaggtatgactgagcctggggaccgcaggggtgggcagcaggaggaggtgagacccacgtggctgttcccaccccccaaggcatgactgcactcagcagacacctcgagcgttgtccaggagccctgaggagactcagcctggcccagacagggttgacaccgcgaggtaggctggatgagggagggggtgaggggaggggggtgggggtctgtccaactgctgagtgaccccgacccaccaccaggaatgagggctctgggccgggcactggccaccaatgccgccttcgactccaccctgacccacctggacctttctgggaatcctggggcgctgggggcctccgaggacagtggggtgagtggctgtcttcagggtgggagcttggggttgctcataagccctgggtaggcgatcccccactccatcgcacccctgtcctccctccagggcctctatagcttcctgagccgtcctaacgtactgtcgttcctgaatctcgcaggcaccgacactgccctggacactgtgagggggtgctccgtggggggatggatgaccggcagggcggactggagggcgggacggggagggctcggtccccccgcgggtgtagccaacagcctccccccgcagctcttcgcagcggtatcccgaggctgctgcaccagccttacccacctcgacgcttcgaggaacgtcttctcccgcacgtaagggggacctgtcggggccgggggaggctgctggaagccgcctccttgcggccccaggcccaccttcccacttcccccaggaagtcccgcgccgcgccggccgcgctgcagctcttcctcagccgcgcgcggacgctgcggcacctgggcctggcgggctgcaagctgccgcccgacgcgctcaggtcagtgtcggaccccggccacgcccccgcgggcgctcccaccctgccctggccttcgcccctccccgctcctgcttctgtcgctcccacaacctcccccagatcctggccctgcctccttcgttcgcaccctggagccccctgtcccagctcccgccaccccgtgtaacgtcctctcccagagcccttttggatggcctcgcgctcaacacgcacctccgcgacctgcacctggacctcagcgcttgcgaggtgagcgccggcccccagaagagaccacacattgggagaggcgctgggaggcggaagggcagggccgtgggccgcctgcccctccccactcgcggcctaagtgggtcccacttcccacctcccacctcccacatacagctgcgctcggccggcgcccaggtgatacaagacttagtgtgcgacgcaggcgctgtgagctccctggatctggcggataacggtgaggctgcaggagagcccatcctcgcatcatccactcgattcccaatccccaccctacccttgcaacttcgcctcgtgcgtgacccgagtcacccccaggcttcggctcagacatggtgactctggtgctggccatcgggagaagccggtccctgagacatgtggcgcttggaaggaacttcaacgtccggtgcaagtgagcccccaccctactcctgggcctcccagacaacaccccaccacccctgtcccccacaactgcggcccctgcccacagggagaccctggacgacgtcctgcaccggattgtccagctcatgcaggacgacgattgtgtgagttcacgggaccttgcagggcctcgggcaattagaccactttggtcctcctttctcttgttccctcagaccctgtgacctgccctcactgacccctgactccagccatcaatggctttctcttaaccccagcctcttcagtctctgtcggtggctgagtctcggctgaagctgggtgccagcgtcctactccgggccctagccaccaatcctaacctgaccgcgctggatatcagcggcaacgccatgggggacgcgggcgccaagttgctggccaaggcgctgcgggtcaactcgaggctccggtgggcggggtcagaggggtgggaccagcgggcagggggcgcggtggagaggagggcaccgggctaaggggagggactgaatgaggcggagcaaatggagcaggctgacgaggcgaatggactaggccgagggttgggtggggcgttgggaagctccgtccccgactgaagccaggcccggcccaggtctgtggtctgggaccggaaccacacatctgctttgggtctgctggacgtggcgcaggcgctggagcagaaccacagcctgaaggccatgcctctgccactgaacgacgtggcccaggcgcagcgcagccgcccggaactgacagcacgtgcagtccatcaggtgggcgtccccctcttcccttgcccttctctgcacggtaactccgtccctcggcatttctcaataccccttgcccctagatccaagcctgtctcttgaggaacaaccgcgcagaccctgcctcttctgaccacacgacccgccttcagccacttggtctggtctcagacccctcagagcaggtcaatgtcccctccccaaccacgagaggtagggcatgaggagacctgtggcatccgggagcctccatgagtcagagggtctgactttcctggggccagggtgcctgagccctgctgtcccacacaaagtccctctccttgatctggaggcggctaaacaccccttaaatagctctccaaataacacccttggctgcctaacgttaagcctgtaaacaggctgtcctgttagagaggaatttttatgtccttcctcaattttcccccaattgtagccccatctctgtcctcacatatacgtgactcccctcccctctccattgtgtgcccaaacccagctgctccttcactgtcttcatctccctccactaccttatctgttggagatgtttctacctctccattcccaaatacctcttctttcctaagcttcagagcccaaaggtcttaatccagacatcctgctgggcttcatgctctgcacttctccaagtgatgtcatcgtcgctcacaaaccctgttgtctaccctggagcccaatcccactggtgcccacagccacccagtgctgtggacagaggttggggcacccttccaggtctctcctggtcacactggagccctcataggcctccttcgtcctgcctctagaccaaccttcatacatgccactccttacccccacaccaattatcccttgctcctcctggtccctcctccagggctactcactcccttttctacccctctctcagtctatcctctgtgtggacagactgagcttctaaaacacagacatgatttacaactcctttccttcctattctgggcacttaggaagtgtatataaagtccttaaaatgaaccaaagcaacagatagttccttccctccttgaacagatagggttccaaagtggctggtctaagggtgtcagcttcaggacctccctctgttaaagagcctgggaggaaggcaggcaggatctgggagactgggagggggctaggctgagactgatccccatttcgccccaggaagtgaatgaattgtgtcagtcggtgcaggagcatgtggagctgctgggctgtggggctgggccccagggtgaagccgctgtgcgccaggccgaggatgccatccaaaatgccaacttctctctcagcgtgagcactccccctcctgctacaaggacccttcccctcttagtcaggtgtcagctcgcaactgcttttcctctttggccctcagattctccccattctatatgaagctggaagctccccaagccatcactggcagcttgggcagaagctggagggccttctgagacaggtgggcgaggtctgccgccaggacatccaggtgagagggtactcctgccccaaccccacctccgtttgcaggtttgactcccatcctttagttttaactgtgatatcccctgactcaatattctgttggagttggagcctcaagccagcagcctggtgtctggccacatcctcaccatgctctgactgacctttgtctaggacttcactcaggccacactggacacagcaaggagcctctgcccacagatgctgcagggatccagctggagggagcagctagagggggtcctggcaggctcgaggggcctcccggagctgctcccagagcagctgctgcaagatgccttcactaggctcaggtaggctggatggggctgggctgggcaaggctgagcaaagccagcccattaacccctgtcctctcctgcccttagggacatgcggctatcaatcacggggaccttggcagagagcattgtggctcaggctttggcaggcctgagtgcagcccgggatcagctggtgagggggagatgtgcacacactttcgtgcaaacacacacatgcagtgacttggccatctcccttgcaggggctctgtaatgtcttctggggtcatgtagcccagggctatttcagggtccccttagttagcatcaatgggatcatggctgaggccctacctgccatctttggctgcttggtattgcaggtggagagtctggctcagcaggcaacagtgacaatgccccctgccctaccagcaccggatggaggtgagcccagcctccttgagcctggggaattggaaggtcttttcttccccgaggagaaggaagaggagaaggagaaggtaagtggttttagaacacggggcatggcactcccagtcttcccatcttgctgtggagtgtggaaggtgaaaggcagctcttttgggttggtgctctcctaccccaggctgagtttgtgccctccccaccaggatgacagtcctccacagaaatggcctgagctcagccacggtcttcacctggtccccttcattcacagtaagtcagggccttgggggagggagtttacgtgggtgggctgaagctccattagacttggggacccggggacctggatgaactcattcagccttgtctgggtacccaccagcccttgactgggccaggtcgggccccttgtgcaacctgcaaagctggggtctgctgtggtcagcccggggcgggacctgggcggatctgggacaggacaccggctcagctcgcctccccgcgcccctttccctaccccagggacgcgcatgctgggcggcggcgcggagccgcgcgcgctcggggccgcgctcagcaccacggacagcggcggcggcgggggaggggcggaggggcagaggggcggggggacgggcggcgtagccgggcccctccccgcgccctgggcgggtcccccgccgccctagcgcctccgccgccacctccccgggctcggcgctcggtgctcttctggtgctgtcccctcaggtgctgctgaggaagcggagccggagcccgagctggcggctccgggagaagatgcagagccgcaggcggggccgtccgcgcgcggctctccgagccctgccgcccctgggcccccggccggcccgctgccccgcatggacctgccactggcggggcagcccctgcgccatccgacccgggcccggccgcggccgcgccgccagcaccaccaccgcccgccgccggggggcccccaggtgagcacccttcccccactccggagcgcgtggaattggggatcacgggtggcccggccgctcctcatgggtggtagcggtcaaggagagggggtggtgggggcccaaggccacctggtcgtgcggccgcggtcacatcctggcttcttcctgaccaccccccaccccaggccatgcctgtgcgggaccatgggtgtgcgggttccgttcggggtgtgcctgggtgtgggactccgtctcggggcggcccgcggcctccgtggctgcgcgagagagggtgtccgtcctccctccctcccccggggctgctgagagatgccgggcagccgggtagccgagccgcggggccaagcctgcgtctgctgcgcgtccggcggcggcgcgtgtggggagatgcgtgtgtgggctgcaagcccgcgggggcagcgggcactggcggagggcggggaggagccggcttgaggccccccagagggtctgacgcagcagccggcgccactgagccggcagcaggccgggtggagtgggggtggggtgggggacactgcagggaactgttcggagcagagctggtggcaagtgggaacgggtgaccccgggggcacgtgagggctaggtttgctggtgaccgggtggctcgggcgtgtaggatactctgtgggacaaggacgggtgtggactgggtgtgcgggagccagcagcgagtgaggagtgcgtgaaatctggagtctctgtccagcagcaggacagtaggaggctggtatcagcagcccctagggtcaccccagtctggaatcctggagttattcagtccaggctgccggccgggggggggggggggtagaagccagagttgcactcaaccctgacccctgaccccatgatgccccccaggtacccccagccttgccgcaggaagggaatgggctcagtgcccgcgtggacgagggcgtggaggaattcttctccaaaaggctgatccagcaggatcgcctgtgagtgaggggcatctgctgggggtgggagagggtgggatgcctgatgggctttctcgctcactgctgggtgtccccacagctgggcccccgaggaggacccggccactgaggggggcgccactcctgtcccccgtacactgcgaaagaagctgggcaccctctttgccttcaagaagcctcgttcaacgcggggtccacggactgatctagagaccagccctggggcagctccccgaacccgaaaaactacatttggcgacctactgcggccgccaacccgtcccagccgtggtgaggagcttggtggggctgagggggacaccagcagccctgaccctgccggcaggagccgacctcgctacacaagagatagcaaggcctactcgatgatactgctgcctgccgaggaggaggcaacgctgggtgccagacccgacaaggtgaggcttgctgatggggggtggtgaaggcgcttctgggacccagggcgcggactgtctccaactcgagcatctctgtccctagcggcggcccctggagcggggagaaacagaactggctccatcctttgaacagcgggtacaagtaatgctgcagaggataggcgtcagccgaggcagcgggggtgccgaaggcaagaggaagcaagtgagttgaggggacctgagcatgaagtgagagggcagatggcatgctgtgggtgacataagtgaccaagatggaggagactcatgacagataggtctaattgtcagttctactccattctcctcgaaatggttacagattcgacctttcttccctcttggctttgacccaggcacaggccaccagcatctcctctttggacctgagaaagtcttttctctgcaggtctaatagaaatctgaggcctgggccaggcgccatggctcacgcctgtaatcccgacactttgggaggctgaggcaggtggattacctgaggtcaggagttaagagaccaacctggccaacatggtgaaaccctgtctctactaaaaatacaaaaattagccgggtgtggcggtgggcacttgtagtcccagctacttgggagggtgaggcacgagaattgcttgaacctgggagacaggttgcagtgagcctagatcgtgccactacacactagcctggacaacaagagtgagactcatctcaaaaaaagaaaaagaaaaaaatctgaccttgtcacttgtgcttgaaatagcaagtcctccaggggcttcctctcaagacactgttcagactccacaacctgcttcagagccctgtggggtcttggccctggccaccttaaaacctcactgctttcctcccctggtgcaaatcagagcctccacacacgtccctgggtggtctggatgtcctccctgcctcgcttccagtctctaattgtgggttacgccaggtccctcctcagccatccctgcagtgcccatggttcttccctgactctcctctgtgggccaccctgctaatgtctctctcattagagtcccaaagaaccccagccctccataccatccattcaatatcttaaaaaacaaaaaacaaaaacaaacaaaaaacatgaagtcggcctgaatttagaaatattcaagtgtgcaaagagttctaagagggctgtactgggtttgccatgttcttgtccagcccatggtgggcattcagtggcaggattataagaacaagaacgaacaaaaggctagggtgtggggagcgggcagggctggaatctgattgccctgtttcctgcagagcaaagatggcgagatcaagaaagctggctcagatggtaagtgggaccctggggtgtggcagtacatttgccaggaggtgtccttatagacagcccccaaggcacttgctctccttggggaggaaggggagaggccaggtttttcttcccctcacctccaaggtctggtacctgagtccccagctccgccttgcaggtgacattatggacagttccacggaggcccctcccatctcgatcaagtcccgcacccactctgtgtctgctggtgagtgagggccactgtgtgtgttggtagtgggagcagggacaggcaggagttgggtcagactgttgttcagacctatcgccaatgcctgaccaggtcttggctgacacctttctccctacagacccttcctgcagacctggcccagggagccaggggcctgagtctgccacctggaagacactggggcagcagttgaatgcggagctcaggagccgtggttggggccaacaggatggtccaggccctccctcccctggtcaaagcccaagtccctgcagaaccagcccctccccagacagcctgggcctcccagaggacccttgcttgggccccagaaatgaaggtaggcaggcacctgattccccaccccaatcctggcctcggggctggaggagttcctgctgggaactcagctcctctaaggaccctgagggtgggaggcaagggctggagtgggggcagctgttggaatacccctgattccctggcctccctcagatggccagctgaggccgaggcctctctcggcagggcggcgagcagtgtctgtgcatgaggaccagctccaggcccctgctggtgaggggagacacctccacgtgtgcttgaatgcaggagatgtgggagggtgggcttctggggctcccttcatagctttggtccttggagggagccaccagtgtgtgaggtctcaagaaatcagggagccagaagaccaggtgcaagggtttgacagcaagcccttccaactagcactggctccacttcccgaagagcagcctctgccaggggtgaggacgcagggacgggggatgctctgaaggcagcagtgtgtgtgagtgcatgcttatgtgcactggaggtggaagagaggggcaggggatggacagaccccaagccttagcaacccaccccaagcctttctgtgtcccttagaacggcccctgaggctgcagcgctcccccgtcctcaaacgcaggccaaaactcgaggcacctccatccccaagcctaggtaagagggggtccaggccagctgggagggtggcaggactgcttagcccagccctgacccttcctctctctccctccctcccctcacaggatctggccttggaaccgagcctctgcccccacagcccacagagccctccagccctgagcggagcccaccctccccagccacagaccaaagaggcggcggccccaatccctgatcctctcctctcctgccgcatgagattattttattaaaaaactcaaaggaa

SEQ ID NO: 2727 - DNA, 54710 bp, Homo sapiens
  source 1..54710: mol_type = genomic DNA
acttctgacagtggggaaagcagctgtgtgtgatagcttggaaggtttactgctgcctcaagtcctcttctctgcagttgaggtttcaggtttcaatcctcccaataccacaagacagagcacggggcggctgccgcctccgcctccgcgccttaacctaggcggcttgccgaagatctcagccccgcggccgcgcgctcgccctgccctagaccagggttgggcgcagcggcggaggtggcttctgggctgcgcgagctgggagagctgggaggcggcgatcgcagctgggccgggacttccttcctccaccgcacggcaacaaaacaaccctgcggcaggcactgagtgcttcgcagctgtctgggcgagaggcacagcgatgggctccgtgctgagcaccgacagcggcaaatcggcgcccgcctctgccaccgcgcgggccctggagcgcaggagggacccggagttgcccgtcacgtccttcgactgcgccgtgtgccttgaggtgttacaccagcctgtccggacccgctgtggccacgtgtaagttccaggggagctcggtttgcgcccacccctaaggagggcgatgtggggaagctgagggcatggtgtggggaaggagggggacggaagacagcctcttaggaaattgctgcagggagaaacctggacccgtcggatgcaggaccacggggaaaacgcgggtcggaaggtgacacaggatttcgggaggagaaaaaataaacaagcgggtcctgtagcccccttgcgctttcagctcccgaagcccaggtgcggaactccagagaaggggatccaggcacgggtcccgcccagagccagggctcgccaactggggagggtgctcttggctggagaaccagcgctcgcccaggcacggaaaggaaacgagctccagctacaaggcaggggctcccgcaaagcgcagttaccccgctgaacacggtagaacgggctgcgcttccctctgccccagaaacccgggtccgttttgttttgctggagctgtgcacgtgttcccagaatgcccacagaggctcgtcttaagcaaacaaggatctgtgcaaagtgtctttccacccccacccctgctaccctttcccaacacagacacccagcccctcaaagggcaagtcaaactggagcttccgagtgactttccacagttgttagagtttaacaacctgctagggtggggcttggacgttagccgccaagcccctgaatgtactccttcaaaacccagccacaacgtaacaggaggtggcaggctacctgctttacgcacggtctctccaaaccggcggaaattacagagtaaaataactttctcaaaaccgcatagtacttagctaaaactcacagttggtgcaaagccgtggtcgtttctaagaagaatttaaaaacaaagtccctatataaaattggcacatccttaatgtgtgtttgaataactggtggagttggagctgtgaatttgtgctctctgtttactgtgtgtgtgtgtgtgtgtgtgtgtgtgtgtttgagagagagagagagagacgtagtctggctctgtcgcccaggctggagtgcggtggtgctatctcggctcactgcaacctccgcccactgcaacctccgcctcccaggctcaagtgagtctcctgcctcagcctcccgagttgctgggattacaggcgcccacccccacacccggctagtttttgaattttgagtagagatggggtttcaccatgttggccaggctggtcttgaactcctgacctcaattgatccacccacctcggcctcccaaagtgctgggattaaaggtgtgagccactgcacccagccttctctctttgctttgattttttttcgtggatacgtgtgtgtgtgttgtgtctgcacagatcaggagcggaagcctacttaatgtcctttgaagggtgactatagtatgatgaagccatgtgtgataccacagtggcttgtaccagcatttggcttagcaggaagaaagaaataccgttattatgaatgcaagtgcacaacatgtttttgaggaccacttttgaaaggatttaggtagtccttaaaaacatgttgtgcacttgcagtcaaaagttttgacgcccggcgtggtggctcacacctgtaatcctagcactttgggaagccgaggtggatggatcacctgaggtcaggagttcgagaccagcctggccgacatggtgaaacctcgtctctactaaaaatacaaaaattagccaggtgtggtgacccgtgcctgtaatcccagctacctgggaggctgaggcaggagaactgcttgaacctgggaggcagaggttgcagtgagctgagatggcatcattgcactctagcccgggcaacagagcaaaactcagtctcaaaaaaaagaaagaaaaaaaagaaagttttgaaaggacttaggtaatccttaatacctatagccttgtatctgaaaagcagttttcactactgcccgtctgtgagccagggacaaaagtgtgcagcctgcacaatgtataaataaagagtgctttgggcattatttcgtagctgtgttttcttttcttttgagatggagtcttgctgtgttgcccaggctggagtgcagtggcacgatcttggctcactgcaagctccgcctcccgggttcacgccattctcctgcctcagcctcccgagtagctgggactacaggtgccgccaccacgcccggctaatttttttgtatatttagtagagacggggtttcaccgtgttagccaggatggtcttgatctcctgacctcgtgatctgcccgcctcggcctcccaaagtgctgggattacaggcgtgagccatggagcccggccgtagctgtattttcaaggcctgttgtttcagctttgttcttaaaactcgaggcttaaatttaccctcctttctattactgatgttgttgctcagctgtccagatgtagcttattaacataatatccacaggccagtctggaagccaagatgggctgtgtgagtcataaaatatattgattattttagggcaataacagcctaaagatatctccatttaaattgagtcattattagcattaaaactttaaagttgtgcaaaacataaacagtgggcgttttgaagattctttttggaacagaccgctttgctattcaatgatctgactggagattgttttctcggtttggactttgaatattataatttaccatttacaatatttttccttctactaaaggataatataaatttgcaaaatgttaaattttttgtttaatctttttctttgttaaagtgaataggaaactagcaactggaaaaatagtcataaaatagcattacaagggctgaacaaattgcctttcctctctttactgttctttgttttgacaaatctatgtccattgttctggctgtgggcagaatttccatattcctccttttggcaaacttacttggtccccttccactttataaatgttaaccagagtcctttctgcagtagagattgtgagcgttaataccatttgtacattctaaatgaattactcttttccattgaaattaagttggaaaacgaataaatgcaaatgaaccttctgtattttattatcccatattgaagctacattttcagacatgttgaactaggtggtttatgctgatttttgtttgtaaacctatttcaagtcaaacaagtttaataataacaacagtaccttgaatgaatatgtaagagcactttataagttgtattgtgatgcagtagtaactggcccttacagagagctggatttgaaattcacctctgccactagccagatgtgtgaccactttagggaaatttgaatttgatttttttcccctaaagttttgatcatttgagtctatgaaacaaactgctaatagattaacaaggggggaaaagcttacaaatgtattaatgagcatatgggcatgggagtcatacaaaatatgaaaactgagagaaagggccagatgcttgatgcttttataccatcttgaggttacagcagagtaggggcttggaacatggttatgggagggagaaagaaagaaggggctggggcaaagatggtctagttatgcagatgaaacttcatagatagcagctcctagaaagaataggcatgagcctgtgttaagttgctctgtcagaccttcgtaggtgtcagactttcagttaataatttcctaggtacagataagggggtgcctccaagaaagcctggttgtttatttcaccagtgtagattttctctacagatgcaagtctcctccacaaaaggcagcttttcagggttattcctgtgggaatatatcaaagaagtacattttggggtgaaatattttcagtttcctttagtcccccatttaaagcttaatttttaaaacattaaacatttcctttatttttattatttatttatttatttttagcggtgagatctcactctgccacccaggctgcagtgtagtggtgcaatcatggctcactgcagcctccacctcctgggctcagcaatcctcctgcctcagcctctcacgtagctgggactataagtgcctgccaccatgcctggctatttttcacttatttgtttattttgagatggagtctcactctgtcacctaggctggagggcagtggcgtgatctcagctcgctgcaacctctgcctcccaggttcaagtgactgtcccgcctcagccactctagtagctgggattacagacatgcaccaccacacctggctagtttttgtattttttgtagaggcagggtttcgccattttgcccaggctggtcttgaacccctgagctcaggtgatttgcctgcctcggcctcccaaagtgctggaattacaggagtgagccactgcacccagccaagaaagtgacaattctttacataccgcaaggtcaggattttgtaagggaaccatatacacagggtaccaggccaatctttttctaagtctgttggctttttaatgtcaatttcagtccctcaaaacagtttgatcatgtatctaagtatgacattccagttaaagccttgctaaaataaccactgtctccaattatgtcctgttcagactgttactgaacttatgcatgtaactatattgccatgaaataggaatactcaaaacccagtttgtgaatccaaagagaaaaaggtaaattattttgctcacaaaagtatacttggccaggtgcagtggctcatgcctgtaatcccaggactttggaaggccgatgcaggaggatggcttgagaccagcagtttgtgactagcctgggcaacatagtgagaccccatctctactacacaaaagtcttgttcaaaagagaaaaccatattttacttttgaatcagtatatcaataataaatttaaataaaacctaataaacaagtccatccaatttcagtcagctttgaccacacaagatttacatatcttttataacctcttacgatttttcttctatttccaactttctatattcacttagttttatctatatctttttttattctttcaatttgaaacaagcttcaaataacttctaaactagacacaattcgttttccattaacaaaaaaatcacacttcatgccattcttttttttttttttttctttttttttttaagatggagtctcactgtgtcacccaggctggcgtgcagtggcatgatcttggctcattgcaacctctgcctcccaggttctcctgcctcagcctcctgagtagctgggattacaggcgtgcaccaccacacccggcctcatgccattcttacaacctttctctccaagaacatatcttgcttttttggtatattctgcctgaagaattgtttgtcttatttctagtagttttatttgtttgtttttagagatatgatctaagaacaaactactcagtgatgtgatcatagcctactgcaacctcaaattcctgggctcaagcaatcctcctacctcaacctcctgagtagctggaacaacaggcatgccccaccacaccctgctaaaattttatttttttatagagacagggtctgcctatgttgcccaggccaatcttgaattcctaggctcaagtgatcctcctgccttagcctctcaaagagctgggattacaggcatgagcactcccaaactgctgggattacaggcatgagccaccacacccagccaactaacaatttaaaactagctttattgctgggcacagtggctcacacctataatcccagcactttgggaggccgaggcaggcggatcacttgagcccaggagttggaaaccagcctggtcaacatggcgaaaccttgtccctactgaaaatactaaaaaattagccgggcatggtggcgcacatggaggctgaggtgggagaatcgcttgaacctaggaggcagaggttgcagtgagctgagatcgcaccactgcactccagcctgggtgacagattgagagtcgttctcaaaaaaacaaaaacaaacaaaaaaacctagcttgatttaccaaagattactaaagtcatatgaacttcgaaaaacatttgggatagttaatttgtgagtactcatttatttagaagtcagtttggtactacagactatacaaactcatgtgtaaacatatatatacatgtagacacaacatatatcacatgcacacaccagtatccaaaagccagagagattaggaagtttaatgcaggagagcagaactttagacatgagaggatggaccctgcccatggcttctgtggctcagtgagaagacagaggacccccaatggccaggcgtggtggctcacgcctgtaatcccagcattttgggaggctgaggtggggggatcacctgaggtcaggagttcgagaccagcctgcccaacatggcgaaaccccgtttctctaaaaatacaagaaaattagccaggggtggtggcaggcacctgtaattccagcaactcaggaggctgaggcaggagaatcacttgaacccaggaggtggaggttgcaatagccgagatggcgccactgcactctagcctgggtgacaagagtgaaactctgtctcaaaaaaaaaaaaaaaaaaaaaaaagaagacagaggacccccaaagaggggcgattggtggcttttgtgtttgtgtatgcgtgtgtgtgtgtgttcctcaaggggtctcagggttcacagaagtcccctctaggcctcttcatgtggtatcaaaaatggcaaaaaggaggaggggcagaaggggaaggaaatggaagaacaagtcttagaggagccaatttggggagattttaagctttcaaaaggccaatacagttttagttagtaggagtctgaggaacaaaaaaaggtctagttgactaagaagttcccaagggagaaacaggatttgaaagagaacagagaatatcagctattaattaagctggcttttgaccacagagccatctttcttaaaaaaaacttttttttttttttttgagatggagtcttgctctgttgcccacgctggagtgcaacagcgcaatcttggctcactgcaacctccgcctcctgggttcaagcgattctcgtgcctcagcctaaaaaatccttttaaatatgcaagcagcaaacattttgtcctctgagcacccggtcttttttttttttttttttttttttgagatgtagtcttgctctgtcgtccaggctagagtgcagtggcccgatctgggctcactgcaacctctgcctcccgggttcaagcaattctcctgtctcagcatcccgagtagctgggactacgagggtgtgccaccacacccacctaatttttgtatttttagtagagaagaggtttcaccatgttgctctcaaactcctgacctcaggtgatctgcctgcctcggcctcccagagtgctgggattacaggtgtgaaccactgtccccagcctgagcacccagtcttttgtgggagcagagagaatggtagctgtggcatttcatgcttctttttccccagaccctcccagcaccccctctttagggggtacccacctctcctcacctgtttggttcccagctgtagcaggaggtatgtctctctggccccgtagaggaagcagattaatggggaaaaagttactatcacactctaaatataaaccaacgttttaaccaaaggaaataactcaaaatcaaaacaaataagaacatttgagactgaaaccaagaagctcttgatggcttcaaccaaggtttcctaagagggagcaaaagttgcaaccctttcaaaatccagatcattccctacaacagcttaaagaaagcaaggttttgccagccgcaaatggggtacaacccacatttttgtctggccatattctctagggtttaagacagaggaaaacaacagctggatgagaggcttacagaatgaatgggtaccccaaaggttaagaagtcatacaaatataaattcaaaacaattcaaactaattttttccaagtatttcttttatttttccttcctgagttaaaggatttacatctcctggggtcttgttccctgaaagggaattgaatccaggctgcagtggtgaaagtgcagaatccttaccactggactacaggatggagtcttttttttttttttttaatttaacaaatttcataaggaatctaaagcatgcaatttgagtacaaaggattttaactttgttttaaatctgatttctacttttcaaaaatcttgccgagggagtttctaaacctgtattccttttgtatcttttcataggtaccaataaggtagctatttaagatgtgagctctaaaaagttttcttttaaatatagccattcatttattttaaaagcgattgaaaccaatacaagaactaatttatatgtttttctctgttgatccaaatttagaaagggtaaaacacagagactcataccatccacatttgaccaggcactataggcagagatcggagaggagaactgacttggttaaaaaaaaatgagtttacctttctttgctggcttttcatccgttgttccaagatcccattcattggctctagaatgaacaaaatgacttacatcctgatcacaacaccaaaaatttttctcctaaagattcgatactttgagtctataaaacaggcagataacagattaatgggataaaagcatacacatttattaatatgcatatgggcgtgggagtcatacaaaatatgaaaactgaaagaaagggccagatgcttgatgcttttatacttgaggttacagaagaatgggggattgcaagatggcaagacaagttataagagggaaaaaaaaacataaggggcaaagctgttcttgttatacagatgaaacttcacaggtagaagctctcagaaagaatgggcagtagtcggccgggcgcggtggctcacacctgtaatcccagcactttgggaggctgaggcgggcggatcatgaggtcaggagatcgagaccatcctggctaacatggtgaaaccccgtctctactaaaaatacaaaaaattagccgggcatggtggcgggtgcctgtagtcccagctactcaggaggctgaggcaggagaatggtgtgaactagggaggcagagcttgcagtgagccgagattgcaccacggcactccagcctgggcaacagagcgagactccgtcttaaaaaaaaaaaaaaaaaaaaaaaaaaaataataggtagtggttcatgataagtttttttgttagaccttcaaacgtttcagactcttggttaatctcctagattgggcaggggagacctcagaaagcctgcctatttatttcaccaatgtagactttctctaccaatgtagacttttctctcccccacaacatgcagcttttcagggtttttcctttctgcaggccatctcaatagccatctcgaagtatgtcaaataattatttttgggggtaaaatattttgtttccttttttttttttttttgagatggggtctcgctctgttattccggctggggtgctgtggcgtgatctcagctcactgtaacctctacctcctgagtagctgggactacaggtgtgtgccaacacgcccggctaatttttgtattttttagtagagatggggttttgctatgttggccagactggtttcaaactcctggcctcaagtgatctgcccacctcagcctcccaaaatgctgggattacaggttgagccaccctgcccagccaattttctttaccactaagttgcttaatctctttgaatctctgtttcttcatttgtaaaatggggtgagtagtgccatttttatgaatatttaaaatgtaaaagtatcccatagtaaaggctcaaaacatggtttctctttccttcagtcattccataagcaaaaccccaggaacagatattatttcttatctctgtatttcttttggaagaacactgtgccatgaaaagttgatctatgacatttctaagatgtctcatatagcctcacttttagcttagttctttttcctttggtggactttaatttaagaagtttcactttaatgttttataattttaagtgaactttattcatattgctgtatcagttgtaaaaaatagatttgaaggaagagccttctcacttctgccttatcttctattagaaagctggggtgagagccactagataacttggagctgtataaatggaacttaaaaggagtctggaggctgggtgtggtggttcatgcctgtaatctcagcacttcgggaggctgaggtggaactgcttgaaccccagagtttgagaccagcctgggcaacaaagtgagacctcgtctgtacagaaaaaaaaaaaaaaaaagctgggcatggtggggcatgcctgtagtcccagctactcaggaggctgaggtgggaggatcacttgagctcgggaggctgctgtgagcagtgattgcaccactgcacttcagtttgggtgacagaatgagaccctgcctcaaaaaaaaaaaatgatttacattcaaaggaaatactcaaagacatttgttgtcagattgaaaacagtagatgcaagggagaaagatatcaaagccaaccactgggctttaaggctggtgaataaacggggtcagagagactggcacaggaggaagtgagtgcactcatgaatgggcctgctgaatgtacagcagtctgataggcagatatccaaatggaaatatccaaaggctctggaggaatagactgggggaaagagatcagggctggagactgagttatctaaaaagcatctagaggttgagaatgggctgaagagagctaaatgaactggagcacaccataagaaagagccaagtctccattgacctcagatacaactgctctaagtcatagaatgtacctaatttttatttttattttttattatttaatttaattttttgagccagtctcgctctgtcacccaggctggagtgcagtgatgcgatcttggctcactgcaacctccacctcctggttcaagcgattctcctgcctcagcctcctgagtagctgggactactggcgcatgctgccacgcccaactaattttgtatttttagtagagacagggtttcaccatgttggccaggctgatctcgaactccagacctcaggtgatccgcccgcctctccctcccaaagtgctgggattacaggcgtgagccaccctacccggcagtgaatgtacctaatttttagaaaatgaaactctgtttaggataattctgaaatactttcaggtaaatggattgaaacgttcaatttgtggtcaagtatgagcagtaaagcgtacatcaaattggtggtttcctaagtagagtctgagagtcttcctgatgagttttaaattgatccagaaatatgcatgagtggctttcattcttacaggacatttgcaatcccactgtaaaccaaaaataaaattctaaggcccccaaccaactgaatggacctttcctctctgccaagggcattctaaagtaaaccagaaacactagttcacgccatgatgggaatgggtatttatcaaatactacagactgggtaatagataaagaaaagaatcttttcagctcacagttctggaggctaggaagtccaagagcgtggtgctgggacctggctagggtcatcccctggtggaaaggtagaaagaagttggcagagtgggaaaatgcacgtgagagagctcgcttattattttattattttattttttagagatgggggtctcactatgttgcacaagctggactcaaactcctgggctcaagtgatcctcctgcctcagagagttggcttttatagcaaagccacttctgcaagaactagcccactcctgtgataacggcattcatccattcatcacagtggagcccttatgacctaaatgcctcctgaaggttccacctctcaataccaccacaagaggaaccaagttttcatgcttgaactttggggggacacattcattatatcaggcctcctggttatacaggcacattcatggtcttatatttgtgacttctgcttgttactgggaagaactgaggtttcttgaaaagactacaaaatttgaggccctacccaaactgtttaaggatcagagcactactgtctgtggctgcataaacttggcacgttgctacactactctgaaccttagtttgccatcaataaaatgaggagaaagcacagtagcgttttatgaattattgtaggagcctacaataataggggataatgtatacaagtgtccgccatagggctcggcaccagtatttgtattctgcttgcattggcatacaactcaaattgtgggaaaaaaaaaaaaaaaaaaaaaaaaaagggaaaactgctagttgacaaaaaaacaaaatgttatctgcttgcctctaaataatgtaagcaaataattcatgtcagaaccataagtgttgtattagaaatgttaattgtgagttgagcatttgaaccatttgtcataaatttcattcaagactacattttgagaacccattcttagagactcagagacatccaaggtcagattgtaccttagaacttataattagctgagatagaaagaagtaaaatatgtatagcagagaacttagatttcttgatcttaaaatattgatcttcccaactggggtagctgtggtagtggaataaaaggttactgaaatttgggtcagaaaaccccagcttaagaccaaccaagttcaagcactttcttttttttttgagagagagagatggagtcttgctgttgcccaggctggagtgcagtggcgcgatctcagctcactgcaacctctgcctcctgggttcaagtgattctcctgcctcagcttcccaagtagctgagactacaggcatgcaccaccacacccagctaatttttgtatttttgttttgttttgttttgagacggagtcttcctctgtcacccaggctggagtgcagtggcacgatcttggctcactgcatcctccgcctcccgggttcaagtgattctcccacctcagcctcccgagtagctgggattacaggcacccaccaccatgcctggccaatttttggtatttttagtagagatggagtttcaccatgttggccaggctggtctcgaacccctgacctcaagcgatccacctgcctcagcctcccaaagtgttaggtttacaggcagaagccaccatgcctggctgtattttttttttttagtagagacggtttcactctgtgttggccaggctggtctcgaactcctgacctcaggtgagccacctacctcccaaagtgctgggattacaggcatgagccactgtgcctgaccaagctcaagcactttctatttatgtgatttttttccccccaagccaaactttatccagctttattaaagatactttccataaacagtcacagtatttcaagcaggacgtgggcagacaatccttaacagtatgcaacaactttcaaactcgcttcttcaatggactaccaaaaaacataaagccactttaaaacccagtggagggccgggcttggtggctcacgcctgtataatcccaactacttgggaggctgaggcaggagaatcactggaacctgggaggcagaagttgcagtgagccgagattgcgccattgcagcctgggcgacagagcaagacatctggcaaaaaaaaccaaaaaaacccaaaacaaaacgaaaaaacccaatggagtattcatttgatactctgaacaagaaagtttagggtgagggttgacatttcacatttagcatgttgtttaacatgagccgaccctgactttcagggagtgaaatgaaaatggcagaatttgtctgacgatacacaatgtagaaattgaaccactgctcttttgaggagccccatctcagtggcatcactggaaagtccagattgcctgacatgctggtaaccaattattgggggccagtccccaacaggtgtgtgggtttaacggagttaagtttatgctgaagatggaaagggagaagaggacataggaacaaatttgtttttccataccacaaggctgttgtgccaaggtgtctgtgtttgtcaaagtcagggaatcccttctcctgggagccaagaggaagcctctcaaaactagaagggaacaccagcctggccaacatggtgaaacccctcctctagtactaaaaacacaaacatttgccgaacatggtggcacatgcatgtaatcccagctgcttgggaggctgaggcagaattgtttgaactcaggaggtggaggttgcagtgagctgagatcatgccattgcactccagcctgggcaacaaagcaagactccacctcaaaaaaaaaaaaaagtctgggcacagtggctcatgcctgtaatcccagcactttgggaggccgaggagtgcggatcacctgagggcgagagtttgagaccagcctgaccaacatggagaaaacccgtctctactaaaatacaaaattagctgggcgtggtggcgcatgcctgtaatcccagctactcaagaggctgaagcaggagaatcatttgaacctgggaggtggaggtcgcggtgagtcaagatcttgccattgcactccagcctgggcaacaagagtgaaatttcatctcaaacaaacaaacaaacaaacaaaaaagtagaagggaaaggtgttttccccacatcaatccagcttctagacgttctattagtgacagtgactgatatcccatccccagaaaacaacaatgaagtgttctgtgtgctaacaacatacctttaaaaaaaaaaaaaagaaaaccaaatactgcatttttataaaacttgataaaaaatagtatttcaaactgtacagtcaccacaagtacatagttatcacagatgcacacacttgacctggcacctccagcaccttggcttcctgtgcctggtctgtttaggcatctgcattctctgcagggttattcccctccttgccaccatcagttcttccctttttctctttgggtaccttctctcccttctttgcaagggtctccttagacttggctttggagaagcaagtttaacagacaacctcgcggatcttctctgtggttcatccttcaccttggcgttatctccttagcatcccgctcagtctttctcttgagcagggcggcagctgcagcgggacataagccctgggtaagggatgcaacagcgcataggttatagtcggtctgggggttgttcttgctgcttcttcacactgttcctttacgtgatcttgcagaagcaacttaccctgtatgtgccttggtttccttatctataaatggaaataatgatctttcttgggagtgtattaagattaaatgaattaaggtatatggaagagtttttaaaaactttggtagagaaccagtgtatcaagcttgaaattagacataaaaaattactggccgggcacagtggctcatgcctgtaatcccagcattttgggaggctgaggcgggcagatcacttgaggtcaggagttcaagaccagcctggccaacatggcgaaacacagtcgctactagaagtaaaaaaaaattagccgggcatggtggtgcacacccgcaatcccagctacttgggaggctgaggcaggagaattgcttgaacctgagagacggaggttgcagtgagccgagattgtacctgggcaacagagcgaaactccatctcaaaaaaaaaaaaaaaaaattaccatacaataacaaaaatagctaaaaggaaagggtaggaaccaaggcagatatggagttctacgtaaagggagaaaagttccatctggttgctactgaatctgtcattatgtcactgtgtgcagtgttcaacttccagagacatggtctatacttgacttggcttgccaggtgctcatgccttcagcaggagttggtaggcaccttgatttaggtcccactgagactatatgtaatataagaggtattgttcctgaagaacaagagcaggatgctattgcaagaaaaaggaggaatggatgctggacaggtataaacaacaagtagatgtctcaatcactgcacaagtgagcatcctctgtgtgcttatagtaatttgataacagatgcagaagagaatactgttacgaatcagtcatgatccaagccaaattcaaacataataagaaaaaaataaagaggaaaaaaatcggtagtgactaatataattaggagttaaagaggaaaagaagaagaagaattgtttggaaaatagctgtgcctgcccatcactaaagtttatcatcagcaagtatttaaatactacccagatgtccattaacaacagaagggtaaataaatttgggtgtattcatacaatagacttcacaaaattagaatggacaatctcaactatatacaacaatataatgaatcttttgaccataatattgagctaaagaagaccaagaatacataccagagggttccatttataggaagtacagaaacaggcaaaactgatctttgttattagaagtcaatgattagcaccaccaaggatggtaagcagggatgagaaagctgcagtctataggctggtacaatgtttgaaaagtataattttcatatgttaaaatacattttaaaaagtcagtgattactttggaggggatagaattgtgtctggaggccgggcacagtggctcacgcctgtaatcccagcactttgggaggctgaggcaggtggatcacctgaggtcaggagttcgagaccagcctgaccaacatggtgaaaccctgtctctactaaaaacacaaaaaattggccaggcgtggtggtgggtgccagtaatcccagctacttgggaggctgagtcaggagaattgcttgaacccaggaggtggaggctgcagtgagctgagatcgtgtcattgcactccagcctgggtgacaagagcaagactccatctcaaaaaaaaaaaaaaaagagaaggaaacaagaggggaaattttaggggctggccacgctgtttttgttataggtactggttatatggatgtgttcagttttgaaatttcattcaactatatgcttataagaactttccagtatgtacagtatacttaaaatttaaaaagcctacctttggacatgtattaatactcccaaatagatattatgtgctgagtagtttaagaggcatcaggtcatgctcatgtgtataaattacccaaatgctcatttttatttctatgtttatggagtcttcaacaactcctataaataggtcagaattttctggaaatgttgattatgttaagatttcataatgagcacctttaaataaaccagagaacatatttcttgaccagaaaggaaggaaggaaggaaggaaggaaaggaaggaaggaagaagggagggagggaaggagggaggggagaggggagggagggaggggagaggggaggggagggaggaagggagggaaggagaaaatggttttatagggaattataatgtgtctggtatttttacttccttgacttcctgctattttcttatgtgacacacaaaaccccacagaagaaagacatattttctcaagaaatttgaggtaaaatccaatttagacattctttaaagtatcgtttaaacttagcctataggaaagctatttcacccactttgaattcttacttttcttgaaatgtgtgaaagtgcatgtggtaagaatgtgtgattctaaagaagtcttgctgggaaggtaagcaattctcgggaagtgcagggtgcaagtggacctgtaatttggtagtatggctcatggggtacgaggtgtcattaaattacagtttacacaaatgaatacatggtggtggctccttatagctttcaaggaaagtgatgtatttttggtctgtttggggtagattctgccgttcctgtattgctaccagtctaaagaacaacaagtggacctgtccttattgccgggcatatcttccttcagaaggagttccagcaactgatgtagccaaaagaatgaaatcagagtataagaactgcgctgagtgtgacaccctggtatgtatgtgaccccacctattttcatggttaccagcttaagtccctgcgaaagttatcatttcacctctgcttctgaccccatggtacgcacctttttttttttttttttttttttttgagacaggttctcgctctttcacccaggttggagtgcagtggtgcgatctcggcttactgcaacctccgcctcccaggttcaagtgattctcctgcccgcagcttctcgagtagctgggtctacaggcacctgccatcacgcctggctaattttttgtatttttagtagagacacggtttcactatgttagccaggatggtctcaatctcctgacctcattacccgcctgcctcggcctcccaaagtgctggtgagatgtgaggccagctggacttcccgggtagagtggggacttgggaaaccttcctgtcttacaagaggattgtaaaacacaccaattagcgctctgtaaaatgcaccaatcagtgctctgtaaaacgcatcaatcagtgctctgtaaagtgcaccaatcagcactctgtaaaacgcaccaatcagcaggattctgaaagtagccaatcgcagggaggattggaaaaactgcactctgataggacagaaacggaacatgggcggggacgataagggaataaaagctggccaccccagctagcagtgacaaccggcttgggtccccttccatgttgtgggagctttgtccttttgctcttcacaagaaaccttgctaccactcactctttgggtccgtgccatttttttttttttttttttttttgagacagagtcttgctctgtcgcccaggctgcagtgtagtggcgccatctcggcccactgcaagctccgcctctcaggttcaagtgattctaatgcctcagcttcccgagtagctgggactacaggcatgtgccacaatgtctggctaattttttgtctttttagtagagagagggttttgctatgttggccaggctgttctcaaactcctggcttcaagtgatctgcccaccttggcctccaaagtgctgggattacaggcgtgagccatctcacccagcctccaatttcatatatgtacatatatcatctgcagaaaaccctgaacttctaccatcacccgtaatttgtcaaacaaatgctttcattgaccacctccattttcccttcttcccattactccagtgatcctctatgatatgtcctccagttctgctactctgttgcagaccactaatgaatagctttattatcaaacccagtgacatatttccacctgtattgatctggactttgcagtatttgtctctatcaagcacaccttgcctgttgcagttttcaacttgggtactatatcagcttccccagatcatgtgaggtcttgaaggttatgtagaagattctagattttatcttaaatgcaatagtaagccagagaaagagagtaagttttggagtgccaagatcgggcttatatctttatttttatttttatttgagacagagtcgcactctgttgcccaggctggtgtgcagtggtgcgatctcagctcactgcagcctccaccttctgggtttaagcgattttcatgcctcagcctcccgagtagctgggattacaggggcccaacaccacgcctgtctaacttttgtattttcagtagagacacagtttcaccatgttggccagtctggtcttgaactcctgacctcaggcgatctgcccgcctcggactcccaaagtgctgggattacaggcatgagccaccatgcccagcccaggattgtatctttaagatatcactctaacatacacatagaaaatggtttggaggccaggcgcagtggctcatgcctgtaatcccagcactttgggagcccgaggcgggaggattgcttgagctcaggagttcaagaccaacctgggaagagaccttgtctctactaaaaatcaaaaaaattagctggggcatagtggtatacgcctgtagtcctagatactccagaggctgagtaggaagagcgcttgagcccaggagatcaaggctgcagtaaactatgatcgtgccactgcactccagcttgggcaacatagcaagactctctcaacaaaaaagaggagctggggagaggatcatgttcatgttcatgttagagggtggttttaaaggtaaatgataaatatatatgtgatatatatataactgatgattgtcttttaacacagtgtctggaatatagtaaatgctcaaaattaatagctttttacattcttaataatagattattgcctatttttactttgtcttcacataaaattcatacacaaaatcaaactcattatattgtttaatcatccaattcttgatcccaccttggtgtctgtcagaaacaagaggattctctcaattaacttgtgtggaaatccaccactccccctcccccattatctgattaatcacaaagattttgatttttttctttgagatacttttttttttttttttttgagatggagtctcactctgttgcccaggatggagtgcagtggtgtatgatcttggctcactgtaacctccactttgcacgttcaagagattctcgtgcctcagcctcccgagtagctgggactacaggcatgcaccactatgcccggctaatttttgtattttagtagagacgtggtttcaccatgttggccaggctggtcttgaacttctgaccacaggtgatctgtccacctcggcctcccaaagtgctaggattacaagtatgagccactgcgcccagctttgagatacttcttatattctgtcttttcctttctgtgttatccctctttctaggaatgctccccattccttctacgcacattttgccctctccatgttgcactctctgtgttcttcagagtcccgccagatctccattccttgaggcctggccttagttttccagttccctatatcaaacaatttctttcttttttttttttttttttttgagacagagtcttgctctgtcacccaggctgtagtgcagtggcaccatctcagctcactgcaacctctgcctcctgggttcaagcacttctcctgtctcagcctcccaagtagctgggactataggtgcacaccaccacacccggctaatttttgtatctttagtagagagggggtttccatattggtcaggctggtctcaaactcctgacctcaggtaatccacccacttcagcctcccaaagtgctggaattacaggcgtgagctaccacgcccagcccctatatcaaacaattccttatctacttgtctaacatccttttttcttctgttagattgtaagcaccattagaacaggcacaatgaactgcatttcttctgccattttttataatgtttcaaataatcttgtgtctagactatgaattgatcaattcatttgtcagtagatagtccacggcttgttaattttcatgactaatgcttatctttgttgaacaaagaatacaaatagaaatttttaccagcaaaagtcataaagacatgagagaaccctaatgtgcaaagttggatgttacaggtcgtaaaatacatctgtttaagacagcttgtgcagatcaatcctagtttttatatcttttaggtggatatttgtaaagccagggttttgttcttacttttcacttgcttttatttttgccctttgttaaacaattataactgtttccttgacacggcagatttcatgtttgaggtttaacttccgtagcttgggcaaaatgaagcagagtgggtcggccaccttaccacagctgtacagagcttcctttagcacaagatcttatcagagtttctaatgaaacatttaataggatgtgtgatgttagcaacagatccctcatggttaggctctctgaatgtatatgtgaaagaacaagggctctttattctgcattgatcaaaatggactgcaagagctgtcttttatgtttgctcttaatgggaccattaagtatactgtgtattgtgaattcatgtaatactgttgggtgtgttataaaaccatggtatttatatctttccctaaggcacagtgtttcatttaacttgctatgggcacctctaaaatgtatccatttattcttcttatctgtccatttcttttttctgtctctttttccatcttagattgtttcttctctcttgtgctctttttcttcacccatttttttcccttgcttccttctttctaaaacctgtttatgtaatggcatgcaaaagaagtaaatttgagtcaccacacatctatctactttaaaaaatgtagatgcttttttttttttttttttttttttttttgagacggagtctcgctctgtcgcccaggctggagtgcagtggcgggatctcggctcactgcaagctccgcctcccgggttcacgccattctcctgcctcagcctcccgagtagctgggactacaggcgcccgccactacgcccggctaattttttgtatttttagtagagacggggtttcaccgtgttagccgggatggtctcgatctcctgacctcgtgatccgcccgcctcggcctcccaaagtgctgggattacaggcgtgagccaccgcgcccggccgtatatgctttttagaagaaccaaattcaagaacttaacagttggatcttctaagtatcggagaatttgaaaaatagtagtattcttgataatgccttaatttttggtggtactggtgttacgaatgcatctatttagtcagttgatcccacagtatgaccttacttgaaagttaaaaggctggatcgcataagctttcattgagcccttttttaacagtgagtttattttgaatttgtttttatgtaggtttgcctcagtgaaatgagggcacatattcggacttgtcagaagtacatagataagtatggaccactacaagaacttgaggagacagcagcaaggtttgtttcaatacaatatagtttaatgctaaaattgataatgtttataaagaatttaatgggctggaaactttaacattcttatgaaaatatttacatatttatgtttatgttcttaactataatacctggtactggtaatcatttgttgatagcaatcattgttaaggaattttgcactgtctactttaaaaatttccaggggtaaccaaccacagactggagagattggggcaacttcctcaaacaagtttgtgttaacacagatccaaaaatagaatgcagaactgttacatttctgctaggctttgttttctaatagattcctgaagtagattgtgtttgggattatccatcttctgtcaccactgctcatttcaccagctcattccttatcattttgcttgtttctctttagaatatagacagcagcatctcagtatacaagagaacaggctgggcaggcatcctgaatcctttgcctttttgatgggtaatctcgtatgggggtaggggaaagatggaggtagctgacagatgtaatggaggatattgatagtattttattctttaaaaaaagagaaagaaacattcgtggggtgtggtggctcacacctgcaatcccagcactttgggaggctgagacgggcagatcacttgaggtcaggagttcaagaccagcctgggcaacatggcgaaaccccatctctactaaaaatacaaaaattagctgggcgtggtggcgcacacctgtaatcccagctattctggaggctgaggcacgagaatcacttgaatctgggaggcagaggttgcagtgagctgagatctggccactgcactccagcctgggtgacagagcgagactctgtctcaaaaaaaaaagaaacacatctaagtcattattctcctgatgagaaaggtaatttagctgcatcagagtaattataaagtttgtaatctgcccctactaaccaaataaagtgatctgtgctctctagcaaagattgatggctttccagccattaatctgcctatggattcatgtatccaatattggtattctgtataatttctctctcccagagaaaaatgttagctctgctcatttttagaaaatatactcaaaatatagcttacatttctaaacctaaaagtctaaacaatcacctcattctttttgttttactagagatcgccttgcaaaagtacctattattataggattagctttataccctgactttataaatttcaaatgagtattttagctataaacagagtatggatcctgttagattgaccacaatgaccaataggaaggaaggattaccaatgggttgagaaagtgtatgggtttgattgcaaggttgatggcttttatgaaaatttaaaaatatatgaaagctaatttgaatcccaatttcttttactcattagaattaaatagtaaagaattaaaataatagaaaatggagagggttgttgattattttacaagatatattaatattttgatttatgataaaaatctttgctttacagaagaatttaccacataattcaaattttaaaaattcttacacctagagtttgtccagagtacaagttttgggggacaagaagttacatctgtaacagaaagtgagcaaacaactccaagactccgtattgtccctaagaacttaaggcagtgttgtccagtagaaatataatgggtttttttttttcttttcttttcttttctttttgagatggagtcttgctctgtcacccaggctggagtgcagcagcgcaatcttggctcactgcaacctctgctgcccgggttcaagcgattctcctgcctcagcctcctgagtagctgggattacaggcgtgtgccaccatgcctagctaatttttgtgtttttagtagagacagggtttcagcatcttggccaggctggtcttgaactcctgacctcgtgatccacccgtctcggcctcccagagtgctgggattacaggcctgagccactgctcccggcctagaaatataatgttaatcacatgtaattcaaaattttctagtagcgacatttaaacaaataagaagataaagtttaaattacctttcaatatattttatctaacctaatattgccaaaatattatcatctgaacgtgtaatcagtataaaaattatcaagatattttacattcttttttctttttacattaagccctcaaaattcagcgtgtatcttatacatccagcaaatctgaatttttttattttttttgagatagagtttcacgcctgttgcccaggctggagtgcaatggtgtgataccagctcactgcacttctctttaggagagaagtgcaatctgagcatgcattaactgagaaactgagtattgcagcacccagctgtccttggattaccttttccttcctccctttccgaattcacataacatttagatggggtgttatttgttttccaacttcactagcatataactatgtgcatcagcctatattgttaatttccagtgaagaaggaaaagtgacctgcagtccgggcgaggtggctcacacccgaaatctcagcactttgggaggtcaaggcgggtggattgcttgagctcaggagtttgagaccagcttgggcaacatggtgaaactcctacctctattaaaaatacaaaaaattagcatggtggcatgtgcctgtggtctgagctacttgggaggctgagacaggaggatcatttgagcccaggaagtggaggttgcggtgagccaagattgcaccactgcactccagcctgggtaacagagcgagactccctctccaaaaaaaaaaaatagaaagaaagacagaaaaagaaaagtgacctgcagctaccttattaaatccttatgtacacttaggaatatttgtcacttatctgtgctgtccaagatgtgtccactgggcacttgaaatgtggctagtccaaattcagatatgtgaccaggtgcggtggctcacgcctgtaatcccagcactttgggaggccgaggtgggtggatcaccttaagtcaggagttcgagaccatcctggccaacatggtgaaaccccatctctactaaaaatacaaagattaacctggtgtggtggtgggggcttgtaatccctgccacttgggaggctgaggcaggaggatcccttgaacccgggaggtggggaggttgcattgagctgagatcatgccactgcactccagcctgggccacagagcaagactcttgtctcaaaaaaaaaaagaaaaaaaaagtgactactatctagttgccaaccattttaatattatttgtattctgtgctatttccaggtgtgtatgtcccttttgtcagagggaactgtatgaagacagcttgctggatcattgtattactcatcacagatcggaacggaggcctgtggtaaggatttttgttacatgtattacagcaatgtctgaattcaggacacattaggaaatccatttaatagatttatatttatagataccttataaaggataattatttaagttaaggttatggtaactctgtgactgtttacaatgtgtgaaagtgttcagttgaaactgataagaacgactaatgtgtaatcactcatttatgaaattacacattatctctaacaggtaatcatgggcataatcaactaaaatgatccaaaatgcacagttaagatctaagtttaccagctgggccaatatggtgaaaccccatctctactaaaaatacaaaaactagctgggtacattggcgggcatgtgtaatcccagctactagggaggctgaggcagaagaatcgcttgaacctgggaggcagaggttgcagtgagccgagatggagccactgtactccagcctgggcaacagagcaagactgtctcaaaaaaaaaaaaaaaaaaaaaaagagaaagagagatctaagtttagtacactaactatggttatagccatgtttagaacatttaaaaataatgcaaataaggctgggcgtggtggctcacacctgtaatcccagcactttgggaggccgaggcaggcagatcacgaggtcaggagattgagaccatcctggctaacacagtgaaaccctgtctctacttaaaaaataaaaaaattagccaggcgtggtggtgggcgcctgtagtcccagctactcaggaggctgaggcaggagaatggtgtgaacccgggaggcggagcttgcagtgagctgagatcgtgccactgcactccagcctgagcgacagagcgagactctgtctcaaaaaaaaaaaaaaaaaaaatgcaaatagtgttattatgacactacactagaaacaaaaagtagtcattcatcttcattaatgtgtcgttttattcatggttaatatttatccatatgtttgtatggtaaatgtacatattgctcattatttcctatattcattgtgaatgatgctttttccttttcagccttggcgttttagttcttctttgtagagtggcttttataattttcatttttgtatagttgtgaggtaaggcagagtggatacatcattgtttacttaagctattttatttttatttttttgagacaggccatagtacagtggcgccatctcggctcactgcaaccttgacctcccaggttcaagcgatcctcctgcctcagcccctcaaatagatgggactgtgggcacgtgccactacacctgcctaattttttgatgttgttgttgttgtttttagacgtgctgtgtcgccaggctggagtgcagtggcttgatcttggctcactgcaacctccgcctcccaggttcaagccattcccctgcctcagcctcctgagtagctgggactacaggcgtgcgccaccatgcccggctaattttttgtatttttttgatagagacagggtttcaccatgttggccaggatggtctcgatcttctgaccttgtggttcgcccacgtcggcctcccaaaggctgggattacaggtgtgagccaccgcgcctggcctggattgttaaccagtttttagaatttgagttcatattcttgtatgcttaaacttttccttatattggaatttttctaagaggaaattccttacattattatttctgcaattaataatgcagactttttattagctcttgaaatgtacttttaaagtgctttccaaaaagtctgagtcaatttatatttgtgtcagcaatgtatgagtaaaccacttttaccttaatctgaccataattgggaacatttatttttaatttaccctggctcaacaaatataaaatgatactttgaagattattttatgtagtatgtagttttatgtaatatatacacaaatgtgtgtgtgttgttttctcatatgagtttttaggggtttttaattttagggttttttccataaaatcctttcagaaagtggatgaaattaaaacataaatatattagacaggtaggtagatagataatggatagaaataaagatgatagagaataaagagaaagatacagccgggtacagtggctcacacctgtaatccaggactttgggaggccaagtgggcagattacttgaggccaagagttcgagaccagcctggccaacacggtgaaaccccgtctctactactaaaaatacaaaaattagcaaggcatggtggcatgcgcctttagtcccagctactcgggaggctgaggtgggaggattgcttgagcctggaaggacggaggttgaagtgaactgagatcgtgccactgcactccagcctgggtgataaaacaagaacctgtctcaggccgggtgcagtggctcatgcctataatcccagcactttgggaggctgaggcggatggatcacctaaggtcaggagttcaagaccagcctgaccaacatggtgaaaccctgtctctactaaaaatacaaaaaaaaaaaaaaaaaaattagccgggtgtggtggggggcacctgtaatcccagctactcgggaggctgaggcaggagaatcacttgaacctgggagacggaggttgcagtgagctgagatcacgccattgcactccagcatgggcaacaaaagcgaaactctatctcaaaaaacaaacaaaaaaacccaaaaaaacctgtctcaaaaaaaaagagagaaaatcctcacagcaatcctatgagataggcttgatgattatccccattttaaaaatgataaactgagactcagagaggttaagtcaatcatacaaggtcacacagctggtaagtaacaaagacagaatttgaatacagtgatctagctccagggctgtgtgggaaacccctgtggtctatagcaagttcaagagaaaagcatgcagagatatttgttattgatcttaatggcctagggagttggcaattggaatggctaagtaggagcttgttaggtgttgagggagcagagccgatggtcacgggcttttcctgctcaagttgctctgtaggaggaactgggctagggagttgtttcacaataggtccctggggagctagaggaagttagaagaaagcataaggatggaatgatagtgactactatcactgagtttactgagttataagtattttcttgtctcctagcaactctgtgaagaaggttgaaccctgaccattagtacccagggtgctgctttggctggaagaatgccaggccctctggactgtggtcctaggctgcatctaagcagcaatctggggcaggccgtgtactggtcagttccgtggtactgtgtacctgctccagcagaaatccagtccacatgctgctcagtttggcccaaattgaaggtggcccatgaagctaggtcctccatgattttacaggtcttcagggtcattgaagacagctgacctaagcagggaaacaaactaggaatggtggaatcagattgcctgtgggattttgtagttaaatcctaggctttaaaggggataggcttggttctaatcccaggaagtctattaaattctgtcactgtttcatcatttgtaaaatggggatggtgatgacattcatgcctttttcacaagtagtaaatgaatcaggcatataataaagtaagcactctgtctcctggtgatcactccattaatagaagagggtggtggtgatagtggaggttcactacactttttcaattctataaaatcaggcctagagaagatttcttagaggaagtgatgtcctctcacagttagagaacccacatggggtggtggtgtgagtcgggggggtggcggggaggaggaggatggggaagtgaagtggtaaaatctcaccacaaagaccaggatgctatcatggccttgaagcaggagcagattgttcagaaatccaaggttctgtaataccctagggctgtctagaggtggtaattggaacacaagaccttcaggtgtcctgtgttagtgtttcactcttgagcagaagctcaggagcatgtcactctgaaggatctagagccactagaagtcatgatttaccccatggttaggaaaaggcaggggacagatatgtggtatagctggggttcacgtgcttaggggtccctaatggggacatgtgggtgaaaacacactgagggaagtcctgggcaaggagggctgggtccaatgctgattctggatgggtgtggaagttaaccaggaattattgctttaaaggactggattacaggttttgcaagcagataagatcagtgacatcatctgacttacctcacataagaggtttcctggcatttagagatttcctgggtaaatgattcttctgacttccaaaaataattagataactcagagatcaaaccacaagataaccatcttttctttctgagctgctcaagaatgataaaatgtttgttaaaaacatcaggggattttgacttttcttatatgcatccttaagagccaatagctcctttttgtcaagcagtaattatattgttatattctgccattttttaaaatttggagacagggtctcgctctgtcacccaggccggaccgcagtggtgcagtaatagctcactgtaaccttgaactcctgggctcaagtgatccttacctcagcttcctgagtagctggaactacaggtgtgcaccttcacaactggataattctttaattattatttttttattttttatttttggtaaagatgagatcttgctatgttgcccaggctggtctcaaattcctggcttcgagctatcctcccaccttggcttctgaaagcattgagtttacaggcatgagccactaagctcggttatttatttttttaaataataattccatctctggaatattagactcgaaggaagcaggtgacacaaacagcatgctttagactgaattatgagaccactttttttctttttccttaaatgtagataacattaatgagaccacttttgagagaaatgtattttattctgtaaagggaagatgttttagcaagaaccttgccctccagctagtctctcggtctagagtgcttttttttttttttttttttttttttttttttttgaagagacggtgtttcatcatcatgttgcccaggctgagtctcgaacttgtgagctcaagcgatctgctctcctcggccccgcaaagtgctgggattacaggcatgagccaccgcgcctggcctcaaagttctctttctttcactggttggctcttactcatcctttggagcttagcttaaattttacttcctcaaggaagccctccctgatactcattaatttcagcttttgcttttctcccctctacttttcagtatttaccacaacttataattgcatattcatttcatgtctgtctctccctctaatttattaggcttatggagtcatgggacctaagtctttcgtttaacactgcatgcccagttctttgcagagtgcctagaacatagcaggatgtagtgatgtggaaaaaagatagtaaagaaagacaggctgggcgcggtggctcacatgtgtaatcccagcactttgggaggccaaggcaggtggatcacctgaggtcaggagttcgagactagcctggccaacatggcaaaaccccgtctctactaaaaatgcaaaaattagctgggcatgttggcaggagcctgtaatctcagctactcaggaggctgaggcaggaatcgcgtgaacccaggaagcggaggttgcagtgagccaaaatcatgccattgcactccagcctgggcgacaagagcaagactcagtcttaaaaaaaaaaaaaaaaaaaaaaaggcatgattccattcaccctgattcaggggttccagtgagttctatattttctttctttttttttttttttgtttgagatagagtcttgctctgttgccaggctggagtgtagtggcgtgatctcactgcaacctctgactccctggttcaagcaattctcctccctcagcctcccgagtagctgggattacaggcatgcaccactgcacccagctaatttttgcatttttagtagagttggggtttcaccatgttggccaggatggtctcgatctcctgaccttgtgatctgcccgcctcagcctcccagagtgctgggattacaggcgtgagccaccacgtccagcctgagttctatattttcaatgttaccctgggggctcattccttaaggaagggacaggacttttggtttgaagtgtaaactgtgatgattacatcctgggctacccctctccatagcagttaatttccgtgagtacttagaatatctgtgacttgatgcgacagtggagatctatgtggtaataattctggaaggaaaaaaaaatctccaatagatttgctttcagtggccgggtgtggtggctcgtgcctgtaatcccagcactttgggaggctgaggtgggcagatcacaaggtcaggagttcaagaccagcctggccaatatggtgaaaccccatctctactaaatatacaaaaattagccaggcacggtggcgcgcgtctgtagtcccggctgctcaggaggctgaggcaggagaattgtttgaacctgggaggtggaggttgcagtgagtcaagattgtgccactgcattctagcctgggtgacagagcgagactccatctcaaaaaaaaaaaaaaaaaattaggtatgcagtcttgtaccttgattttaattacataggtgcctgtgaatattttcagtgcatgttccttttttcttctttgggtattggattgagtgacctttaattacctcctcaaatggcacttgtcatcacatgggaagtgttctataatcagctgagttgctgtggaggttaatctaagccacagatagagcggagtgtccattatcatagatattctgaaggatcgaatcctttgcatcttggaatggctgtaacatgagtgcactgttgtccagctcttttacacttgtactcctagagtcatcttctgacttcaggagaacttgatagaacatgctgttcactaaggatcattgatattagattgcatacatagtacttggcaactgaaatccctcaacagtaaaatatggtgttcttgcatatatgctattagaacttaagaaaagggtaccagaaaaaaattaagttctgacacacttattttctattaaatattaaatcagtcacgcacagactttagaaatggaattcaagttttatagtagaaaatagatgtcattggctgggtgtggtggctcatgcctgtaatcccagcccttcgggaggccgaggcagggagatcacctgaggtcgggagttcgagaccagcctgaccaacatggagaaaccccgtttctactaaaaatacaaaattagccgggcatggtggtacatacctgtaatcccagctactcgggagactgaggcaggagaatcgcttgaacccgggaggtggaggttgtagtgagccgagattgtgccattgcactccagcctgggcaacaagagtgaaactctgtctcaaacaaaaaaaaaaagaaagaacatatatgtcattcacagtgaggactgtcagacctgcactgagtatgattattttagggattccctataacaatacaaaaatgggggaaaactgtcaactgtaggccaactcttcaggcatagtggctcacacctgtaatcccagcactttggaaggctaaagcaggcagatcacttgtggtcaggaggtcaggagttcgagaccagcctggccaacatggtgaaatcccatctctagaaaaaatttttaaaaattagccaggcacattggcgtgtgcctctaggaggcaggaggattgcttgagcgcgggaggtagaggctgcagtgagcagagatcgcatcattgcactccagcctgggtgatgggagtaaaaccctgtcttaaaaaaaaaaaatagaactggaaagccaactaccctgttggttatgatctgtcagtaatattgcctttattcttaatgggataagggaggggtgtcttattgaaaaccctggtaaggaccagttcagaaagactagggggggagacagggtatttgactccatgtatccatgaagcagtatcaactccatttctgtggctttggtgtttggtgtgagaaactttaggaaatgcatcctaatagacctatgttagatgctctcacctatgatcctgatgatcaaagctcatatgatcatgcctgtgaagacatttgtacttttttttttttttttttttttttgagacagagtttcactcttgtcacccaggctggagcgcagtggcgtggtctcggctcggagcaacctccacctcctgggttcaaacgattctcctgcctcagcctcccaagtagctgggattacaggcgtgcgccaccatgccggctaatttttgtatttttagtagaaacgtggtttcaccatgttgaccaagttggtcttgaactcctgacctcaggtgttcctcccgctgtggcctcccaaagtgccgcgattaccggcatgagccaccgcatctgccctgtacattttatgtattctcagaagcccttacattggtgattcctaatattttctctgtcccatcacatctaaaaaatataatactgaacaaaatcattcttatttttccataagtaatagtgatgcatgagagtggtgagaactcctctggggagaaaatatggttttatcagaatttagggaaggaaagttatatcattgaaaaagaattctcatctgattctgtgtatcaactattcttctcccatttctgacctgcccaagggctctgttgtaggaactgatgtgaagtagaagacatttggaaaaaacaaaaagctagcaaaaatctgtcagaagagaaagaaaagtactagaaatctttttcccaaaaaggaattctttattcatgaggtgtctactgtgtgtcaagttatgctaggtctaggcataaggaaataagataaatatgatttgttcttgccctaggatcctttattccaaggaagaagaaaatttgaataaaatatatattatctaatctgcaaagtatatattttattcctactttagatatgaaaaattgaatttgagcttctattatgtgccaaatcctatgcaagctaacatagcaagaatttaggccagctgcagtggcttacacctgtaatcccagcactttgggaggccgagctgggggaattgtttgaccccatgagttcaaggccagcctgggcaacggagcaagaccctgtctctacaacaacaacaacaaaattagctggacccggtggtgcacgcctgtaatcccagctactagggaggctcaggtgggaggatcccttaagcccaggagtttgaggctgcagtgagctatgatggcaccgctgcactccagcctgggcaacaaaaggagaccatgtctctaaaaaaaaaaaaaaaaagaaattagaccaagttattcttatttagtttttcctgttccaacatcttgctcccggtattcattctcacactgctataaagaactgcccaagactgggtaatttagaaaggaaggaggtttaattgactcacagttgcacatggctggggtggcctcaggaattatggcagaaggcaaatgggaagcaaggcaactttttcacacgcaggagagagaatgaacgcgggaggaactaccacacacgtataagaccatcagatcttgtgagaactcatttttatgagaacagcatgggggaaactgcccccatgattcaattacctacacctggtctctcccttgacacttggagattgtggggattattaagagaacacttaggccaggtgtggtggctcatgcctgtaatcccagcactttgggaggccaaggtgggcggatcacctgaggtgggtagtttgagaccagcctgaccaacatggagaaatccgtctctactaaaaatacaaaattagccgggtgtggtggcgcatgcctgtaatcccagcttctcgggaggctgaggcaggagaatcgcttgaacctgggaggcggaggttgcagtgagccgagatcatgccattgcactccagcctgggtaacaagagtgaaactccatctcaaaaaaaaaaaaaaaaaaaaaaagaacatttaaaaattaaaaaaaatttaaaccctaattttaagaaacttaagaaatccattattatttctggctgcctttataaaagacactttgtttttaacgtcatataggactttttttttcctggaatttgcaaggattcttactctcttcagtattcctgaaaatgaaagtaagtggctcacataggaagaaggagagatttcgtagactttctgtaaagtgaacagacttcaggtactgactcctcgtaaatctagactgttataaaattgccctacaaagctctgagaaaatgactcacatgaataaagaggaaaaggactggcctggcgtggtggctcccgactgtaatcccagcactttgggaggctgaggtgggcagatcacctgaggtcaggagttcgagaccagcctgaccaatatagagaaaccaccccccatgtctactaaaaatacaaaattagctgggcatggtggcccatgcctgtaatcccagctactcgggaggctgaggcaggagaatcacttgaacccaggaggcagagattgcgttgcagtgagccaagatcacgccgttgcactctagcctgggcaaaaagagcaaaactccgtctcaaaaaaaaaaaaaaaaaaagacaattatagaaaaaaagataataacattaaacaataaaaaagagcaaaactccatctcaaaaaaaatttaaaaaaaagagcaaaaggagtgggaagtttttctaattctcatggattacagtaggagaatgagaacaggtgcaaaagaaactcaatgcacttggctttatgccaacaatgatttttttacacagcaaaaaattacaaaccttcttccttacctctcttcctcaagcttatacataatagacatacagcagcatttctatttctacattatacttgggctgtttatagtattgagctaataaagatttttacacagtcgtagagaaaagggtcctcagaggtgatctaatgtagcctccctctcaaggtgataagtaacttactgtgtgagtgcttgaagttttccagaatggtaacccagttattacaaggattttgtttctacacctttcaacatcttaatttcccttctgtgtctattgcagtttattgatgttttccttacccagcacttaaaatagaacacagcactccaagaatggtcagtgaatgcagaacagaggaaacaaccattattctagataattgaatgttatccatacagcactgtactagcttttttatgattgagtcatatttctggcctaattatgattctcagtaaaatagaaccccaaatgacttttttttttttttttctgagacggagttttgctgttgttgcctaggctggagtgtagtggcgcgatcttggctcactgcaacctctgcctcccgggtttaagcgattctcctgcctcagtctcccgagtagctgggattataggggcatgcctccacacctggctaatttttatatttttagtagagacggagtttctccatgttggtcaggctggtctcaaactccttacctcaggtgatctgcccacctcagcctcccaaaatgctgggattacaggcatgagctaccgcgcctggtccaaatgactgttttttttataggtactggagttaagaaaggtgttctccattacagcctaggtattagatttagaatttctcatttgttcgcctactattttatcttgtttctctgaaagaaattatattgtctttaaggcggttgttctcaaactttatcatgcatgagaatcatctacaagacctgtttaaacatagattgctggcctctgcccctagagtgtctgataaaataggtctgagctagggcctgaaaatttgcatttctaacaagttaccagatggtgacaatgctgctggtctgaggaccccacgctgagaaccattgcttcctttaaagcgctaaagtggccaggcaccgtggcttatgccagtagtcccagcattttatgaggccaaagtgggagggttacttaaagccaggagtttgtggttacagtgagccatgatcataccattgcactccagcctgggtgacagagtgagaccccatctctaaaaaaaaaaaaaaaaaaaaaaattaaagggcaagtgagaagtatgaccatatatgtactttcaatttttgtggatgcatagtaggtgtatatatttatggggcacatgaaatactttgatacaggcatgcagtgtgtaataatcacatcagggtaaatggcatacccatcaccttaagcatttatcctttctttgtgttacaaacaatccaattatactcttttttttttgagagggagtctcgttctgtcgcccaggctagagtgcagtggtgcgatcttggctcactgtgacctccgcctctcaggttcaagggattctcctgcctcagcctcccaagtagctaggactacaggctcatgtgaccacacccagctaatttttgtatttttagtagagacagggtttcaccacgttggttaggctggtctcaaactcctgacctcaggtgatccacccaccttggcctcccaaagtgctgggatttcaggcgtgagcccctgtgcctggcctatactcttaaatgtacaatacattattgttgactttaattgccctgttgtgctatgaaatgctaaatcttatacattctatctaactatatttgtgtacccattaaccatgcccacttcccccaatccccactacccttcccagcctctggtaaccatcattctaccctctatctccatgagttcaattggtttaatttttagctcccacaaataaatgaggacatgtgaagtttgtctttctgtgctaggcttatttcacttaacataatgtcctccagttccatccatgttgttgcaaatgacaaaatctcattcgtttttatgactgaatggtactccatatgtaccatgctttctttacccacttgtctgttgctggacacttaggttgtttccaaatcttgactattctgaatagtactgcaataaaaatgggagtgcggatatttcttgaatatactgatttcctttctttggggaatatacctgggagtaggattgctggatcatatgatagtttgattttcagttttttgaggaacctctaaattcttctccgtagtagttgtactaatttacattcccaccacccgtgtatgaagtttcccttttctccacatcctcgtcagcatctgttattgtgtgacttttggataaaaaccattttacctgcggtgagatgatatctcattgtagttttgatttgcatttctctgatgatcaatgatgctgagcactttttcatatgcctatttgccatttatatgtcttcttttgagaaatgtctgtttaaatcgtttgcctgttttaaattgaattactaatttcttttcctgtagagttgtttgcactccttatatattctggttattaatcccttgtcagatgaggagtttgcaaatattttctcccattctgtgggttgtctcttcactttattgattgtttcctttgctgtgctgaagcttttggatgtgattccatttgtccattttcgctttggttgcctgtgtttgtggggtattattccagaaatctttgcccagatcaatgtcctggagagtttctccaatgttttcttttagtagtttcatagtttgaggtcttagattcaagtttttaatccattttgatttgattttgactatttttttttaatttgatactatcttgaccagcattgaataatctatatcctaaggatttagaggaataattatcctttcaaaagaatcttcctcatctgatcaaaaatggaaagaaacatctgtttccacccacatcaagtgttgttttgtttcaatcctattaaagcagccttggtcaggagatctttccccttttcctagcaagaggatttctttggtcctcaatttggtcatttgtaaaacaaaggtagagaaaatctactcaatgattttggttatttttggctttatggtttcttgaaaagaaagaacaataaatgaagattcattgcatagaaagggcctatttggagtcaacatgctcaaggccaggaaatagaaaccacagggctaaggggatcaactgaaggcatcagtaggatgaggtgaagctcttctaagctgccaggtcacaaatcaggacaggcagatgtccggtccctgacacactggcctgcacagtgaatgggctgtaagcttatccactaaagacctgtcattgttgcgggtgggttggtgggagcataaggacatgataatatcaccatgtctagtaagtgggaggctaatcttagaaacagttttcaattctttgaagttggtagtagcttctaatatggtagctattatttgcccattgcattcaccatcagaaaaagcccatacagagatgaagccagcatattttgaatgtacactgtatagttgttggctcttaatataagtagtatagcctgggagcattgagtagagacaagtaagaaaggatgagctgatgttaggaaatggacaacattgagtataagtcaatacttaggtaatcttcagtctgtctctcacctaccatttctttctccttcctattcttaccctctcttccctcaggtttaatctcccaatttaagaaacaaaagaagtttttccactagtaccgacttcagcccattgttttgcaatgtcgttttgacagatgtgtctttagtcacacaattaaattttatgttgaccagagactgaagactccactagttgcctattaacgtcagactaacaatggcttgcacctgtaatcctagctactcaggaggctgaggcaggagaatctctggaatctgagagttcaaggccagcctggtcaacaaagtgagatcccgtttcaaaaacaaaacaaaacaaaatcttgtttgcttaaaattctagtttttttttcagacagtcttgctctggcgcccaggctggagtgcagtggtgcgatctcggctcactgcaagctccgcctcctgggttcacgccattctcctgcctcagcctcccaagtagctgggactacaggcacccgccaccacacccggctaattttttgtatttttagtagagacagggtttcaccgtgttagccaggatggtgtcgatctcctgacctcatgatccgcccaccttgccctcccaaagtgctgggattacaggcgtgagcccccgtgcctggcctaaaattccaggttttctgtatttgtcttctccactagactctaatcagctccttattggtagggaccaaggtaacagacatctctgtacctctgactccttgcatcaagtctaccaaaaccatgtcaggtgcttgaataaatatggagcagagctagttccaacttatcattccaaactcatcccctaccacttccccaactttccctaccttcagttacactgaggtttttccattgccctaagcaggcctctttcttttaggatttactgccttttcccacgttgattcctctgctgtgatgctcctccctgctggcctggctggctcattcttcaagacccacttcagttaccagcagctctgctggagcctttccgaacccttgggcaaaattagtaattccctttacagatcttgaacagttgtctgttcacatcttgagtatggcacttgatacactattgaaagtatctgcttaagtgataataatggcagctaaagactgagctaatataatgactgagctttataatagtaaatggtgtattattttaaatctaacagctctgagacacagaacatcagcgagaggctgaaatgaaatcggaaactattttctgggtactaagaatgtagggatcaactagacacatggtagtttcttccctcagggagccccaactcttcaaggacagggatcaaatagtagtaaatatgtggcatttattgaatgtttgatgtttacctggcacactgaagacattatctgtaaatattacagctactctacaaggcaggtgttattatctccatttcacagaaggggaaacttatatgctcaagatcacactgctggtgctaggatttgaacccaaagtatctaacttcaaagtatcctactgatctctatattctaagtgcggaacacgtagtaggggcataataaagagtgttggatgaacaaatttctataagcaggttccttctcccacactacaaatattaatagtgctcttttgttgaaatatttcttggtctcagctctgttctcattatacatagtggcatcagggaaaattaaatgctgtcttggaatgaccagtagtgccaattaaccaagaacattaggaaattgtaaatgattataattcaacaataattaattaaaaggatgtaattttactaaaaataagatgtaaaaattagcgaagttgagcaaaattcagaaatagacctttaattatagaaattgagcatattgaaactgagatcctcataaaacaataagaaagaaaagaaatatataaagacctcatttaaataaagaaaaacattatcacccaagttgataaattggacactgttagaatgtgaaaagaacattggaggatcagcgacattgattccagatctgatacttacagctgagtaaattcaagctatttttttttctctctgaaattgggctcatcaacaaaataaggatagcaattaattcactgagttgttgtgaggatcaaatgagaatactacctaatttactacctaacaacacatacttggcactcagtaataagtctgcatctcatactttaaaaaatgaatacatgggccgggtggggtggctcatgcttgtaatcccagcactttgggaggcagaggtgggtagatcacctgaggtcaggagttcgtgaccagcctggccaaaatggtgaaaccctgtctttactaaaaatacaaaaattagctgggcatggtggtgggcgcctgtaatcccagctacttgggaggctgaggcaggaaagttgcttgaacccaggaggcggaggttgcagtgagccaagaccatgccattgcactccagcctgggcaacaagagcaaaactcaaaactccatttcaaaaaaaaaaaaaaaaagaagaatacatgaataaatataattttaaaaaagtgaacctttgttaaaatgtgataaagtaatatatgttaaaagagttatttatattagccatcatagaagtgcaaattaaaaccatggtgagataccagtacacgtttaacaaaatggctcaaataaaaaaatttggacaataccaaatgttggggaaaataaagaaaaactgaataattcatacattgctggtgggaatgtaaaatagtacagccactctggaaaacagtttggcaatattttacaaagttaaacatatacttatcatataaccaggcaatcacactcctgaaaatttatcctagagaaatgaaaacttaatgtttatgcaaacatttgtacacaaatatttcttggagctttatcttaacaaccaaaaactggaaacaacccaaatgccctttacaaaataaatggataagcagactgtgggacatccatacatgaaatactactcagtaataaggagggagctatggatacacccagcaacttagatggatctcaaagtcatgctcaatgggaaaagccaatctcaaaaggttaaatactgtatagttctatttatataagtttctcgaaatagtaataataataatatggggaacagagcagaggttagggagagagaaggaaataaaggatagcaacgcactgacattcctttgcagtgacagaatggtctgtatcttttttttttttttaatccatcaagtccttttttttttctttttgagacagggtctcactctgtcatccaggctggagtgcagtggtgcgatctcggcttactgcaacctctgcctcctgggttcaagccattctgctgcctcagcctctggagtagccaggactacaggtgtgcaccaccacgcctggctaatttttttgtctttttagtagacatgggttttgccatgttagccaggctggtcatgaactcctacctcaagtgatccacctcccaaagtgctgggatgacaggcatgagccacggcgcccagggattacacttcaacatgagatttgggcggggacaaatttccaaactatatctcacacacacacactgaaaaatatgagtacaggcaaaatctggtgaaatctttttctttttctttttttttttttttttttttttgagacagagctggtgcctcggctgcctgagtagctgggattacaggtgctgccaccatacctggctaatttttttgtctccacacccagggattacatttcaacatgagatttgggtggggacaagtttccaaactatatcacacacacacacactgaaaaatatgagtacaggcaaaacctagtgaaatcttttttcaagcaattctcctgcctcagcctgccaagtaggtgggatagcaggcaggtgtgcaccaccacgtctgactcatttttgtatttttagtagagacagggtttcaccatgttggccatgctggtcttgaactctgggcctcaagtaatctacctgccttggcctcctctcaaagtgctgggattacaggagtgagccaccgctcctggccaacgttcataattgttgacctggtaattgccatttctggtcatttctcctaaggaactaatcccctaaaaggtaaacactatagttattctcatttgtgatagtaaaatatccatatacaaacaagtattccaagaggtaggcaaactaattaagtaaattatggtacatgtattaattgtaatattgtttaaataataaattgatgaatatgaaacaaatagttatattgttatgtatgcatatgagcaagaaatgcatatgaagacatgtaattttatttgcttaatgttgctttcatgtttatgcaattttataacataatactgaggtatggctaatggatgaataaagttgacagtttatttttgaatggttacctgttgttgttttttgttgttattgtttgttttgttttgtcttgttttttgagacagagttttgctcttgttgcccaggctggtgtgcaatggcaagatctcggctcactgaaacctccgcctcccagattaaagtgattctcctgcctcagcctcctgagtggctggcattacaggcatctgccactgcgcccagctaatttttgtatttttagtagagacagggtttcaccatcttggcctggctggtcttgaactcctgacctcgtgatccacccgcctcaacctcccaaaatgttgggattataggtgtgagccactgcaccccgtcttgttttgtttttttgtgtgtcggagtcttgctctgtcgccaggctggagggcagtggtgtgatcttggctcactgcaacctctgcctccgggttcaagcaattctcctgcctcagtctcccgagtagctgggactataggcacgtaccaccacgcccagctaatttttgtatttttagtagagacggcgtttcaccatgttggccaggatggtctccatctcttgacctggtgatccggccgcctctgcctcccaaagtactgggattacaggcgtaagccaccgcgcccagccgttgtttttaattctaacactaataacgattttaaattctttcttgaacccctggtcttgtttgtttccagttctgtccactttgccgtttaatacccgatgagaatccaagcagcttcagtggcagtttaataagacatctgcaagttagtcacactttgttttatgatgatttcatagtaagtatattttcttatttttacattatgttttcatgctgtcttgttaagcttacctttccgatccaagtgaataaaattatagaggaaaaaatgtgtatatagctatagtgttgagtattagcattaagtaagaaatcatgaaaatagaatgttttggcctggtgcagtggctcacgcctgtaatcccaacactttgggaggccgaggtgggcgaatcacttgaggtcaggagttcaagaccagcctggccaacatggtgaaatcctatctctattaaaaatactaaaaataaaaaaattagccaggcatggtggtacacgcctgtagtcccagctactcggtaggctgaggcaggagaatcgcttgaacccaggaggcagaggtttcagtgagctgagatcacaccactccactccagcctgggcaacagagtgagactttgtctcaaaaaaaaaaaaaatgaaatgcaatttcaagataaaatttaataacgattgaagattgtcatttgagaattttctccatgctttctatctgccaattattattatccaggttggatacaaggagctcaggttctaaactagttttaagcaatagctctgtcatatatgtgcgaccttgcagaaggtatttaacctcggaaactcagtttgtgcactggttaagggaagagattaaaagcacctactcccaaaattcttcttaggattaaatgagataatgtatataaagtgctttgcacagttcaggtgcagatgttaggcaaattggagatgggatgggagtagaattgttaggaccacttgaggaactgaacaaggaacatgacagaggctttaaattctcagctccatatctctaagcatgtcttttgtggcccatatggcacacaggcctcaacagaacttggttctggtctatgtgttctctctggtaatacaaagaggtttctcttggccgggcgtggtggctcacacctgtaatcccagcactttgggaggccgagatgggcggatcatgaggtcaggagatcgtgaccatcctggctaacacggtgaaaccctgtctctactaaaaatacaagaaaattagttgggcatggtggcgggcgcctgtggtcccagctactctggaggctgaggcaggagaatggtgtgaactcgggaggcggagcttgcagtgaaccgtgatcgcgccactgcactccagcctgggtgacagagcgagactccgtctcaagaggtttctctttaccttagctctatgaggtgttctaaaagccaggtcgattctatggctgttctgtctaatcatgctcagtctgttctcaagatctttcagacaaagcatgatccagagctaggcaggatgaagccactttgataggaatactttccagccactcacagccatattcttgggtagggaagtgaactggaagtagtgttctttgttttgattttttgcttcctgagctactatatactaagctaagcactatatgtatatatcacattttattccttgtagcaacttccgtgaagtgaatactgtatttttatcttcatttaactgaaatatctgaagctcaaaggttaactgaattatctaagaacaagccagtatcaagaccaaaccttgtgttctgctgtactttatgactttcctttggattttgtgggggtttttttgttttgtttttatattgcagaatggactttgaatagagatttcaccttttgttattgcggaagaggagagggattgcagaggatagggttcttaatggtttttgttttacttatagaatgtgctgacatagaattttgaattccactttgacacataggaggcaaggagaaagttttgtttttaacattttcttcagaagtagccattcagtggtactgctggcattggtgaagcctgtgggggagcctgaactttgctccattttacaggtttatgtggaacatagcactctgaccaggatttgtaatggtgactaaaaacttctcattatatcagataaaaacttcaaatttcaaatcaagactgtttattatgacagtaactagttaatcgatagacaacaaagtgaagtagaaaattcattagccccaaagcaaaagtcctgggttctatgacaggctttgtggaaccttggacaagtctcgtaactttagttccctacaaaatgagggtgttgcattgaccctcatcctctagtttctgaaatactattgactctgaatatttctaattatttttctttattgtaggattttaatataattgaggaagctcttatccgaagagtcttagaccggtcacttcttgaatatgtgaatcactcgaacaccacataattttattaaaacgaagggaaaagggaccactgaattgcaccatttaagatgctgcttgaacaaatgggagggaagttgtcaatgattgatgggcaaaaatgtacaacacagttatgtgtttgtccatgtttattgttatagtgcatttaaaaactgctttaattttaatggtttaaatctgttttacatccttgagattcttacacatctaacaacaaaaaaaattatctacatcagtcattgttacatggaaaagacaggtggtaggcaagtaggtggaggatctcggtttgcaaattagataatactctgtgtataatgctacatatcaataactaccatcatggttaggcacgataactaatctttgttctgtgtaaaaaaatatggagagtgaaacaaagtgcagacattcaaagaaataagaaatctgctccaatgctcttgttctaatctctaataggttaacgttaataatcttgtatgggagttggaaaggaaaattttggaagtcaagaaagtccatttaggccggacgcggtggcttacgcttgtaatcccagcactttgggaggctgaagcaggcggatcacaaggtcaggagttcgagaccagcctggccaacactggtctctgtgaaactccgtctctactaaaaatacaaaaattagctggacgtgttggcgggcatctgtaataccagctacttgggaggctgaggcagaagaatcacttgaacccgggaggcagaggttacagtgagctgagatcgcaccagtacactccagcctgggtaacagagctagactccatctcaaaaaaaaaaaaaaaaaaaatccatttaaccaaattgtcttacataatactgtaacaaaacaaattttgtgttagaaaagtatacttaattctttgactttttataactgcatacataagaattcaatatttttcaaatatttatagcttatttagaaatatttctataatataagcaatttcttaaaaaccatcagatgatacttacagtataagtattcacatccagactttttagtagaaaaccctaagggctttgatatcttttttgattgtaacattttaaaaattatgaaataaaagtactgaaaaccagacacaaaatttatagctgaatgccttattataaggaaatactcttttaggactcagccagtcaccccacgtgtcctttttgtgtcctgtcacaattacaaccccacaaaagtaactgctagactgatttaaatggtaatcactttgttgcatttgattactgctgccacacctaaatgcatatatctatattttaatattatcaatttaaagttgttattaaatgtatattttattttacatctcttttttaatctagaagttcctccttctttccagttccttaaaatttacctggtgaagaacctgatcctaggacctatagagtttcccatactttgtattttgctgattgcacactcatggcacggttcagcacattgccctgtcctctcgatattagcacacagtgcaggttcaggcacattgaatttgagaagacttaggttcagtcctttggcaagactgtaaatcacggtgtctttctttccttcctccttcttctctctctctctctctctctctttccttttctttctctttttttcagagttgcactctgttgcccaggctggagtacagtggcacgatctcgactcactgcaacctccatctcccgggttcaagcagttctcctgtttcagcctcccaagtagctgggactacaggtgcacgccaccatgcccggctaatttttgtatttttagtagaggggtttcaccataatggtcaggctggtcttgaactcctgaactcaagtgatccaccagccttggcctcccaaaatgctgggattacaggcatgagccaccatgcccagctaatttttgtatttttagtagagacagggtttcaccataatagccaggctggtctcaaactccttaccttgtgatccgcccacctcagccttccaaagtgctgggattataggcgtgagccactgtgcccggcctacagggtttttatctaacctttctgttacaactgtacctctccttctgtactgaaagtcctggttttcaagaacacagggcacgatagaattagaacatcccacaattactcatttcttttatttatcttacacttacagctgtctcagaataacaatagaaatacaaccacaaataatatggcaattgaaacaattaaaaagttttcatttgcttttctcattctttcccaatttttttttttttttgagatggagtctcgcgctcttgttgcccaggctggagtgcaatggcacgatctcggctcactgcaacctctgcctcctggattcaagcaattctcctgcctcagcttcccgagtagctgggattataggcatgcgccaccacgccctgctaattttgtatttttagtagagtcaggatttctccacattggtcaggctggcctcaaactctcgacctcaggtgatccgcctgcctcggcctcccaaagtgctgggattacaggtgtgagccactgcgcccgacatcccaatttttaaaatagttatactatgtcaacattttcagaacatactggtatagcatactgtactttcttccttttatcccccatttattcttagttcttcaactatatatttaacacttgcccccagttttgttttgttttgttttgaggaggaatcttgctctgttgcccaggctggagtgcagtggtgtgatcttggctcactgcaacctccgcctcccgggttcaagtgattctcctgcctcagcctctcgagtagctgggattacaagtgggcaccaccacacccggctaattgttgtatttttagtagagatgggttttgccatgttggccaggctggttttgaactcctgacctcaagtgatccacctgtgttggcctcctaaagtactgggattacaggtgtgtgccaccgcgccaggcaattgcccccagtttttatttgatggctctgactgtttctcatatctgactctttaattatgaatccagggcatagattagtatctccatcttgtaaggatgcaaagaagccatgaaaataagtaatatcaactcctgaggataaaacgttacttgactagagttagctttttaattgtaatcatttataaacttctttgttccttacatataagcatagtcataaccatggtacccaaaattttctataagttattgtaactccttaaaggtcttgctacagttcttttatccagtacaaataattgggaaaatgtaaagctgaatgaaatctagtgagcctcatatcctcccttttagatattgattttaagtttgcttttcacagctgctaaaaagtaacaactgatttttagttccacaacctctctttcttcaatttagatggatcatacaataaagcaaaatctggctggttacagtggctcacacctataatcccagcactttgggaggctgaggtggagggtctcatgagcccaggagttcaagaccaacctgggcaatatagtgagactctttctatttaaacaaaaacaaaaacaaacaaacaaacaaacaaaaagctgggcatgatgcacacctttagtttcagctactaaggaggctgaggttggaggatcacttgagcctaggaggtcaacactgcagtgagctatgatcatgctactgccctccagcctgggcaacagagcaagaccctgtctccaaaaacataaataattaaatataaataaaaataaagcaaaatctgttgggaaacgagaaaaaggagaggaatttttcaggaataatcataaaaagaaatgatcatcagactgaaagtccagagcctgagaaatgaaaacatatttttaagcattggtgttgaccatgcagacaaacttttgttaattcagagcgatacaaaaggcactttgaatctataaaacttgaaaaagttaaaaattgtatgtcggataaagctttaagtcatctgtcactattaacctcagtgcagcaattctgactcctgtgcctggattccttttatgataattttgccacctacaggacagattaggtgctggtcgcctgaattattttgtgttctgaattattttgagctctaaaatggtaaagtacaaatactcattgttttactgtgcctttggccttttataaaaaggtatttataattcgttgataaaaaccaatatttgaagctgttgattaccaacaaaaaagtttcactctctttatagtgcttcaggatacaactttttcagggccttattagagaaaaactgattcacatgttattcttctaaagctaaattattaaaatgtaggttgaaagattggattgattgtgaatctacactaaagatatggttccaggcagacctccttagagacctccaggcagacctccttactgtcttcagtgatgtttaatttcattactgttactgggtgccaagtgtctttcatttggaagtgaacttactccagttattgaatgtttatcatatcataatttgcatttttccaacattgaaggtattttaaaaagtcactaagagattcattcttttattattcaactacaaaaaaatagtgtaatgatcagaatttaaaatgtgtgattctttttcttctgtaagtatgtattgctatgataaataaaaaatggcaggaccattgtttttattaaaat

SEQ ID NO: 2728 - DNA, 20007 bp, Homo sapiens
  source 1..20007: mol_type = genomic DNA
ttgcctttaaaatcattttataaagaatggcacaagttggggtttatgtttactcagatgaacccgtccccttagaggacacaatcccacccccaacccccccaactccacgactgcccatcattgctgttaatccctcaggggagggttcacagctgtttatgaagccaagagaggttctgggcaagatcacagctggggaaacaggcccaggccctgctccctggtgtcctccatgctggagtcagcggtgcccaatgacggggtgatgtgatcacatctgcttccttctccacaacaagagcagggctggcgggcaggccaggaaagtcctccaggatctgatcttgccttccgactgaccagtgcgagcgacttctgcttctcttgggtcttctagtggtagaagacagctggagctggggtggtatttggatcaccccagacccaagatcagtggactggagcaccatggaaatgtttgggagggtccctcaggattgggactttcccctgaggcctctaggctcctccaagctgtggcctcaaggataagagagattgtgtcaggttcatgtgtctctggaactgcatgattgctgttgagtctgtatgtgtttcacctgtgtatggatatgtgtctctgatcagatttgtgccagcccctaaagtctatctttaaagtgcacataagaggtttgagttttaactctatgtctgagatgctcttggccttcattgtaccctagtcccacacccaaatcccataaaacaattatctccagcctctcatcctcatcccatccatttttggttagaccccaggtaaagggtagggtgcccaaatacttccttgctgagctgggaggaaggcagaggcagaaaatgtaaagctccagattcattttatacaggtccttctgggctctcactgccagtctctgagcttgatccatctccccaagccgaagcccaaagggaaatgcaatgaggtatttcaaaggcttattcttagcttctgagcttctgaatgaattgcattctattcatccagggagccctggatgcccctgttttcttgaggatgtcttggtcccccagaagtccttaaatcccagccaccccatgccttccagaagctgggtgtgaaggaatatgggaaatgagacaggtcaaagctgaggctggagatggtgttctgccagccccaccctctggcgattgtcccactgccaggccggcctgctgacagaaagccagccgcagcatctgctcacttccaaagagctggtggggaccaccctccagggttcatgggaaaggaaaagggtgagggtggaacggggtccagggaggtgggccagcaggccatagggagaggcaaggagtccctcttccaggtcacttggacagccccacaggtgactcggtttcagtgctgaagagctccttgtagagtggagggaaagcggcttggaccacgatggggtggaggtgctggaagatctgcagcctttccacatgctggctacacaggctccgaagcttccccttgggtggcagctggatatgggttaatggggaagggagggtcaatacttcagctctcctcagagcaaagaagtccgctcattcttcctgggctaggacaaaccctccttgccttccccttatgtacttggcactttggcaccagccaaatcccactggtagaagtacgtgtgtgttcaggacactggagggaagtgagagtgggtggggcacaggtgaatgttttctgggtgaagccctcaatttatgttcccaatacttctagaatgaaccttgtcaaagactctaatgtgcacttcctgcttttataagagtgattgtctgtgactcttgttgtatgctgtcacatgcctctgcctttgtgcatgttgttcccctcttcccattactaatccttaccctctagtgtcacctctcctaagactatttccctaactgcctcccatctggattaagggcccttcttttgggctttcctctgtgtagcacttactacattgcaggaaaatggtccaatttgtctgccttcccaccctagatttcagctccttggctgaggtctctctttccctgtctcctctgtacctatcataatgcttagcacatggcacatgcttaataactctttgaactaaacagactttctaagcaggcacctaacactgcaagtagcaaaccaatgctgccagcactcagccaaaggggagatgaaaaaggcacagaaaccagtgagcagacggaggcagggagacctcactggagcaaggctgaaagaacaatttatctcttgcagtctcctctacaaccaagaggcttaaaaatgtctcttgcctgccattgcctccctcccccagcttagtttccttggaaagaggcagtcagagaaaagcaggcagcagggtgtgatcccttcatatctcctagattctctctcttcctcaccactgctttattctgagcttttttgggctatggcaatagcttccttcattcattcaacaaatatttgttgagaacacatctggatctgagctaggcactgtgatggcctctagtgatatatcagatatatcagtcaataaagtataatctgtaccttgattaaatttacattctggtgaggggcccagaaaataaatatgtagtgtatcagataataagttctttaaagaaaactaaagctttttgtatggggttactggtcaggaaaaacctctcccgaatgaagagatggggtaagccatttggaaaactgggggaagaaccctccaggtgactacaatagcaggtacaaaagccctgcgactgggtttgatgtgttcgaggaatagcaaggaagcaagtgtggctgcaatgggtgtttgaaggggcagtggaagatcaagtgagaaaagaaggcagggatcatgttatgagccacttgaccatgacgcagactctagatttgattctcggcatcacaggcagctacaggagggctgagaacaggagtcaaggccaggtgtggtggttcacgcctgtaatcccaacactttgggaggccaaggtgggcagatcacctgaggtcaggagttcgagaccagcctggccaacatggtgaaaccctgtctctactaaaaatacaaaaattagccgggcgtgtaatccctgtaatccaagctactcaggaggctgaggcaggacaatcgcttgaacctgggaggtggaggttgcagtgagccgagatcacaccactgcactccagcctgggcgacagagcaagtctgcctcaaaacaaacaaacagaacaaacaaacaacaacaacaaaaacaagaaaaaaaccacaggagtagggcatgatgagattgcatttttaaaagggctaccgtgggtgcggagtaggtgtggttgctacagggcagatgagggtggaacaggggctcagttaggaggcctctcttaaagtccaagtgaaagctgagagctggtaggggccagggtggtggtaatagtagggaaggtgatgtattttgaaagcagatccaaccggatgtgctttccaattgctctcccagattcctgtctctcctccttcaaatccatcctgtagcagattaaagttcaagttcttgagagcacagaccgtgtaagtcattgctgtatccttaacacccagccctgtgcctggcacatagcaaaggcctgcttgaataattacataaatggttcctttatactggttccaaagtaaattgcctaaatgacagctctgattgtgtcatttttctagcctttggagctccctgtggcctagaaataaagctttaacgcttatatggcattgaaagtcctctctgatttgcccctgacctaattttcaggctgatcatctggtgctcttctgccccaccagtctatcccagctcctgattttacactttagtgaggatgtaccatgagtgattctccacatacacactattttgcctccttatttttctcctgttgttcttggtcttcattgtaccctagtcccacacccaaatcccataaaacaattatccccagcctctcatactcatctcatccatttttttggttaaacctcaggaaaaggattttttttcattttttttgttttgctcctattgttccctaagcctggaatgcctgccccacccccatgaatgcctgttaaaatcttacatcattcatggcctagtataaatgtcatcttccctgggaagtatttatgacccactccttttacccccaaattatttttaatccctgttttatactctcataacattttcctggtgtcacttattatagttatacataggggacacagggatagaaagagcgcaaagagcactgggattcaatcttgcatttaagtcactgaagtctcctgatagctacaaggagattttttttttttttttgagacagagtttgctcttgttgcccaggctggagtgcaatggcacaatcttggctcactgcaacatctgcctcccggtttcaagcgattatcctgcctcagcctcccaagtagctgggtctacaggcgcctgccaccatgcctggctaattttttttatttttagtagagatggggtttcaccatgttagtcaggctggtctcgaactcctgacctcaggtgatccacccgccttggcctcccaaagtgttgggattacaggcgtgagccactgtgcccggctgctacacagggagatttgaacacctgtcctattgactgggttgccatgaggatgagaaagcatgtcagcaaaagcactctgttaattgcattattattatatcacataccacattctactctatgttagagttagtgatacacagatctcttcttcataccagattaaaatctcttggtgggggcagcgaccaaatctctgtgtctttccacagtgccttgtacaagcaggtgctgggtaagtgctggctatattaaactgaattgttccctggaggtccctcccaatcccaggccctctaactttccagtctttatgcacgtggaagtagctgttcattcccttagttcccactgctgatgcaagctctctaacagagagtggtactcccgcactccctcctctgtacccacagaccccggccctcgcaaactctgatgttacagagctagcgatgggcctggcctcttctaccccagggactgctcctacctttgccaggatgctttggcgatgagtcttgcagagatgatgatgaaaggccagctccagattgtactgcagctgttctactttccttttctcttggagccctggccgatctggaggagggggtgggaccgtaatgagaacaagaaagaacatggacattaactcccaacaaaagggtgtatctttgtggacatctgtgctggatagaggtcttctaagctgagcgcgtgcatgtgtgtgccttggtttgataatggtaagctctggacgttgggcttggctagctgtctacaaggaaaactgggaagagatgaaaggtatgagaatttctgatctcctgactccaagctaccttctccctggtaacctgatattccacatagctcattcaatgctaggcactaggattctgtcataggggtaacaagagttggaaaagagctcccccatgtacgaaaagggctcctgataggaggtggccttcctgaaggtgcccaggcctgcaccagggggcttgcagcaatctgtgactaacttttgccctgattctataaaatatccagaagtcatctttaaagtttttatcttctagtttgaagggcatatttaggtgtccactcactggcagagccagaagactgatagtctcgatctgcaaactcaggttagcagcttgacccacttccctaggttctctgaatatttagtattcatctggctcagcccagctactccatgccaggggagtggataggatatccagagtcttcctattataggcatacagccttaaaattagttcacacagagcagtgattcttaatcttggtggcctgggggtggctgttaaaattcagtgcaccccttatcaattacagatggtcccagtcttatgatgagttgacttactattttttgattttatgttggtgagaaagccacttgcattcagtagaaaccatactttgaatacccatgcaaccatcctgctgttcacttttagaaccatattcaataaattacatgagctattcaacactttattataaaataggctttgtgttatatgcttttgccagactgtaggctaatgtaagcattctgagcacatttaaggtaggctaggctaagctatggtgttcagtaagttaggcgtgttaaatgcaatttcaacttaccatattttcaacttacgataggtttattgggacataaccccatcataagtcatggagcacatgtacactggaatctctggaagtgggacccaggcagcaatagtttttaaagctccccaggtgattctgatgtgtgctacaatgaaatcactgccatagactaacaatcagacacatttctgtcaggaaagtggctcatttcctctcaacctcatttctccccacttcccacaaccccaccttatgctgctcttgtccctctctgagagtcctctgaatctttattttaactcattttattttatagcaatactgagtagggctcattctgctatttaaagcaatttcccagatttaactacatctgaaggtctagactcttcttcaatatctgccatgcccctgccacctgaatgtccttcacccaagcccagcaacactcacgggcattgatgagaacaagggctgtgtagagggcaatctcatcctcggaaaagtgcaaggcacttagggagtgggagaagtcaaagatggagctgatgagctcgctgcagcctgatggagtggaaatgagaaaagtgagagagtggctggagcgatggtgcccgaggacaccgcccttattgtgtttagagcagagggggcaattcgccctgaaaagagggtgccctgggtcacaaagctttgcctggggttggcatcagaatcttccctctcatttctccctgcccctcacccaaggctcggaacagctccatgccaccgtatttgccttcaaaaaagaccgtgcggttgtcagcattgtaggcccggcacatcctaaccagcaccacttccattgctcctgggcagtggggagagaagatgcagggacagtgtcaagcaaagccaggatctgactctgtccccctgatttccttaagccacctccctccacttggctctgtccccttgtccccaggcctgcccacccatccctgggcacctgctttgagaagcacaatctggtcattctggcagagctccataaagcctgagagcctcttggcgaactccaccacgtactgaatggcctcggtgaggtggtgggcacaccgttcccacatctcccacatggactgcagggagggaggagggtcccgctgtagcgctctgtgtggccctgtgatcctcctgagccctggagccccacctaataaactgcaaggggtaggctctgaactcctatgttctcaactagcattttcaaaagcctggtcttagcacaaatgcacagattcctgccagtgagtcccacacactgagcacctaccggctgctgacaccgagttagctgttgtgagggaatccaaaaagtatgagatacagctttgccctccaacaaggtatatctcgttgaggtgaacaggacatacagctgccccttcccccacaaaggttatgcccaaggtctcaataacctggagaagcaaatgtgaagtgccaaacgagtgtgtttagagcaggtggtatgagagtgtgatcgaaaaggcagcataaactttggagcctgatgaatctgaatttgactttggttccaccactttgtgactttgaggaaacctattaacccctctaggctcagtttctgtctgttaaaagtaggaataaatgccaccctcataggttggttgtggtaggggctgaggataatttacataaagcgtttagcacaatgcctggcagagaaggggtgtttaacaaatggtaatcagggttctgattattgttattgttgatggaagaggaggaaggagggtgcaccaaggtctgcatggtagaggaggtaggatgaaggccaggtacaattttaataggcaagaactaaggaaaagcgctcatccatctgctggggtgtagacagatacacacattcgcaactgtacataaaaggtgtgcacatgcttgttggccagcctgtgtctgtgatgtcccgccctgccccaggacccagtcgtgcgcaggtagccatctctgaactctcccggtgggggtgggatacgttcccttcctgcaggtctcctggcctcaccttcctctggtagccagtcacttcctcccgggagaagatgttggagcgctgccgcagcaggtcctccagccgcagctggcatgtctccctgtaggacttgcagacgctctgcaccaggtgctctggggccggagaaggaaggcatggcttgatctcagccagctcctacgcctacccatgcaagggcacttctcagcctggcctatcctgctccgcctcctccctccgcccctcgtctggacccctcaattccctcaggcgcatgtttgattgatacggggtactggtggaaacccctccctcatctctaccaccctctccacctccccagctgctcacctatctctgtcagggaggcatagggtgcctccggtgtgctgcggaaactggggctgccgtagctgtctgggccctgtcccagttccccaagcccaggatgcctgtgttcctcaaaacgaagtccacatcggtcaggggtcagctggctgcctgtgctatagaagctctctctgccctcagccttgccccgctcagggctgtattcaaggtggcatgaggccccattgagccctgccttggccaagttgttggaatatgagggcccagagcctgaggctttcaggaggccagggggacaggcagaagcctcaggcaggtcaggcgaggagcccaggggcagctgcccgtctgggagccccaaggtgtaggtgagggtatctgctccttgggcccctgctggaggggtcttgaccactggttcctgttgctgctgttgccgctgctgcagctgtttctgcacttctgcatgcaggctgtccctctgcttcttggacatgcggccgaacttgacagctgaaagaggtccagggaccaggggtttatgaggcaggagaacatggcacagggcagggtcaggaggcatttggtcattaaaggattaacttgctgctctctgaatggctgactccaagcacagcttctctagcctttagggaacttatgctcaagaccccgtccacctctcactcttgtttgcttctggggtctgtccagtctgccatttcaatctgctaagcaaaatcttctaagttctaaatcagatttgaatcatggcagaattcaagcaatgagtctaggctggggattctggcctccagatcttggggctgggggtggtcgagcagagggcctcaagctgtattggggtcacctcgcctctttgggagggtcggaggaagaggagagctgagaacacaggtctccctgtggtcaggcctgcaggctccctggtgacctagatactcaccacagcccaacccgggctccgcggcttgtttctgaacatcctcttctgctctctctttcctgcctttttactccccccgccacccctcccaggtgtaggggcacagcccctcgccccgcctgcccctttgcacccctgcgtgcttccttttgctttgttattttgggcactgaaaagtgctgacgggctccttctggctcctcatcacctcatgcccccccagctccaccctaggctccttctgtggtggtggaggtgtgcagggagactggtgaggaggtggtgggtgaggagggtggataaggcaccaggaacaccagccctcccccacgaccaccctctggttgttctcaggccaattctgtttccattcctggctatagtcctgtgtccaagtatgggaatgggggattagaaaaggagatagagctagaactacaacaacagggtagcaggggaaggtgccagagctgcatgggagctgggccagagggcagcagagtgaggagaattcgttccaagtaagaagagatgaagaggtatgggaccttggaaagaggatgtttgttctagcaaagcctaaagttggggactccaaagaactttgatgggggtgacccatccatccctggaggggaggagacaaggggttgtaacggggaggaatggagaggagaccagaggatgggccgtcttgcaggttaagccttgtctagctcagcaggccaggctgcccctctggagacaccaggaaaaccccagggggctgtcgacttggcctcaccatctcgggacatgcccagcgccaggcatttctgcaggcggcagtgctggcatcggtttcggctggtgcggtcgatggggcagttctgctgacgggtgcaggagtaggccgcgttacagcgctggctccggcggaagaagccctggggaaagcaggtggagggcaagactgcttatcctggtcaggcccagctcactcacaaaggcctccagcccacaagctctggcagcttttctacatcccacgacctgtcagttttctctctcctccatctatttgtgtaattgcaatttatcctgtagtcatttccccagcttaagacagggccctgccagtgttgagggccctgcaggaaggcgctactcaggcattttcctggctgcccaggagatcatccctggagtcagaacaaaggccattaacccccttgtttatctctaaggagacactgtgtgtgtgtgtgtgtgtgcgcgcgcgcgcgcttgtgtatgcacacgcacacatgcatgcatacacatgcctatgactcaccttgcacccctcacaggtgataaccccgtagtggatcccagacgacttgtccccacagattttgcaagggatcacttcaatttgtgctggaagagagaaagagaagtaggtcagcccaggaggcttttctgcattcaaccaccatgtacctgggctgcagatacaggtacctggtgcttccactacttctccaaccagctccagcttgctgtttccctcttgcaaaatggaaggggaagtgaaatgccaaatgcttctcagcaaagggtgtgaggaagctgtgtttgtttcacagaggaggggagtgtggaggggtggccgggagttgtatcagtgctatggaggcagagaaagcagctgcagaggggccacctgctcagcccttcgagttgaaaagctccagttgcctccctcccgccttgggacataggactcctcacggcctcacaacacctgcttcccgccgaaggggcttcctctgtgcctccctccctcgctggggctcagctcccatgggcaaagtgtagggtatagcaggaagatgtggtacacaaggggtgggggataggcagagatgccagtccttcccagccagacagtgaaggctcagggaggtgctatacagagacagggtgagggggtggcagggaggaacccaggaaacgggggctcaacaccccagctctgctggatgcctgagagcctagggaaagaattagccagggctcttaggctcttggccccagagcagagagagggtggctttgtgtacatccgtgtgtctgagtgtgaacacttatgtttgtacaaaggcatctgtatccatttgtgtgaacatgaatcatcaatgttaaaaatggctgagactagagaccatctcattcaacctcttcatttaccgatgaaggactaagccagatgaggcaaagcggttgggccagggtcataggctagtttgcctgagagctggatctacatcccagttcccctgagctttccattatgctgttctgtgtacctgtcttttcgggtacacatttcagtgggcatgtttgaaggtgtgcttgtgggtgtgcatatgcaagaaaagtatgtgtcatttgtgagcctacgacatatctggttgctcctgcgtccacacgtgcatatttgtatgttagtgtctgctcatggggcactaggaccccgggttctctctcccactgaactcactgtaacctgtacctgcttccctacccctgtggtttgctgctggccctaagctcatctctgctttgccctgttcctgtcaatgcccacgactctctgctgagcttcatgggaccacaggaggccttctcccagctcttccttgaaaggtagctgggcaaagcttgggatccctggttactgtaggtgtttttagcatttcccagagcacatgggtctcttttccaccatcactgacctgctgcctcccctctgagtggggagccctggggcgggacaggccagaaaagtgaagagaagggccaaagccccttttaatctatgacgtgtctcccaccaaaggggcaaaagaagtggcagcctctctggagggcgaatgcacattgctgtgatctcacctccagtccctggcctggacactggtcacatgtagggcctgttgatgtgaagtgggcagggagaccatggcttgcccgccattccccaaaatattatttccatcattcttaaaccatcatccctcaggccagacttgaggtgagtcagaggcagtagctgaccctgacggggacagggcacatgggtatctgaaatcccttcattagcactcaattcctcacccaacccccagccacacgtgcctgcccagcagcaagcttccagtgctcacactgtaagctgtggtccccccaggaccaggcggtaagtgagttttccaggttctttccagtaaattaagagcagattttaatacatggaggggaagagagaataagagggcactgggtgtctggaacaggggcagaaaacgttggggcccccatacttctagtcacttagattctccctctagacctacgttttcttgtcagcaagatcaggataaaagtattattgcctgtccatggggtgattgtaggtaacagagagtaatgaaatgatatcaccaatggaaagcactgtgtattcaagttactcctgagcagaggtcaggctgagaagaccagtgggcctggcaaggctgagaggagcactcgggccctgtggactctgttcttgcccaacacctccccctccaacactgtggcatctctcttttcagtggcctaagaccagagatgggagaaaccaacgtgggccacccaaaaaagtaagcgggagggagattaggccaagccgcagtgggaactcgggctctggcccagcagtcaaccacaggcctccctgcctcttcccttctccaagagccacatccgcgtgcgtgtgtgtgctgaccacatggtgaccccagacacatctccctgccccatgcttgacccactgcttctcctggccctaggaacctcacaacagtgtcaccaagaccttgaccttctcataggaagatgcggccagtcaaggacccccttcgcaaatacccatgtttgggcgacaccaaagccttggactccagccacctggtcagcccatcctccatcctcccagtccaagacagaagtacccagtgagacagacacacaaggccaaagactctgagctagaatgtcagaccccctagcctcactgagctggagagaccaagaggtttgggtccaggaaaaacagagacatagatctagggatggagagacggctgcggaaacactgaaacacagaaaatccacgcttgtatcctggcctttgcccaacccatggccccctcagcacttcaggccctctagtcctgctcccccctccttcccctgccacctgcactcccttcaatgccatccacccaaacctcagaaagaaagtaccagtgctgtgtacatgagggtgtgtgttacttgtagagaaggggtgggggagaacgggaagggggctggtagacttgggggttggtgagaggagctgaaaacacctctgatgataactcaccttcaaaagctacccctgggagacacgtccctgaagcagcaggtggtgggaactcagattggggagaaggagctgagtaatcacaggattactcaaactgttgccctggagccaggcctgccaggaacttaccatctaagggcctgccagtgccaggaactagagccaagcaaaggtcaggaacctcgaaccagcccctgcaccactgctcccatggcagccctaactctaccctcgcctgctgtcttggaaagatctttgcatctcacctgcagctctctcactgtagctctctcctgagagagagctttctccaaaagaaaactccaattccacatcttccaaaaggagagacaaatgcccaaatgcacccgccagctccttaagtcatctaatgactgaatgactatggctttctgcatctcaaacaagattacctggggatctgaggtgggactcaagattctgcactttggtcagctcttagttggtgcctaagcttactggtcttcagcttatactttgagtagcaagaacttagtccctattcctgcctttttgccaggctgctccttccagggagtggggctggggttggcgatcttttcctgagctcattcttgcatcttttctgccatccagtgtgacctctaagacttcattctgagacaatactagaaaaagaaactgaatctcctctgaattgctttagagactgaagtacccccaggagcatcctagtagctcctcctatgaggggaaatacggtagaggcaaagtcctccatcctcctctaatcgagcctctcacagctgtgagattcaatgatagtgctttgagtacttccagagcctggccctgtgccagcttaggaagccaaccctgggccctgtccaggtgccctatgccacagagaggaagtggtaggagcaggggaggggctgcaacccagggggatctctcctctcaaaccccagaaccaccacccccccaccatcatggtagagaatgggttcacacagagaaaccccggggtcctcatctcctcctggtgcctcgtcaatctagagctgggccttttcctctcctctttctctctcctttttctccagtggatactgattaaggagaaaggataatgatagacataagcattggctgaattcttactctgtgccaggctttacatgcattttcattcaatgatcacaaccaccctgtgaaataggccctgctagtatcatcctcatcttacagatgagaaaactgaggcctagagagaataaacagcttgactaaggtcacacagccagaagtggcagatctggcatttgaacctagatctctgtaattctgcagccagtgccctcaagccttaagctatatactttatgaggataagacgcccaaatgcacaccggagacctgggtagaggacatggttatttggctgtaggggtaaaagtgtgaggtgattgtggtggtctaggaacagaattcacagaggaaacccacagaactaaagccaggactcctgtttgtataaagatcccaagagatattattccctctgtcccaactcttcctctgaggtcccagcctcctcctgcccttacccctttctctaaggccaagtgggatgacttatatatcaacaacagggttcccggggactcctcaggaacaccacagcccctttagggtatagactaggtttccatacatcttggtatgcctccctttgcagaatgaatgaatgagtgagaaagaggaatgcatctctttccttagcttgagctcctcctctccccacagccagaactctctgtctcgatccccaccgagaccacagctccggtcaggggtcacttgcacaccccaacctgtcaccagcctccctcctttctcagctctcagttcccccagcttctgcaaagctggaaaccaaggtggtgggtgccaccacaggggagcaggagcgggagggctgggtgggggctgggggagaagtggttctacctggcgaacactacccccagcccaggccagggccctcaccgcagctcctggtgagaattttctgctgaaacacccagatcctggggctgagaaaatagtgaagctaaaactcaggtgggcgagggagagtctggggttttgaaaagccatgaatgacagccagccagccacccgaaaccccctcctggtgcctccgccacccccacagtctgggactggagaaaggcgagtgaaaacaaccagtgaatgggggaggggatgaatcactaggaggaagctctggcgagtgggagcccagacgtcaccatcagcaccttccctgccttcagggccatctgtccctcatcccagagcaccttcactgctccaggagggtagtggacccagaaagaccttggctctggccctgaggccctgccttgttactgtccctcccccgaaatagacatctccatcctttttgagcctcagagccccagggaaggggctgcactgcagcagcaggcgtggaggtgagacttcagaaaggactagctatatgggaacaggagcgcgggccttgggctgcccgcctgggagagaccttagcccttggaaagtcctgttccctgttagtttgagtcagcagcacagcggcaggggatggggaggagcccttggtagggaccgaatattttcattgtgctgggacaagctgagtcttttcagagtctagcaccttgggctcggtggtttggtatttctgttaggaatgggaagacggggaaagagaagggtgctggagtgatgaaaggaaggaagaagcccttcacggagtcctaagatggccctgggctctcagggtgatatctgtgtaccctggggacttggagtcctttctggcccactgttcctcatgatcatgaccaaacctaagaaagatcagctcatagacagtgacctcacacccctcggcctcccacctccccatccagaccaaatgccagggcctgagtgcctattggcgccacgctggccatgcccttaggggaagatgtctgggctaccctccgtctggctggctgggagtctctttggcgtacagacacattatctccacttgacagcagcaggtcggatggcagggtgctggtgccatccttgtcagagccaccctacttccctcttaccgcttgcctagaccctgtgtctccctgtcttccctttactgccagttatcttttctctccgcctctccctgtgtctatgtgccttgtgatcttctgcattccagctctgtttctgggcttcacaccttcatgtttgtttgtttgtttaagagacagggtctcgctctgtcacctaagctagggtgctgtgacattgatcatagctcactgcagccttgaactcctgggctcaaacgatcctcctgcctcagtctcctgagtagctgggactacaggtacacgccaccatgcccagcgaattaaaaaaaactttttttgtagggacagcggctcactttgttgcccaggctggtctcaaactcctggcctcaagcctcagcctcctgaagtgggattataggcatgagccaccacgcccggctgcacctccatgcgtttggctctattggtgtttctccaaccacacctccagctggacattactctctccctaggtgttccagaaactcgccctctgagttgggcctctgcatctctccttatttcttgatttgtttctgctccttttgtcgggcccttggtctctgggtgtgtcacagtcccaagccccatgtgctttgacttttgccatcggcggttggaggggctggtggtggttggcactcattggggtcagataacttggggctatgagatacctgtaaatgtccaagtgagaaggaccagtggcactgaccccctcgttggaggaggccctctctcctacttccccgcctgggtggggctgtgtgtgtgtggtgggggtgggaataatggagagctggccaagtgtctccctcagcccctcctggggactcctgccccgctgctgggctagaagcacacctagtcatttcatcccagggttgatttgctcattaggggccatctctgggaagaccagtctgccagcgtttgctgctaatagagagaagctagaagggaaacggaagctccaaggggccctttcctctgtgtagaagctgttggctcttctctccagccctccttatccaccccagctcatatgcctgcactgtggcctcagtccctgtcacagaagtggaattcttttctttccttggtttcccttccttctaacctctgggagagctgagtctccatcatcacccttggggatgcctgccttagggcactgggctctctcttggccctgggcctttggaatgggagactctccatagttggttttgttgttctatcttaaaattcagctcccttgttttgcggatggtagaccagggcccagtgacttggcttgtctaagtctatatggctagccagtgataggcggcacaagtgcctggtcttacactgtcagtccaggggtctttccaggactcaatacggcctcccttctgtggcttgtgggaagaccccaggttgaagctggggctgcttcaggcctcagccacaggggcatggggcttcccttttcctccttcaccttgtgctctgagagcttctctggcttccctggcttcccttcacaacaaatacaggggacttcctgaggttgcccacccttgctctgctggaaggcacaggaaccccagacatctgcccaccaactgttggcccagggctccaagccaggaaaagggtgaggccgaggtctttccaatcccatctccattgccttgcttccccggtcaaatgggtgactgaccctggagaaccacacacacacatacacacacaccccacacacacacgcacacacacacatgcacacacacgcaggcatgtgcccgggtgcaccctgactggattccacatagtcctcatgtccctggattgggcagaaagcctggtggctttgaggcctggacgcggggattctgtgccctgctgcctgccaacctcagttgactctcgctgtcctgttgcttcagagcacagcaactgctctggcctccttttactcacaagcaggctggaggcacagagggaaacaccgtaacaagggaaacactgtaacaggagagtgcgttcagggcccctagtaattaccagcccccatcagataccagctgtgtaacattgggccaagtacgcggcctccttggctctcagtctttttgtaaaattaagggcctggatacctcagatacttttggaggttctttttggaactcaggaattcctcaacagtcctcttaccattgctgctgtcagggagccgcctggccagcaggactccccagctgctccacccatctcccaacagatcttgaccttgaccaggacgcaccctgctttgctcagatttgctcacactgttcccaagacatcctcctttccagaggggtgacgacagggtccaggctcccccgcccccaggtggccccattcacttacttctcatgactgagccttggctctgccggccttggctccctgtccttctcagcagggggtggtccaggagtggggtgcagctggcggcagaggcggggcgaggccctctcagcagcgcctcagcctgaagctctgcacctagctctct

SEQ ID NO: 2729 - DNA, 25802 bp, Homo sapiens
  source 1..25802: mol_type = genomic DNA
ttgcctttaaaatcattttataaagaatggcacaagttggggtttatgtttactcagatgaacccgtccccttagaggacacaatcccacccccaacccccccaactccacgactgcccatcattgctgttaatccctcaggggagggttcacagctgtttatgaagccaagagaggttctgggcaagatcacagctggggaaacaggcccaggccctgctccctggtgtcctccatgctggagtcagcggtgcccaatgacggggtgatgtgatcacatctgcttccttctccacaacaagagcagggctggcgggcaggccaggaaagtcctccaggatctgatcttgccttccgactgaccagtgcgagcgacttctgcttctcttgggtcttctagtggtagaagacagctggagctggggtggtatttggatcaccccagacccaagatcagtggactggagcaccatggaaatgtttgggagggtccctcaggattgggactttcccctgaggcctctaggctcctccaagctgtggcctcaaggataagagagattgtgtcaggttcatgtgtctctggaactgcatgattgctgttgagtctgtatgtgtttcacctgtgtatggatatgtgtctctgatcagatttgtgccagcccctaaagtctatctttaaagtgcacataagaggtttgagttttaactctatgtctgagatgctcttggccttcattgtaccctagtcccacacccaaatcccataaaacaattatctccagcctctcatcctcatcccatccatttttggttagaccccaggtaaagggtagggtgcccaaatacttccttgctgagctgggaggaaggcagaggcagaaaatgtaaagctccagattcattttatacaggtccttctgggctctcactgccagtctctgagcttgatccatctccccaagccgaagcccaaagggaaatgcaatgaggtatttcaaaggcttattcttagcttctgagcttctgaatgaattgcattctattcatccagggagccctggatgcccctgttttcttgaggatgtcttggtcccccagaagtccttaaatcccagccaccccatgccttccagaagctgggtgtgaaggaatatgggaaatgagacaggtcaaagctgaggctggagatggtgttctgccagccccaccctctggcgattgtcccactgccaggccggcctgctgacagaaagccagccgcagcatctgctcacttccaaagagctggtggggaccaccctccagggttcatgggaaaggaaaagggtgagggtggaacggggtccagggaggtgggccagcaggccatagggagaggcaaggagtccctcttccaggtcacttggacagccccacaggtgactcggtttcagtgctgaagagctccttgtagagtggagggaaagcggcttggaccacgatggggtggaggtgctggaagatctgcagcctttccacatgctggctacacaggctccgaagcttccccttgggtggcagctggatatgggttaatggggaagggagggtcaatacttcagctctcctcagagcaaagaagtccgctcattcttcctgggctaggacaaaccctccttgccttccccttatgtacttggcactttggcaccagccaaatcccactggtagaagtacgtgtgtgttcaggacactggagggaagtgagagtgggtggggcacaggtgaatgttttctgggtgaagccctcaatttatgttcccaatacttctagaatgaaccttgtcaaagactctaatgtgcacttcctgcttttataagagtgattgtctgtgactcttgttgtatgctgtcacatgcctctgcctttgtgcatgttgttcccctcttcccattactaatccttaccctctagtgtcacctctcctaagactatttccctaactgcctcccatctggattaagggcccttcttttgggctttcctctgtgtagcacttactacattgcaggaaaatggtccaatttgtctgccttcccaccctagatttcagctccttggctgaggtctctctttccctgtctcctctgtacctatcataatgcttagcacatggcacatgcttaataactctttgaactaaacagactttctaagcaggcacctaacactgcaagtagcaaaccaatgctgccagcactcagccaaaggggagatgaaaaaggcacagaaaccagtgagcagacggaggcagggagacctcactggagcaaggctgaaagaacaatttatctcttgcagtctcctctacaaccaagaggcttaaaaatgtctcttgcctgccattgcctccctcccccagcttagtttccttggaaagaggcagtcagagaaaagcaggcagcagggtgtgatcccttcatatctcctagattctctctcttcctcaccactgctttattctgagcttttttgggctatggcaatagcttccttcattcattcaacaaatatttgttgagaacacatctggatctgagctaggcactgtgatggcctctagtgatatatcagatatatcagtcaataaagtataatctgtaccttgattaaatttacattctggtgaggggcccagaaaataaatatgtagtgtatcagataataagttctttaaagaaaactaaagctttttgtatggggttactggtcaggaaaaacctctcccgaatgaagagatggggtaagccatttggaaaactgggggaagaaccctccaggtgactacaatagcaggtacaaaagccctgcgactgggtttgatgtgttcgaggaatagcaaggaagcaagtgtggctgcaatgggtgtttgaaggggcagtggaagatcaagtgagaaaagaaggcagggatcatgttatgagccacttgaccatgacgcagactctagatttgattctcggcatcacaggcagctacaggagggctgagaacaggagtcaaggccaggtgtggtggttcacgcctgtaatcccaacactttgggaggccaaggtgggcagatcacctgaggtcaggagttcgagaccagcctggccaacatggtgaaaccctgtctctactaaaaatacaaaaattagccgggcgtgtaatccctgtaatccaagctactcaggaggctgaggcaggacaatcgcttgaacctgggaggtggaggttgcagtgagccgagatcacaccactgcactccagcctgggcgacagagcaagtctgcctcaaaacaaacaaacagaacaaacaaacaacaacaacaaaaacaagaaaaaaaccacaggagtagggcatgatgagattgcatttttaaaagggctaccgtgggtgcggagtaggtgtggttgctacagggcagatgagggtggaacaggggctcagttaggaggcctctcttaaagtccaagtgaaagctgagagctggtaggggccagggtggtggtaatagtagggaaggtgatgtattttgaaagcagatccaaccggatgtgctttccaattgctctcccagattcctgtctctcctccttcaaatccatcctgtagcagattaaagttcaagttcttgagagcacagaccgtgtaagtcattgctgtatccttaacacccagccctgtgcctggcacatagcaaaggcctgcttgaataattacataaatggttcctttatactggttccaaagtaaattgcctaaatgacagctctgattgtgtcatttttctagcctttggagctccctgtggcctagaaataaagctttaacgcttatatggcattgaaagtcctctctgatttgcccctgacctaattttcaggctgatcatctggtgctcttctgccccaccagtctatcccagctcctgattttacactttagtgaggatgtaccatgagtgattctccacatacacactattttgcctccttatttttctcctgttgttcttggtcttcattgtaccctagtcccacacccaaatcccataaaacaattatccccagcctctcatactcatctcatccatttttttggttaaacctcaggaaaaggattttttttcattttttttgttttgctcctattgttccctaagcctggaatgcctgccccacccccatgaatgcctgttaaaatcttacatcattcatggcctagtataaatgtcatcttccctgggaagtatttatgacccactccttttacccccaaattatttttaatccctgttttatactctcataacattttcctggtgtcacttattatagttatacataggggacacagggatagaaagagcgcaaagagcactgggattcaatcttgcatttaagtcactgaagtctcctgatagctacaaggagattttttttttttttttgagacagagtttgctcttgttgcccaggctggagtgcaatggcacaatcttggctcactgcaacatctgcctcccggtttcaagcgattatcctgcctcagcctcccaagtagctgggtctacaggcgcctgccaccatgcctggctaattttttttatttttagtagagatggggtttcaccatgttagtcaggctggtctcgaactcctgacctcaggtgatccacccgccttggcctcccaaagtgttgggattacaggcgtgagccactgtgcccggctgctacacagggagatttgaacacctgtcctattgactgggttgccatgaggatgagaaagcatgtcagcaaaagcactctgttaattgcattattattatatcacataccacattctactctatgttagagttagtgatacacagatctcttcttcataccagattaaaatctcttggtgggggcagcgaccaaatctctgtgtctttccacagtgccttgtacaagcaggtgctgggtaagtgctggctatattaaactgaattgttccctggaggtccctcccaatcccaggccctctaactttccagtctttatgcacgtggaagtagctgttcattcccttagttcccactgctgatgcaagctctctaacagagagtggtactcccgcactccctcctctgtacccacagaccccggccctcgcaaactctgatgttacagagctagcgatgggcctggcctcttctaccccagggactgctcctacctttgccaggatgctttggcgatgagtcttgcagagatgatgatgaaaggccagctccagattgtactgcagctgttctactttccttttctcttggagccctggccgatctggaggagggggtgggaccgtaatgagaacaagaaagaacatggacattaactcccaacaaaagggtgtatctttgtggacatctgtgctggatagaggtcttctaagctgagcgcgtgcatgtgtgtgccttggtttgataatggtaagctctggacgttgggcttggctagctgtctacaaggaaaactgggaagagatgaaaggtatgagaatttctgatctcctgactccaagctaccttctccctggtaacctgatattccacatagctcattcaatgctaggcactaggattctgtcataggggtaacaagagttggaaaagagctcccccatgtacgaaaagggctcctgataggaggtggccttcctgaaggtgcccaggcctgcaccagggggcttgcagcaatctgtgactaacttttgccctgattctataaaatatccagaagtcatctttaaagtttttatcttctagtttgaagggcatatttaggtgtccactcactggcagagccagaagactgatagtctcgatctgcaaactcaggttagcagcttgacccacttccctaggttctctgaatatttagtattcatctggctcagcccagctactccatgccaggggagtggataggatatccagagtcttcctattataggcatacagccttaaaattagttcacacagagcagtgattcttaatcttggtggcctgggggtggctgttaaaattcagtgcaccccttatcaattacagatggtcccagtcttatgatgagttgacttactattttttgattttatgttggtgagaaagccacttgcattcagtagaaaccatactttgaatacccatgcaaccatcctgctgttcacttttagaaccatattcaataaattacatgagctattcaacactttattataaaataggctttgtgttatatgcttttgccagactgtaggctaatgtaagcattctgagcacatttaaggtaggctaggctaagctatggtgttcagtaagttaggcgtgttaaatgcaatttcaacttaccatattttcaacttacgataggtttattgggacataaccccatcataagtcatggagcacatgtacactggaatctctggaagtgggacccaggcagcaatagtttttaaagctccccaggtgattctgatgtgtgctacaatgaaatcactgccatagactaacaatcagacacatttctgtcaggaaagtggctcatttcctctcaacctcatttctccccacttcccacaaccccaccttatgctgctcttgtccctctctgagagtcctctgaatctttattttaactcattttattttatagcaatactgagtagggctcattctgctatttaaagcaatttcccagatttaactacatctgaaggtctagactcttcttcaatatctgccatgcccctgccacctgaatgtccttcacccaagcccagcaacactcacgggcattgatgagaacaagggctgtgtagagggcaatctcatcctcggaaaagtgcaaggcacttagggagtgggagaagtcaaagatggagctgatgagctcgctgcagcctgatggagtggaaatgagaaaagtgagagagtggctggagcgatggtgcccgaggacaccgcccttattgtgtttagagcagagggggcaattcgccctgaaaagagggtgccctgggtcacaaagctttgcctggggttggcatcagaatcttccctctcatttctccctgcccctcacccaaggctcggaacagctccatgccaccgtatttgccttcaaaaaagaccgtgcggttgtcagcattgtaggcccggcacatcctaaccagcaccacttccattgctcctgggcagtggggagagaagatgcagggacagtgtcaagcaaagccaggatctgactctgtccccctgatttccttaagccacctccctccacttggctctgtccccttgtccccaggcctgcccacccatccctgggcacctgctttgagaagcacaatctggtcattctggcagagctccataaagcctgagagcctcttggcgaactccaccacgtactgaatggcctcggtgaggtggtgggcacaccgttcccacatctcccacatggactgcagggagggaggagggtcccgctgtagcgctctgtgtggccctgtgatcctcctgagccctggagccccacctaataaactgcaaggggtaggctctgaactcctatgttctcaactagcattttcaaaagcctggtcttagcacaaatgcacagattcctgccagtgagtcccacacactgagcacctaccggctgctgacaccgagttagctgttgtgagggaatccaaaaagtatgagatacagctttgccctccaacaaggtatatctcgttgaggtgaacaggacatacagctgccccttcccccacaaaggttatgcccaaggtctcaataacctggagaagcaaatgtgaagtgccaaacgagtgtgtttagagcaggtggtatgagagtgtgatcgaaaaggcagcataaactttggagcctgatgaatctgaatttgactttggttccaccactttgtgactttgaggaaacctattaacccctctaggctcagtttctgtctgttaaaagtaggaataaatgccaccctcataggttggttgtggtaggggctgaggataatttacataaagcgtttagcacaatgcctggcagagaaggggtgtttaacaaatggtaatcagggttctgattattgttattgttgatggaagaggaggaaggagggtgcaccaaggtctgcatggtagaggaggtaggatgaaggccaggtacaattttaataggcaagaactaaggaaaagcgctcatccatctgctggggtgtagacagatacacacattcgcaactgtacataaaaggtgtgcacatgcttgttggccagcctgtgtctgtgatgtcccgccctgccccaggacccagtcgtgcgcaggtagccatctctgaactctcccggtgggggtgggatacgttcccttcctgcaggtctcctggcctcaccttcctctggtagccagtcacttcctcccgggagaagatgttggagcgctgccgcagcaggtcctccagccgcagctggcatgtctccctgtaggacttgcagacgctctgcaccaggtgctctggggccggagaaggaaggcatggcttgatctcagccagctcctacgcctacccatgcaagggcacttctcagcctggcctatcctgctccgcctcctccctccgcccctcgtctggacccctcaattccctcaggcgcatgtttgattgatacggggtactggtggaaacccctccctcatctctaccaccctctccacctccccagctgctcacctatctctgtcagggaggcatagggtgcctccggtgtgctgcggaaactggggctgccgtagctgtctgggccctgtcccagttccccaagcccaggatgcctgtgttcctcaaaacgaagtccacatcggtcaggggtcagctggctgcctgtgctatagaagctctctctgccctcagccttgccccgctcagggctgtattcaaggtggcatgaggccccattgagccctgccttggccaagttgttggaatatgagggcccagagcctgaggctttcaggaggccagggggacaggcagaagcctcaggcaggtcaggcgaggagcccaggggcagctgcccgtctgggagccccaaggtgtaggtgagggtatctgctccttgggcccctgctggaggggtcttgaccactggttcctgttgctgctgttgccgctgctgcagctgtttctgcacttctgcatgcaggctgtccctctgcttcttggacatgcggccgaacttgacagctgaaagaggtccagggaccaggggtttatgaggcaggagaacatggcacagggcagggtcaggaggcatttggtcattaaaggattaacttgctgctctctgaatggctgactccaagcacagcttctctagcctttagggaacttatgctcaagaccccgtccacctctcactcttgtttgcttctggggtctgtccagtctgccatttcaatctgctaagcaaaatcttctaagttctaaatcagatttgaatcatggcagaattcaagcaatgagtctaggctggggattctggcctccagatcttggggctgggggtggtcgagcagagggcctcaagctgtattggggtcacctcgcctctttgggagggtcggaggaagaggagagctgagaacacaggtctccctgtggtcaggcctgcaggctccctggtgacctagatactcaccacagcccaacccgggctccgcggcttgtttctgaacatcctcttctgctctctctttcctgcctttttactccccccgccacccctcccaggtgtaggggcacagcccctcgccccgcctgcccctttgcacccctgcgtgcttccttttgctttgttattttgggcactgaaaagtgctgacgggctccttctggctcctcatcacctcatgcccccccagctccaccctaggctccttctgtggtggtggaggtgtgcagggagactggtgaggaggtggtgggtgaggagggtggataaggcaccaggaacaccagccctcccccacgaccaccctctggttgttctcaggccaattctgtttccattcctggctatagtcctgtgtccaagtatgggaatgggggattagaaaaggagatagagctagaactacaacaacagggtagcaggggaaggtgccagagctgcatgggagctgggccagagggcagcagagtgaggagaattcgttccaagtaagaagagatgaagaggtatgggaccttggaaagaggatgtttgttctagcaaagcctaaagttggggactccaaagaactttgatgggggtgacccatccatccctggaggggaggagacaaggggttgtaacggggaggaatggagaggagaccagaggatgggccgtcttgcaggttaagccttgtctagctcagcaggccaggctgcccctctggagacaccaggaaaaccccagggggctgtcgacttggcctcaccatctcgggacatgcccagcgccaggcatttctgcaggcggcagtgctggcatcggtttcggctggtgcggtcgatggggcagttctgctgacgggtgcaggagtaggccgcgttacagcgctggctccggcggaagaagccctggggaaagcaggtggagggcaagactgcttatcctggtcaggcccagctcactcacaaaggcctccagcccacaagctctggcagcttttctacatcccacgacctgtcagttttctctctcctccatctatttgtgtaattgcaatttatcctgtagtcatttccccagcttaagacagggccctgccagtgttgagggccctgcaggaaggcgctactcaggcattttcctggctgcccaggagatcatccctggagtcagaacaaaggccattaacccccttgtttatctctaaggagacactgtgtgtgtgtgtgtgtgtgcgcgcgcgcgcgcttgtgtatgcacacgcacacatgcatgcatacacatgcctatgactcaccttgcacccctcacaggtgataaccccgtagtggatcccagacgacttgtccccacagattttgcaagggatcacttcaatttgtgctggaagagagaaagagaagtaggtcagcccaggaggcttttctgcattcaaccaccatgtacctgggctgcagatacaggtacctggtgcttccactacttctccaaccagctccagcttgctgtttccctcttgcaaaatggaaggggaagtgaaatgccaaatgcttctcagcaaagggtgtgaggaagctgtgtttgtttcacagaggaggggagtgtggaggggtggccgggagttgtatcagtgctatggaggcagagaaagcagctgcagaggggccacctgctcagcccttcgagttgaaaagctccagttgcctccctcccgccttgggacataggactcctcacggcctcacaacacctgcttcccgccgaaggggcttcctctgtgcctccctccctcgctggggctcagctcccatgggcaaagtgtagggtatagcaggaagatgtggtacacaaggggtgggggataggcagagatgccagtccttcccagccagacagtgaaggctcagggaggtgctatacagagacagggtgagggggtggcagggaggaacccaggaaacgggggctcaacaccccagctctgctggatgcctgagagcctagggaaagaattagccagggctcttaggctcttggccccagagcagagagagggtggctttgtgtacatccgtgtgtctgagtgtgaacacttatgtttgtacaaaggcatctgtatccatttgtgtgaacatgaatcatcaatgttaaaaatggctgagactagagaccatctcattcaacctcttcatttaccgatgaaggactaagccagatgaggcaaagcggttgggccagggtcataggctagtttgcctgagagctggatctacatcccagttcccctgagctttccattatgctgttctgtgtacctgtcttttcgggtacacatttcagtgggcatgtttgaaggtgtgcttgtgggtgtgcatatgcaagaaaagtatgtgtcatttgtgagcctacgacatatctggttgctcctgcgtccacacgtgcatatttgtatgttagtgtctgctcatggggcactaggaccccgggttctctctcccactgaactcactgtaacctgtacctgcttccctacccctgtggtttgctgctggccctaagctcatctctgctttgccctgttcctgtcaatgcccacgactctctgctgagcttcatgggaccacaggaggccttctcccagctcttccttgaaaggtagctgggcaaagcttgggatccctggttactgtaggtgtttttagcatttcccagagcacatgggtctcttttccaccatcactgacctgctgcctcccctctgagtggggagccctggggcgggacaggccagaaaagtgaagagaagggccaaagccccttttaatctatgacgtgtctcccaccaaaggggcaaaagaagtggcagcctctctggagggcgaatgcacattgctgtgatctcacctccagtccctggcctggacactggtcacatgtagggcctgttgatgtgaagtgggcagggagaccatggcttgcccgccattccccaaaatattatttccatcattcttaaaccatcatccctcaggccagacttgaggtgagtcagaggcagtagctgaccctgacggggacagggcacatgggtatctgaaatcccttcattagcactcaattcctcacccaacccccagccacacgtgcctgcccagcagcaagcttccagtgctcacactgtaagctgtggtccccccaggaccaggcggtaagtgagttttccaggttctttccagtaaattaagagcagattttaatacatggaggggaagagagaataagagggcactgggtgtctggaacaggggcagaaaacgttggggcccccatacttctagtcacttagattctccctctagacctacgttttcttgtcagcaagatcaggataaaagtattattgcctgtccatggggtgattgtaggtaacagagagtaatgaaatgatatcaccaatggaaagcactgtgtattcaagttactcctgagcagaggtcaggctgagaagaccagtgggcctggcaaggctgagaggagcactcgggccctgtggactctgttcttgcccaacacctccccctccaacactgtggcatctctcttttcagtggcctaagaccagagatgggagaaaccaacgtgggccacccaaaaaagtaagcgggagggagattaggccaagccgcagtgggaactcgggctctggcccagcagtcaaccacaggcctccctgcctcttcccttctccaagagccacatccgcgtgcgtgtgtgtgctgaccacatggtgaccccagacacatctccctgccccatgcttgacccactgcttctcctggccctaggaacctcacaacagtgtcaccaagaccttgaccttctcataggaagatgcggccagtcaaggacccccttcgcaaatacccatgtttgggcgacaccaaagccttggactccagccacctggtcagcccatcctccatcctcccagtccaagacagaagtacccagtgagacagacacacaaggccaaagactctgagctagaatgtcagaccccctagcctcactgagctggagagaccaagaggtttgggtccaggaaaaacagagacatagatctagggatggagagacggctgcggaaacactgaaacacagaaaatccacgcttgtatcctggcctttgcccaacccatggccccctcagcacttcaggccctctagtcctgctcccccctccttcccctgccacctgcactcccttcaatgccatccacccaaacctcagaaagaaagtaccagtgctgtgtacatgagggtgtgtgttacttgtagagaaggggtgggggagaacgggaagggggctggtagacttgggggttggtgagaggagctgaaaacacctctgatgataactcaccttcaaaagctacccctgggagacacgtccctgaagcagcaggtggtgggaactcagattggggagaaggagctgagtaatcacaggattactcaaactgttgccctggagccaggcctgccaggaacttaccatctaagggcctgccagtgccaggaactagagccaagcaaaggtcaggaacctcgaaccagcccctgcaccactgctcccatggcagccctaactctaccctcgcctgctgtcttggaaagatctttgcatctcacctgcagctctctcactgtagctctctcctgagagagagctttctccaaaagaaaactccaattccacatcttccaaaaggagagacaaatgcccaaatgcacccgccagctccttaagtcatctaatgactgaatgactatggctttctgcatctcaaacaagattacctggggatctgaggtgggactcaagattctgcactttggtcagctcttagttggtgcctaagcttactggtcttcagcttatactttgagtagcaagaacttagtccctattcctgcctttttgccaggctgctccttccagggagtggggctggggttggcgatcttttcctgagctcattcttgcatcttttctgccatccagtgtgacctctaagacttcattctgagacaatactagaaaaagaaactgaatctcctctgaattgctttagagactgaagtacccccaggagcatcctagtagctcctcctatgaggggaaatacggtagaggcaaagtcctccatcctcctctaatcgagcctctcacagctgtgagattcaatgatagtgctttgagtacttccagagcctggccctgtgccagcttaggaagccaaccctgggccctgtccaggtgccctatgccacagagaggaagtggtaggagcaggggaggggctgcaacccagggggatctctcctctcaaaccccagaaccaccacccccccaccatcatggtagagaatgggttcacacagagaaaccccggggtcctcatctcctcctggtgcctcgtcaatctagagctgggccttttcctctcctctttctctctcctttttctccagtggatactgattaaggagaaaggataatgatagacataagcattggctgaattcttactctgtgccaggctttacatgcattttcattcaatgatcacaaccaccctgtgaaataggccctgctagtatcatcctcatcttacagatgagaaaactgaggcctagagagaataaacagcttgactaaggtcacacagccagaagtggcagatctggcatttgaacctagatctctgtaattctgcagccagtgccctcaagccttaagctatatactttatgaggataagacgcccaaatgcacaccggagacctgggtagaggacatggttatttggctgtaggggtaaaagtgtgaggtgattgtggtggtctaggaacagaattcacagaggaaacccacagaactaaagccaggactcctgtttgtataaagatcccaagagatattattccctctgtcccaactcttcctctgaggtcccagcctcctcctgcccttacccctttctctaaggccaagtgggatgacttatatatcaacaacagggttcccggggactcctcaggaacaccacagcccctttagggtatagactaggtttccatacatcttggtatgcctccctttgcagaatgaatgaatgagtgagaaagaggaatgcatctctttccttagcttgagctcctcctctccccacagccagaactctctgtctcgatccccaccgagaccacagctccggtcaggggtcacttgcacaccccaacctgtcaccagcctccctcctttctcagctctcagttcccccagcttctgcaaagctggaaaccaaggtggtgggtgccaccacaggggagcaggagcgggagggctgggtgggggctgggggagaagtggttctacctggcgaacactacccccagcccaggccagggccctcaccgcagctcctggtgagaattttctgctgaaacacccagatcctggggctgagaaaatagtgaagctaaaactcaggtgggcgagggagagtctggggttttgaaaagccatgaatgacagccagccagccacccgaaaccccctcctggtgcctccgccacccccacagtctgggactggagaaaggcgagtgaaaacaaccagtgaatgggggaggggatgaatcactaggaggaagctctggcgagtgggagcccagacgtcaccatcagcaccttccctgccttcagggccatctgtccctcatcccagagcaccttcactgctccaggagggtagtggacccagaaagaccttggctctggccctgaggccctgccttgttactgtccctcccccgaaatagacatctccatcctttttgagcctcagagccccagggaaggggctgcactgcagcagcaggcgtggaggtgagacttcagaaaggactagctatatgggaacaggagcgcgggccttgggctgcccgcctgggagagaccttagcccttggaaagtcctgttccctgttagtttgagtcagcagcacagcggcaggggatggggaggagcccttggtagggaccgaatattttcattgtgctgggacaagctgagtcttttcagagtctagcaccttgggctcggtggtttggtatttctgttaggaatgggaagacggggaaagagaagggtgctggagtgatgaaaggaaggaagaagcccttcacggagtcctaagatggccctgggctctcagggtgatatctgtgtaccctggggacttggagtcctttctggcccactgttcctcatgatcatgaccaaacctaagaaagatcagctcatagacagtgacctcacacccctcggcctcccacctccccatccagaccaaatgccagggcctgagtgcctattggcgccacgctggccatgcccttaggggaagatgtctgggctaccctccgtctggctggctgggagtctctttggcgtacagacacattatctccacttgacagcagcaggtcggatggcagggtgctggtgccatccttgtcagagccaccctacttccctcttaccgcttgcctagaccctgtgtctccctgtcttccctttactgccagttatcttttctctccgcctctccctgtgtctatgtgccttgtgatcttctgcattccagctctgtttctgggcttcacaccttcatgtttgtttgtttgtttaagagacagggtctcgctctgtcacctaagctagggtgctgtgacattgatcatagctcactgcagccttgaactcctgggctcaaacgatcctcctgcctcagtctcctgagtagctgggactacaggtacacgccaccatgcccagcgaattaaaaaaaactttttttgtagggacagcggctcactttgttgcccaggctggtctcaaactcctggcctcaagcctcagcctcctgaagtgggattataggcatgagccaccacgcccggctgcacctccatgcgtttggctctattggtgtttctccaaccacacctccagctggacattactctctccctaggtgttccagaaactcgccctctgagttgggcctctgcatctctccttatttcttgatttgtttctgctccttttgtcgggcccttggtctctgggtgtgtcacagtcccaagccccatgtgctttgacttttgccatcggcggttggaggggctggtggtggttggcactcattggggtcagataacttggggctatgagatacctgtaaatgtccaagtgagaaggaccagtggcactgaccccctcgttggaggaggccctctctcctacttccccgcctgggtggggctgtgtgtgtgtggtgggggtgggaataatggagagctggccaagtgtctccctcagcccctcctggggactcctgccccgctgctgggctagaagcacacctagtcatttcatcccagggttgatttgctcattaggggccatctctgggaagaccagtctgccagcgtttgctgctaatagagagaagctagaagggaaacggaagctccaaggggccctttcctctgtgtagaagctgttggctcttctctccagccctccttatccaccccagctcatatgcctgcactgtggcctcagtccctgtcacagaagtggaattcttttctttccttggtttcccttccttctaacctctgggagagctgagtctccatcatcacccttggggatgcctgccttagggcactgggctctctcttggccctgggcctttggaatgggagactctccatagttggttttgttgttctatcttaaaattcagctcccttgttttgcggatggtagaccagggcccagtgacttggcttgtctaagtctatatggctagccagtgataggcggcacaagtgcctggtcttacactgtcagtccaggggtctttccaggactcaatacggcctcccttctgtggcttgtgggaagaccccaggttgaagctggggctgcttcaggcctcagccacaggggcatggggcttcccttttcctccttcaccttgtgctctgagagcttctctggcttccctggcttcccttcacaacaaatacaggggacttcctgaggttgcccacccttgctctgctggaaggcacaggaaccccagacatctgcccaccaactgttggcccagggctccaagccaggaaaagggtgaggccgaggtctttccaatcccatctccattgccttgcttccccggtcaaatgggtgactgaccctggagaaccacacacacacatacacacacaccccacacacacacgcacacacacacatgcacacacacgcaggcatgtgcccgggtgcaccctgactggattccacatagtcctcatgtccctggattgggcagaaagcctggtggctttgaggcctggacgcggggattctgtgccctgctgcctgccaacctcagttgactctcgctgtcctgttgcttcagagcacagcaactgctctggcctccttttactcacaagcaggctggaggcacagagggaaacaccgtaacaagggaaacactgtaacaggagagtgcgttcagggcccctagtaattaccagcccccatcagataccagctgtgtaacattgggccaagtacgcggcctccttggctctcagtctttttgtaaaattaagggcctggatacctcagatacttttggaggttctttttggaactcaggaattcctcaacagtcctcttaccattgctgctgtcagggagccgcctggccagcaggactccccagctgctccacccatctcccaacagatcttgaccttgaccaggacgcaccctgctttgctcagatttgctcacactgttcccaagacatcctcctttccagaggggtgacgacagggtccaggctcccccgcccccaggtggccccattcacttacttctcatgactgagccttggctctgccggccttggctccctgtccttctcagcagggggtggtccaggagtggggtgcagctggcggcagaggcggggcgaggccctctcagcagcgcctcagcctgaagctctgcacctagctctctcccccagtgcttctggactggggggtttaagctctgcaccacacaggtggccaagtgacaaccccccaccccacccccaaggggtgcagtgagtaggatgacaggcgccccacgtggccaatctgggcctggggcagggtgtgaggggaggggcagccaatcgtagggggcgttggaaaattccaaaaccacatgcgacagccacacgcggtaaaagctgtttccacccgccagggtagttctggctggggagccagaatggagctcacacgagcctgaagccaaatttctactcctcctacccccgaggaccttccaagcctgaccctctttgccaggtgacttcagggacagggatgttttcagaggtaagtcacaggatgtctgcctggggtggtggcatgtgccacctgacaccctgtggactgccaacagccatacccagtgtggtgcagcctggggggctgtcccaccactcccatgcccacgctcctccctgcagacaccacatatatcttgcgctagggaatacatggaaatgatagaagcagtaataatcaccaggcaaatacccacaatccacagaaggaaaccagaaatttccttaggagccaaactgctgaaattggagtgtagataatgatcatcatcaccatcatcatactcataatcataataatagtgcttactattatgtgtcagaaatggttctcgatgttttatgtggataatctaatcctcacaaaatactttatgtgggccgggggcagtggctcacgcctgtaatcccagcactttgggagcccaaggtgggtggatcacctgaggttaggagttcgagaccggcctggccaacatggtgaaaccccatctctactaaaaatacaaaaattagccaggcatggtggcgagcacctgtagtcccagctactcagggggctgaggcaggagaatcgcttgaacccgggaggcggagtttgcagtgagctgagataatgccactgcactacagcctgagcaactgagtaagactctgtctcaaaaagaaaaaataaaaaaactttatgaagtagctaccattatcctcatttcgaggaggaaagtgagacacagagaggttaagtaacttgcccaaggttacacagctagtaagtggcagagtcaggattcaagcccaggcagactggcttcggatcccacttgaaggatgggagggtttctctggttcaagtctgcttttgagggtgtctcagcctgggaggtccctcggtatgtgagtctctctggagtgttttttggcctgggggaggggggtccttctcaggggccaaacaattccagagaccttctcagcctcttaggtgctttgtggggtacattggctttgagagtccctcttcagggcccctcagtattcaggctccctcttggtctggggagttcccccgggttccccatcttggacccccatcttggggttgtctcaattcaggagccaattttcagagtctctcggcctgggggaggccttaatgtctcctggattctgtggggcaaactcctgagaggtgtctgatcttgctgggactccagaccctctcatccaggcacaggcctttccttgccttcctgggccttcctggggcttcaggagctgggccgtggagtgggggagaggctgtcagcctggatcctcaggacaacactcttggggtggggacacgaggactggtgggatgggaaagggataaggaggtatagtcctggctgaggtttctgaggtcaggggttaagggtaggaatagggtttgacctctcccagttcctgctgctccgaaagtccccctactccccccacccacataaggtccgtgacccccctcccccagctcacccgcgtcactccctgacccgctttcctcccggggccctgctcagcatttccgtggggccctgtggctaggggcaggcgagacactgatcaggattatgctgagcaaagcaacccccacccaggaggaggtagcatcctggatggccctcagccctgggctgcccagctcatggagaagggcaatgctttgctctctgagatgtctctacttggaacagggaggctctagacaattttggcattgggcgagatggcagtgagctctcaggaggaactggcaaggcagtcaagggacggctatggagaaatggtgtggccactcctaccctggagggatcctctcgattcagggacccatgctcacagaagggcacgcatggccctgatgggcatagctttgggactgtgtgcattctctgggggactagcctttgccacaaactaggagaggagagctgatgtgctgagtggtccctagagaggattcttattcactagcgtccactgggaagtcctctctgagctctagtgcccttcttacctgctgtagtctggctttcagggccccaggacacagagtgcccctgtccattctgtttcctacagagataaagctctcctgctctctagtcctgcacaggctggctccaggcttgttcacacctcaggatgtgttaaccacagagatgaacaccaaacctggctcaggaccacagagcttggtgcaggctgggcacagtggcccatgcctgtaatctcagcactttgggaggccgagaggggtggatcacaaggtcaagagtctgagaccagcctgaccaacatggtgaaaccccgtctctactaaaaatacaaaaattagccaggcgtggtggtgggtgcctgtagtcccagctactcgagaggctgaggcaggagaatcgcttgaacctgggaggtggaggttgcagtgagccgagattgtgccatcgtactcccgcccaggcgacagtgtgagactctgtctcaaaaaaaaaaaaaaaaagcctggtgcaggctccctgtctcccttggcagcagcgctgagttcctgagttcctgaggccaccccgcctccgcacacccccctacctctatctccttccttccccggcctggcagtcggccccaccccctcccatctccctgcctctgtccagcatttctcctcgccttttttcacaaggcggttcccttttcctttgttctctcctggtttctttacagtgtttcctttcatgcttcaggcttcttcctcatctcctcccactgccctgatctgtggtttcctcgcacctccccttgctttcctgttgcctgccatctcttcctgactcctccacctctgtccaacctcagtccccccacagatcacttgctgaattattctccatctcattatgccccagccattttcttgccccggaccccctactcacaggtgtgggtcttctttgcagccagcagctctgtaaagacaagagagggggttgacgtcaaaggttgaagatcatgaggggctgagacactttccccactcctaggatcccactgccgcactccttccctcagagcctggcgtctgaagggcaggcaggccaccccctgcagtgcccctctctcctcctctgcccttgggccacactggccctcttccaggtacccagaagtgtcaggctcctcactgcctctgggactcccccaagctgctcctttgcctagaatgcctgtccctcctgtaccccttaatctagccaacttctctttctccctcaggtctctgattatgtttcttccttggagaagccacacacacccccttcccctgcccttgtgctgacacatttagctccttgcattttatttcctggcactcaccatgtcaccaactgtcacctaactgctgtaattgtgtcattgtctatgaaatgggtctttcctgccaaattgtaaagccctgtgaaggcagggactgtgttggtcttatttactttgtaatttcattggaggtgcacaagaaatatcctacagccagagttaaatctctgtgggactgaaatctcttggttgcttatctatgcctgaaaacaccagggcttcagagatgtgggggttgggagtagggggagaggatgtttggaggaagaggaggggagagttgcaaatacagacccctctctggcttccacgggccaggcttccctggcctaccagcctgaagaggaaggcctcccttctctgctgctgctgcgtggccgggtctgggtggagattgggcagtagggagcatgagtgggtcgatgggggtcacatggatactcggacctccagggggagcagccgttgaggggagggccttagctggagcatggttggtgggtgggggggtgtcacccattcatgcagttaacatctatgaaacacctagccagggagcccctggaaagaggattcccctgccagaccttggcccatttcctacatccacatagcagctcatcacagaacacatggccagtcttttgtctcagaaagcccttcaaccatgccctataccccctatagcttccctaacctctgactctattctgttatttttttccttctgctgttcagtcttgacacctgacatacacacacacacacacacacacacacacacacacacacacagtgcccttctgcccgggagatgctccccactggcaggccgtggtcactaggctgtgtggaggcgagtggcctgatggcctgggctctgctggggtgagggaggagaaaagactgccccgaggtggcaaggccccacccagccccgcccacctccccttgctcctgcctggccccacccagcttcctccctgacgtggcaccggctcctggcctctagccttgcacctcagagcagtcctgtggtgggggtgctccccttgctcacccaggcagccagttcttcctccaccaggtggccctggagcttggtggctctggccctcaaactttcctcctccatgctcacagctgaccaagcctgtggccctgcgatcctgctctgagggggttcctgacttggaccatgggtggggccaaggacggcctgacattctgtccttccctgctgatggcccagtgccccacattctctgcagagatgaaatcccacatccctgggtgagtggcgaggaaaggaccaggctacgtggtcatgggcagctgacagggtgtggttccccctgccacactccccaagtctgtcactccttaaaggacaggtttctccactggtgaatgaacagaaggtggagcagccagcctcccggccactgctgtctggggtcctggccagatcaaggaagcagtgtccctgtgcctcctggggggtaagcccacacctgggagggcctgtccacattctgacccctcgctgggtctagatctggctcccctgacttggctcttccctccccatctaccctccaacctgtttcttccttctcccgcttctccctttctttcctgtttctctccttttgcgatttcttctcctctgtcatctccccagcccctcctcctgtttctcctccagtttcactccctgccaacccagggctttctcctctgcactcttgtccctccctcccctcctcacttcttgcccagtctcttgccatttctgccctcctctgaacctccagcagtctcttccacctgcaggcagggccatgggcctcttaccccgtgaggctcggtgctgtctctgtggggccctgtccatggggcagctcccttggtgccgtcctggctgccctggctgcccaggagggcagggagcagggcccaggggagggaggagggcggagggtggaaggcgggagcacctggc

SEQ ID NO: 2730 - DNA, 4922 bp, Homo sapiens
  source 1..4922: mol_type = genomic DNA
gattcccgtcgtaacttaaagggaaattttcacaatgtccggagcccttgatgtcctgcaaatgaaggaggaggatgtccttaagttccttgcagcaggaacccacttaggtggcaccaatcttgacttccagatggaacagtacatctataaaaggaaaagtgatggttagtcattgctttaattttttgttactccagctgtaagtacaaattttgagcttgctattctcgtggttagttctgggtaatttctttctatcttccttaaatgaagccagacccctacgttgaaaacatactttaaataaatgttcttgttattgagagaaaagatttctgctccaggggaggaatatgtcagttgtctgagttacgggacttgggttgggtcatgaacatgagaaagttcattggctgagtttctaatagctcgcatagtgccttcaacttcataggtacttacacaggctattgaactgaattttgagtggaaagtggggtaagaggtgggaatgaacaatatggtttggaagaaccagaggatggaaggcattaagttggctaaggcacttacttattttagagataaagctaccaaggacttgggagtgacatgctgtaaaggagttttaggatgaatcttgcatcagtgcagattataaaagggaaagagtggcagaaagccaggaagtggattattaagaaccaatgatggaataagtacagggaaagagaaaggaaagatggatttagccaactgaatctaggctgcacactattaaagctcagggtggaggccagtcttggctcatgaacttctgagtgtcggaagtgtgctatatcaatggcaggattttcgctaacaccagtagagcttgcctctatgactggagtttggtagtactcgctgccacatagagtaaacttgagaagaatgtttgcacagccaggtcaagtgttacaaatccttctgccctcacttaggcatctatatcataaatctcaagaggacctgggagaagcttctgctggcagctcgtgcaattgttgccattgaaaaccctgctgatgtcagtgttatatcctccaggaatactggccaggtttgtggaacagtggttagtttttatattatagaaataaagcttacagacattgtgagacatagaaagacataagaaaacagaaataactcaggccgggcgcggtggctacgcctgtaatcccagcactttgggaggtggagtccggcgtattacgaggtcaggagatccacaccacggtgaagccccatctctactaaaaatacaaaaaattagttgggcgtgggggcgggtgcctgtagtcccagctactcaggaggccaaagtggagaatggcgtgaacccggtgggcggagcttgcagtgagctgagatgcgccactgtactccagcctgggtgacagagccgagactctgtctcaaaaaaaaaaaaaaagaaaatagaaaactcaaactccactgttaagagatcttaagttggactgagccatagaaatcgcccttatgacctatgaccttcctttttttttttttttttttttttccttcaagacagtctctcgctctgttgcctgttgtccatcctggactgcagtggtgtgatatcggctcattgcagcctttgcctcctaagctcaagggattctcctgcctcatcctcccgagtagctggaattacaggcatgtgccaccatgcctgactgatttttgtatttttagtagagacatggttttaccatttggccaggctggtcttaaacgcctgatctcaagtgatcctcccacctcggcctcccaaagtgttgggattacaggcgtaagccactgcgcccagcctgtaagaccttttcaacatacatgctgggcatctggcagtatgttgaactttataatttcattttgtgtagacttgtgccactaaatatctagaaattctattaaagtggcttatcacattttcccatagtcaaagtttttaccttaaaacaatgaaatactgggacagaaattttttaagaatcttagccagtcatgacggcatgcacccatagttcccgttaattgggagtctgagccaggagatccctcaagtccaggagctgggggctgcagtaagttatgattttgccactgcactccaagcctggggcacagagtgagatcctgtttcttaaaaaagccagtcatgggtggctcatgcttttgtaatatggggtactttgtgaggctgaggctggtggcttgcttgagcccagaagttcgagaccagggtgggcaacgtggcaaaactccgtctctaccaaaattaacaaaaacgagctgggtgtggtgttggcgtgcctgtagtctcagctgaggctaaggtgggaagattgctagaacacaggaggttgaggcagcagggagccaagactgtccactgcatcccagcctgagtgacagagtgaggccttgtctcaaagagaacctctgccaacttgaatgaaaaataccttaatttgtatttttaagaaatgactagttagtaaaacttgaatcttttttgccacagctctattttaataatttttctgttgagaaaactagtagatttcttgaattctaagagttctaacagggattttattcatcttaactattttgacagatttaaaaattatgtagtaagactttatttcaatgttgacaggacgggttcccatgtgtgtttttgcagagggttattcctgaaactgacttgttactaggaccacatagtttggtacacagtagaaaaaaggcagttagttattgctgtagaatgaactgagtgacagttcttgcttgcttgagaaaaatatactgagcatctagattgggccaggtagtgttgctaggtgctcgggatatatagtagaaaaacaagcctgtcttttttaatgtatgcaggaaatctctggagaagtaagagaggttaaggaaagctgggtatgtgcctgctttacatggagtagtagtgattaagttggccagtgcccagaagtgcttactgggtgccaggattgttgctgtggaatatcgagtaccactaacttttaaattcttcaaagagggctgtgctgaagtttgctgctgccactggagccactccaattgctggccgcttcactcctggaaccttcactaaccagatccaggcagccttccgggagccacggcttcttgtggttactgaccccagggctgaccaccagcctctcacggaggcatcttatgttaacctacctaccattgcgctgtgtaacacagattctcctctgcgctatgtggacattgccatcccatgcaacaacaaggtaatgattttaggatctagagtttgtgaatgcgtgctctagaaaaaacattcctgtgcacattgttagagcttggagttgaggctactgactggccgatgaactcgcaagtgtaggtagtgtgctacatgaggggcaagttttcgctaacaccacaagggtctctggcccaatgagtggagtttgatagtaattcttgctacaagtataacattactgcatgacagctttgtggagaaatgaaaacatttggaaaatagtgtgttcttctgcctttgtccatgtttcttgctcaggcctcaggcacttggcctttgttttcacaccaacttgatgggttctactataagatgctaaaaaggtgggttgtgtgtggttcagattggttgatttgtaaccctagttgtgcataagaattgcccagatattttttttaaatgccagtgtccaggcatttttttttcaatccctatgattccagtgtgcagacaaggttgaaaatccctatttataatgctccctgttacaattgcttttcaactaagagatgtctgtacttttggtacctagatgatgtaagagccaggaaggtgcttgctgtttgggtttgaccaagtgtcactttttaataatctgccactcttggcagggagctcactcagtgggtttgatgtggtggatgctggctcgggaagttctgcgcatgcgtggcaccatttcccgtgaacacccatgggaggtcatgcctgatctgtacttctacagagatcctgaagaggtaagcttctccaaaggcttgtggttacataagcaaattggacgacttggactgtgcttctaggaagcaaaacttgtcagtccctgtaagtctttcctcttttttttttgtaacccagattgaaaaagaagagcaggctgctgctgagaaggcagtgaccaaggaggaatttcagggtgaatggactgctcccgctcctgagttcactgctactcagcctgaggttgcagactggtctgaaggtgtacaggtgccctctgtgcctattcagcaattccctactggtatgtatcaggatagaggtgaatcaagctgatattttgcaacttctcagttttattctaactttaatgatctctgtgacttttatactagctttaagaggttttcattccagtgtgctacagcatctgatagactgctgttgggagtggggtaaggaaaaatactacattgaggacagagctgatggctttttttggtattctcttaacagaagactggagcgctcagcctgccacggaagactggtctgcagctcccactgctcaggccactgaatgggtaggagcaaccactgactggtcttaagctgttcttgcataggctcttaagcagcatggaaaaatggttgatggaaaataaacatcagtttctaaaagttgtcttcatttagtttgctttttactccagatcagaatacctgggattgcatatcaaagcataataataaatacatgtctcgacatgagttgtacttctaa

SEQ ID NO: 2731 - DNA, 5829 bp, Homo sapiens
  source 1..5829: mol_type = genomic DNA
cgcctgtcttttccgtgctacctgcagaggggtccatacggcgttgttctgggtgagttccgtgtagcgtccctggcgccttccagggctagaaaaatgagcttttcctgctcaaatgaagggtgagaagactagtgatgaaagccggtcagactggatctgtctcccgcccggcgcgccccaccttaggcctgcggcccgcacgtggccaggctcgggctggcgggttcccagagtgccccgggagcgggtggaggccgccctccagcggaggctccgagctggggttcggaccaggccgcgggtgggcgggagtgcagaaagcgggctaacatcctgtgttgctatcccttcggagtcccacacggcggtgagtctaggcccaggcgctgatttacaccagctacttgggctggtcgggttttcccttcgcgccgtgcgggtcaggagttaaggttctcgggtttttagacaaacaagtggtgacagcacagcgaagtaattccaaagcatccgcctacaatctgcttgaaaatgtctgaaaacaattcatgccttttttgcctttagtttgcatattccaaacatggctgctcttttgtatctagttgttaacttggcgcatccacaacttttccttaattcctatcttgagaagtgttgaatttccattcgctaatttcgtgtagttttattactcggttactctgccgtccacactatttcctcagtaagatgtgcgctgttccgtaatacacgacatgtatgggttaactttctgtttacccttcactacactgtaagctcaatgcctgacactatagcagatggagtttttggttgcttttaagggtgtgccctacttaactcaatggaatgaaaagaaataggttgctctcttatttcagattcccgtcgtaacttaaagggaaattttcacaatgtccggagcccttgatgtcctgcaaatgaaggaggaggatgtccttaagttccttgcagcaggaacccacttaggtggcaccaatcttgacttccagatggaacagtacatctataaaaggaaaagtgatggttagtcattgctttaattttttgttactccagctgtaagtacaaattttgagcttgctattctcgtggttagttctgggtaatttctttctatcttccttaaatgaagccagacccctacgttgaaaacatactttaaataaatgttcttgttattgagagaaaagatttctgctccaggggaggaatatgtcagttgtctgagttacgggacttgggttgggtcatgaacatgagaaagttcattggctgagtttctaatagctcgcatagtgccttcaacttcataggtacttacacaggctattgaactgaattttgagtggaaagtggggtaagaggtgggaatgaacaatatggtttggaagaaccagaggatggaaggcattaagttggctaaggcacttacttattttagagataaagctaccaaggacttgggagtgacatgctgtaaaggagttttaggatgaatcttgcatcagtgcagattataaaagggaaagagtggcagaaagccaggaagtggattattaagaaccaatgatggaataagtacagggaaagagaaaggaaagatggatttagccaactgaatctaggctgcacactattaaagctcagggtggaggccagtcttggctcatgaacttctgagtgtcggaagtgtgctatatcaatggcaggattttcgctaacaccagtagagcttgcctctatgactggagtttggtagtactcgctgccacatagagtaaacttgagaagaatgtttgcacagccaggtcaagtgttacaaatccttctgccctcacttaggcatctatatcataaatctcaagaggacctgggagaagcttctgctggcagctcgtgcaattgttgccattgaaaaccctgctgatgtcagtgttatatcctccaggaatactggccaggtttgtggaacagtggttagtttttatattatagaaataaagcttacagacattgtgagacatagaaagacataagaaaacagaaataactcaggccgggcgcggtggctacgcctgtaatcccagcactttgggaggtggagtccggcgtattacgaggtcaggagatccacaccacggtgaagccccatctctactaaaaatacaaaaaattagttgggcgtgggggcgggtgcctgtagtcccagctactcaggaggccaaagtggagaatggcgtgaacccggtgggcggagcttgcagtgagctgagatgcgccactgtactccagcctgggtgacagagccgagactctgtctcaaaaaaaaaaaaaaagaaaatagaaaactcaaactccactgttaagagatcttaagttggactgagccatagaaatcgcccttatgacctatgaccttcctttttttttttttttttttttttccttcaagacagtctctcgctctgttgcctgttgtccatcctggactgcagtggtgtgatatcggctcattgcagcctttgcctcctaagctcaagggattctcctgcctcatcctcccgagtagctggaattacaggcatgtgccaccatgcctgactgatttttgtatttttagtagagacatggttttaccatttggccaggctggtcttaaacgcctgatctcaagtgatcctcccacctcggcctcccaaagtgttgggattacaggcgtaagccactgcgcccagcctgtaagaccttttcaacatacatgctgggcatctggcagtatgttgaactttataatttcattttgtgtagacttgtgccactaaatatctagaaattctattaaagtggcttatcacattttcccatagtcaaagtttttaccttaaaacaatgaaatactgggacagaaattttttaagaatcttagccagtcatgacggcatgcacccatagttcccgttaattgggagtctgagccaggagatccctcaagtccaggagctgggggctgcagtaagttatgattttgccactgcactccaagcctggggcacagagtgagatcctgtttcttaaaaaagccagtcatgggtggctcatgcttttgtaatatggggtactttgtgaggctgaggctggtggcttgcttgagcccagaagttcgagaccagggtgggcaacgtggcaaaactccgtctctaccaaaattaacaaaaacgagctgggtgtggtgttggcgtgcctgtagtctcagctgaggctaaggtgggaagattgctagaacacaggaggttgaggcagcagggagccaagactgtccactgcatcccagcctgagtgacagagtgaggccttgtctcaaagagaacctctgccaacttgaatgaaaaataccttaatttgtatttttaagaaatgactagttagtaaaacttgaatcttttttgccacagctctattttaataatttttctgttgagaaaactagtagatttcttgaattctaagagttctaacagggattttattcatcttaactattttgacagatttaaaaattatgtagtaagactttatttcaatgttgacaggacgggttcccatgtgtgtttttgcagagggttattcctgaaactgacttgttactaggaccacatagtttggtacacagtagaaaaaaggcagttagttattgctgtagaatgaactgagtgacagttcttgcttgcttgagaaaaatatactgagcatctagattgggccaggtagtgttgctaggtgctcgggatatatagtagaaaaacaagcctgtcttttttaatgtatgcaggaaatctctggagaagtaagagaggttaaggaaagctgggtatgtgcctgctttacatggagtagtagtgattaagttggccagtgcccagaagtgcttactgggtgccaggattgttgctgtggaatatcgagtaccactaacttttaaattcttcaaagagggctgtgctgaagtttgctgctgccactggagccactccaattgctggccgcttcactcctggaaccttcactaaccagatccaggcagccttccgggagccacggcttcttgtggttactgaccccagggctgaccaccagcctctcacggaggcatcttatgttaacctacctaccattgcgctgtgtaacacagattctcctctgcgctatgtggacattgccatcccatgcaacaacaaggtaatgattttaggatctagagtttgtgaatgcgtgctctagaaaaaacattcctgtgcacattgttagagcttggagttgaggctactgactggccgatgaactcgcaagtgtaggtagtgtgctacatgaggggcaagttttcgctaacaccacaagggtctctggcccaatgagtggagtttgatagtaattcttgctacaagtataacattactgcatgacagctttgtggagaaatgaaaacatttggaaaatagtgtgttcttctgcctttgtccatgtttcttgctcaggcctcaggcacttggcctttgttttcacaccaacttgatgggttctactataagatgctaaaaaggtgggttgtgtgtggttcagattggttgatttgtaaccctagttgtgcataagaattgcccagatattttttttaaatgccagtgtccaggcatttttttttcaatccctatgattccagtgtgcagacaaggttgaaaatccctatttataatgctccctgttacaattgcttttcaactaagagatgtctgtacttttggtacctagatgatgtaagagccaggaaggtgcttgctgtttgggtttgaccaagtgtcactttttaataatctgccactcttggcagggagctcactcagtgggtttgatgtggtggatgctggctcgggaagttctgcgcatgcgtggcaccatttcccgtgaacacccatgggaggtcatgcctgatctgtacttctacagagatcctgaagaggtaagcttctccaaaggcttgtggttacataagcaaattggacgacttggactgtgcttctaggaagcaaaacttgtcagtccctgtaagtctttcctcttttttttttgtaacccagattgaaaaagaagagcaggctgctgctgagaaggcagtgaccaaggaggaatttcagggtgaatggactgctcccgctcctgagttcactgctactcagcctgaggttgcagactggtctgaaggtgtacaggtgccctctgtgcctattcagcaattccctactggtatgtatcaggatagaggtgaatcaagctgatattttgcaacttctcagttttattctaactttaatgatctctgtgacttttatactagctttaagaggttttcattccagtgtgctacagcatctgatagactgctgttgggagtggggtaaggaaaaatactacattgaggacagagctgatggctttttttggtattctcttaacagaagactggagcgctcagcctgccacggaagactggtctgcagctcccactgctcaggccactgaatgggtaggagcaaccactgactggtcttaagctgttcttgcataggctcttaagcagcatggaaaaatggttgatggaaaataaacatcagtttctaaaagttgtcttcatttagtttgctttttactccagatcagaatacctgggattgcatatcaaagcataataataaatacatgtctcgacatgagttgtacttctaa

SEQ ID NO: 2732 - DNA, 20568 bp, Homo sapiens
  source 1..20568: mol_type = genomic DNA
aactcagctgagtgttagtcaaagaaggtgtgtcctgctccccaatgacaggttgctcagagactgctgatttccatccctatataaagagagtccctggcatacagagactgctctgctccaggcatctgccacaatgtgggtgcttacacctgctgcttttgctgggaagctcttgagtgtgttcaggcaacctctgagctctctgtggaggagcctggtcccgctgttctgctggctgagggcaaccttctggctgctagctaccaagaggagaaagcagcagctggtcctgagagggccagatgagaccaaagaggaggaagaggaccctcctctgcccaccaccccaaccagcgtcaactatcacttcactcgccagtgcaactacaaatgcggcttctgtttccacacagccaaaacatcctttgtgctgccccttgaggaagcaaagagaggattgcttttgcttaaggaagctggtgagtacatggtcctagacagaaatcaggattctcaaccactgggcagtggggtaaggcgagaaggggctgggggtatgcacaagctggagagcttctccaaagcttgaggtcaccatttacccttgcatggtgagcatgttgtcctatgagaaaataattcagtgaattttggagtgggcacctagtccttcctaaatcacagaattgggctggaacaggggatttgtggagcaaacctgtccctcctgccatttggaagcaagaaggggtctatgcaaagggcaggtccctattacacttggtgtttggaaagaggcggtttgggaagtttgtactactttctgagtttgcccacaacactaacgaatttgggttttccagaaacagttattaataattagaaaagttggaaacaaaaacaaaaactttgacataaaaatagcagtagttgaatcttatatttgagtttgtgtatattcttttaataggaaaccttaaaatttttttaacaaatatgtcaaggacttagccttcaagaatgcttactgagcatcaccacattagtaactggcagcgtcttggagagaactcagcacgtgaccttcgaatgcaatatcttccactccagatctgttctgccttccgtccttgtcttcctgtctttcctagagtaccttctcaactagtaacttcagcaacatctctagcttctttccctccttgtttaactttttaacaaaagcatagcatacatgcaccagattacacatattctggatgtgcaccctgatgaatttcacaaagcaatcacagccaggtaaatagcctgcagattcagagagaaagcatcaccagcgccagaagtgcatgctgcactccagccactaccctggtaagcacttgctggacttctaacacacagattcattttgcctgatcctgtactttatataaatgaaatcatacagtgggtcctatattggatctgacttctttgctccacgttacattggcttagttacccaaagctgattgctcaaatgagaacctgacttcccattcccagtgtggcttaactcaaattcctatcatttctcaccaggattactgtaattcaactcactgtctctgcttgccccattgaaaactcctgatctttttttaaaatgtacttttggtgatttaactcctaactctccttcttatgagcatcgttgtcaaggcccctggcaagctcaatgttgctctcagcctctgctaccctgatggcttgggtcccctctgctgtagacacagcctgtcacactcattttctccaaacatcaaaattgttaaaatgatggtcatattgttgtctcttcctagaatgtctgtcctcaaatcttgttggtgaactttcaaagttcctttgaattctccttgatcctctgcagccataattatgccctttacttttcacttatgagcttatagcagttggtacaaatatgtcttgcagctttttaaaatgtactattttgttcagtttttttttttaatgtctggttcctcaaagaaattgcattccaaggttgaattttaccctcctgtgtgtcttcatgcctgacaggatgtctagaaagtaatagaggcttaagaaatgttttagataaatgaatgaatgcatgagtgagtgaataaggagatatgtcgagggaaattacgactttcattcagaaagccagggtttgagtttctgctctaacatttactagatttgtcaagacatttagcttttctgagtatcagttccatgatctttaaaattatctttagataataatgataactgataaaccaatctcaaaagttggtacaaggcacaaacaagtgaatgttcatgtatttttgtcataaaagataaattattattaatagttataattaatacttttatataataacctctcagtttaagtaagtaaaacaaaagttaattgaaatgcttacatgatagtgtaggttgtattttcctgtaagagagatttctagataatggaggaaaactatttttttggttgtaagaattaaagaaagaggaaagaaacacaaaaggtggctccacagtcaaggacaggtttattttagagaaaaaaaacctgagaggggcttctggctgagttaagtcagagcccactctcttacagactaagagttttaaggatttggcgtgggagggtttattagagacttggactgcttctgtttctctttgttgtgcttatctgggagggagagttgtgtgtctgttcccgtacatcttcctgcagctgcaggcatacccaccctgaatctgcttttagcttccctatcttagaacactaaagagaaactaatgtgcttatttaggcccactgttttactgggacccattgtatgacagtgaagtttggcagttacctaaaagacttcccctcaacctccctctgtgctcaagctgtcttgtctgtgttttactgtctgctctttctggctgcttgtggttagaagataagtgatttccttgaaatgcatgaggctagaaagggagctggaacttaaagtggtggtgtttgtctgagatgatggtgttcttgatctgtcagtggtaattaaaggtttaaattcacattgaaatttaaattttaatatatatttttatatattatatttaaaattaaaatttactattctggctaaagatgctcctaaaatatattatttactttcctggcttttaaactgttttgaaattctattcagaaagactgaatagaattaaaaataatgagcatcagatctgggctgtaatatgatcactcatgtatgttaacactattgtaaataaattactccttgtctaagatattaattatgcctctaaattctattccttcccttttgttattcttccatcccttctaaatatactcctcaaaattgttagcagttttgtgccactggccaggaccctgtcttactttctccagtttatctgccactatatcacatcaccacacttcttaggtaattatgttttgttttgttttcgggttataatgagtgtcactcaaactgcctcccagcatgatggattataaatagggaggtgatataatgcctcactgtccaatcatagagacatctgagagtgaaagggggcactaaaactcactcacagatactgtttcatctaccataaaccaaaactgttccaggcacaccagcctggaggcttctctacttataaagactctaggctttggagtctaggcatgtaccctagctctacttttctctagccttatgatcttcagcaagtgtttaacctttcttggcttcaattcttccactaaaaaccagataataattccttccccatgggttatttaagggttgaaagctttaaccatattaccttgggtgatgtatggtgaggccagatacagattaatagagacaagaaagaggtttgcacgggttcattctcctagaatgcaggcaggcaggtgtatgacgcacaggcccatccttctagaatgcagactggcaggtgtatgttgcaaaggtccatcttcctagaatgcaggcaggcaagtgtgtaacgcatagatccatccttctagaatgcaggcaggtgggtgtataacgcacaagcccatcctcctagaacgcaggcaggcaggtgtgtaatgcatagaccccatcctcctaaaatgcaggcaggtggttgtgtaatgcatagaccccatcctcctaaaatgcaggcaggtgggtgtgtaacgcatagaccccatcctcctaaaatgcaggcaggcaggtatgtaacacatgcaagagacatgttttcttctctgagaaaacaaaatgaccccagagtaaagaccaaggatattagcaattggaggttttcctatgaataaaccagtttacctctctgtctctctgtagtgaaaccctcttttggaccagcccctcccttcatcacagaaattccattctgctattttgtgccatactgaaatttgaatgaacaaataaaaacatcaaaagaagaggcagacaccaaaacaaatacacagagagtatgtaggaagaagaaaacgtccaaaaaaatctataactagtaattgcagagagataagagaaagaattgcatacatgaaacaagaatagaatgcctggaaaggaatagtcagaatatggaagcatctggggaatgaaaaatggggtttctaaaattaaaatcttaatagaaagacgaaaagttaaagtcttaaccaaaatgagaccaaaaaatcaggatagacgtaggaaggaagatgatgataagaaaatagtggttaaatttagaaactccaatgttccagtaatagaagttccagaaagatgaaaaagtaaaaattgagacaaggggtgaataagcaaatagtaaaagaagatttttctttataacataaagagctatgatttgagattgaggccttccaggtggccagacagtgaatagagagagattcctaggacacccggtcttgaaattccaaaacattaggaagaaaggttctggagagagaaaaagccatgcacttacaaaggagtacaaacgagggtgttatcaggcctctgaacaacagcatttaaaactgagtgaaaatgacttcacctagaatgtgatacctggacaaacaattgatcaccaatgcattttgaggcatacaagtcatcactttaattcctgctttacgtttttttcaggaagcttgtaaagggattctccaaaataagggagtagcccaagagggtgggcgatgcggaatccaggacaaggagtggggatgggaaacgcagagtcaggaggagtgtcattctcaggctggcagctggcccgtggacagtcacgccacatggcaggcatgtggctttatgctttgcaaatcctggtgctgcctcattgtaccctttggtgtctgagcaagtctattcatctgtgtaaccagttccctgcatccctgtttagatcccgaattaaacatatgctattcccattgggtgggattggtgttgggaactagggttaggggaggggaaattaatgagaaagttttatttcttttttttacattgagaaaatactacttttgctattaaaataataatgtatatttgtgaagtggtaaaattcatgtatcaccttgcacaggtatggagaagatcaacttttcaggtggagagccatttcttcaagaccggggagaatacctgggcaagttggtgaggttctgcaaagtagagttgcggctgcccagcgtgagcatcgtgagcaatggaagcctgatccgggagaggtggttccagaattatggtgtgctccatgggatggcattcttcttattgctattgctatttttattgttggttcttatatttccttccctcctgggccttcagccaggcctgctgaggaactggaagggaggaaaaactaatcttgcttactctaattgcttttcaagctgtgcacggcattatggcagttttagttccttagggctctcagtaaacaagtttggcaagttagataatagaccttttactgagatgactatcttgtacattgcaatttagcaaatacaagatctatggccttagtttagacactaggtaggaaaattaacacatttgacagctttgtaataaaatatctctgttgggactggactggatccatgactaattttatcagaacctcgtggtgtgtggattagccaaggtggagggctccaagggattccaccatgtagccaggattaagaactgctgaattctaaggctgctgagattcctcgcagttcagttttctgcaggtgtcatgtccatatagcagttcttaaaacttagcaagagcttggaaaacattagctcttcttatatggactgtcatgttgggaaacaggtataatctgttacagtacaattctctgttcttgtttatatgagctgttggagccttgaagtctttcaaagggaaactgcatttataatctgttgaggatgttgctgagacatctctgataccccatctgtgatggtgcggacatggactgtgggggagggacgctgtggatgtgggttggagggtccatctgataagggttaagcaggtagagaagagtcaaggtgtcagatgcaggtgaattaggaagggcctacaagcgtgtaaaaccaaaatggtagtgaagggaggcactttgtcactcacacagggagtctgaggttcaaaagtgaactttgggaaccatactcagagagagaaaaaagaaactgaggaagcagtgtgatggagaccaactggcggggttttctgggtgggtacccagccaatgcccttcctccaagatcagccgtccaggatgtcctcatggtgtgcagagtagggacagtactgcatgtccaggtcaaatctctcaggcttgtgggagaaagtggtataaattagtgaatttagaagcatataagaaaagacactgtcagcagcatggagacaataggaaagcatgaagactgtggagaacgggaagcatcgcgccatattcctatagtgcatgagtggagcgccaactaggaggtttcattgatttttgtgcagcaagagaatttggatgatcctcaaattattaaacatagatcaaaaatctacaattataaatatttgaaaataattagaaatatttttaggcattgtgaggaacaaatgtttatagatgcctatctggcccataagctgctgattttccacctctggcttaatgggtcagggatgggtctatgtgttgagtggatgaagagagctgttttagggcctcactacctctccaagtttggtaatttgctagaaggacttccaacactcaatagccagctatgctcacgtctagggtttattagaataaaggatacagaacagaaacagcagggtaaagacatatatcaccagagtccagagagtccagacacaggctctgagtccttctccatcccaggcctcataggttgtactttctctctagcagtgaactatagggacatatttggaatgtctttgcacaggaaggtccatttgagtcttagggtctgaggctttatacagggctagtcatttatgcacatgctgctatgtaaccagctattggaactgaaactcaggaccccaacaacgcaaccaaggaaatcatggatcttgttaaacaatcctgagaagtcttgacaagttgattcaacatgccccattgctccaggtttatacacctcaccaatgatatatagaatattgtagctaccatatgtgcagggattggccaagattccaccatggttccaggttttcctggaaagatgtagggactgagcaaacagatctgctccattaaatctctcttcccaagagctttggcaaggaaaagctgaggacaggaggatagttatcatggacacatagcaaaagttggaaaggcggcagaatatagcaattgacttacagatcctcagatgacttggaaatcaactaggtctgtctttagtataactgataaggctgtatgtttttggttttgaacttaatttctggtctgtttggagatcaggtgctcagttacttgccttttcacaatgtgatatgccattaggaatttatttgagatcaatttttagaacgttttgagttgttttaaattatggacagttgccttattctggctccagtttatgctagatattttgagggcgtatgttacatacggataaaataaaattagcccaaaataggagttaaaatgactctttttataatattagaggatagttgcttaaagagtttttggaatttccagcttctataatttgaaagtaattttaagaaaaagagtcgactcttaaaaagtcacaaaactaggaaaactcagacttaatcaactgcaaggagtgactcagccattgagaatatctgtacttaagagataagtggatagcatgaaggagcagaggaaattggagggataataagataggtggagtagaaactagtgtgacagaaaccaaagcaaaggtaattgtgaacacttgctgtgctcccaaaacgacacgctgtcacagctcttcacataccatgttgcaaggaggggtctgtttacactttattcccacaccaggcttccctttctcttggttttcttggcatctaacacagttgtctctgacatcacatagaatgtctctagatatttagatgatgagacaactgtcaagaagatgtccagaagaagcggatgaacttagcaaaaatactagggatcttcaacagagcaattttatctgtgtgatggaaagaaaaagaagtaaatttataattgttcataaataagtctagaggcatccaaatatatctacctgcctcagaaattacataatttgtatgcaggaataaatgaaaaacctcatttaaatatatcagtaagtgctcacacacatacatgtgtagagttttcaaataatcaactaagtatttgcatcattattttacatatatatttagtttttcaggtttgacacaagaagaaagtaaaattcatatctcaatgagttttgtgggtataaggaaaagtgtctttttaaaaatttaaacaagatatattttatcacaagagatctaaatagcccaaggggcttggtccttggatagaaaagtttaaacatgatcattttccctcaggtgagtatttggacattctcgctatctcctgtgacagctttgacgaggaagtcaatgtccttattggccgtggccaaggaaagaagaaccatgtggaaaaccttcaaaagctgaggaggtggtgtagggattatagagtcgctttcaagataaattctgtcattaatcgtttcaacgtggaagaggacatgacggaacagatcaaagcactaaaccctgtccgctggaaagtaagtacacaaggtcgcttttgctgatttccttcaagaaaactttcaggaatgacttttttcaatgaaactgaaaacaatactgatacaagagaactctggacctcgcaagccagtccagaagtcaggtccttggtctttcagctctgttagacttaaaactatacttttctttgtcttagacataaaactagacttttctttgccttacttcccttttctgaaaacatgatatgatttcctttggaaatattgtgaggataaacataaaaaaatatgctcagtgctttgaaatgtttggaagaatatgttcatagaaagcctaaatttatttttaaaactcttggcttatggatggacagataccggttcctcataaattctgatgcagtgaatttctagaagacattagggttaaagtcttccccaagttgtagcaaaatgggacctttattcccagattcatgctttagggctggccccactaccagctactaaaagccaactccacatatgcagctcccactctgtgcagacatcatgactaaaatcccagttttctacctttgactgctcgtcagaagcaaatcaggaggctgtttaaaaagcagcttcttgggcctcatatctgctgccctgaaacagggcctgtggtgaaggtaagcatagcagggagggcttgcacaaacgtgtatttctaacaagcagtccaggtgcaatgaaagataagatgcagagctcagtgctagcacaaacacacaaaaagagatgtgggaaaagtcacatgatagaaagctatgtgtgctaccatatcgtgaaatggcaaaacaggctgagcttaagtggaaggcttcatataggaggaagcatttggctatgctctgaaaaatggaaagaattttcgtaggtggcaaagacctgaagaagaaaggcacatccagactagagggctttgcctgcacaaaaaacagcttttccttcaaagctgccttggctgtttttttaaatcccatgtcagcattccaaatagagttagggaagagggaaagggatattctatcattttcctgaagctgtcctgtaatatgtggaaatgggttaggggaagctggagatgctactttcaaaaattgctaataggtatgttgaacttgaacttttggttacatatataaggatatgaattatcagccacattcccaggtctagaaggaactggagaaaagctaaagagagaggtctgataggaaaaacagggacatgatccaccaggaaggcagaggctccagctggagggctaagctgccttagacatgttgactttcctgcctgcccctctcctgtacccacctctctcgtcttccctatgtttcctgttactgtcttcctcattgttctcttttggtgtccttttttcagatgtgtaaatattttttccccacagcttggttttctcctatctcatggcctttctctcagatattttgactcccacactggcttccattcatctgattcactgtagatttgccatcaagatcctgactcttttggtggaaggctagtttctgcctgtttggaaaaccagattattgatgtatgcaggcttccaattgatgtaaattgatgcttctggaacaggtgcctgttcttagtccaatcttacattgcactcagaacctagtttcctgaggctgcctcctccactgtgaggctgtgggctggaaggtgtcaccagccgtgtccccgggacaacagcaatgagcatgcgtgattactcactgggaggctttgttgtgacctgtaggcttgctccagcagcatgggaggagagggctccttctactcccccatgcccaatcccacaccctcaatattgttccccttccagctcctacggcttgcttttctcctgcagaagcccttccagtctagctggctgattctggagtcaaagtccctggaaaaaaatgcctgtgctgtatgtcttctttgatagtcaagtctgctcatgattcaaacctacatggaagggcactccctccctgccaggcctctccttaccctgagcctggatggggcatgaggatgggtgacaacccctcccaagatgctcacagtctattaaggaagacaccatgaaagcaaatagcaaaattatcctatgaccaggggccagtggaggcagatatcaaaagaccgagaagcaaaaaagaagaggaaaaataaagagtgagcaaaaaaggcaacatgaagtgttgacaatttcttctcatctgactatagtggcatctgagtggttcagacgatgatattagtgaaattctgtgtagaatcatcctttccatggaaaccctttagatctgggtttgtcctgcctctgtgttgggttggctgtcaccctttgtcaccttgggcaagtctcttcacttcttgccttttctaggactgacttttattttcaaatgatggtagtatgtatagaataatacactgtccacactcttacacacacatttgtttacttaaaagactgttgaaagagaatattaatgattttgaaaaactgttcttaggtcttacatgaaaaacagacatatgctagaggccttcataagaatatattaaaaatcagcagagaaaacaatgtttttaaaatgtgtttttctgggttatgggattacacatgatttatttttatgctcttttatagtttatattttttcaataagtacctattattttgttgtctgaaaatttatgactcaatcaaacataatctagacaagtttttgaaagtttatattttaataatgtttgtgcttctgacaccatattcctaaatttcagggctagctttcatttccccaaagtaatatctttctagaatgttcctcagctcgtagagtctctttgctcagaagagatgaagcttgaaaagggggagtgaggtttgggggaaaacacgatggaaagctctctgcaaagcaaacactaccattgcctttcaggtgttccagtgcctcttaattgagggtgagaattgtggagaagatgctctaagagaagcagaaagatttgttattggtgatgaagaatttgaaagattcttggagcgccacaaagaagtgtcctgcttggtgcctgaatctaaccagaaggttgtataaagcaaaagttgttttctttgtcatcatacattcagattgattcccaaaagggaagtctctcagccaaggaccccacacattgttattttagagggttcggtggtgagaaatgggaggaatgccatgtcagggcagatagggctgagggctgccattgactctgccacctcccagctgcagggtctttagagagcttcagtttctctatccacgatggatagagtggtactttgcagatgatacaactgtatatagattcatgtagatattcttgctatatgattcatataagtataatgtccctatgtgtcatacatgcatgacataacccctaaacatagaaagaactaacgaacgccactctgttgatatcaacattatcactttatttagttgaataatctctatgtataattttgttatgttgcacagaatgtagaagaaatgtttcccatttagttttctaatgtaatgacaattggatccatcctattagcacaaatttcatacaccgataaaacaaggttggccaaaacatgtctacactgtggagcttcaggtataactagaagccgggtatctaaaaatgtgttctcagaagctacaggaaaaaaaatccattaataaggaacctccttattaatgaaagatacaaactttaaaaaaattatgatagtataattgaatccataaaattaaaaatatgtcacacatatcataaaattaaaagtgaaatatgttaacatgatatactgaattgtataaaataaagtattatatataaagttatttaaatcaataagaatctatgaacaccaaaaaaagcaaaacatccaatgggcataaatagataatttacagaaaaaaaacaaatggtgaataaacattttaagagtatttgatattgtctatattcaaggaaatacaaaataaaatatgaagcataaagttgcagtaagagaggcaagttcatattgttagcaagagtataaattattgcaactttcctagaaaacgaattgctaactttataacctttaaaatagcccatatttgaatttagaaattctaccttaaaacaagagaaatattcacagaactagagaagtacttatgtaaagatatgttactgcagtattaagaataataccggccgggcgcggtggctcacgcctgtaatcccagcactttggggggctgagatgggcggatcacgaggtcaggaaatcgagaccatcctggctaacacagtgaaaccccatctctactgaaaatacaaaaaattagccgggcgtggttgcgggcgcctgtagtcccagctactcgagaggctgaggcaggagaatggtgtgaacccgggaggcggagcttgcaatgagcggagatcgctcactgcagtccagcctgggcgacagagcgagactctgtctcaaacaaacaaacaaacaaaaagaataataccaaaaaaaaataaagatagcctgtcattcagcatacagagaatgagtaagtctgtaggttcacagaatgaaatgttacactgactaacaagcatattccaaaaatttttaagtgacaaggagaaattctgataatataatagtaggtacagataaaaaacagtatgcaaaattaatttgaagtttaatcctgatgtgtaaaaaaaagtatctctacatattcctttggttatcttggagtagtggaattataagtagttttattcacctttataactttttgaactttaaaattttgtaacttaagtattagttttattattttaaaaacagcttctccatctgccatccaaaaatacatatacaggaaaatctctaccccatatgtttaagtaatgctaggaactcaaagagcagacattcattccttatgctttagacttctgaggctctaggtaaatggttcaagtttaaaaggtaatgttgaagtgaacatgaacaagaaaatctcagaatgaaggacaggatgaccatcaaaaagaagagaaagggggtagaggaggttttcctctatgcactattttatttaattttttaaaactccatcttaatagttaatatgacatcaaagaaaatttggttgagtacctcctttgtaagagggactgttaaccctttgactcattgccattttcactaatgcttcatgagccaggttgtatcatccccattgtatacatcaagaggccgagtggtaggtactcatttacctgacttgtatcaggggcaaaatctgaattttgatgaccccaaagcccacaaaccttttagccagtttgtttcaaacttcatcaaatcacctgggatcttgtgaaagggcagacctctactcagtgggtctgaggttggcccaccactctgcaccttgaactagttcccagatgatgctgatgctactggtaccccactagacattcaatagcaggtctgctcccatcccttcctaggagttggcaaatgctggccccagggatgggtctggcctgccacctgttgtagtacaggatgcaagttaagacttgatgagggaaaacatcaaaacaagaatcgtatttgtgccctgtgaacattatataaaagctggttttctgggtccataaattaagtttcagtggagctcagccaagctatttttcttatgtatcatctgtggtggattttgggctgcaaagcacagttgattagttgtgacagactgtgtggcctgctaagcagaaaatatttgctatctggccctttacagaaaacattttacagacccctatctacaagaataggtatagaaggaataccttcccatcaacagtgcaggtacagcttctatatacctatagaagtcataactgtttgtaagtaatgttagggtaataataaaatcctcaggtaaatcgaccctttagctccaaaaaaatagcattcaagagagttctgctttatacattgaaaagggagaaattagatacatggtggacacagtcatcagaaatatcatgtaaagaagaaaagggctctcccaaagtgtgaagggttggggaaattgccttggggttcaatgtcagggaagccttcaggatgaaggttctgatgtgtgaccttttcagcaaagagcagagaatccaggcctgctgtgatctgttgaaaaccgaatgcacacaaacagagccttgtcttgtgagggccatgccaaaggcaactcaagggaaatgagaaatgctggatccaaaacaatacaatgcaaacactacaggtggacaattgagctcacatactgagaaatgcacctgaaactaaatttgtattaacttctcctttgcagatgaaagactcctaccttattctggatgaatatgtgagtatttccaatgagttataaaattaaaacttaattaattaattagcagtaatggcagagttgagttccatgagcataactatctagtacctatttgtccttcttaattagcacttcacagtttgatagtcagtgattatgattatgccagagccctcacttcacagggtcaaatgtggagctaaacactggaacagaataagcttcaacccaggtcccagcactgatttgcactgagcaccatatgatattgtctgccatgtaactatgcatccgtggatgtcacattgaacccgttatcacacacaacagagtcatctgttatgtagtcctgggctggaggctctcctgagatagggcatccagcctactttgaaggaaggccatatcactcttctcattatcttggacaaaccaggcacagccagcttgtcttctgattgataaaccttggctttcctaaggagaggcttatgtttctgctccaaacaccactgatattattcctacccccactgccttccaaaggaagagggaaacctacccttctcaaaactgaaaaacaaatcactttcccctttcctctgtctttttttttctagatctataaccattgccactcttcctagcaaaggacaaataattccatttgaagacatattttaaagaaatgagctccaacaaccttgaattccatatttaaattggatttgttttttggagaaatacttactgtcacttttgatgtttgcttttctttctttcttttctttttttttctgagataggttttcctgtcacccaggctagagggcaatggcacaatcttggctcactgcagcctcagccacctgggctcaggtgatccttctgcctcagcctcccaggtagctggtactacagatgtgcactaccacacccagctagatttttatgtattttttgtagagattggattttgccatgttgcccatgctggcctctaacacttgggcctccccagatgctgggattccaggtgtgggcccccatgtccagctggtattttgttattttcaagttaaccaatcattgtttatacccatttcatttcttaacaatataagctttcttaatagagcataagggaaaaggtgataaggaaaacatttagtttctgggtccaaggtagagaggaaaattcaaacaatttatttttggagtggaaattattatgattgtctagtgattttgaccagcatccctcaacaaactcactggtctccacatatttggaaaacacatcgttgaaccaaaatttgcttttaccaattgaataacattttgcttcaataagtattacttgagctcctatgaaacactcagtgtaggtcgtaaggagtgtgaagaaatcgtttctgcctacagagtagaataggacagactaaaacaaatgaaaatggatggaataagattaaaacaaagagccttcgcaggtcatggaagactcttcttgatctggcacctgccatggaagactcctcttgatctggcacctgcctgcctcagcagcacctttcttttcatcctctctccgtttctcaaaacaagcctttattaatatttacatatatgcatgcatgcacggatgcatgcacatcattactattccagaaacaccgtctacctccatttccccagtacatcatgctatatcacacttctgtgcttttatgataccattccctccaatttaaaatctcaacacataattcagatgttagcatttggggcaagcctctcctgattaccccttcccccagtggaactacatctgcccatgcggggcgcatatcattctgtttattgtgcgcttaggtgtctactgtacttagcccagcctcttccaccagaccatgagctggttgagtagagagatggggtccaaggggttcaatatcagccacagatttcaaaagatacctgtcgacatgactggaatatcaaaagctatttgggattaatagtctagattgagttttacaggattcatcacatggaaatataccagtttctgttatgaattttctagatgcgctttctgaactgtagaaagggacggaaggacccttccaagtccatcctggatgttggtgtagaagaagctataaaattcagtggatttgatgaaaagatgtttctgaagcgaggaggaaaatacatatggagtaaggctgatctgaagctggattggtagagcggaaagtggaacgagacttcaacacaccagtgggaaaactcctagagtaactgccattgtctgcaatactatcccgttggtatttcccagtggctgaaaacctgattttctgctgcacgtggcatctgattacctgtggtcactgaacacacgaataacttggatagcaaatcctgagacaatggaaaaccattaactttacttcattggcttataaccttgttgttattgaaacagcacttctgtttttgagtttgttttagctaaaaagaaggaatacacacaggaataatgaccccaaaaatgcttagataaggcccctatacacaggacctgacatttagctcaatgatgcgtttgtaagaaataagctctagtgatatctgtgggggcaaaatttaatttggatttgattttttaaaacaatgtttactgcgatttctatatttccattttgaaactatttcttgttccaggtttgttcatttgacagagtcagtattttttgccaaatatccagataaccagttttcacatctgagacattacaaagtatctgcctcaattatttctgctggttataatgcttttttttttttgcctttatgccattgcagtcttgtactttttactgtgatgtacagaaatagtcaacagatgtttccaagaacatatgatatgataatcctaccaattttcaagaagtctctagaaagagataacacatggaaagacggtgtggtgcagcccagcccacggtggctgttccatgaatgctggctacctatgtgtgtggtacctgttgtgtccctttctcttcaaagatcctgagcaaaacaaagatacgctttccatttgatgatggagttgacatggaggcagtgcttgcattgctttgttcgcctatcatctggccacatgaggctgtcaagcaaaagaataggagtgtagttgagtagctggttggccctacatctctgagaagtgacggcacactgggttggcataagatatcctaaaatcacgctggaaccttgggcaaggaagaatgtgagcaagagtagagagagtgcctggatttcatgtcagtgaagccaagtcaccatatcatatttttgaatgaactctgagtcagttgaaatagggtaccatctaggtcagtttaagaagagtcagctcagagaaagcaagcataagggaaaatgtcacgtaaactagatcagggaacaaaatcctctccttgtggaaatatcccatgcagtttgttgatacaacttagtatcttattgcctaaaaaaaaatttcttatcattgtttcaaaaaagcaaaatcatggaaaatttttgttgtccaggcaaataaaaggtcattttaatttagctgcaatttcagtgttcctcactaggtggcatttaaatgtcgcctgatgtcattaagcaccatccaaaaagtctgcttcataatctattttcaagacttggtgattctgaaagttttggtttttgtgactttgtttctcaggaaaaaaaatattcctacttaaattttaagtctataattcaatttaaatatgtgtgtgtctcatccaggataggataggttgtcttctattttccattttacctatttactttttttgtaagaaaagagaaaaatgaattctaaagatgttccccatgggttttgattgtgtctaagctatgatgaccttcatataatcagcataaacataaaacaaattttttacttaacatgagtgcactttactaatcctcatggcacagtggctcacgcctgtaatcccagcacttgggaggacaatgtgggtggatcacgaggtcaggagttcgagaacagcctggccaacatggtgaaaccccgtctccactaaaaatacaaaaattagccaggcatggtggcgtacacttgtaattccagctactcaagaggctgaggcaggaggattgcttgaaccctgaaggcagaggttacagagccaagatagcgccactgcactccagcctggatgacagagcaagactccgtctcaaaaaaaaaaaaaaaaaaaagcaagagagttcaactaagaaaggtcacatatgtgaaagcccaaggacactgtttgatatacagcaggtattcaatcagtgttatttgaaaccaaatctgaatttgaagtttgaatcttctgagttggaatgaatttttttctagctgagggaaactgtatttttctttccccaaagaggaatgtaatgtaaagtgaaataaaactataagctatgtt

SEQ ID NO: 2733 - DNA, 18511 bp, Homo sapiens
  source 1..18511: mol_type = genomic DNA
ataaataatatacaatttttatttgtcaattagaaagtaacaataaagagtgagcttataagttatggagttaaaattttatgcagaagcaagggaaaatcttcctccagtgaaaaaattctaatgagattttgaagacagaaacaaatcacattttttttgtttttgttttctaaatgttttacaagagaaaatttcaaaagcataatcagtaagagggagaaaagtgtgctgaattccatgtatccagcttgcagccattgttaactcaggactaatcttgtttcggttctacttccctttcaccacccccacaccccaaacacaaaattactgattctagatcatgtcatttatttacaaatactttagtatgtatctctaaaaggcatgaactctttaaaaaacataaccatggaatcttcaataatatagtaccttaatatcctcaaatatctagtctgtgttcaaatttttctgattgcctaataattgattttagattttgctcaaattaggatctaaagtctatatgttgccctttagttgttaagtcccttataatgtatagattccccaacatttttttggtcctttgcaatttctttcttttttggttgaagaaaccaaaaaagaaaaccaggtttttgtcctgtgaatttcccctttctggatattgctgattgcatatttgtggtggtgttagtaggatttttttaaaatttcttttgaattgcaaataagatccagagacctgatcaaattcaggtttaattatttggcaagaccatgtcacgggtgatgtgtgcactcctatagtacttccaggcccataatgtctggtcttcctctgtgatgttaatatttatcaggatttgggacagtttgataaatccattagaaatttttgttttttaatcagctttccacttaatggttttggcagccattgatgactgcccatatccataattttattaggggaaaattacattttgattacgtatcgctggttgtttttgttcaaaacataggttgtatgttaatctgccagtacattggcatcttctggatgagggactcattagtcttctcacaagagtcccttttgttcattagcttgtggaatttgagtgtctgtatgttttttttttaattgtttgtttggaggggagttgataagctaattagctatagagacaaatttcatttttgcttaactgaatctcactgcatgaaaaggcaatctaattctccaacctactttggtaaggtctgatgacttctgtgggcatgaccttcagaagactggttggtcctctgttttggaagatccttgagtgccaagcacatgatacattgatgatctgcttagtaagaataaatgttgctcctcagtttgagaggtttttgctgtctttgagaaatattttcccagacattctaatgtctaaatgccatttgagtagacaatcttcttcaatccatgcctggtaagtagtggggttctgtgtagccagcttattacactaacttctcctgactccagtcatagctccttattattttgtcatcaatgatgttaaccaaaccaaggaacatatttgctacttttcatatatctcactccttcctttttcactattgtctttgtagaactcataacatgtttaagaggaaattaaatactgcatgtacagatctgaagagctagaggctgtatctataaccttgccggtttaaagcatagatcttgagtccaaaaaaattaaatgggtactgagatcaaattcttggaggaagaatatcaggctcttaaacaatttcaatgtcataagcaagtgggcctccaatggaaaatcccaggtaaaaagacaccttctctatgcttctgccacttctaagttgacctaaaaaagcgggagtgatgggtattgtgattttttcattgattccatattctatatataaacaattgttttcagctcgaccttgtaaacgaagcaaaagttcttggactttttcctccttccacacatctccactctgccacaaggaattaatatctggtgtcttcttaaagcactggtcaatttttcctttgtgaacaagtctttccagtcttttaccttttccaagaaagaaatatgcaattggttgctttgtacgatgcatatgtttatattgccccttgaaagaattttttagtgcttgagcatactctttcatttgttcagaatgttgatctagttgttgattttctggccagaataagagggaagctagaaaatacggttctgaaaactgataagtcagtcctattggttgcaagacttctcgaagctgatcttttagtttttcaactggctttactaatctggaggtaggttggatacaggagagaataatgttggccaagatgaaatttagcttttcttttgactggattttgacagtgcattgttctaagagaaaagtatattcgttcactatacatttcatagtgcttatagcatcctcttgacttttgataagatattccaagagcccagaaaacttgtctgcttttaaagctactaggtttctcctgcatctctctacttgaagtggctcactgaactttgatccaagacctgtgttgttttgtgattcttctaagagacaaaatatatctacatatttcttaaaatatccagccacctttctccgagttttggcctcttcattttgcttaatattgttcctgggttttagcaggacaaagtattcatcaaaaaaatcaaaggactttttcaaagaaaatttcaatttagttaaataaggaatatagtttttgagggctaatttatattcattgtttggatcccctggaatatcactacttcctgatacaaaattgaccatatatcttttagatagctcatttttattatcaaaaaaaggaatgagctggagaatttggattgtgtaaagcccaacttctatctctccttgataaccagctatattgtaagtatcataccgcctttttgacttcggatacaatctttccttcacttcatactctctatcttcactttgctgttgagattctttgaatgcacttgaggcatgttctgctaaatccaaaagagcaattagatcatcaactgaaatgttcccgtttcctccgttttcctctatccaccatcttattttacttttgtagacttgacccagtgtatctgagatataagaattgtcaggttctatgatttttgcttgttttgcccagtttagagcattgccaaagtccttctttttaatgtagaaatgtcttgccaacgcttggcaaatgaatgcatttgggttgaaccgatggatactttcaagcaatacagcttcaactgcttcatttccttcatctttatgtaatgcttcaataaatggggaaaaccaatttcctgtttcaccttcatgttcatcgcggtgtcttgtgagtaggagtgtgtgcatatcttgcaaaaatttactttttcccataccagtatcgaagaacaaattctcagttagcatatccaacataatttgacttttattcaggtgatagcttttcttcaattcttccagtgagaactctgcaatcaaagagtgaatgatgcgtactccacagtagttcccacattcgatgacctctgtttttatcagaattgtagagtaggtgcccatcttgtcttcaaatttttctgtcccccagaaagccttcttgtttccaattcctaagaatttttcacactgtgatagtgaaatggtggtatcaggcacatatgaattaagaagagccagaaaagaaaagagctttgcttccttggtgaaaatattctgccctttcaggatattccggaccacattttctatgtattctttattaaaattggttttcatgatcataaaggaataaaaatcctcaaagtttttatgctgttctttgatttctttcaatttaagctcaaaagctctctgttctttgggagagagttgctgtattacggcaatactgtctgggatccttgcacttttttcaggattttgtgatctcatacaatttaggataatcaccagaggtttttcatatcgaatgtactttttagctatagctgtttgaatagagtactgcagaagatagacattatcttgttcttcaaaatcatcaacaaggagtagtacaggtacgtattcctgacggttcattgccccataggtgattaaactggttacctgttctccaatttcagaaaaatccactgtcttgtttttcagcacagcacatctgaatttcttccttagttcccagagaatgtgcatagccaaggtagttcccccacagcctggatgatgatacagatgaataattttggtacttgttggtttagaagaatctgcacagttttgaatcattgcttcaagtctttcatatttatcccttttgacaaaaggtgaagaataactttcagaagagaagtagaagttccaccatgacactttgccacctcgatagaagtcttcctcttttgatgccttgaattcaaggaatttatttttgtccttctctaacagtgtaccctcacattcattttcacagataatttccagagcagtcatgatatcttcttcctttttcagaaggacagtcgataaaccaatagatggcaaaagcctttttgaagattgagtcacagattttagtttaagaatagtgccattgatctcttcaaggcttaaagcagaaatacattggcttgaaatttcatcttggtgttttattaatcttgcttcaagtagatctttccatccctgaaatatgtgtgggtgcacacaaatacacagtatattttccattcctttgagatcctggtagaaagcacagaaagtctcaatgaggggatctcttgggtcatccacagaggacagtaatagaaataccaccaaaaacttccctcttggcattatgtcttcatgtgtaagaaatgaaatcagtttcctgacatcagaagctctttctctttgccaggaacttggatcaaagggtttatatttttcactgtcaaggtctaacctgccattgcagaaaatccagctgggttgatggtaaagatttagagtagaaatcgtctcatttggtgtggttttctgttctacatatacacttggaaagtgaaggtttgctactcggctttctttgtaagctttgaccactccattgatgttagactcaggatcaaactccaatacagcaaaccatttaatttccttcaggaaatctaagtgttttgtttgatctgggtggcatttatttgttacaagaatgtactgttcatagtatgaattatctaacaaatcttgatttcctgtcaataatttaaccaactttggtccctctctttcttttttatttgtttttgctctgaatttttcttctgctgcttttctggactctgccagtgttttaaaatctgctttaaatgctctgaaatcaactttatttttcgtaatgtccttagagctggtcccatctcgcacaaatagtgagaattttttactttgttcccatattttgttgttgtaattttgcattttaatctggaaataatcatattggcattcagagaactgtggaataatgtccacttcaataacaaatctgtcagatagagtactatttggcagtaaaacttccacaaatcttggctctcgaatgcacttctttgcttgttggacttgatggtcttcaaaatacttgtttatcatcagattgaaatggttaatgagggcttccttggtatcattggtgactttgatgccaacaattttcccatggggtttgtctttgactccaaaatgaatagtgccattggtacgtgaattcatacaagctgaagcaaatcggaaaacctcattgctaaatttcatcttgacatcctcttctgtggctgttgctgtatttgtgaaggctttgaattcatgtatcggatcaatgagattgcctggtcctgtttcaggctgtagactaaaatccaacttgtaacgatatggattactgaattcatcaaatggatatgatacacatgtcaggtctatggatggttgcctttcctttgtataatctattttatcttctatgagctcaacttttagtgacttagaacctttagcagttgtactcattgcagacggattagccatatctgggttctctttacccttttgtttttgctttgaagtttctctacgttccttttgagacacagtttggtctttaggagcatttttactgggctttcccatcttagatgtctgaatcgaatcttcaatggctgttttccgcaattctttgaatagttcttctatttgaatagctggtccatgtgtgatgcccatatcaacaagatgttctttttttaaccacttcaagactgctccattcacgtcttgttcagtcaaaatttccctgtgtttttggtcaatcttatgactttctaaccactgatttacatcctcttttgtccaatcatctgtattttctggaaggttaagttgctttgccattctgatacctatatgtagaaaaagaaaaattatttagtattattaaaagtaaaattttgaaacaattttagtagataatatatacataattttcaaaatttaaaaagctcaaaaggatatgccaatgaattatctcttgagagaatgtgactattgccagtttcttctgcatccctccagagaaagaataccaaatacaaacacatgaacacacttttcccacataaattgtggcatactatacataattctcttgcttcattcactaagtaaattttgggaatgcttccagtcagtatatatagagatagtttatccttattaatgattgtttgctataatgtgtgtttgctgtattatttaagaacgttcaattctgctatagaaaataagagaaaaaagaaggatatttgaaactaagtacagaagcaagtttgtgagatacatcatgatagacatagataaagtaaatagagcatatgagtattaagcatagttagaaagggatataagaaccaaatagtaaatattcatgagacacacatgaagcatttgctgtttttcaggtctaaatttggttacctatttggtgacacccattctaatcatttgtgttctccattgaagaaacatcagtaaaatccatagtagcttatcaggctaatgacctgtatctgtggccaggcatactcatccctctgcatttctctgattacagcaagtgtatgtcattgacccaggacctcttccatctgccaagaccctttaaacagacctcaactctgtttctcaaaattgtacaatcagtggagaatgctgaaacatcagagaggaagagagaagatatattaacttgcacaactcaggtaatgagatccttctacccttcttgttccttacccaagatgtgttgaccacctctttgttgtgttgttgggtattttaattttttttttttttgagatggagttttgctcttgttgcccagggtggagtgcaatggcgcgatctcggctcattgcaacctctgcctcctgggttcaagtgatcctcctgcctcagcctcccaaagtgctgggattacaggcgtgagtcaccatgcctggccttgttgtgttattttaattgatttttaaaaatatgcccttcaagcatcttaattttgtctgtgagctgttctgttccatgtcatctggaatagcttgctgagtagtgaacttgttggctactgttgtattaaactaatttttcacataataattaataagagctgattcctgagcaataacttgtggcataattatttagtttgcaaatttgcagactactatctgaaaaattaatgtcaatctaggctacagaaatatagcaatggttagaaaaaatgaaattcaaataataatagtcagctttaagtatgatccaaaattgtgagacattttaatgaactaaactttcatttatcatgggagacatcaaattaaataatggagacagcctggggaatggtggcagataaattattatataggcccaagttcatgaaataatacacagaaatattgttttctagtggcagatacaaactcaggattagaatttacctttctttcaagacatgaagatgccagagccatggtccaaggtttaagctattatttttttcatatgtaactacggtatacatagaaagtgaataagcaacataccttacagctatatcaattcaaaataggcaaagataggcaatatcttagttgcgattttgtactataattttataagattttactattggggaagctaggtaaagagtacacagaatatcaaattatttcttacaactacatatgaatctacaataatcttaaataaaattttactcaaaaaataaaaaactgcaatggtatccatatttagaactgagcagtaataaaaatgctgcatataaagagttgtaaggaacaatgtctacaatacttggagaaatatgtatagccttggatgtatttataaaaatggaagaatgggtgtggcccgccgtgccttgccgtgcctcgccatgcgcctgtgtggctaaggcttctgctgtgtgtgcgcgcaggtgtgacttgtgtccgcaaagtttgtgatgtccgggggactgcatgtaccttcagccgtcctcccttcacacgcatgtggacacagtgtcacctcctcaagccatagggtgccgagtctaaagcacagggccgggttccaagatggctgaataggaacagctccagtctacagatcccagtgtgagagacacagaagacaggtgatttctgcatttccaactgaggtactgagttcatctcactggggcttgttggacagtgggtgcagtccaagtagtgtgagccaaagcagggcagggcatcgcatcccacaggaagctcaaggggtcggagaattccctttcctagccaagggaagccatgactgacggtacttggaaaattgggacactcccaccctaatactgtgctgttccaatggtcttagcaaacagcacaccagaagattatattctgcgcctggctcagagggtcccacacccacggagcctcactcactgctagcacagcagtctgagattgaactgcaaggcggcagcaagcctgggggaggggcgtccaccattgctgaggcttgagtaggtaaacaaagtggccaggaagcttgaactgggtggagcccacagcagctcaaggaggcctgcctgcctctgtagactccacctgtggggcagggcatagctgaacaacaggcagaagaaacttctgcagacttaaacatccctgtctgacagctttgaaaggagcagtggttctcccagcatggagtttgagatctgagaatggacaggctgcctcctcaagtgggtccctgacccctgagtagcctaactgggagacacatcccagtaggggccgaccgacacctcatacagccaggtgcccatctgagatgaagcttccagaggaaggatcacacagcaaaatgtgatgttctgcaatatttgctgttctgcaacctctgccgctgatacccagtcaaacagggtctggagtggacctccagcaaactccaacagacctgcagctgagggtcctgactgttagaaggaaaagtaacaaacagaagggacatccacaccaaaaccccatctgtacgtcaccatcatcaaagaccaaaggtagataaaaccacaaagatgggaagaaaccagagcagaaaagctgaaaattctgaaaatcagagcacctcttctcctccaaaggaatgcaactcctcgccagcaacggaacaaagctggacagagaatgacttctatgagatgagagaagaagtcttcaaacgactggtaataacaaacttctctgagctaaaggaggatgtttgaacccattgcaaagatgttaaaaccttgacaaaagattagatgaatggctaactagaataaacagcatagagaagaccttaaatgacctgatggagctgaaaaccatggcacaagaactacgtgacgcatgcacaagcttcagtagctgattctatcaagtggaagaaagggtatcagtgattgatgatcaaattaatgaaatgaagccagaagagaagtttagagaaaaagaagtaaaaagaaacaaacaaagcctccaagaaataagggactatatgaaaagaccaaatctacgtttgatttgtgtacctgaaagtgacggggagaatggaaccaagttggaaaacactcttcaggatattatccaggagaacttccccaacctagcaagggaggccaacattcaaattcagaaaatacagagaatgccacaaagatactcctcggggagagcaactccaagacacataattgtcagattcaccaaagttgaaatgaaggaaaaaatattaagggcagccagaaagaaaggtccggttacccacaaaggggagcccatcagattaacagcagatctcttggcagaaactctacaaaccagaagagagtgggggccaatattaaacattcttaaagaaaagaattttcaacccagaatttcatatccagccaaactaagcttcataagtgaaggagaaataaaatcctttacagacaagcaaatgccgagaaattttgttaccaccaggcctgccttacaagagctcctgaaggaagcactaaacatggaaaggaaaatccggtaccagccactgcaaaaacatgccaaattgtaaacaccatcgatgctaggaagaaactgcatcaaataacgagcaaaagaaccagctaacatcataatgacaggatcaaattcacacataacaatattaaccttaaatgtaaatgggctaaatgctccaattaaaagacacagactggcaaattggttagagtcaagatccatcagtgtgctgtattcaggagacccatctcatgtgcagagacacacacaggctcaaaataaagggatggaggaagatctaccaagcaaatggaaaacgaaaaaaggcaagggttgcaattgtagtctctgataaaacagactttaaaccaacaaggatcaaaagagacaaagaaggccattacataatgctaaagggatcaattcaacaagaagagctaactctcctaaatatatatgcacccaatacaggagcacccagattcataaagcaagtccttagagacctacaaagagacttagactcccacacaataataatgggagactttaacaccccactgtcaacattagacagatccacgagacagaaagttaacaacgatatccaggaattgaactcagctctgcaccaagtggacctaatagacatctacagaactctccatcccaaatcaacagaatatacattcttctcagcaccacatcgcacttatttcaaaattgaccacatagttggaagtaaagcactcctcagcaaatgtaaaagaacagaaattataacaaactgtctctcagaccacagtgcaatcaaactagaactcaggattaagaaactcactcaaaaccgctcaactacatggaaactgaacaacctgctcctgaatgactactgggtacataacgaaatgaaggcagaaataaagatgttctttgaaaccaacaagaacaaagacacaacataccagaatctctgggacacatttaaagcagtgtgtcgagggaaatttataccactaaatgcccacaggagatagcaggaaagatctaaaattgacaccctaacatcacaattaaaagaactagagaagcaagagcaaacacattcaaaagctagcagaaggcaagaaataactaagatcagagcagaactgaaggagatagagacacaaaaaacccttcaaaaaaatcaatgaatccaggagctggttttttgaaaagatcaacaaaatggatagactgctagcaagactgataaagaagaaaagagagaagaatcaaatagatgcaataaaaaatgataaaggggatattaccaccaatgccacagaaatacaaactaccatcagagaatactataaacacctctatgcaaataaacttgaaaatctagaagaaatggataaattcctcgacacatacaccctcccaagactaaatcaggaagaagttgaatccctgaatagaccaataacaggttctgaaattgaggcaacaattaatagcctaccaaccaaaaaaagtccaggaccagatggattcacagccaaattctaccagaggtacaaagaggagctggtaccattccttctgaaactattccaatcaatagaaaaaagagggaaccctccctaactcattttatgaggccaacatcatcctgataccaaagcctggcagagacacaacaaaaaagaattttagaccaatatccctgatgaacatcgatgcaaaaatcccaataaaatattggcaaaccgaatccagcagcacatcaaaaagcttatcctccatgatcaagtgggcttcatcactgggatgcaaggctggttcaacatacacaaatcaataaacgtaatccatcatataaacagaaccaaagacaaaaaccacatcattatctcaatagatgcagaaaatgcctttgacaaaattccacagcctttcatgctaaaaactctcaataaactaggtattgatgggacatatctcaaaataataagagctatttatgacgaacccacagccaatatcatactgaatgggcaaaaactggaagcattccctttgaaaactggcacaagacagggatgccctttctcaccactcctattcaacatagtgttggaagttctggccagggcaattaggcaggataaagaaataaagagtattcagttaggaaaagaggaagtcaaattgtccctgtttgcagatgacatgattgtatgtttagaaaaccccatcgtctcagcccaaaatcttaagctgataagtagcttcagcaaagtctcaggattcaaaatcaatgtgcaaaaatcacaagcattcctatacaacaataacagacaaacagagagccaaatgatgagtgaactcccattcacaattgcttcaaagagaataaaatacctaggaatccaacttacaagggatgtgaaagacctcttcaaggagaactacaaactactgctcaatgagataaaagaggacacaaacaaatgagagaacatttcatgctcatggataggaagaatcaatatcatgaaaatggccatactgctcaaggtaatttatagattcaatgccatccccatcaagctaccaatgactttcttcacagaattggaaaaaactactttaaagttcatatggaaccaaaaaagagcccgcgttgccaagtcaatcccaagccaaaagaacaaagctggaggcatcatgctacctgatttcaaactatactacaaggctacagtaaccaaaacagcatggtactggtaccaaaacagagatatagaccaatggaacagaacagagtcctcagaaataataccacacatctacaaccatctgatctttgacaaacctgacaaaaacaagcaatggggaaaggattccctatttgataaatggtgctgggaaaactggctagccatatatagaaagctgaaactggatcccttccttacacctcatacaaaaattaattcaagatggattaaagacttaaacgttagagctaaaaccataaaaaccctagaaggaaacctaggcaataccattcaggacataggcatgggcaaggacttcatgactaaaacaccaaaagcaatggcaacaaaaccaaaattgacaaatgggatctagttaaactaaagcacttctgcacagcaaaagaaactatcatcagagtgaacaggcaacctacagaatgggagaaaatttttacaatctacccatctgacaaagggctaatatccggaatctatgaagaacttaaatttacaaaaagaaatcaagcaaccccatcaaaaagtgggcaaaagatgaacagacacttctcaaaagaagacatttatgcagccaacagacacatgaaaaaatgttcatcatcactggccaccagagaaatgcaactcaaaaccacaatgagataccatctcacaccagttagaatgggggatcattaaaaagtcaggaaacaacaggtgctggagaggatgtggaaaaatagggacacttttacactgttggtgggactgtaaactagttcaaccattgtggaagacaatgtggcaattcctcaaggatctagaactagaaataccatttgacccagccatcccattactgggtatatacccaaaggattataaatcatgctgctataaagacacatgcacacgtatgtttattgcggcactattcacaatagcaaagacttggaaccaacccaaatgtccatcattgatagactggattaagaaaatgtggcacatatacaccatggaatactatgcagccttaaaaaaggatgagttcatgtcctttgtagggacatggatgaagctggaaaccatcattctgagcaaagtgttgccaaggacagaaagtcaaacaccacatgttctcactcacaggtgggaactgaacaatgagaacactgggacacaggttggggaacatcacacactggggcctgttgtggggtgggggaggggggagggatagcattaggagatatacctaatgtaaatgacaagttaatgggtgcagcacaccaacatggcacatgtatacatatgtaacaaagctgcacgttgtgcacatgtaccctagaacttaaagtatagttttttaaaaaaggaggaatgactgaaaatcatgaacctaatgccagtttaataaattgaaagaagaataacagaataaaactgaaataagaagaatgagaaaaataaagataagagcaggaatttataaagtggaaaacaaaatgacaagagagactcagtgaagtccaagagctgtttagataaaaagtaataaaattgacacatccatggaatgattaaccaaaaaataaaaaagaaaggtggcacaaataagcaatattagaaactttaaaaatgaaccaactttaactgaataaattgaaaactgagattaattgagcaaattcttaaaaaatatagcttaccaaactgactctagaagaaaccgaagaagtctcacttccagggtgatgtaggagatcacaaaaggccacctattcacccactgcaaccatgagatcaaaatctgaaaaattgcaaaactcatatttttaagtaatcacaaagtcatcaatagaccagatgacaaggactggatgaactaaaattccagagaggaaagatccctgtctatgtaagctttgggggcatttgttgatttggggttgggtttaaggattagacttggcctaccgggaggaggaaaaccagtggggattttcatagtcacaggggcgggtctaatgaagtgcaattagaagtgttccaaaatgtttaccgtaatggaaatgcaaagtaaaattacaacaagataatactacatgcctaccagaatggctaaaattaaagactgttaatgccaaatgttggtgatgatgtggagtcagtggagctctcatatgctgtctgtgggaatgtacattgttttagccacttcaagaaactatcagtttttgtgaagttaaatatatacctactctttggatctgcaattctcatgaaaattattaaagtactgatacaggcaacaacatgaatgaatatcacatcatactgtgtgaaagaagccagttacaacagaaaacatattgtagaattctacttatatagtttaagaataggcaaaagtaatctgtcatagaagtcagactgatgttggggggtggatattttctgggaaggggtgatggaaatattttatatcttgatatggctagcggttgcacagataagtacatattaaaatttcataaaggcttacccttaagtttgttcattgtatacaagttatactgtatttaaaaagccaataatgcctccaaaatacattagaaaataaaacggatgaataaaataaaagagatacttgcataaaaaagatgatggtgtgttatgaatcaaggataattgtgaattcaatggtatgtgaggtcctaaagttttactaggtgtttattattgcagtctcagattatgaacttttgacttctgcatcccactcagtgttgattcaatactggttttagagttgtctaaaaactgactacaccctcgtctagtaaccattctatctgagtcactttcttgtatccatttactgagtcacgtctactccaccctatgaaagtatgctcacttttgttgcacccacactatttaacacataaagcaggggtccccgattattgtgctgctagcgtgcgctggctcctgaggcctcatacctatggctctcatcccccatctcgccgcttcccaccagtacccttttcctagggtctccctgacttccttcatcaacttggacctttcacagttttacagacacagtccttagtctctggtgatatgtcataaactagattatgagactggtgaattagatggattatttgattcatgcaagaactacataccattatatgtgaaaacgtaaagtcaggttctcatataagagtgtgggggatggagaactgggcctgaacatttggttgggaaagtaagcaaataataaagaagtgacttttgactgttttctctactagagacactatgaatatttcaaatgtcattgaacaggttacactttcacacttcttcccctaaagcttttgtcagattattgatagctgtgcctttcaatacattattttaaaaaaattgttgatgatgtcactcttggagaaaatatatgccagcattcataggtatttatgccactgttcatagatattttacatattaatgatttctttataccctctcgttccaaaatgttttttaggtaatttagaaagtaatataggatcacacatatattaaaacccttaggtaaagaaatcatggggaaggctaaataagggtagggggagaaaaggtgaaatgagggagtaaaattagtacctaaaattactggttttgattccgtatactttaaaaactgacctgaaaatttggttctgagcatcttagtaggaaacactatttgttactgattgaacccacatacattttttaactctggttggtgttaaactgtagggtttgttaacttttctagaagggagttgaaggtcagacctttattcagaaatgtgatcctccaaccgtcttgcattatcttactgtttgctttggggagaaattagacataaacctagtatttttgccaggaacataaagctgccttaattccaaagacttcccatagtagtctatctgtctgtctgtcttcctatgtatgtcatccgacaacaatatctgagaagctctcagagagttttgttttctggaagctacctatttcttagagtagatggtggaagttgtatttgattaaagtaaagtacttttaagttttcattgcctgttctttatctatctttccgtttgttgttgttgttgttgttgttgttgttgttgtttttgagacagtgtctcactctgttgcctatgctggagtgcagtggtacaattacagctcactgtaaccttaaattcctgggctcaagcaatccttctgcctcagcctccaaagtagctagactgcagctgcgtgccaccacatccagctatttttttttttggtaggaatcttgctaggtagggtcttgctatgttgcccaagctaattttgaattcctggcctcaaacaattctcctgtccttgccttccaaagtgctcaaattacaggctaccacacctggcctgtttgttctttctgaagatgctgtatgccttgggagagttcatcaataaaagtgtctgtagttttcaactgcatctttaatgaaatgttatgactaatttttcaactaatataaagcagactgctgtcagagcaacaaatagtctagaatttctaggcttagaatactattttttgttttgaggtatatttgaagcttctaattgaaaagtatatttctttctattcaataaaatgctgctatagatagtaagaacaatattaataatagatattgtacttacccagtagtcttgcaaatttcttttacatatatgtggggaaaaccatctcttttagtgctgaaaatatctgatgtgtttgttttcttcctcctacgatgctagagaaaagtattttcctcattctggttttaacggaagtctatgtattctctgcttctgtc

SEQ ID NO: 2734 - DNA, 18511 bp, Homo sapiens; identical to SEQ ID NO: 2733
  source 1..18511: mol_type = genomic DNA

SEQ ID NO: 2735 - DNA, 18313 bp, Homo sapiens
  source 1..18313: mol_type = genomic DNA
gtggataaataaatatattttttattcaatattcaatttaatctatattagcctatgtttcactttataggcaatgcgtagttcttaaattccaagctctagaatgctgcttgagactgttctggctgttgtgcatctgagaatgagcttctgggatggcattccttgacactgaaaacttgagaacacatattaccatgaggaagccctctaatcaggcaggaatgatggtggtcaaggaagacttcctggtgaaggtgactcttgaaatcagttgtgaatgacaaatcagaatagcaggagagagaatgttagatggaaataaggcaatctcaacagagagaacagcatgtatatagcacaggttgagaagtaaagggaacaaagagggtaatgaatggaaaaaataagccaggggagatgggatctaagaaacaggtggagataaggctgtattcacaggagacaaaaatggcttaaaggaagagattcacctgtaaatgggaacaagagaatggagagagttcaagtttatgattactttattttttgaactcttctctctcctggagcaatgagctgggagaagggcaaggggtacaaggagtgtgtgtgtgtgtgtgtgtgtgtgtgtgtgtgtgtgtgtgtgttggggagagtgttatgtggtggatggggaacaatatatttaccttccacataagtttttattgataccaagatgaggtaaatagaactctggtgtggatctgtgggtttgagtccaataagctttctcttttacattcatcttatttaaatctttgctgtcacagtgaagaaataatttagaaaacttataaaagcaattgagtttaacacagattttattgccctatagacagttatgatgtgaccagtggatatcaatgaaacttcttaattatttgagtctgaaaatgcatatttaaaacattaaaagattgactccactttgtgccaagctctgcgggtaggcatatttcatatcttaaaaaggcttgtaattcattcagggaggcaaaagcaaaatctgtaattagaggttagccataatgttatgaaagtgccatgagaatagagagagagaataaaatcataaagatataaataaacgtatttgaactacaggtgatgtattgtcttaaattacttctatatcatatgccagagggccttcaatggaaaatcctaggtagaaagacactctttctatgttcctaccacttctgagtggacctgaataaacagatattactggtatttttattttttcctctgttccatattctacagagattagcttgccttcagcctgaccagttagacgacgcaggaggtctttgacttcattttttttccacacatccccactgtgccagagggaatttgtattttgtgctttatcaaagtactgctctattttggccttgtgaacaatactgtttagacccttccttttgcccagatagaaaagtgtgcttgcctgcttggacctgcacatgcgcttgtactgtcccctgaaggatctatttaaggatgaaacatacttttctattagtttggaatcttgatctagctcttgattttctggccagaacaggaggcaggccaagaaataaggacctggatattgatgacttagtcctacaaattgcaagacctctcggagttgtttttttagcgtggtaagtggttgaattaacttggagttgggctttagacaactcagaataatgttggccaaaatggaattttgtttctcatttgtcatgggcttttttgagttttgctgcagtaggaaggcatattcattcactatactttccatggtggtagcatctttgtagtttggattaagatattccaagagtccagcaaacctatctgctctcagagcttctagctttttcctgcaattctcctcctggagtaattgactctctttactttgtaatagacatggatccaaatgacagaaaagttctgtgtatttcctgaaacaacgactgactttcttgcttaacatgatttctgcaatttctttttgggtatacctcattttcagaagaaccatataatcaataaaaaagtcaaagcaccttttcagatctgattgtaaattttttaggtgggatgtgaacttgctaagagccaaataacattcatttctgggatcaggaggaatggtccactttcctgataaaaattgcaccatatgttttttggataattcattttctttgtggaaaaagggagtgagctgaagaatctggatagtgtaaagaccaacttctatttcacccaagaaacaagctgtgttatacatgtcatatcgtctctgggacttctgtggtgaccagttctcggtttcatagtttttactatcagtttgcctttgggattctttgaaagctcttgaggctttttccgcagcttctaggagatgtgttaggtcattaacagtaatgctcctacagtttttgttcccatccaaccaccatttgatttcacttttgtagacttgacctagtgtatctgaaatataggaatttttaggtgctttcattttggcctgacgtgcccagtccagagctgtgttaaagtccttctctttaatgtagaaatgtcttgctaaggcttgacaaatgaatgcattttgtgggaatcgtctacttcctgcactcaagaccttttcaatgtctttattctgtaaagcttccattaatggggaaaacagagtgtctgtttcatctccatacaccttgcgctgtcttgtaagcagaagagtttgaacatcatgttgaaatttgtctcttcctattccagaatcatagaataaattctcttctaatatattcaatgcaatttgacatttatccaagtgatagcttctttccagttcttttagacagtacagggcaatcagagggtgaatgatacgcacacctgtgtatctcccatattctgcaacttctgtttttattagaagtgtagaataagttcccatcttgtcttctaagctttcaggttcccagggtgtactagtgtatatgattcccaaaaatatttcacactgtgaaactgaaattgtagagtcagtaacataagagctgagtaaagccaggaaggaaatgagttgtgcttccttgctgtcaacatcctgtccttttaggatattcctgactacattttctatatatgtttcatcaaaattgcttttcatgatcatgaaggaataaaagttttcacagttcttgtgctgcttttcaatttccttcagtttggcaccaaaagctctttgttccttggaagaaagttggtaatttagtgcaatactgtctgccaattttgcactttcatctggattccgggatctcatgcagtttaagataattaccaatgttttttcatatcgcaaatccttttctgctaaaacggaatggatggcattttgtagaaagtagacattttcttgttcttcaaaatcatccacaaggagaagcacaggaatgtaatcctgatggctctttgccctataggtgaccagattgatcacttgctctgcaatttctgcaaaatcagttgtcttgttttttaacacagcacatctgaagtttttctttaagtcccagagaacatgcatagccagtgtggtacctccacagcctggatgatgataaagattgatgatttttgcaaatattggtttaggagactctgcccagcagtgtattaaatctttaagcttttcataactgtcccttttaacaaaatctgaagaatagttttcagaagaaaaatagaagttccaccaggatactttgccacctcgataaaagtgttcttcttttgatttcttaaactccaggaatttagatttgtctttctcgatgtctgtctctgtacactcattttcacagaggatttccagtgcagtcaagacatcctctttctttttctctaggataactgaagaagatccacgggcgggcaaaaaccttcttgatgaccgagtcaccgattttagtttaaggatagtgctgtttaccagttctatatttaaagtggaaatactgtggtttgttagttcatcttccatcttcattcttgtttgtagtagatctttccatcgttgataaatatgtgagtttacagagatacacaacatattttccattcctttgagagcttgatagaaagcccagaaagtttcaatgagtggatctcctgggctttccactgaagagagtaatagaaacactaccaaaaattttcctcttgtcattatattttcatctgtgagaaataaaattagtttcctgacttctgaagctctttctctctgccataaatgtggttctagaggtttatatgtctcgcttttcaggtctgatctgccgttgcagaaaatccagctgggctgttggtaaagattaagagtagaaatcttctcccacatgttagttgtcttgtcttcatattgatttggaaagtgaaggtttgccacccgactttctttgtaagctttgaccactccattgatcatagattcaggatcaaactccaacacagcaaaccatttaatttcttttaaaaaatctaagtgctttatttggtttggatggcatttatttgttacaagaatgtaccagtcatagtatgaattatccagtgagtctcggtttcctatgagaagtttaaccagctttagtccttcactctccttcttcattgccttcattccatactcttcttcagcctcttttctagatgctaccagtgactttaaattttgtaaaaatgccttgaaatctacatcccgttgcttggaattggccaggatatccctagagctagccccttctcttacaaacagtgaaagattttggttttgtttccatattttatctttacaaatttgcatctgaatgtagaaatacttatcattacatatagagtgttttggaatagtatcaacttcaatgacaaatctgtcagatggtgtattgttctgcagaaggacttccacaaaccttggctcccgaatacacttcttggcttcattgatctcactttcttcaaaatactttttgatcattacattgaagtggtcaatgaaggcagccttactggtgattttcacaccaacaatttctccatggggtttgtccttgactccaaaatggatggtgccattggtgcgtgaattcatacaagctgatgcaaatcggaagacttcattgctgaatttcatcttaatgtccacttccgtggctgtttctgtgtttgtgagagctttgaactcatgtattggatcaatgagattgagtgctcctgtttcaggttgtagagtataatgttctatgtagcgatggctgtcatggaactgatcaaaaggatatggcatacaagtcaattgttcaggttttagcttaccctttttcttgtgtttagcatttgctacttcatctaacacattttctttcataagaattgattcttcttgtttgatatctctgatctctctgggatcataatcaatattagatgacattgaattttcttcttcctttttggtgtgttttggatttttctggtgttctgttttggacggttttgaattatctaattgtcccggatcatgattgtcactttcaggggacttactattcaatttgttgtatgaacgttttatcaaaagtgctggaccccatggtagccccatttctacaaggtccttctcagttaattcctgcaggactaatcctgttacttcttcactgagcagaatttgcccgtattgctcattaatcttaaggtcttcatttacccattttttcacatgctctttggtccagtctttaatcatttcaggtagagatacttgtttactcatatcaaagcttcaacttcttcctgagacaaagcaatataataagtattttagaattatactttatttttaaaatcacatagacaattatgtatacattatcatacagaagatacatatatatatgtataatattgctaaaggctgactcttaaaactgcttgatacttactttagctattttaccatcctaattcatacccttgtttcttaggtgactctaattgtaattatgaaataagctatagctgctaactggtgacacaccttttagccttataataattctcccttttagcttaacttggtgaaagttggggttttgtgacttaaaagcagaatcttaagtaacatagaaattggtttccgtagcatataggaatattgcaaataaactttaaaataatgaaactggataggtagaagtgggttgaggaacaggaatccacagctggctatctttgttacatagtaacagagcagttggttaaataatctgttttcttttggaactcaagctgttaggccacaaggctagggtttgggggaatgtggtagcaaaatgtcaggataattgatttgattggctaattcttgtgttctcagaaggtaccaaaagagactagctataattcaagctgggctccctgaaactagatagggaaaatagtatgagtttttaattttgttagagccattttcacctaaattattgatatgaggctaatgaagatcctacaactatgtactttgatgaatggcaagagctgcctattttggactcctagaacaggggttcttaaccttggttaaacattagaattacttggcattccacacctgagactgcattagttggttgagggagtgagggtggtgttttcaggcattagtacttctaaacatttgccttggtgcatctactgtgcagacaagaccaacagcagtggttcttaaggtgtggtctccaaactagcagcatcagcatcacttagaagctggctagaaatgtaaattctcaggcccccacttagacctactgaatcagaatttaaaagataaatcaattaattggtttaagtaaacagaaaatcagaaagaatattttacggacagacaaaaaaaacattaaggatcaaatgaaacaaaaacactaaactataaaaagataaaatacaagcattttaaactaggggtctccaaatctggggacctggaccagtaccagtctctagcctgttagaaactgggctgcacagcaagaggtgactggctgatgggtgagctggcaaagcttcatctgtatttacagcctctcaccatatcttgcattactgcctgagctccacatcccatcagatcagtggtggcattagtttctcataggagtgaaaaccttgttgtgaactgtgcatataagggatccaggctgcacactccttatgagaatctaatgcctgatgatcagtcactctgtcccatcaccccaaatgggaccatctagttgcaggaaaacaagctcagggctcccactgagtctacattatggtgagttgtataataatttcattatattttacaatgtaataataatagaaataaagtgcacacaaaatgtaatgcccttgaataaactcaaaaccatcccccactaccctgtggaaaaattgtctcccatgaagctggtccctggttccaaaaagattggggactgctgttttaaatgatttgtaatttttaggttccttaggtttaaggaacctaagttttttttttttttttttttttaatttaatgtacatccagtcacaaagtctagccaaactgcaaatttgaaccatctgtgcttggagcttcttggaaaagttcaccagaaagtccccttgaagttatgtatggagaataagctaaactggggcttcagcttgcagccctgtgattggccacagaggaaacttgcactacacatttatggtgtgaataccatatttgcaccaggatgatttaccccatctataggcatgcaaccactgagcctagcagcttccacttgccttggtaaaactgttcctggttgtcttagtgccttgaattctcttacttactctggcttcagtctgcagatcacaactagtcctgggccaattagcagaaccatgagcaactggcacaatgaacgctataaacgtattttagatgatcaattcagttcatctgtagtgtagacagaagtcacttgtgggtcttaaggagtcccacaaaaattagcccatatattgtaactagcgataagtgttatttatcttaagtagtgtcatctgttcattcattctacacatatttaatgagcaccaattatgtaccaggcatcatgctcaggaaaaacagtgataatcaaaacagatgtgaagctcgttcatgacatttattgtccattggagaagataaaaaaaggaaataagtcacacacacacacacacactcagaaaagtttgtactgacaaagtgtggtagtgctttttgtcagacacaagaaggagtctaggcctaggatatatgaggaagaagagagtgggaacattgggcaggtgaagttaagggaactgctggagtcatgtgggaggcaattgagggagaaagcctgggggacagagttagggaataagaaatagtctacttggtggacctgccaaaggcccctttagtgggtctaaggggtatgacatagcgctgttccagcagtgggcagctcctactcttgcacccagagccagggcactgggcctgccatagagtactccagggcagatggagcttgggagcccggtaggctcatccctgatattcccatctctctgccgaggccctaagtgtcatctcaggtaagaccgacagaggggccctgcctcacctttttacaagcattatataaaaccaatagtataagcagttattaataaacatatccttaatgaaaacttttttgaagtcattacatatgagataactaccatagtattttaaatcttagtcttaagatatttcatactttgaaaatttgctgaatacttactttttatatattttatacagtttttagacattttaatatattttgtattaaatacattttgtattaaaatgtaggaagctgaagggaagaggacacttgtgtcctcagataccatttctgtcataattattggtggctcaatagacatgtcattgatccttccaatacaatggcctctcacccgatcgacttttatcttgacatcaacccacctctattcccacggtcatatccttgaccttatcattactattatggattgaattatatcgcgccaaagttcaggcactgaagtcctaacctccagcaccttagaatgtgactttatttggagacaggattgttgtagatgtaattagttgacatgaagttatagtggaccctaatccaatatgactgaggtttttgtgaaaaggggaaacttgggcacagaggcttgcttacacaccgggagaacagtatgtgaagacgaaggcagaggttagtgtgatgtttctacaagccaagaatcaccaaagattgccagcatgctactgtgagaggcatggaagaaattctcccttgcagccctcagaaggaaccctccctgccaatagcttgatcttggacttctagttgcaagggttctgagataatacatttctgttgttgaagtgactctgtgctactttgttatggcagctctagccaataaatacggttactgagaactacaagccctccgtcctctctgtttcaaacacttccctgtccccaccatctcctgcccctcagacccactgcctttagtgctcaaacactagtaagtatttctttaccaccaacacctttgatctattgattctactactgtctcacttttcctcactccattcatgtttcacttttcctcttttactgacttaatatttctttgattattcattatcatgacttatttttctcctctctggtacactcttatagttaaactacaatgctagttacatccaccactcagtccccactcagtccccactcagtccccaacagcttgtcagagcatggctggagaatggccctccataccctgactggaacatggctggacaatggccctctgcaccctgactggagcatgctggacaatggccctccataccctgactggaacatggttggacaatgggcctccacactgactggagcatgctgaacaatggcccttcatactctgactggagcatgctggacaatggccctccacaccctgactggaacatggctggacaatgaccctccacaccctaactggagcatgctggacagtggccctccataccctgactggagaattgctggacaatggccctccacaccctgactggaacatggctggacaatggccctccataccatgactggtctcaccttaatgctgtcagctaccatgctttatttctctgcgttagtcaacctcttcacttgcagtagtcactctcttattctcctaaacaatcatttcactgtctctcctctctcatcaaacttacaacacctcctcaccacggtcaccttgtttcccatttaaaccggcagaattgaaggaatccaaagagagcttctccaaactcctgaaaccacatctacccatcaacctgcgtcttcacttttcttctgttactacatcatatgttagtttctgttctctgcatgttctgcccacatgcctagtgaggtcaacctctccacttgcagtagcccttgcatccctctcacctattcaggaagttgctccagaaagtgtccccactctatttggcttcttcagtctttcctcatctactagatctccttcagcaatcaagcatgtttatttttttcatgttaagcaagactctttggaaacaactcttccccacatttgtgcttttcttcacagtagatctgtctacactttctgtttcctgtttctcttcttccactcactttagaaggcactccaatcaggctttggcctcactcctccactaaaattgcacttggtattgctacagacagttcttgacagaacagcagcacttgaaacaagtgattgctctcttttccttggatcactctccttgcaggcttttgggacactacctttcctgatttttcctcctccttttctggctagtccttctcagtttcctctgctggttcttccttaactctccacctctaaatgttgacgtgcctctcagacctagcctcttttctatctagagttttatctagagtttctccctatgaatctcatctatcttgcatttaaacgcaatctgtatgcctgtgacttccaaattaacatgatcggccctggcttctgccatgatgtccatatatctgccttctctatgttcacctaggtatatgacagtcctaaaacgaacatggccaaaattgatctcctgatatatgcccctcccactccaaacttgctcctcctacagtcttatcagttaatggaacttgtcaattgttcaaggcaaaaaccttggcagcattttttactgctttttttttcactcattgtattagcaaatactttcaatcacaccttcacagtatatccataattccaccctttcccactatccctactgctaccaccctgttctaggccatcatctctttcctggattatttttgttacctggtctctttgactctggctttgccccaccaccatgccattcactctattttcaacacaacagccaacctggtcctgttcaaaagtgtaagtgtgatcatgtcactgactcttagtcagtgtcctctgctcaaaacttttatctgacttctcatctcgcatggagtaaaagccaaagtccttaaataaggtctgacatgatatgtccaccccactgtctttttgacctcattacttctgctcacttccctccagctgcccagttgtcttactgttcctcaaacatggcagccatgcagctacacgaggcctttgcactacctgttccctctgcttggaatgctcttcctccagatgccaacacagctcacaccctcacctttttagctctttactcaaattcaataaggcctttcttgctcatctttcttaaaatttcagtccttcctccagcactttccattgctcttccctgcttcaagttttcactttagatttatgtactatacatttcacttaattatatttctcattctgtgtcagcaactggaatataacctccatgagaacagacatttttgcctgtcattcatgcatgaatcaccagggcctgacataaaataagcactcaataaatatttgttgaatgaggaaattaacatttttagattagtgaaacaattgaattgtatttgggaaatatcttcatgttgtcatcgatgagaccaaaaccaactccagcatctggattagccagtcataattagtaagaaaagagtttacttttcagaaagaaaagtcagtaaacattttattcttcatctaacaggcaaattacagagacttgatgtcctattgtaagctccagttttctaacacttctcctcaggttttggtgtctcacagtccctgagtgagcatttttctcagatagggttttccctggaggagatctctttctaccctaggtcctcagtaagccagaaccccagggcttcagggtcaccttccactgttttaactgctgttgctgctttaggcaacaaaccctcctctggagatgctcttactgtcaccatagagtggctctgtttaggtgtgaggcagtatcttctcctagccagtgtcctctctcagtaattcaagctacccatcctttctttgggtcaccccaaatactataaggaagaactctagatttttcccttctgtggctacagcaattcttatagacaccagcgctctacaagaagcagcgttttaggaatttcctgcttagcaaccattacatgcccagagacactgtgtttgccgggtggttgcgtgggggatagcagagggattgtctttgtgtctttgtgttacctgacagcatgacagctttccctcactttcttctttattgattgacttctgtcaggaactaccatggagatagaaacacccttctcaaatagggtgactggcatctgtgctcctcaagcctcgagtctttttatctttaccttgtcttagaggtttcccaatggttcaaagataaagactccacaccctgactggaacatggctggacaatggccctccacaccctgactggagtatactggacaatggcccttcacaccctgactggaacatggctggacagtggccctccataccataactggtcccaccttaatgctctcagctaccatgctctatttctctgctttaatcactcttttattctcctaaatgatcatttcattgtttctcctctctcatcaaacctacaacacctcctcaccacggtcaccttgcttcctgtttaaaccagcagaattgaaggaatccaaagagagcttctccaaactcctgaaaccacatctacctaccgacctgcttcttcacttttcttctgttactacatcatgtgttagtatgataacatataacataaaaatatttctcagccagaattccaccatttcccattggtagctgagaatatatttaacaacttgaagctattatgtattcaatattactttcatgtgaattttgccctctgtcaattataagcatcttatatgatctataatccataggtagttggaactgttatttaattcaggtgacagtgatttgggcaaaagtctttaataatgctttgacataaccctttggctctttctgtgacttaaaccttacaccctagactgcaggcatagttttaaacatgagggctttcatgtttagcaagaagctacacagtgtgtataaaggtggaggagttgtgatcagaaaaatgatgtcacgattaaattatgtctcctctcagtgagcctgttttcccacttataatataggaaaattggaccagaactagtgttgtcttagctattgcttgtttttgttctgcttcttcaaataaatgcacctgaaaccactgtatctaacatggataaaggtgtagctgctctggttggagctgggcagaagaccttcaccttaactctattctgttctgggataattttgaaacacagagttctctttatttgtacactgggccctccctatcagtgggtaccacatctgtgggttcaatcaaccacagattgaaaatatttgaaaaaaaaattgcatctgtactgaaaatgtaaagacttgtttttattgtcactattccctaaacaataaatacggtataacaactatataatattacattgtattaggcattataactaatctagagatgactcaaagtacacgggaggatgtgtataggttatatgcaaataccttgccatttcacattagggatttgagcatgtacaggttttggtatctgcgcaggtcctggaatggatcccctacagataataaattttaggatctactgcctaaggactattatttttctctctttagggactaagcaggaaggatcaaactggcctgcccttggcaagctctggtgctcaccatcatgtctaggaggctgggcctcactgggctcactcacctcactgggctcactcactcactttccgtgcctccgggaaaggatgctcagaatcccagctgcagcccagcaggcccacccctgctctgatcctctgtgtagctgaaatcgcaaagcaaaagttagttttattttcttgaagtgcaagttcaaattatgtatttcctcccatagtctctatacaagctagatgtgcataaaagtcttacataaaatgatggctaaaccttggaggattttattctttaattaaatgtaacttataggacagagtatggcatagctgcacatggctacaattttctacatggttttgtatgcttggattcctgatctcctggtctatgttttacccaggttttttagcctcaccccagagctttccacctctagaaatatgctgcaccgtcaccatgcttgctggaaagtttcttgtttaaaaattctgcaatcagcacaagttacatctattgattctcatataaaaatagtgatatttctcattccttttaaaatggtttcataagaaatagcttatgcacacttgcaagtatgttcattttcaaagttctgttttactttttataattagtttttaaagatagcttttaaagagagttgattaaacaagactttaatgattagaaacttaccagggcttttctgaaaacttctatctttatattagaaacataaaataagtcttcatgaggctgtttgatctggatcccttagattagttcccctttcttgataatttgcaagagtcacgttctggaaagcagctatgaggaagcagagctgtaggcagaacagacttggtccttgttcagtttgccggaggatatacttgttgagaacgtattgcataaaacaatgatatcacaaccaattaaaatgcaatagactggactgctgctgaggaaatgtttatgaaacagattttccccccaactttctactatgaaaatgtttgaacatacagaaaatttgaaagaatagtgaaaagaatacccttctcctaggtagcatctctttgtgtacttacttctaagaaaataaataaaactcaaaaagtatgtgacaggtacactttatctctcttccagcattccacattcaatgtggagcaaatcctatggggtgtatcttcaaaatatacccagcatttgactacctgacaccactaccacctggtccaagccttcctcatctctttcctggattataggaatagcttccttgccaggttccctcttgctgttattgatctcttcagggacttctcaaaaaagcagccggaatgaccctgttaaaatgtaaacatcatatcaatgttgtgtccaaccctgtctgtggctttccatctgacaaggcctcacacaatctggtaccctgctaatcctctgatattaggtcttttatttttccctctaaatctggcccagtcccctgacctcctcgttgcttcctgaaggaagcacctgcccctgtttccagccactacacttgttttcccttcctggaatgtccctggataccagcagggctcactctttcactttgttgagatcttttgtcaaatgtcaccttctcagcaaggcactgtttggccagcctactgaaaactttatcccacctcccaacatttcctatccctcttctggcttcattttttatctacttaggacttacaagcagcaaatattttatatattttaacctatttattttctgtccaacccattattctatgcactccataaggacaaatttctttacattttgttcattatctggcattgcctagcacataatagcttcttaacaaaaatctgttaaatgagtaacacattttcttagagtagttaaaagtaatgaatatttgaaaggccttgagctaccagtgtctgtgggtcaaaggacttcctcattttcctagggaaattatttcgcttggctggaactccaggtagaaatctggggaaatctctttactgtgctacccgttaggccagaatgaactccagcttctatcatctggtcacaaataatgaaaaggaagtttttttttcaaaaggaaagcaaaacaaatgaatatattttctcctgcagtttttgtagataccctagttacagactacaccttaccaactttctgctgtgtcactcacagtcaccgaatgaggccatttctcacacagcgttttccctggaggaggtcccttttgactctaggtccccagtgtcttaagacctttgctgttttcaccctctgcctttgctgggaagctgctcttctggcaaggggcttacactttccacagacacagtctgctcgggtgagatgcaataccttcttttagctggtgtcctctttcagaaatttaaccagccagtctctctctggaaatgctaaagatggaaaaaacagactccagattttttctttcgttttagccagtacaattttaagagcatctggatgtatgctgttggaactaagtaacaatcaaaatgaccatgattagtgtggacaaattttgtgattgccttgacttaagtcttggctttctaggggccctcagtgtcctgttttgaaacaattgtgaagacaaatattatctttagcaacgttggttattgacaaaggagttgcaggttggcatcctcaacacttcagttttctctctttgatgctcagcaagaatttccaagtcagcaaactctcagggacaagcccaccccatctttgagagaccctcagcaacaccgctgatatccatgccctagggaggtgttctgctctgcaggattcttagaactgatgtaggggaaacacacttcagaatctggctgtagcccaggagagctacccacaccctccttgcatagtctggcagacagaagccacacaagcaagttagtttcgttttcctgaagaacactttgcattttttttcttagttttcaaccagattgctggataagatgtatgtgaatgaaatactttaatagaataatatttagcctctgcagagtattaactttgataaaatgtaaaagttttaataacatcttacgttatgaagacagaattttgtgtaattacacaagatcacacgttcctttagaatcttcagtgcttaaattcctgaccctgtttgcatcgtttctctatcctcttttccaaagcctgcctgccacaatcagaaaccctcccactatcctaattacacttaatggtatgtttctttttagaagagcacttacaaagttattatcagttaaatatactgacatgtatttaatccattgatttttctaattactctagtatttttataagtaatcgtttatgtacaaacatatatttatataaaaagtacagctgaagttttaaaaaatagctgtcgcctcaaaagcataacaaataaaggtttaatgattcagtttacttaccaggattttcctgaaaatgtcatcgttttatatcagaaacttgaaacaggccatttgaacttttgctgtctcattcctcttctgatggctaggagacatgaagtgtaaggatccttttttaaaaactgaggcattaaattgtgaagtcttctgttctcccagtactctgacttt

SEQ ID NO: 2736 - DNA, 277526 bp, Homo sapiens
  source 1..277526: mol_type = genomic DNA
gagacggagtctcgctctgtcgcccaggccggactgcggactgcagtggcgcaatctcggctcactgcaagctccgcttcccgggttcacgccattctcctgcctcagcctcccaagtagctgggactacaggcgcccgccaccgcgcccggctaattttttgtatttttagtagagacggggtttcaccttgttagccaggatggtctcgatctcctgacctcatgatccacccgcctcggcctcccaaagtgctgggattacaggcgtgagccaccgcgcccggccaggtcaattcatttttaaggacaacagctgctgtttgtttcatgcttaacaccaacactcaaaatgacttatagtattttacaaattttacaaatgtttataattactatgaagatttacaaaaccctaaaacctatagcaaatatcgaacactcattacaaacattctaagtatttaactaattttagatagaaaaaactctaaaatatgtatggaattgccacttactaaacaggcagactttctgttcccttttttctagagctcttattagtgtttatccttatttttaatccctgtttctccaagttgatagctttgctctgaaatattcagtaattcacacaaaagaaaaaattagcaatatagaattatagacgtggaatcacgaagtaaaatcttttttgttaacaaatctggatctcttgcccaatgggtgacgttgtgctgaaggaggaggtgaatgggcattgttttatgtcaaaactaagtctatccacaggtcctctcctgtaacaaagatagaagaggtctaaagaagcaggagaccggccctcgatggaggtgcctcttagaaattagatgagtggttatgatttttgctcaatgttgctagagagcatggtttctctccttctacaagaaagagaaaaatggggaaaatttggtgagatgaagggtgaactcttaattcctccaagtcttgtaggtatctaagtatgtgccctccctgagttcagagaagatccatccatttttaatttttaaagcctgggcatttctcacaacagattctgaatttgaattaattctaacctcagacagaacaaaagactggggatgtatttttgtggtatgttttagattctcaagaaggacagaacagcatagattgatttatttgtattttgatagggcagtgaagatttattttatagtatgtgaggggtgtgtgtgtgtgtgtgttgggagagagagggagaaactgagaaaatggtgggacatgaaacatatccttggaaactgctttctctctcccttcgtctttctctctccctccctcttctttcccatttctcttcagtactgccataaacaggcgggaagcaagattatatacatatatatgtacatatgtgtgtgtataattatatgtaaaatttagtggtctcaccaaattgtggacttgggccctcaaagttttcttatcaattttctttcaaattagcattgaataaactttctttgggtttgatttattttcctataataaattttagcattttatgtaaaatgtttcttttctggttaatagtcactttattttaatcaaacgctcttcagtatatggacttcttatgacttgtgtcatagaaaagctattttcctctgcctattgcttcagttaccaaatatttagtttacaagttacaccattgttatcatcattaactacttgtctgtgttattgcaattaaaatgataactatttatgtcttatctgcctttttaattttaaaattcagatacaggagaaaatcctgctttctttcttgtgtgttaatggaaggcaattttcaataaagtgtacttaattgacttatttgttcagacataaactttgtaaggcccctgtgatctgtgtttgtggttctatttctccaaattgagcaggcttttactgaatatagtttttaaaaatacatttcactacatagtcttttcagttattatttaatggcagtaatgacctccagtggattcttgggtaaatagcaagtggaattttcagaggatgtcaattttcagtatatttgcatttcttagatcttttgaagcatggtgacttatctgaataaacttaaatttttcttaaaatatttatgtatttgttcattttacaatgaaattgcaagtgattatgagcactttaacttaaatgtataacctataagctaactttgaaaactgaaataaacactgtttaagattaatatctaaataaatgttcataatggttctcctgtgtaatccacttgctttcaatttttatttaggtgaaaacatcttacaaaatttcatattttagaaaggtaattgctaaatatttaatagaagaaggaaagactttgataaataaacattcttaaaaatacaattgttttttataacatttaagagagaggtaaaaatgctctgaatatctcagtagttaagtgaactcatgaaacaattttctgtctcttaatataaaagagagaagaaaatttgatatttgagagcaaatcactttaatatttttttcacaaataaaacacggttgttatagtatattttagatttcagcgaagattatttagaaacttaaaatttggagctttaatagattttcagtgctgcaaaatcttcatttttgacttgtgagataaattatctataaacaatactttcatattaaagtatgatacaaggattaacatgttttttatttcagttatttgtttctgcaaatgaacttgatgtatccatgtacctactgataatctgctttcaaatctttcctaaacagatatccgtctgtagagaaaaaagaaatgtgtgagaatataattttttttaccacaagagggaagcaaaaatcttttacagtagttagaatcctaactataacttcatctgatttgacattctttctgagatttgatatctttctgagaagttaccttagtttttatttccacagtgagtgaaaattaaagactgtgttataaagcaaaaatagtgtgaatgtactttaatgaatattttacgaagggcacaagcctcagaatgacatttttcctttcatgggttacagcactcacaacacacctgctacttaacactcatggcttaaacaacactaataaaataatccttaaagagtacagaaagttcacatgagaatgccaaagtatcttgtattctgcatatcttacattgtgatggaaaagaaaaattcagaaatattaaaacatatttagttttatatttaccatgattataagtctccaatttttcttcaatattctaataatcttgtcttccaaaagtaaaataataattttcacagaaaagcagccaagtactgaaaataacagctacagttgttttttgataaacataatgagaaaccattaagcaatgcatttatttaaaaaattagttaattttatgtaaagtttatccagtcaaatgagtatgtagaataatttattataacaccttcatagtcattcctgtattacagaaatctcttttaagtaatgcaaagaagttggatgatttatttttttacttttttactttccaaatataaattcttcaaaagacagtagatagtctcaccccatcaggagtccagcgtgtgcctgggcaggcggtaatgctcaggtttggaacggagcttcttttcctgagggttggcatacttccacttggagggtgacattttaagctttttcctctttctatctgtgcaccatactttctcgcagtattcttccactctctggaagttgctataaccgatcagctgcaagaattccttgtaccatggttttgctccctgcgagatgctactctgagcaggacaaggcatcctgtgatgcctgtcctcctcatcgtccttgttaaacatatcctcgactttctcctcttccactacctccaaggtgattttacggaccgtatggacaaagctatgctctactgtctggcaaaaataggtcccagcatctgatttgtgtaaccttaggaagagtaaaccaaggtccatcttaaccactctgtcatctgtcttcacctgcaaaaacaaaaaagtaaatggcactgaagtacacaggagagaaaataacaatccatcaccctttccactacctatcttgaattttttcattttcactgtcacataatgaaaccctgaaaatcatacatacacaaaaatgctaaataattacatctctctctctctctctgtgtgtgtgtgtgtgtgtgtgtgtgtgtattctgaagatatttacattggtggtcacttcatatcaatgaccttgagatcattttatatcaatactgtaaagtaagagggttttctccctaatgattcaattaatcattagaaaaaatacatttcaatatagcagtcacagtaagagtgaaaggaaaatttctaaaatttattttttaacatttgtttttcaatggacagaacaaataccacttcccacattctttcaggaatgattatgccctccagatggtagtgaccaatgtttctacaaggacctctctttggagaactgggctcctttcactttgtcgtcttacaaaaaaattcatcagttaatcagttcagtgaacatcccttacattttcataggctgtcctttacaagagattaaaaaataaacaagtaaaatccagttcctgctctaaaggatcagacggaatagcaaatattaagtttcaatataccttcagtgctcaaatatcttttgtcatgtatttgatataatactcacattatttctataaataaataattataattcagagtaagaagagcaagataaggctttcaacgaatagctcatgttttatcacaaatagctggactagtaagtaaatgatttgacattaggcagagttagagtcaaatattgccaccactatttattgtgtgatttagggcattcatgtatgtttcttgccttagttttctttgtaaagtggagataacttaataacctgaaaaattgttgtgaagattaaagaaaataggtgaggattttttgcacagtgctatcaatagctacctctacctttctactatacattcatctaaccaaaaacaatcatgttttcctgtggcccaggatcttacgataatggtataaaggtggttcacagtatgctgacagatttcacctttgagaatacaaaaatgaaagcaatattcttctttgtcaatataaaagaaatgtagaggcaataattacaaacaatttggcaataaaggctattaatgataagcatgtttttgtccctgtgataggtcctggccaggcatgccagactcagctctttcctgccttgatgagacctggcatagatgaagtttcaatgtgattactcaggtgtagaaactggtatccacaaaccacgatttgtggaacagatggcaaaatgtagtaatatagtaagaaatagggatgttatttttaagttatgtggtgccccaaaggcatttttttcagccattataagtaagttaataactcagaagcttcagagtgtcctagttgggctaataaaagagtctccataagtcttttgcaggtgcttcccttgacttggtgggaccatgtcctggtaggcagaatgctgtagccattaactggagagtgaaatcctccagtgaggaaccaagaagaccctcaaagcaaaatcatcttcaccacatagaaacaatctgttttactgatacatttttctcagaatatccttagcaactgttataggcaactaacttttaaaggactttgtgtacctctgcttgtttactcatgcctccaggccaggcttctgaacaaacttattttccagcactagctttctccataactttaccatctattgcaacctatgaccaccccgtgcctcacatgatactgactctgaagtaagcctccagtgttttaaaatttatcgctgcatttgatatggatgaaatctgcctccttaaacatcttttattttctgtgaggtatgtgccattatactgtccttattttccttactctttcttggtttcttctgcagatttctcattaccttaaggtgcaatcctccatccttcactgatcttacattttatttccatccatttgatagtacttttattcctttgtttcagccagcttccctaaaatggtacatcttacacatagataatccattgttttgtgttttctgttagttaaaaaccaaaaacaatggatttggtgtttttaattaaagaaacataaataaccctttaatatgtacaattcagtatcttcccactcaaactgccctccatttactaactttcctatttctggccatgacatcattattcttctagtctccctatcctcaattgttgatcgtttatacttctctctcattatatgctatcacaaattcctatttacatttcttcagtggtgacccttaaaacaccccttcctcatcaccatttttgctgcaatgttaaattctcataccttataactgtctctttgaccttatctcatgacaaactctccaaatcttccctttttttctgtttcttctttcatacccagcttgattctgtttcaggatctctgtgtatatctctgccttcagatacttctttaaggctgattaattctcatcctgcgtaactgaattaaatatcatcttcccaaactggcctttctcacaccctgtaaaagtgtcctccctcctttattaccttcgtttcgcctgttaaccttcatatacttgagcatgcaacattacatacaagtatctaacaatagtccttcaattaaatttcctgtgtcatctttccccccttatttcaacaaatggatactaatttactcttctttaaagctcactttcttttgtcaacatcctgatttagaacttattcagatctctatttcttgcctgagcagtaagaattgctccattaaccagatcctgcttttgtaaatctagaacccaaaattgcttaatgtagtgtttctcaaactagcgttggtggaagaggtgcatttgtggggatgtggagatcagctcttttttctataaggattttttaaattattgtgtttattgacacaaaaatcaatatgaattaataaactatatttggaatcatgtgaaagatcaatctcagtgttagtgtttatgtttatcatagattctgaaccactttcaaagccatgttcccaaatgataaaaagaacaaagatggtataatatgttaatgataagttacagcgaaatgaaaatgaaacaacatccccatgtagtaatacacataaaaagtttcaaggtcacttgaataaagtgttgggaggatggagtcatcacatggtatagctacaggcagaaagtgttatacatacacatatgtggcaatctgtgtctcatcttacaaccatagagatacatatttcagtaaaaacaaaacacacagtaaataaacattttaatgatgcgtcaatttgtttataatttatctttaattttggttcaatattttaataaaagctacaagcgtaaggaatgtatgtgttgttttattcttgtgaatatttaatgaacatattaatataaatcgtgctagcagcccaggaagatgtttcacttttaagggcaggtggtgggggcaacctgtacattaccagaatcaacccctccttttcataattctttatgctgccattcccgtgtatcgccaccctgctttccactcacagctcttactctgaacatactctttttcccttaaataaactcctttctactgtctaccaatccatttgttttttcatttccttccaggcttaactaaactttcccttcctttataaatacttcctttatagcccctaaaggtattttgcttctttttgtaacacaataccatttacatttgtagcacaaaagctgttatttatatttcttttcaaattatttttccacacaagtttcatctcttcaaacatataagtttttaaagggcaaagacctatttctttattcttctgaattatcctataatgagtaaagaattcagaagatagtgtaaaatgagaacatactaattcatttttagagcacaaacatgtatagcaatggggtatatccatacagacatatccaaaagatattaaaaacttccaggtaaatccaataataatttgaataagaaggagcaaacatggtttcaggagcacttagtaactgatgaaagagggctacatcacagatacgtcttaggacattgcctttacctgaaaaaaaaaatgcatacaaacatccttattgaatatgatcttttgttgtctctgttatatctcctgtgagagtgaataatacatgagaaaatattaaagtgatctagcctagtttccagcatatagcaagcagtttatgaaagtgatttaaaagaaagcaaaaagcaaaactaaaaataaatacaaattcttgaccactagaattagggttgtttgtttgttgcttgttttttcaagtttggtaagttaaaaaagcagggtttaaaaaaaatcagaaacccaagtttgagaaacactgtattatgtacatataaagtccagattggtcaagatacaagatacggaatcatgacaattaccatagaaattgtcctacattgtttatttccatgttagagatagtgcctctcagaattttgatctacactcttggttatgacaaatacacattacaaagacaggaatataagctgttttcatgctcggtctggagggccatacattatgtaggttaaatcacctagaaagttagaggtatcttacatggactataaatacccaaaaatataaaatgacttagaaatttgtatctgaagttcttccacaatttagtctttccctgtcagtttacttgggtacctccaacatcaaatcttgattacagaattgttttcatccatctgtgtttttttctacgtctgcagaccagattttctctgtcaagaagatagtgcataatacatcatttctatcaaatattcttataggcaatctatataaatacaaaatttttgctgaaaacggttttattattcttagctataaagattgattcagtatgttttataatttctagtaaaaaaaaaagtaattgaacaaagaactctgaacatctggtagctggtcaggaagaagcagttatttccatgtctaccaaccatatggttccatactttcacaggaaaaggacagacataggccttgaattgatttagttgagaatacatttaataataaaatcagttttagttaagaaatagaggaaacaatttatatatttgtttgtttatttatctggcctgcctttgaccaattttatacatatacacacatacatatgtatatatatttatttattttacttacagaaaatatacctaatatgacagagcataaaaatagaaatttattttattaaaaacactttccaacataaacctgatatatgatactgatggttacctagtagacaggatgaattgtttaaaagctcattcggggaaacctatcacactacgtggagaagaacaaatgtggaaaaacaacgcttattttaatacaagattatgcaggaaagaaagtcattataaataactcaaaaccataacatgtaaaacatgttatattcaaaaacatacacgatatcaaaggagaaatttagggcatttatattcaagaatgaattaatgtctagaagaggcaaaagagtttttcaagtcaacaaaaagagaaataaaaaagaaaaaatggaaaaagcatataaatgggcacttcagagaaggagaaacccaaatgtttagtaagaatgcaagttaacattcaacctcactagtaaggttagaaactcaaatttaggccgggcgcggtgtttcacgcctgtaatcccagcactttgggaggctgaggcaggcagatcacctgaggttgggagttcgagaccagcatgaccaacatgcagaaaccccatctctactaaaaatacaaaattagccaggtgtggtggcatatgggtgtaaacccagctactcgggaggctgaggcaagagatttgcttgaacccaggaggcagaggttgcgataagccgagatcacgccattgcactccagcctgggttacaagaccaaaactgcgtctcaaaaaaaaaaaaaaaaaaaaaagacagaaagaaagaaattcaaatttaaacaagacgttaccctatagccagaagaaagacaaaacttagaaaacaagataataccaaatgttggtgagcatgtggggaaacaggaacccacatgaactgctttgggagtccagatggcacagatatcctgagagcaagctgacaataattacataaatgaaggatgctgacaaataataatgcagaaacttccactcagatctataaggggttatttgcagagatgactgtcaaagatgtgatagcaagagttaattacactctggatgtccacatttaggggaattaagaatgaattaagagcaatgtatgcatgctatggtatgttaagtaacagtcaagcaatgaaatagagacacaaacagcaacagggataaactgtaaaaacatagtgctgagttcacaaagtaagaaggagaatataatctataatataatacatttacttttacagttcatgcatactcaatatgttatatacctgttcaatttgcaaacatactattggacttattccaatcattcaacagatgcatatggagaaacaaggatgaaagtagaaaaaggaggtccaggaaaaacaaaatcaaacaagagaaatttgtataaaccaatcatcacaatgtaccataaactaaatcgtatgattaagtaaattatgcatctgaagtgaaaaaaaacaagagccaaaatcaagcaagcaaaaaataaaaaccaaaaacaaaaactcctgttgtttgtaatgattaatgcggtttgacaaccaataaactaagtttgtaaagagaggtttgtgattaatggtttattcaaattttccatagataagaatctcagactgaagagaaattaagtttaaaaagaatgaaggtaaagacaatgtttgaaaacaaaattgcacaatataaggaactgtacaacaactataattgaagtagaaattcaatactaaatttcctagtaaccaaaggaaagaagaaagtatgataaatcctaagatttaaaatgtctctaaaatatatttttaaaattactccttatgataagtacatctttcctggcactgagacttgagaaaaatctctctgcatgtccttataaaaagagagggaggtttccaacaacagcaccataataaatacatttcctttaggcaacatctcagtgtagggtgaagagataatgcctgataatagttcaatattatagctattctgtagagttaaaacaatgtagtccagatatacagttctatactgggatatcttcatgcacacgcatatttttatgatctggaagaccatataaattataatttatactagaacaaaaggaacttgcaagtgaaaggaattggtattttggagtatctactgtacatgtgtgcattgggctttctgcattaccatgttatccggtttaatcagatgcacaaagctagaatggtgtcagtggcatgagacttagatccataactgatatcatagatctaagagaaaatgttttaattttgaaatatactcaatattctcctggaaaattaacagaacagagttcagttaaaaactctagattcattcctcttgttatgaccataagttgttttatattctccatttatacaataggaactctgtctccgccattgtaaaagcaagaaacatgaaattaatgggctagcctcctaattattgtgcaactaaaaaatgagataaatgatattatacaaatatgtttgtcaaggctagaaaagtaaattctgaatatttacctgttgtaaagagttgttagtttagaaagatgagcacattttttaaatagactgaaaaagaatgccaaaactacgaaacagatggttcaaatgaggcaagagttcatgcactttacattataaaaacaagaaaaacaaagaaataatattaatggggaacaaaaactgatgctttcagtgttgtgcataaagataaaaatgtaaacttatggctggctttgatcccttggagttactaccataggatagcattggtaaaagttaggaaaatatgagtcatgtaacaaacaaaatggtaaaataaaaaggagattttacttcataattctcctagcttcgatgacataacccaatattaaaagttgtaatttgtgcactccatttttcattgtttcatttttgtagaagctgtctccataacgcattgaattatcaataaaattatgttttattttagactatagaaacttagcacagaggcaatgaactctaagttatgtggaatgagctgctcattgataagctaaccatggttattagattactcaacagcgtttaattgactttggtgaatttattctaccttgtaagtagtctgaaggcagagttgaaaaatgccaattttggtattgagtaaaacaaaaaatttatagcaaagcacaattaaagtttaagagtttttctgtcaatatacattcttttttgcatttactacaataaacatgcatatttgtgcattatgtaagcagtctatataatgcatacaattaactattttaaagtgatacactttatttttaagacacagaaacacatatttcctcttaaatagagaatccacaataaaaagatcaataatgatcatggaaaaaataattctttcatgcttaccaaagagatctacaaattataatgctggtcttatgggccagcagttttcttgtctgccttacaccaccccaaaataggcatagatgatattttatgtgtcttgagtttgcccccaaattcccctacaggagatttgtgtaaattgatttaactcactcctagaactcaatctcatttattgtgtctttgggatatacttagattttgtcagcaaatgactgaactccaaaagaatgtattccaagaaattattcacattgcttgattttattgaaaatccattgcaatgaaattttagttttagtttcagaacaaagtgagagctaacttttgcacaaaaagactttttccccccaaaatagaggcatttttcacaataatattcattttatagggctttacttgtgtatgcattttcatttcagcctttaaatcagggatcaaaaactttttctgtaaagagctatatagtgaataattttggctttgcaagtcctgtggtctctgttgtagctactcgactttgcagttgtagcctaaaaacagccacagactttaggtaaacaaatgggtgtggcagttttcaaatacagttttatttacgataggcagagggccagatttggcccccaagtctttggtttttcaatttctgctttaaataattgtcaggttcaggggaacctacttttaaaaaaaatatggattaaaaataacatattcctaagacagaacatttaaaatgtgtatgaaattgaagtgaggaattaggtactaatcttctgagcagcttgaagaagccatggttttctttactataactgaaattacacacaatcactaataaccatttacatttaaataaataatgcatatttaaatttttcctcatttactcagttttaaaatgtagtgcttatccattttatagaaagagaaatgcatacagaaatacttcaactatatgaccttaactatatgtctcaacaagaatgaatttctccacttagggatgttactcagtattaaaatttttgtagttattatggaggttcataaattcaagtatgtggaattgcagaaattgagtcttcataaaccagggtatagtggtgatttggctataattttaacagttttgtcctctgctattacagaaaaaaatgatttatacacccttcatagaaggaagatttaggcttgtatttcagattaaaactatatgtggaaatatatatagccactgaatttaaatgaagatagaagacctttggaactgctaaacttaacttctgttgatgaaattacattatccacataaatgaatcattttattttctcctaattcagagagtgaagagtctctgttttccttctaagaatttaccccttaaattttgcctgtgattatattctctcccacatgttctttattttgcttcatcaactagttgcacatttcttctttatagctacttcctttcaacctataaacatgaccaagtcacctttttactaaaaagaaaacaaaacaaaatttatttctactcttgtctacctttgtggatctctctctttgtcattcgaatattttggtagagtacactaaactagcagtttctggttcaacagagcaccattcatcacttaacctgttattagatgaatcgtgccttaacatcccacttcacacattatccctggaaacttggtcctcgttttatgcattgttcaaagaatattgtttaatatatcttatccaattccttttttcctggttttattacaccacaccctcctaatttcactgtttctacttatttaagccatacagctctggaggtactaactagtttgtattttgtgccatttacttaactttagtaaattagcacaacctttatgaaaaacaatatagagatttctcaaagaactaaaaataggattaccattcaatctggcaaccccactactaggaatatacctaaagggaaagaactcattatatcaaaatgatacctccattcatatgtttatcacagcattattcacagcaataaagatatggaatcaacctgaatgtctgtcaatggatgattggataaagaaaacgtggcatatatgtgctatggaatactactcagccattaaaaacaaatgaaataatgtctttcatagcaacatggatggaactggaggacattatcatgagtgaaataactcaaacgaaagtcaaatactgcactctcacttataaatggaagctaaacagtgagtacaattggatatatggagtggaatactagatgctggaggctccaaaaggtgggagggtgagaggtagatgaggatcgaaaaattacctattgggtataatgctcactatttgggtgatgggtacactaaaaggccagagtcaccactatgcaatgtaataaatatgcacctgtaacccccaaatttgtaaaagtaatttaaaaactactagctacctcagagaagttttgttagttctaaataagttactacatataaagcacttagaatagcatggcatatagtaagcactaaatgaatgctaactataattacaacttattttctacttttactttctcttttttagtttgtcttctaacttttccttaaatatgtgttttccccttgcttttggagttagttcactttgctttttatttcatcactctctaaggtaagctatactagaggaggcatcactgcattgtgtctaagggccccaaattaaaaccagactgtctgggctcaaatgcaaactgacttcacaagctgtgtaatcttatgcaagtaactcagtctctctgtgcttcaattttttaaatctgtaaagtagaaacaataaaaatatctccttcatgggactgttgcaaggattaaaaatattaatcatgcttggtacacagtaagtcatatttaagtaccgattggtgctatattcttcttacttttattaattcccctgaaattgatactacatttttttctgatgtctctccaacatctcttgccatgccaaatcttccattgggttttatattcctgaacactgatacacagcaggacagctccacctgaatgatttataagagcttccaattcaacacagccaaaagttaactcaacaactttctcccaaacgtgcttcttctcctgtattattggaatcatgttactgtgccattagccacacagacactcaaacaataaacatgtgaatattttgtgattgcttctcttttttctcaaatatgaaatccacttaatattatctcataaaaattgaaacctgtcttctccctttctactaatactgtttagttcatgtggcacaaaattttttcaataactattgaaatatcatcctaaatgttcttgacattctgtttatctcctaagtctgtgtgccagtttctagaataatttgtgtacacagtcaagctaagttgttctcattggcttagagacaaactgaaatggattccttgatctgtctactcatttttgcatcctcatttctagccatgatttacatgtaccatattgtttttcatcttgtaacataagctaacattattctctctactaattaccctctactcatcctttaagatgtggctcaaatgtcatctctgccatgaatcgtttcccagttggttattatgccaccaccctacccaatctcttggttgagacaattttctttttccttggtttcaacagaatctttaaggaacacatataattatctgtttgcactcttgtctttattacaaggctgtaaacttcacaagagctaagatgtatttattcatggcctattaaagtaggctccgagtagatatttactgagttcaaaacaccaattgcagacagttgaacagagagaagagaacagaaggtccaaaatagtattccatctgagatgctaaacagccttcacatttcttaatagtgaaaaatatagcaaagcacattgctacaatgtgtatgaggcaatcacttgcaaatcatctggtcttgaaggcatgaacacattaagagttgtttttaagcatgaagatttatacttaatactgtgtgttcctatcacctcaatgactacctacttccacctttatccccatcccaacatactataatcttaatacaataaccaaagtgatctttttaaatacaaatgttaatgatgtcacagctctgctgaaaatacacaatggtttcctttttaattcagaacaccaaaaccctatgaaatggctataggtccctgcgtgagcttttccttgacctcacctctctggttcatggtctattagtctccctactgctcactaacctccagtcacactgctcttcactcagctgttctttgagtatatcacatatgctcctatctcaagagtcttagcatctgctgttcccattgtccagaaagtttttatctcatactgttacatgacctatgccctcacttttttcagattttttttccaaatgtcacttttatggtgaccttcttagtgaggccttctatggccacccttttaaaattctaacctctccctataatttaatctcccttgcatttttttctttatcattatctgatatatttaatatcattcttagtcattattgttattattttctttccacattcttcagaatataagttctataaggcaggacatagtaagtgcttaataaataaattcaaacaaatgaataaaacatttcttttagtgaaaaaacacccaataaaattagatggagtactctgtattttatatctacataggctcaaatggtggctcacattttccttgatatagaagtcatcttgtactaccaataggcatatagtagaagcttgaaaaggaaatttgagaatggaaatacattgatgtctatattgtgtatgttgtgtaacaatggttcctggcatcagtgcttagagtggcgatggttcaaattatgggcaggttctctggcatctgacaatgaggagtaatgcctttgtcattaagcctgcagcagcatgctccactcaactctgacaaagaaaaatctatataaggatcaatctgacatcaggagcattttttagaaattgaatcccagaacttctgctataagcagttttccatttgtgttatgtcccaaagcatctgaagctgtatttagaattttgatttcagaagattttgtgttttagtagaaattacatagacacctggatttgaacctactttactggctgcaagtaaccaggggagttattaaatatcctgtgcctcagttacctcatctataaaacaattctttataataaaatggtatattccataaaatacacatagaacagtccttggtactgtagcactgaatgtgaaacagcacagctttcgagttaggaatacctgagttcaaacgtcaggtctgtccctaactttgtgtatgagctataactctctgagttttagcttctgcatgtgtaagatgaagaaaattatgtctaacatgcagttgtgagatctaggaataacctggtacctactcagttcctgtttgcaataggtacatataaataatagcctcagttatcaattctgtttatgagtctcttttctctcaggatatcataataattgatgctatacatagtatcttatatatttaatttacatttataattcttaataacttattattacttaattataattaataaggtctacaagtcaagggaaaatgctccacatgaagtatctagcaaagttggctttcaataaatacttataaataaaatatatagagattatgttccatttgctttgtttaagaaagcaggagtctataaactgcatatttgagagaaccactataatctagagtttagaaagtagacaattgagtttctaagtgctttctaacaattcaggtatgtttctaaagattaattcagtttctaaagattaatttgggcaaaaactttatccacatgaatatgttgcttctggataactccagagggctgagtttgaatctgaacaggcagacattacagaatcaaaaatttcagttaaataaaaggaagatgtatatactctgtggtctgataaattaatgacttctctttgtttgtagcatcagagatgaaccctgatgagcatcgtcaggggtactctataaagcacttacccaggaggtaagaattaactaggtgaaaataaatatccttcaaaatggtctagatttgataagaaagtgatttcttatcaaaataaagatttgataagaaagtgatttcttatcaaaataaagatttgataagaaagtgatttcttatcaaaataaagatttgataagaaagtaattatgtttcacaaaaaagagacatataaatggcaatagtggaaaaattgttattaaagaaaattaagaactcacatgcaaagttattctgctttgtgtatacatcatgtatattcagcctttaataaagtcagaattttgtgttttgttttatattgtgaataaatcaatccgtatatagctaggtccttaaaagccaagtattattattagctgattatgacataacttttgatgcaaagagtaaattcaaagtccaaatatcagcaaatacattagttggggaaatttgaatgtagttgaaaataggtactaaaaattataggaatggagaagtagattatatcaacaatatgagaaagaaccttataattgaacattgatggattcagcatgtcaaatgatttggtaaagatttccaaatgaggcagattatggtgagttccaaattagaaacagaacatactgagtgaggaaaaccactgataaaagaattacttcactgtcttctgaagccattcagcttggaggaactatggaagattatcaggtccttttctgccaagggaattacaaggaatttaaaaagccatttcacctcagatttgtgaagtggaaaatactttaatactaaatcaacaacttaactcagtgcaatatgctgtacatttttggacatgtgtttattcttatgacatcatgaacagaattttcctttcctgattgcatttctatattatttctaatagcctttgttaggttgaggtgactttctttctaaaacctgtccaaagaatcaaggatttacaaatttaattatctcccagaatgtactgtatgattttgatctaaaaacatgttaggttttaaatttcacgataggctaggaaaaaaggaataaaaagttcaaagtgttccgcatttggaatcagtaattttgtattccaatgacaaatgtttagtctgcagtgccaaaacgaggtgaagccttccattgattcactctctatccaaaatgcacctattacctcttctctgtaatagagacaggtctctagagcttattttcattattcaacttgcaaccttttctttaccaaggataattttttcaatattcatcatttaatattcaatattatttctccttctaaaatatccatttttttttctacttgctatctttgtaattccacttttgtgaaactgagttcaaagcctacatcaccatgatctgccttacctaactgctttatgccctggacctctttatgccctggactctttctatagacagcccttgactcacattcttttatccagtaactgcctcctattctacacatgtgctttaaagctgcctattcttccatctctacaagcatccaagtcattcctctcccatcatttagatgatgaaagagcggggtctttcctttgttcccagcggtcaagaacccttgtgtcaatgtctcatatataattgaaaaattttcttctacaatgagcttaatgttgtagctgtgttgttattttaattctgttattattcatatgtctaagacatatgtgttaatgataattaagttttgctatttctctacaacactgccttgggagtcatgatttaagactatcattttgacaacatgaccataaaatcatgagttataagtacctctttaaaaaattcttacttccaagatccaaattaatgatttctatgtatgtgtatagcatatatatatttatatagtatatgtatataaaatctatatgtatatatatttaaattattgtgtgtatataaatcacacataacaaataaaactgacttattaaataaggcatgcatagtacaacagctagcttcatttttcagcatccaaataaatcatctatttactgatcacacactatatgcaaaatactatgttttgaatatgcagctatgaattacctcctcttttcttgtctcacgtcctttctgtacaaaccagataactttcgcttgtaaagatcgtggggtacattccagcaaagtactgttgttctctatgccataagccagatgttcttcagtcttatccaaagcatcccctacaacaggaacattaatgccatctttgagacttagattttataggtaaataaatttttcaaacattatttagatccctgcagtaacatgattaactcattacttattgcttatttctgcaaaaggtaatttaaaggaattatttagaaagagtggcataccaaaatttaggcatgaaacaagcaagcaggctatggggtgggacagaagtaggtaactgagagtctggttccaaaggatgggacaggatagtcaaggcagtaagaagcatcagtgttaaactcatggaaagtctattgcaacctctattgagggaagagaaagggaacaccaaagcacaggacaaaattcgtggatacaaacaaaagcagacaccagaaatgcaggcaaaatgccactacataaacacaaatgtggattatatcttgacaagggattgcatttatctgggtgttgggctgctgtagtgagaagagaatatgagactgaaccagggactttgtgaaataaagcttgattataatctgtgtcttggaccagaaaggctcttactggacttgaactcaaatttgcacacaggcaagtacacttagctgcagtagggaataaaaggaagcaggattactctctctttattttaaactaagacaaattcaataactggacctctggatttatttttcctatgcctgaatcctactcaccttcagaactgacccctaaacttccctaagatgaaggtcctacttttctcttgctagtattcccagaggcttgagtcctccactgaatcctgagtcagtctggggtccaacaaattgatgctggagcacagtctctggctctgcgtatagccaccgctggtttctcatttatggtgtcccttcttattattacttcctagtgagctcagtgacactaaatacagcctattcaacagtcactaccataatagaaagagtcaggagttaacagagaagttctttcttatattccttacttttgcctaaagatgagatttcctccattcctaacccatcagttaccaccaccctatcacctttattgaaccaccaaccccagccctaagcttggtcaacttagataaaagagtaaaagctttttcactttatctatcccaaagcttaggagatgacttgatagaagtaataccagttgataaaatcaccagaaggtacgtaacatggtgaagatagtccccagtatgagataaagaggtaagtcataagagtcactgtggcatcaaccacctaaagtatgcagcattcttgttctagggtttctttgttttaataattagtttaataataaagcttggtggtagcacataaaacttattttcctaatcaggtaaaaattagtcaaattttcaaaattttaactacatgtcagagaaaaagaatacttattacattgttctagtatacatgaatcacaaagaaaaaaaggactctttttaagaagtttgtagtttatgttcaatgtattctctgagtaacccagaacaactgattttctatggattaccaacaaactgttgtccaaagcactgctgagctgcatttccatgtcgaacatcttgtctccggaaacgcctgaaagaaagtaaatgcatttagatgttcattttttcaattttccagactttaaaatgcagccaattgcatttcatatacaagtagtattctgctactgaaaaaaatgatcattcatatgaaaaaagaataaaatccaagtttcatagtttttcatatttccattatatgttcttcagtagctaagatctatgttaccctgttctttatttacataatgttgaattctggaaactcaaacaacaatggaatgtatttctctttactttttgttaaaaatttagttcaacaagaaatcttctagtttgagaatgtcttgaatggtaaggtatttgagcagataaagacaatgggatttgaagtaaagtatttattgagtacaaaacagttattttgagtataaaactcccatatataataaagtgcaaatgaaaaaggtgttaaaatccaaatagtttgttctatagccattataatcaattagtacaaatagaatttctaacaataagacataaactaataatatactgtagtcagcttacttttattcagatataacattgcctctattcaatgtgatagtgtgtttttcatgtttagcagaattttgtgcatctagtgggactcaagaaatattagtattttccccctcaatctgcctcgtataattagagtcatttctagtattgttttaatttcatagattgtttagatatataactgaaaaaaatacaatattctgtatctgcggaaaaattccagaatatatatgtttatatatatataacgttatatatatgtttatatatatataacattatatatatgtttatatatatataacattatatatataaaattccagaatatatgtaatatacatatgtttcgaatatataaaatattatatgtatatgtaattcaagaatatatatattatgtatataatataatgttttgaatatatataaaaacattagccgggcatggtggctcacgcctgtaatcctagcactttgggaggccaagacgggtggatcatgagctcaggagttcgagaccagcctgaccaacatggtgaaaccccgtgtctactaaaaatacaaaaattagtcgggcgtggtggtgtgcgcctgtagtcccagctactcaggagactgagacaggagaatcgcctgaaaccgggaggtgaaggttccagtgagccaagattgcaccactgcactccagcctggcaatgaaatgataccccatctcaaaaaataaaaaaataaaaaaaaatatatatatatctttaaatatataatataacattatatataaaatgatttaatatgtaagccttttttctgaggaattaaacaatgagaattatcattagtattaatagtattgaaattctaaaatcaagaactctggcatacttaatttagcttagagattaaaatagaagtattacataaaggtagaaaataccacttgcttctctaattcatggcatttcttcaagactgagggaaaaacagaaggcaaagcagaagttttaccctagagggtgatagcatagctcccaaagtgacaatgagatgctttaaccatatgcaatgatgaaatttggaaaagtgaaccagattcaattcccaataccaccactaatgttctgtatgatcttatgcatatttcttccctttcctggctctttgtgtcctcccttgtaaaatagaggtggcaaaatgacacctaaaatctatttcagtcttttttttttttttcattctagggtgtccttactgtctctaaataacaataatagaatgctatttcaagagatcaagtgctttctcacacaggagttcagatcttatttaacatattaatagatattaaaaactagggcagatcaacatctccaatcaatttttgggattatgacctgtgtacaaaagtatgttttagttttagtttttttttaatgtagagattgctgattagaaaatcttacctaaaaacctgagattttacaaagttaatattagatctgccacatgtatcattctactgaactagattgaaaatagagcttatgaaaaaataacaagcaaaagtagaaagttgtatgattctatattgttttatactagtatgtacaattattatacaaccaatagcagatcaagatgagaattaaaatgctgttgttaatccctcactttgttgagtattgcttctatattgagaacctaagggctgatgagcaataatgaataatggataggaataaaatcaacaaaatgagaaatggcttccacttggccgagatggtgttgtataaagattattatacaagtgagatgaggataaggaaactacaatcaaataattctagataagcaatgtcaagaactgagtgcaaaaatatcgctgaaagttattggaaacatacatttaaaaagaaagacatcacattctccagcaaggtttcagttcattttatactatccccgtatagttgtcctttatttcagtatacatatatacatacacacatatatacacgtatatattacatgtatacatacacacacatacacgtatatattacatgtatacatacacacatatacacgtatatattacatgtatacatacacacatatatacacgtatatattacatgtatacatatatacacgtatatattacatgtatacatatatacacgtatatattacatgtatacatatatacacgtatatattacatgtatacatatatacacgtatatattacatgtatacatatatacacgtatatattacatgtatacatatatacacgtatatattacatgtatacatatatacacgtatatattacatgtatacatatatacacgtatatgtgtatagtgtatacgtatacacatatatacgcgtatatgtgtatacgtatacacatatatacgcgtatatgtgtatacgtatacacatatatgcgcgtatacgtgtgcacatatatgcgcgtatacgtgtgcacatatatgcgcgtatacgtgtgcacatatatgcgcgtatacgtgtgcacatatatgcgcgtatacgtgtgcacatatatgcgcgtatacgtgtgcacatatatgcgcgtatacgtgtgcacatatatgcgcgtatatatgcgcgtatatatgcgcgtatatatgcgcgtatatatgcgcgtatatatgtgtatattacatatttacactatatatatatggagaagtttcagaaagttgaacaaatttgctttcattctcaaaattgcgtattattcttatatctctagtcttttagacatatttaaagagaacactggaaatagacaaaatagaagagcaaggggaagaaaaagattctagcattataaaccatagtgtattttggaagatcattttaaacaagtggtttggattgtgaattactgtttttcccctgttgactcattttcactctttgagcagaaaagtatttattttaatgacctgttttcaatttctgcttctattcaggtctgaagcaaaaatgatctgctataaaagcaaactattttaccttcatgtgttggaacttatccaaaaagttatcttccaggggtagtgatggttcaaaagaatttgacagcactgaaagatctccattacatgtcactgaactgaactaattcatttacgagcacggcttctgattccagcatttcatgccttcctgtctactatttttctcattcacttgactttttctaagtaactctttttgtccaccacatctactgtattaacaagcttaaggctggacactgctaaaagatgcaccatatagaaaaattaactatggaaactgctcaattaaaattcattatcactactgcatgcctaacacaaaaccctgtcattcataagcatttggtgcaaggcttgtaaacagttttattgttgctatgacaataaaataattaatgctgttattcgtggttacattcacattctaccctcatattcttctatttcactcctgacccatggtacggcatgcttgtttttaagcattctatttctttgtgcagacaattaattccctttgactggaattttcttatatctctaccttcaagattaagctcaaaagtgagattattttgagaattaaataaagtattatatgcattgctcttaatccaatagctcattcatagtaagtgctcaacagcaagctactactatcattatctacaattccattcttcactttaggttccaatttcctttagacaagaggttatgcttgtttcttcatatccctggcacatagtacagtaattggcttaataggtgaatacactaataattaatattttcaaataattatgtgactatattcttcaagaattgttttcaaacatcaacaagcacgtctgcaaaatcaattaatttgctcaattctttaatacatttggtaaatttagttcagaaatgtcctctcgaagcataattttactatccacttattatatcatttttttaaaatactcactggagtgttaattttgctcaagtaaaattaacaaaagttttgaattagtgaagttttaatgagattctgctatatatttgaacctataaaacaagaactacactaaattgggttaaattatattctgaaaaatgtttacagaaaagtaacccaaagttaaataataaaaataattgaaattaatacaaactgtttttcagtaagaaaattgtctatacttctattgtttgctttattttgtctttggtcattttattgcaagaaagaaactgcttattctgtaagaaataaaaatactttttttcctgaggtatttccacaaagaatgcacaacttcatatggcttgagtgaagagatatccttattcttcaaaatacttaactgcacctcaagatctctgcttaaagaatcctgggatttaccttctgtaggaaatggcaatgacctcacagaattgtaggcattggagtttggaggtctttaagtacctttcatttgtgttgaattaaatcacacatttcattaattatacaggtcatgcatttgcctaggagttaaaatattcactttcaaaatgaaataaatgaagaccagctggtagagaggacatggggcaaatgcaggatgtattttagaatttctttattgattttccttttaagtctttgaatctctcatgtgtggtggcttgtcgtttccacattttaactttatctgaactcgtttcatgtcttgcagcaaaagtttcaaaagagggaaaaactgactcaaacctgggtgaaaaaataaaaggtcaacagcatgttcagtgccagtctctgtacacaataattaatacaggtattttctggaaaacttcaagttaaaaaaaaaaaaaaaaaagcattagggttttcctaagcaagggaaatagttaatcaggtagcacgtctcacctttttgcatgtgtgcctgttgggtaataccgggagcaggatatgccatcccaggcacagtaagggtctcgagccaggcagcagtcagcacaagcacttccatacatgtcacagtgatggaatctgacttgagccacagcagaagcagatccaatatacagctgttgctacagaaatcagaaagaggtcactagcagaaatggacaaaactttcactgagctattacacctagttttcacatttatacacaatcacctcagaaaaaattcacttaaatttaattcacttaaattagcagtttcaggagtttgagaccagcctgcacaacatggcaaaaccccatctctactaaaaatacaaaaaattagccaggcatggtggcggatgcctgtaatctcagctactctggaggttaaggcaggagaattgcttgaacctaggatgtggaggtggaacctgggcgacaagagagaaactccatctcaaaaaaaaaaaaaaaaaattatagcagttgttcaatatagataatatttatactttcatttctctaatatttgagaaacattcatagacataaatgcaggagtaccaaaattgctacactgaacttgacaagaactcaagaagctgtgttcattatcttgcattacccaacactgtggatcttcctttaaagatctatagaaacggctgggtttatgcctgtagtggcttatgcctgtaatcccagcactttgggaggctaaggcaggtaaattgcttgagcccaggagtttgagaccagcctgggcaacatggcgaaaccctgtctctacaaaaaatacaaaaattagctggtaatatgtgcctgtggtctcagctactcacgaggctgacacagaaggatgacctgaccctggggaggttgagtctgcagtgagctgtaattgcaccactgaactccagcctgggtgacacagtgagactttatctcaaaaacagaaaacaaatctatagcaaaaactaataagagatttggaaagcaaatagtcttttaaatattgacatataacatttagaagagtgatgtgtatatctatctatctatctacagaacaagtggctgaacatttaatataatatctttccttttgcctgaacatgaaggattatttataaataaatttggggcaatatatgcaacaactgtttctaaagaagtttacaccaaactgatttcagtgaagtggaaaggaggtgtgtttccttgcacactattggattatcattgttcttgcacactattggattatcattgttaccattgtttttgaaaaacattagtgaaaaataaccagggaataaagtgttatcatgattgtagaagtaaaactactctcatcttcctttctatagagatagaaaatgaaaacaagtatcaaatgtaaatcatgataaacttttgtcagaatcaatcaatggacataaagtttcagtcaaacaagattaataaggtttagaggtctgcagtataacactgtacctataaccattaaaaatgtattgtatgcttaatattttgttaacagggtagatcacatgttaaaagttcttactacaataaaataaagtaataaaagaaaaataaaactgtaataagttcatatttaagcacatgtactaatgttctcatatcctttgaccttaccttagctcacatatagaacacacacacctacacacacacacacacagaacttacccgctttgaagaaatctccatagaaataataggaactggatcctgaaattttaaaaaagttttcatttttaagaaaacagtataaaaacatttaccttaatatggttgtaaacccctgaaattacattacttatataagtggttatgtgttaagtactgtatagctttcattttagtaaaccaatatgcaaacacaattaaaatgcagctttaaaaacttgtttctaacagggtgggcagatatgcagatgagaagagcagcaggaaatctaaccagcttactgtttggaatatgatttttgaatttgtatttgaatattacttgcgctttggaaactcaagtatctttaaataaaataataaagtcagaatgttctattaaagtaattgagtcattaaaatgaaaccattgtgtctttcaataggtgttattgctaataaaccaggtgattttaatcatttgaacccaaacctaaacaaaatatttttctgttggagtgatcatggtgaatcataattaacccaggattctttgaatgagatgaataacctgattttcttagaactgcaccagaggaaggacaatttataccatagctttgggaaccaacatgttgtttttggattgttaaggctagtgcatccctaaggagcacaataaactcagatcagctgtgcaagtggaaaaccacaagacaggtgaaatccactctggggatgattatcctttgaaaagctgtttgttaagagggaacatttgatcctctatgtcagtgtttttttattttttatttttactttaaactacagaatctttatgccttcatacattcactcaggcaacaatgtttcttaagagttttcatggacaaaacactgtggtgagtgaatattaaacatatttcagtttataacatgaaatgaaatcttatgtagagtcccagagtgcaaaataaaaaaaagcatagctgctccggttgatataggatagtggttagctttgagtgtggctctagggaatctgtgttctagtacagcaaaggcaaaatgtactgcttctcatttataaagtcttttcacatctacccatcataaacatatagagccaatctttgttattcacagattctgtatttgcaaattagcctacttgctaaaattagttgcaaccccaatatcaagatgttctgtgtttttaactcatgggcacatgcatgctcagagtagcaaaaaacttgagtcacaggacatgcacattcccagctgagatgaaacaaggtgtcactctgccttcttgtttcagctttcatagtgtaaataaatatctttttcatggactatgtagtgccaagattttcacatgtctgtgctttttgttgatgttttgtttttaaaatggcccccaagcatagcgctgaagtgctgtttaatgttcctaaattcaaaaaagctgtgctgtgccttaacgttgaaaactcttagataagcttcattcaggcatggattatcgtgctgtcagctgtgagttcgatgttagttcatcagcaatatatattaaataaggtgtctttaaacacaaacacacataaaagaaggttacgtattgatctgttgataattacgttataaatagaaatttgctggaacataaccctgtatttcccatgggagcagtggtcagtattcactagttcagtgttacaacaactttgaagaccaaaactgctgcaaatgatacgacttgatgtgtgtgtgtgtgtgtgtgtgtgtgtgtataagtgcatatgtgcatttatatatatgcacacatatatatgtgtatacacacatatatgtatacacacgtgcacctatgtatgttaagtgtatctgcatatgtaattgttttttcatgtcttttttattatcatcttctattgtttttcttttttagtaaattatttgtataattaatgcacttaataaaaagcagtatgcttatcttgcctcaatgttcacaatatgaaaatgtatttttttttgtcagtattgatagtacatttacaagatgtgactgtaatactggctctgaaaattatatgtagtataaatgttatttctttatagtcacagtttattcactgaaattctttccatgctgggtaaatattgatctctcagttgaaacgtctgtaacaatcaaacagatgcattagaatttgaaataattcttcacttatattagctctgaatccacaacatacctgttagggaaaaaaaaatggacatagtatctttcctatttacatctcacttgtagttgtaatgcataaatttggtctgtattttttgctttaaataccttgaatatctgaagttcttctagaattacttcttccattgattccatttcttggttgtaaattgtgattactttcagcacaattccattatctgtaagaaaacaaaacaagaaataaactagaatctatgtcacagtacggttttcaaaaaaaccatgtagctggctgggtgcagtagctcatgcctgtaatcactttgggaggccaagatgggtgtatctcttgaggtcaggagttcaagactagcctggccaagaaggcaaaaccctgtctctactaaaaatacaaaaaaaattagccaggcatggtggtgggcacctgtaatcccagctacttgggaggctgaggaaggagaattgcttgaacctgggaagcagaggttgcagtgggcaagatcatgacactgcactacagcctgggggacagagaagccttcatctaagaaaaaaaaaaaaaagtagcgactataaattcaaataaaatttgaaatccagaggcatgaaacatgttaatcactgtcagtttaaaataatatgattacttataaactcatatttttaattagcaaaattaattttatatgcctggccaaaaatgagaggaaataatgattttttcaaatagtttgatccaaaaatccaatcatagattcaaaaatcaaaatgtcttttggaattaataaaacataagagagatgccaaattattctagctactttttctgtgatgcatgacgcaagaaaatttttttaccaaaagctacttttatggtacgaaactatacctttagtcttagggaatattccaagcaacacactgtgaaactcatcatatatataaaacatacacatacatgcaagcacacacagttttggcaagaaaaaaatccaagtatacaccattgagagaagtgtttgtaccagtcatttagtttccataattatcatttatttttaaagtttatactcatattttaaaattccatctaatttttatcatttctgatattctgaacttgttccttcctataaaaattttaacaacacattaatttgcctatacaaataatttagtataatgctggacataataatttagaaaaaaaagaacactttgaatttcttctctaagagtttctatgctatttcagcagtttgttgaaatattatcaagtcttatggatgagataataaaactggattataattaagctaataacagttacctgtattgtacactacccaaaggaaacaaaaattatcatcattttgaaaacaaagcacacatattaaatacttgacaattatatcaggcaaaaagcaaagataagactcaaatgattaattcgcaattagtgattttttaataaggaccatatatgtattgtattaaagccggtgtctagtaaatattggacaaaatattatttgtgggatttttcaatgttgtacccatttcattcattaaacatgttcttttttctgaaaatctgtggttcaatatgatgacacctttgacttaagcatggtgtatatggcagcacaaatatatgcttgatacttctgaaattctctggaattactttgatcaatatgacaagcaagtatttctaaaaacattcttggactgttatatgtggcttctgctttccagggcatttaaaaatcacatactaggttggtgcaaatttattgcagtttttgccattaaagtaacagaaaaaaaccgcaattacttttgcaccaaactaatactttaattacttttatcaaatattagtattgattatgcaacttttaaaaattttgttggaagtcactatgagtgaatttatggccaagtaatttcaagtttgctaaagaaatctgatgacaccgttaatcatgaacccacagtgctgagcatattattaacattaacttcctaaaatgaatgaataaaatacagcctgtaccagagatcaatttctaagaataagatagatgttttcttttttaaatctttgttttaaaaaacaaaaggatggctgggcatggtggcttacgccagtaataccagcactttgggaggctgaggcaggtggatcacctgaggtcaggagttcgagaccagcctcaccaaaatggagaaacccctgtctctactaaaaatacaaaattaggcgggcatggtggcacatgcctgtaatcccagctactcgggaggctgaagcaggagaatcgcttgagcccgggaggcagagtttgcagtgagccaagatcgtgccattgcactccagcctgggcaacagagcaggaccccagctcaggaaaaaacaaacaaaccaacaaaacaaaaaaagccacaaaaaacaaaacaaaaataaaaacaaagggtttattggagaagcccaagcaccaatattaatattaatattacatcctgtttcctgatctgggcttatgccaatatctcttgagaattatatatctataattaaagtcatgtatgttagaatgctcacttctctaaagatcaactactgtagcaattatactatgctgaataagaagaaagacaatgaaagaatcattttaaacactttaaaaatgactaggattttaaaacacttcaaagaatttgctacatactactttggaggctgaaagatctcaagtcctcttctacaagttagatctaatgtatgggttaattgaaattacaaatttatttgaaaatatcacttgtagcatatttatcatactttgttttattaatgcaggatattattggtaacatttggcctgcttggtacaaatggttgatcttgacgtgaactcataagaattgctgtgtttagagatttaggtgaaggtattgtcccaagttccaagttgttcacaaaatctccaggactcgctgagcaaagtcagtaatggagctgggaaactgacagaactattcttgctatgacactctacttccactatgagaacttctattggaaaccaactttgttcattaacgtctattattcatttctttacttattcatttattcttatgcatgaagtattgatcatgtataaggaattttgtgctatgcaagccccaaatcctctctttgtcagcttcaatatttctcacatctgaaaaaaaaccacatattttgttggtcaaaccatgacacttctgacaatgaaagtggtaatattcccagacaactggcctaaactcttactattgcagccacatgaggtctctatttcaatctttctcattttggattagcagtgtgaaattgtttaacagatggacagatttgtcgataggtgcttttagaaatattattaaaattattgaatttaagggtcaatttaaatatctctgagtactttctcgtctctttacctgtcccaataaacaagacgtcatattggccatcctcagcttccactcgatctactgctatttgtttcaggttatattttccatctgtttttaccaatattggttttttatgggcaggttttatggcctggtacattagtggatgacttcttgcaaatcggatggcatcatcaggatagtccttggtggttccgtatctccctccatttactttgctggcacactgaaaaacaagtggatcagataattctttttgctttacacccaaagagaaaatttataatcaattatgagaagaatcagaaaaattgaagttgtcaaattagtcaattgtgcatttagaaatatttagtaatcatatatttttctttttttttaacttttattttaggttcagaggtacatgtccaggtttgttatataggtaaactcatgttgttgtacagattattttgtcacccaggcactaagcctagttcccaatagttcttttttctgatcctctccctcctcccaccctctgacttcaagcaggcccctacatctgttattcccctctttatgtccatgtgagtaaccatatattttttgttacagaaatagaatcttcctcagaaattggaaaggctaaattatttcaaacatgcagcacaagatatacagagaaactggataaattctggaaaagtgaagtatagttactatcaagactttagggatggtaaaaatgtttaacatcatacatattcaaattattttctctgtttttgaaatttgttttttgtaatataagttaaattttgaagggaaacaatctattgttcacacaaagagaagaaatctcttcgttgtgttgaaacttctaactaaggatcacaactgtacaaaatagctttactactactgagtctatgataatatgatcagtgatggttctgattggctcactgactatagaattttagtggttcaacaaaaaaacctattcagatgttatcactgttaattatcaatggcaaaaagacactctctgtttgctgtaatctacgtgaatttgtatttttaatggatttgacaaaataaactgggaaaacaagaaatatgtgttatgtcaatttttaaactactgactaaaaaattaaatactcaacagtagcttaagttactcattggaaaacctttaaatgtgttgattcatgcttgttagtaactgctccctcgttttacatattttcctccagaactacaacaattgcaacgattaccttgataaaaattttccactttagagtataaatacagtagtttagtaatcagattccacaaagaggacatttataatggtgtggtttttaaaatcagaccatatttcctaatttggcatggatttttcacttgagtgtactttcatgatatataattggaaacattttggactagcttggaagcagttccataaccagtcgcttcctccaaatctcctttaagaccatgtggtttcaggaagcatttccagcaaagccacaggagtagggtttctccatttaaaattgtaatttcaatcaatagagtgaaataaaatatactttatgtcttactggaagtaataattttaagctagtgagagagagtgattgaaatggtaaagctttaacacttgttaatggaagtaaggtttgttttcactttgggtttttgctctacaaaaatggtttctatttgacttgcaagtaatcgtggaatcagtgtagtgatgggatttcaccagctgcttgtaaaagtatagatgttgacttgtgtgacaagttaaatctttgctctccatagctcacatagcacatacaatgatccaaagtttttccaacctagttgcacacaggatgaatgatacaaaatcatcatctcatcatcaccctcactatcatcatcagttttagccatgtgtgctaaaagcacaaaagacttcatgcctagctaagaagaatcttaatagtatagttcagagacaagtggtagaacctttgtactctagcaatacttttgtattggcatttctttcctaaggggccagcaaggatgttaaatgaggtgctaagtattctgaggagatagagaaaaaaacttcttatagatttcctacaatgagaagtaaggagacagtttggcctagggaaattagaggctaatttaaatgttagaacataaaaatttggtgacattgtcctgcttggaaattatatgtggtgctaactcctctgaagaggctgagaggaatacgatgttcatgttactgaatgtttctgttttcaccagtacttttaaaaataaaatttcaattggtgttacttagccaaaatatcaataatagtacatattttataatactgctgtgtccattatatattatattctttttattaaataacaaggataaaacttgagatttgaaggaatatttttttactacatatacttttcaccaagcatacttttaggtatagtattccttaattgtttatctgcaaagtcttatgaaacagtgaacaaaatattaccaaaagtatacttaaaaataagaattatttgttatataactaaacttacagaaccaggccttggataagggacttttccttcatagactgaccagtggtattcaggtccttccttatgtgcatatggtccgttgaaggctgcccgaatgctagacatgtgatagacacatatagcatgccctcgaaaaatattactgaaaaatacaaaaaagataattattcttctggaactaactgcaggtcatctagccaaataccccagcctacaaagataagagtcaagtcttttgggtaaagtggttgcaatttctttaagcaaagaatattctaggtatgttaattattgcaatatttccaattttgaaactctgaaacttaccattttcttaactgcctacttaatacacttgaagatgacattgttacaatgacaaaaataatgttacttcagttatttttaaaccttgtgtttttatatttttttattaaggatgatctggccttcatattaacaaaggcttattcccaagttgaattactcatttagatattatctccttttatgttgttctattttcaaagtagacagtgtcctcttactcactatgctgttaatattgctacaaattctattaagatgtattaagtttcttaatgtatatgacttaaagaaaaatttaaagtcttatgaaaatttaggcttttttccattttttagcgggggttcatgtaaactttaatatgcttgtatattccttcctccagtcaccacaaagtgtctttaaaattactttaaccatataaaacttagatccctcatctccagaactagcggaaagcaaaaaaattttcttgattaaaatttctacttgacagtataaaggcagtagttgactaactgtggcaagttttattgaagatatttgtaatcagattctacaaaaggacatttttaaagatttttttaaacattcttgccatattccttaatttagcatgaactgaatgaattataacattatcagaatctctgtattgtaagaatccaaataattaatgtttgtgaaagtgttttgcaaaattcaaagttctatataaataaagtttcctacatcctgagacacctgtaaaacagcagttatgttactgtcctacacccccaatttacacattttataacacaccttgaagcaattggaaatgcctgggatacagggaacacttgagatagtctcctaactaaagtggtagcacgcctttgatcaccattctacaaatatcaatccttatgtcaggtaacagctgggaagcttttgttctcagatttatataaattgaacagtcaaaatagaaattatagaagaaaataatgtcttatgcttgatttctcagaaagatccattacgctatcatttaggaaaatagcttataatctgatcatattaacccatagaaaaactaaaccgattattccatagctttaatttatcatataaattcactgaattatcatgcaacatatgaattattcacagcataagggaggagatgaagttaaaacgttaagtactctccatgcgctgtgataactaccaatctacattaactatttttctttgcatcaaggaataattgatagacaaattgtttccatgtttctctgttgaagaaaaggtctctttgcaacagcaggattcttgtctaaagagatgtattattttctctaagtgagcattagaaactacctactgaaaaataacaaactaaagctgtgtggaaagaccccacgtaagcacagtatacataattatatgacagtttatggcttatatgatgtaaaagaggaattcagtaatattattctagccctgtcaagagaattgaggtatattcttctttattttttatcctaatcattttacctgcactatgccttacctggaaagatactcaggaaattgtctatataaccttttaacaaatactgattctaatatttttatttgtgtgtcaaaatatatgaaataatattttatccatttttacagcactttactatgggttaaaaaaatacagaaacataaaggggaaaacaatagattatacatcttaaacttgagcagcaaatttaaaagatagagagcaaatgatgaacgtgttcactatgaatcaacgtaagagcaggaaaatcagaatgaaagagtgagaagagtgttctatgattatgaaatcgagaaatttttcttggatatggcaattggtaagtattggagaactgatttaaatcagtgttggaggagaaagttttttcaagcaaggtaagtgaataaataaaaatatagtaatgggaactagcaaagtagacactgattggcatctgtcaaggcattatcttgtcaaaatcagaccattagtgaactcacagggaaaatgtccaaaggcaagtgagtaacagttgagatagaaccttgaaagcctggcttggaaaattctatgtgatgaataaaggaattatcctagactttacaacatataataacacattgtaaggactgatatcttacaaactgtatgtgaaaaaaaaatcactgtgttctagattacagagtgaagatatcaggatactgagcacaggaggattctgggtactataaacagaaacaagatttggatttagattgagcttctgaaaatgaaagtacatttgcaaacgttggaaaataaagatcaattggtgattataaagtgtagaaaatgagaagagcaactgggtcaatagtctttcaacttatatacaccatgaagggagagtccggtgaggcatctcttgttctatattgtttttattgactgtataaatttctcacctggtagtgttaaagagtccaaatatcactggattcttatgatctctggtaggtagcaaaaaaacgtcctctgaaaaattaaaggccattccatcgcttagtatttttagctctctttgcatgcaaagaaaatttattcacctaaatttgtttagaactcattatagattttgagatgtgtattttcatatacaatcatacaaccatgaccaagtcataacagagctaatcattcagctattctgggtggccttgagctgaacaataggaaggaaccagacactgactctaagctaacaagatgagcctctttttgttcttgcaatcccttttcccccagcatgcgtgcctggccaaaatgaaaagaacagaaacttgctctatgttagatagaggtcaaatacacagaaagcaagtttctatgtgtcctagggataaagttataaagaagcatatacataaaagagcaaatttaattcacctaaaaacatttacctaattcatcaaaatatgtgtcaattccattcattcctggtactgagcaaacgagtctcgcttttaggaaagtgctccacttattcaccagtattctctgccctcctacatcattctgtgaaaaccaaaaaggaggtaaatagttacctaaagaatttcgaccaaccacagatttcatattattaaacatgcagttgccaagagttatgacttttttatttaactaggaaaatttggcataattctcaagtaatgtcataggtgcaactccccataatttggatttttatttttttttaggtttcttcattcggccttgtcagtgcactttcaccctgatacagtaaatatattttgcagatattaaacaatattaatactgcaaactctcctaaatagaatagtggagagatacagtaatcatgattattactttgttcataaataatttgcctctctcaggaatatagaaacacccatttcttttcttcctttaacaaaggaagaaagcttttcaagaaagtttgaaatacacacacaacacccatactatatatgtatataaatatatacatacaccacacacacaatatatatatgcacacatatttatatgtaaatttattttcgaacatcttcttaaatggcaaggtaactttacatttgtaattttatttgattctctcaatatatgttgctactcctattggttttaaatgttcccaaacaacctctctaaatattcagtaagttacagatggcttttttaaaaataattttaaccaaccgaattgttcaaacatagctatgtatattatttgtactgtgtactaaaggaataaaaaaggttttgatcaaattcattaagaaaaataaagttcaaatttctgcatgggaagaaggacagtctaatcatagacgatttcttcttggtatagcttcaaaaatggggaaaatcatgcaaaatacaaggtccttttaagatacacctttcactagatatgaaatgtagaggttggtatagtaaatatcaattgtaggcagtctaaagaatactagaaaatatttaaaagtagaaacttactataaacttaataaaggcctgaccataaattgtgagataagcaagcataatgagagagaaagcctcaccacacagagtcgcccgaccctggtgtaaattgcgtgagcattgttttctgcctccagtgccttctcagtaaaaaagaaatatactttgttgtcatctctgtcttcattgtcaggaatcatgtatgaacctacaaattttggttctataggagcaaaaaataggagaaaaagtgaaatagatattacaactaaatgctaacaagttattccaataaattgtatatcatctgaatccttaagtttaactttcaccatttcataaagaaatatttttcttgaatttttttaccaaacattaaaaactatgttgatatctccactttatttgcatattaacagcccttttagaaatattacaagaatatttaattggaaaataaaagaatccaggagagaagaagaatttcaaacaacatgcaatgcgaacttaaaatgcattcaggaaagagcagattgggagcacaatgaagacaaatctctacaaatttcctcccattgtaggtaaaaactaaatgtaagtataagtaacatattaaagtaaataaatctatcataatttatttttaattcataaatgatctaccagtatagcgcatagatcattttagtttcaaagtagaaaatttattttacgtttttgggattgtagtccaagagatttgaataaatgttctttgatatggtatgtaaaatatatgaatggtatcatcaatgactatgcattttaaagcttaataaaaatgtggaaagtaattaaaatgctcaccataaaacaatattctagcacctccatataccagtgtgccaaaatataaaacttacttcttacaaagaactctgtatcaatgaatgtctagtgactttcctagagttttgtctctaaagtctaatgcaatcctattaaaacaagcaaagcagggcaatcaattcatcaaagattatatcaattgataaaagtagacaaaacagcttattggatgatggacttttcacttttcatacatttgttttgttttccttattcaaatactgatttctaagcattgctcggaaggtatactgattttataattaagccaatcaattttgatagaaaatgatgtacatatattatatacaatattttaattcaagaatgttgctagtaaaacattctgaaatttgtaaaggaattgtatttatattcttattattatcaaaatggcaacattttccgtaagttttagagttgatttcaatcctaattcacatactcttttcctcatccttacctttcaacagacgctcatcgtcatgctcagtgcggatatgggccagtcgccccatgctgcggaagatcgcagcgtctctgctccagtagtcactgtagagtccagcaaacaattcactacctacacgggagcatcagtaaaaaagaagtcagtatttgttaatatgttaacaaattaaacacatccaaatttaatatgtgtatctataatatgtactttatgacattaatactattgctgttaggagcatggatggtatagtaagactcccagggtttgagtccagagtctgtcacttactaggtgtgaacttgggcaagttgctaagttccctgtgcctcagtttcctcatttagaaattagaaaagtaattgcattcagtaagatagttaagagcaaagcacttggaagatcagctggtaaatagtaagacctatatgagtttttggtaaataccttggcttcatttattttcctagacttcttttaacctccctatcatcagggctttatcattatgattgttattgtgatgattacaggttttatatgtcagtcagctaattcaaatccttcttgtaacaagatactgctatcatgaatatgattttagtgtgggaacaacaaagtctaacaaagatgatataatccaatcagttgtcattcaatttgtaaatttgtggctcagtcagataggaaggatataaaaagcgctcaaaatttaatcagacagtcaacaaaatgattgaaggaagttagttgcaacatgtggtggcagtcacagtcttaaaatcagactgagaaattacataatgtattcagggtctcaggaaataaccatgtgtcttttgagtaagaaaaaagacattaaaataacttaagggagagtataacttgaactccaggaagatcaatagctctgaagcatagggacttagaatcctttcccaaaactcacaagaggtaatcagtgtgcccatcagttttaccagaaggatgtcctggccatacccggctcagttgtcctgtctggagcaaaaatctctggccaagaaacaaatgataacagcagattgctggaaacagcaacctcaaagcaaagtggtaaaattgttttcttaatgagtggcatataacattggtctagttctaaaacagatatgattattatattacatagtactaatgcttttttgttaagtttgcaatgtgtatgcatacacatatttaaaatgctttaaaggttaagagatttcaaaattaattgtatttccaacttaatatatctaattatgtaattaattttataattaggattattaaagttgcaggtataagaatttgaccaaatatataaacagaatttaaaagatattgaatactttatttataaattttatttattagaactttaaaaattgtttaattatttatgaaggacttttttcccaaggtaaggtctttaaagctttggaaaacttcagaagtgtaagcatttttgtatgatttaacatttgagaaaatgatcaattaaattatatataagacaaattaaaaggaagtttattttcaacttgcattaactattaatattttaaaggtaaagatgattgcttttgttataccaaatttagaataatatgatataaattaaactcaaagattaaaaaaataagctttagaagtactactataatagtctttttcattttaaaaagataaataattctaattagtttttctctgttcacaaaatcctctatggatgcctaaaacactctatgagatacaaataaatacaatctatggtttccaaaaaagaattcattttaaaattatatattctaaatgagagaggaaaaagtaaatgtgtcagagtgttaacaattggtgaatcaaggtaaatggtatacaggtgttaattttagttttacttcaaatttctttgtatttgaaaattttcaagatcacagagtttttaaaaagatatatttgttgagttcttctagtatattcaacttacgctaagtgagaggtatgatgtaaggaaaataacaaaaactaaatgactatttaaatctggacttaacaatatataatttggtagagaaaagttatgttagaactcttaagcatatcatgttatttgataatagaaagggaaaagattaacataattttttatcaaagtcatttaattagtgctgtctttcccagaaattttatgtctatgtttgaagaagtagtattttgagaccaaatgcataaatgcattcagtggttaggaatatgacctgttacctggaattcagtctgcattatttgaacatggataaaagagagtcattaaaaggactttggaatcatcaactctatggcataaacaaccaagttgacacttaaaaaaattgactattaacacatgagtgaggatttctctgaaatatttttgtttttaattattatagttgagttatgtttaccacaccaaatataaagaccagcttgttaaatggttgaaaatataatttatttcgctactgtgggctggtctgaatctttaatgtataatgggaatgaagattagatttctttaaaatcatgagttttctattctttacatttttaatatttgattttatatcttaaagtattttagactttgataattgaaaatatttttatgggaaaataatatttatattagtacacttcgattttaatggatttatcctaatttggaacattgtttcaaaattatcgttttaaccaatgctataaaattaacaaacaagtattccttggagccactaggtggcagccctatgatgctagataataccatattcagagacaattctctgcacaagagaaaaaataatgtattctcaatgttacccagtttcccattttgcactcaggacagagaaaattgtgagcaattcccataacacaatatgaactgtatgacttgaatttcaaagacactatataggtgctaaaaactgtaagcaacgtaaatagaaacaaatgtgtttctgttggaaatgttaggttttcctcagaagggagagatattcctttcatatcttcatatcaatgcaaatttaaaaaaattcatagtaattgataataattatgtttagcaaaatactttcctaagaaaattagaaaagaaagacaacacattagtgaaaaataaataataatattaataaaaccttaggtaaaataatacctaatagtaattaagtaagcaaaaatactgggcattattaaaatttttaatacaatttgtaggaaatacatagtctctaattaaatttattataactatttggtatcagaaaagttgtgaatcaatacattgatcttttacagaatgcaaaaataacatctagataaatcatattttcatggattaaaataggaaaacattttataaaaagattaaaataccttttagggcttcagttataacagaagaactatctaaggatttagttttctatgtctatggagatgggcgagtttaacaacttctcacactcaacaatagtctttatatagagaagaaagaatagtagaaatagttctgcagtggaaatctggcaagccaagtctctagctcaaaatctgctgtttgaccaccacaaactgctcaaaatctcaaggtctcagttatctgcagaatcaaagagactgccatgtaattctcggaaactgccaagcttttatgttctctctgctctttggcctagaattccacacctctcttctcacttcaccttccttttgcctggttattgtccgctttttccatgacaccttgtctggccaaacttttttagtgtagtggttcctagtgccactgtagctctggtacctatttctatcctactgctcatccaactatatttttattgactccttgtgtgtttgaaatgatgcctcattaatgtctgaaatacaaaaaatgctcaataaatatctgttgaatcaaagaatggcttaatgagttcataattaaatatatcagaagttcctttcagggtttaaaaaaggttatgaaaggctgtgaagtgtcaacaatcagggccaggtgcagtgattctcgcctgtaatcccagcactttgtgcagcccaggccggaggatcgcttgagttcagatgttcaagatcagcctgggcaacataaagagacccccatctctacaaataataataataatgataaataataaagtagctgggcatgggggcctacacctgtggtcccagctactcaggaggctgaggtgggagaatctcttgagccaggcaggtagaggctgcagtgaactatgattgtgctactgcactccagccgagccagaccctgcctaaaaaaagataaaaaaaaaaaaaaaaacacacaggataagatcttaacttttaaaaactgtttcagagagaaaatatcaaacgaaagaaaaggctattgggaatttacgtggataacaaatttgaatttttgttccttgagggccttacgttattaattttaatagattaaaacaggaactctatttttttcaaaaattgatccccaagaatttcagcccaaaggacattatattgtgattaaaagagtgtgtcaacactaaattgcttatgtgaaagaaaataagacaatcatttgactctttgaaatagataaaaacacattctttatattaattctaaaatgtgtaactaaaatacttttctatataactccttttttttacaatgtgaactctagttgaagttttaattaaatccattgcattgccttaatattttatggaacgtatcaagagttttgttcatggactatatattatctgagtttttatttaccatgttggattttaattgtataacaagaaaaattcacagtagtgtttcatgaccttcttatcttgttaagttttactcaagcattgcttctgtttatgttataaatgtatgttatgcaaatctaaataatgtgaaacatatttgcctcatggaacagcatatggctaaagactgatttagctgcctcactttataactgaattttataattttgttagaacattattctattgtggatggactgttttgcagaatcactatgacatgcatagctacaaagagaaacaaaatgcacttgggaggatgaggatggatgaaaatgactcacatatttcaacatcccggttcacactcacattctgcttaggatgctgaaagaaaccaggaagaatgtgagattctgaatgtgtgattttattaggcatttagctgttgtttgggctttcggtttattttggtttgggaagatgattagcactagctctcaatgttaagaaggtggttttgaggcatgaaggaacaataaaaatatcttttgaatctgtttatttgtgtgtgccagcacccatggctgtactcttgagttttcttggtggcaaaccaatgatattgataccatgagggttaaaacagattctcaaaggagagaatataagtggggaattgaagagtggggcttttttcttagtcctttacctcttttcgttgtgacggaaccataagtaaagtattcaaatagctcctcagagactagcagtcatggccagaagctacaataagcatgtggataatgggcattctgccaagtgagagagagagcgagcagcagcattggataagaaattatagatattctttagggacaggaaagtggtaagggaataacctgaagtctatgtttctatatagttgaggtgaattcaaaacacgaggcaacacatttgcttattatgtttgtagaacttaccattataaagacaaatattctaacttcatttataattttttcatttatttttctaataaatgaccttactttgtgccagtttattccctgaatgcaaatatagttaattaaaaataaacaattatttatttaaaatgttttaatattattaacaacttgaaacaataacttaaattttctctgcatgcattctaactcccattcattcaattgacattgacttttaatttacaaaattcataataaggatatatattcacaaaggtattattattatggataaaagctcagtcaggaagaggatttcagtggctgtaaactttgtagttttatttgctgaaaaaagtaatagaaaaaaagtgtaggaaaaattcatggactataaaatgtcttattagtgattatttgttaaaataaaattcatggactataaaatatcttattagtgattatttgttaaaataaaatttagtgtgcatttactttgaaaagcatccctaaaaatactccaacaacaaagttaatcctttcaaagcaaagtttcaaaaggtacatgacaaatcagggtgtttttttccccaaactctagctacatgtgtcttatcataccttaggcatttcagtaatggtaggattaaattatacctggaattggtaatacaactatgggtcagaataaaatttaaaaataaaaatggctatagaattaaaaggagaaactatgggggactgtaacgttactgaagatattatcaacttaattagaatattgcaatagtatgtcaaatataactgataaaaagagtcagcaaaaatatttgcttcttggccaaaatgacacatgacataaagaacactgtttcctggatttttatttggccacttaccaaacttaataatttagtagcaagataattactaagtatatttggatgatttgaaaggcatggatacgcaatgcagcaattcattatactgaaaaatttattgtttcaacaagctgcttttaaaatcaagttgtaatgccttgtcttcctcagacagttacttaaaaccacttcaaatacagtaggagtaatcacactggaggaaaacttggccaaacatgcagaaatatggcacctgagatatgagctgatatgctaccaatataaattgtgttactacaaagacgcattggaagagcaagcctatttaatatatgatttcattttgattagtttctgaatatatatgacatagttcagttagaagcttgtttttactccttaaatcctttgtcgcatagaattattacaagctatcaagttttcatttctaagttagattataaatgaaataaaaatgtgctttataacttgtctttcatctatcaaataagctttaatatttattcaattttttattaacctcttcttcgtatgaacttaagtcaactgaatttaagttaactgaattaaaattgtatctaaaattaggaaattacatagaaaattctctaatttgcaagcaccatttttttttaggtcaagcagctttatgagtatgctaccagtttcagtgttttatcattaaatttgtcttcatgtgaacagacattaaacattgtgtgacatataattaaccatgaaactaagaagtagcaataatctaacgatagtcatctttttgctggaggcttgtcttaacccatcagcagagaacatgtgtggtcacaaaatacccattaatacattctttcacagtcagagtaagttctaccgagcttgccaaattccaactcaggtagcttcatttttccagcccacattcctgctgctttttcaattgggtgaattattttcacttcctctcttttaaagagtttctggctcacataggttatcaggtttccatccagtggctgctgcatttccacagtgagtgaatgatctctccaaggtactttgggatgaaagtgagtggataaatgtgaagaattatatttttatttcttctctttggagggattattctataacttttgtgtttagcttggagggctcctttgatttgatttctcttcgaaataagcgaaacagccacccagatggcaagcacttcagatttcagcatagtgtaatttgatttggaggttcaatgaaactcacttagaaatgtccctccagtaatatttcccctcttagaaatttaacttttaaattcttggcttcatgcagaaacaaactcctagggaggctgagtagtgagtggcaaggtggtcatagaaattattattaactctttaaatgaaatgttaaaaaataatttgccttctaatattctcaggatttcactatagaagcagcatatactgtgtaatttttaatttccaattccctttttatgattcttatgaataatattccaaaattaattttgcatttgtttaggaacctcagtaagaattacatttagtatttataggagacttagtctttgcaagatactatatggcacaagaaagataagaaagtctctttttttcaaacatattaaaatctttatgaagaaaaattcactaacaacttcagaaaaagatggtgtgagactatgagatacataaattttaatgtatattctgtcagttgcattggaatttcttgcatttatggacctggcatcccccaaaagtgttattcctaaggttttgattttaccaagtctaacctgacttaggcaacccttttctcatatttaaagtcttcctttttttaatactctgtttatacacacacacacacacacacacacacacacagggagagagagagagagagagaattggtagagaaactcaaaatatttcaaattaatattttctctttaatatttatttttctcaaatattgtacctctttattcaagcccctgaagaacttaattactatataattctcattttatagccttgtccaattatgaagctgaagtaaatcaaacttttcccattaattagagttaacatgaggtgtttgctctataaatacataggttttaaaaagctttacttttttacacctgagaaccagatgtagggaatagaatgcaagacccatcaaaataaactgacttgaatatgtttagggaacacagattctcaagaatatgcagtagcatctgtatcaactctaaatcaagtataatatggtttaatcatcaggagagagttttaagttttaatcgtttatttagaatgtgaagtctctacattttattctgtactcattttctgcaaagaagatgacctaatattagcatataactctaaacattataaatgtaataatgcaaccttgcacatctgcaccatacatgcatcagaatctctcaacgctgagggaagaaaatcacttccattagtacctatgtcagtgttggggattgctctttttaattgaaggcttaggagctcattcatcagtctttactgtcacagtgctgaaatagtttgccaagtttgcaatttttaaccccaaattgcaggaaaatattacttagttgtgtcttaagtgagattgtttggtactttgtctaattaaattaaatcgaattgaactccagatccaactttatcaactcatgtcattatttccgtatgtacatttagtgataggttgagcggatcaacttctatagtttacattctagattaacagaaatttagataaataaatttaagttctcaaaagagatgagtttctgctgaattctactaataacagagaaagataccataaagaatattaaaagttctctaaagtcacaaaataattgaaacatgaagaattaacacatatattaaaatagtttcatttctctggcaaaatttttataaagtcttcatataattgcattttataagcatcacatgacaccaaatacatgagatattaaacgacaatttgttttctcagagtgagacacacacactttatagcatctgcacttattttagagtcaaattgctcaggttaacatggcttgaaatttaatatcattgcttcgagcatcagaaaatagatatgacaaggcatagtatgtaaagaaatgctgaaagaatgtaactgaagttgaaatatatgttttaaaatccttatgactaccacctgatgtctgtggcaatgacaattaccaattaaagtggagatgaaggaggagctggggtcaaaaggacatctgccccttcctctctcagatctgggtgattccaggtgaaacagaggatccttgaaagaaaaccagaaaaatcattatgaatatgcctcctctaataatcatttaattccttaggtaaaacatatgaaacttcgattatttataaagcatgtattctaaatagagcaccagtagcatcaatttatttagagacaaactgggttttataaataagcacatgtgttttacagacccataagagttctctcactcctctgaaaaagtatgcaggtgatgaaagaaaatagcactttttaaatcattttatgagactgtattatttattctgagatgtgtcaatgaaatatttgaaaggaattgaaacttgctggaaaaaggttaatgaaaaggaggttcaatgttaaaaatgatagtgggcttttatcaagcatatcaagaatgctgttgttgatttttttataaattagatttttatttttgatataaggggtacatatgcaggtttgttatatggccttattgtgtgatgctgaagtttggggtataaattatcccattagccaggtagtgagcatagtgtccaacaggcattttgtcagcccctgcccccctacgtctcatccccctccagtggtctccagtctctattattgccatctttatgtctgcatgtacctaatatttagctctcacttataagtgagaacatgcagcattttgtttgctattcctgccttaattcacttaggataatgacctctacctacatcaattttgctgaaatggacatgatttcattcttttttatggctgtgtagtattccactgtgtataaataccacattttctttatccagtctagcattaatgagcacttaggttgaatttatgtctttgctattgtgaataattctgcaatgaacatatgagtgagttagtagaggagctcaaaatatttcaaacacacattgtctttttggtagaatgattcattttcctttggaaatttacccagtaattgggattgcagggtcaaatggtaattctgttttaagttatttgagaaatctctaaacttctttccacaatggctgaactaatgtatactccttctaagagtgtataagctttcccttttctccacagcctctctgacatctgttatttttgacttattataatagccttcctgactggtgtgagatgatacctcattgtggttttgattttcatttctatgatgattagtgatatggagcattttttaatgttttttggcttcctgtatgtcttctttttagaagtacctgtttatatccttcgtccactctttaatggggttatcatgattaaaactctcaacaaactaggcattgaaggaacatttgtcaaaataataagtcgtatatgacaaactcacaaacatcatactaaatggacacaagctggaagcattccccttaagaacaagaaaaagacaaggatgcttactctcaccactcctattccacatagcactggaagtcttagcaacagcaatcaggcatcaaaatagaaaaagaagtcaaacgatctctcttcactgattgattctatacctagaaaattctaaagactgctgaaagtctcctagaacagatagatgatttcaataaagtttcaagatacaaaatcaatgtctaaaaatcagcaaaatttctatacacatatagcattcaagctgagagccaaattaagaacacaatctaatttaaaatacccacacacaataaaaccagaatatctacaaatacatctaagcaaggaggtgaaaaatctctacaaggtgaaaggcctctataaggagatactgctgcagaaaatcatatagatgatacaaacaaatggaaacacattccattcagatggactggaagtatcaatatggttaaaatggccatactgcccaaagcaatctacagattcattgctatccctatcaaactatcaacatcatttttcacagaattagaagaaaactattctaaaattcataagaaaccaaaaaagagcctgaatagccaaagtaatgctaagcaaacaacaacaacaacaaaaacaaagaaaaactggaggcatcacattatgtaacttcaaactatagtacaagactacagtaagtataacagcttggtattggtacaagagcagacacatagaccaatggaatgaaatagaaaatccagaaataaagctgcatatctacagccatctgatctttgacaaagttgacaaaaataagcaatgaggaaaggactccctattcaataattggcactgggattgctggctagccatacgcagaagaatgaaatggggctcctacttttgccatatacaaaaattaactcaatatggattaaagatttaaatataagacctctaactataagaatcctagaagaaaacctaggatatactcttcttgatattagccttagcaaagagtttttgacttagtcctcaaaagcaattgcaacaaaaacaaaaactgacaagtgggacctaattaaagagcttctgcacagcaggaactatcaacagagtaaacagacaacttacagaatgtgagaaaatatttgccagctatcatccaacaaaggtttaatatccagagtgtataaggaacttaactcaaaaagtattactgatttttttaatagtttggaaaagaataacaaaatgtactctcaataatttggaatatttattttcaattttattcttcatcacatagtatttgtataaacattcaatgtttaataacatagaataatgcataagtactgtaaatatttatcaacaaatgccatattatgtacaatatttcaattttaatataaggcttcacacagataatgaaaattaatattttcatgaaaaactactttattggctcctatttcaagcatataaccatagaacttatcccttaatgtttccaggtttcaaaattctcattaaaggttgttttgtataattaatctccattaagtatactacaagtggtgtgggtaaaaaaagtagtttagaaaagtgacaataaaaatcaatattgaaaaacttgtataaaaaactaatttaaaatagaacatcatgatattgctcaatttggcaactatgtacaaccctgctcatctgtgaaccacaaacctataaacaatcttgaaagtccagagtaacctctgagagttgagggcacttctctcaaacttgatcttaactttgctagtcatctgatttacccacattatctgttctgtctttgtcttgctattcttatttagcacccttttctctttctctgtgatatcctaaaatcacatcctgatcctgccgttttgaaaacttttcagtaaatgctgagttcacccaaccactactaccatccagtcttatccttggatttaaaacatagcctagtgccgggcacggtggctcacgcctgtaatcccagcactttgggaggccgaggaaggcacatcacctgaggttgggagttcgagaccagcctgaccaaaatgaagaaatccagtctctactaaaaatacaaaattagccaggcattgtggcgcatgcctgtaatcccagctacttgggaggctgagacaggagaatcgcttgaacctgggaggtggaggttatggtgagctgagatcgtgccattgcactccagactgggcaacaagagtgaaactgtctcaaaaataaacaaattaaaaataatgataataaaacatagcctatagaacaaatgtggcctcctgacccaaaggtgtggctaaacttatattctaagccaaaaaagttttacctttatagctactatacaccaatttgaagaaagcatgaatggcagtagagagatgttttgtgtttacttcctgcagatggcagtttgcaatgacatgagaataagtttgtccaaatgagaaaaaattatagatctgcccagctaacactttcactgaagaagtttcaccaaaatttgcaaaacagacccacatcatttcatggaggaggaaatgaccaagtatatgaatataatacttgtttgcccctttagtcattgccactttatacaatatagatagtagatcagggatatacatattatatttgttttactatagtcaaacatcagcgtcatggaaagctgacagtgatactaggctgctttcaaaaatcaacgttttctgtagcttaattcagtttttgatgtctaatgactgatgaggttgttttatctaatgggtataattagacaccttatatagtaaaattgaaactgcaagagcaatacaagtacattgcgtatttattcaaataattttaatacattcgtttaaactgtcaaatgcgtgaagcaaatagaaaatgaaaactgaaagaattttaagatcaagagaaacccagagtttgtagaacctcaggcatagatgaataaaatgcagtcacaatttcatagaaaagttacaggttttcatgactagaaatcataatataggttcttgaggctatatttgactagtgaattttagcctgtgactgtggtattaagtatcttacataccagtgtgttcaactctcagaagaagttgattgagtcgacaagaaacaatatgcaccaagaaacctgccatgctaacattttgaaaacaatcaaatggcacccagaatcatcctgaaatttttagttatgtaggagacacaaatctgtgcaatacgtaaatctaccttagtctgtgaaaggatatattcttttataaaaatctcaagtttgacaatgagcatacttgagccttgaatattgaatgtgcatgcattctcagagatgtatgtatgtctaaggtcaaaactcagatgtaccttgactaaaccctcctttctcacttttctccagaagacttcaaatacctatctcacatttatttgattaatggctaaaactaagtcaacaagtaatcattttaaaataataaacaggttaaattaaactcttctggtttgctttctgcatcactatgaagaatttttttttttttttttgagacagagtctcgctctgtcgcccaggctggagtgcagtggcaccatctcggctcactgcaagctctgcctcccgggttcatgccattctcctgcctcagcctcccgagtagctgggactacagacgcccaccaccacgcccggctaattttttttttttttgtacttttagtagagacagagtttcaccatgttagccaggatggtcccgatctcctgacctcgtgatccccctgccttggcctcccaaagtgctgggattacaggcatgagccactgcacccagcctcgattttaaaaatagggtacagtgtatactgctcaggtgatgggtgcatcaaaatctcacagatcaccactaataacttactcatgtaaccaaataccacctgtactccaataacctgtggaaaaataaactaaaaatacaaaaaataaaatgtatgttttttgcagattataatttattagcccattaatttttttaataatgtaagctattggaacatcactgcagtagaaaagtaccattctctttatgtaaaaaggagaagaaaggtccacatctttggaggatacattcattttatcagtgcataacaatagatggttaataatgccccaggagtcaaataacacaaaaagggtagacaacgtcagattagattgtagtttgggatacttctcaagtttgaagaatattgtaatgtgtattttgaagactataatatttgtaacaaaataatgaagaggtgctttgaacacatgaaagcactataattcctctgtctaatcactttgcacaggtattcttcgaccctgtcctgaaacttgattgttagattaacatttaaattactacagtatgatgtcattacataccacagagagctccatttggaaaggtcattttaattagagataatatgaatactaaaactacatctccggcctactcacatctttccatcatgtcttctaaaatccttctttcttggtaattaaatccctaacaacaaactcaatttgcaagaagcttccaaaatctctttaccttaattgaataattgtttccacaacaggcataataacggagcctcaaagatgtcattgtcataatcctggaacctgtgaatatgttaccttacatggcaaaagggactttacacatgtgatcaagtgaaagaccttgaggaggggaaactaccctgacttatccaggtagatccaatataatcacatgggtctttaagagataagatgttttgataaaagcagaaagccaaccgggatgatgcagtgcgagaaaaactagatccagaaatgcttgctttgaagatggaggaatggggccctgacctacagagatgcctactcaggaggtgctgtcagcctctaccatgtgtgggagggtagctggatcccagtctccagtgacaatgtagctgatctacatgacaagtatagtggatctatcccttgaaggagggtggatgtgactgcttgcattttgggggtaactgtcattggtaatacggatcagtgctccatccaggtatagtggaggggtcttcaactgtatcagtacttttttaaagctctggaactttgacctctatgggttaccagttgttaatgagctattgcagaggtgtctgttttactttcttgaatgttaacattatactattcaatacttgaaaaaaaaaatgttttctgtatgccacaaactaagcctggaactagaaacacagcaataaacaaagccccaaactattgttctattttcttcataaaattaccccaaatatacttttctctcctatttttagtgttcctttcttcaatatttgacactgttacctgctttctggcacttacttattttgcttctttaccacttatcaccttgattttaacaccagcctcctgaacagtctctgagtcccagccatcaattctgtactctgctgcaaagagtcctttctgaattgtgaattttttctcatcctctggttaaaaatcattcattgactacccatagcctccagaataagttattaagtccctataattttatataagggattttatatgtacttaggtaattattcacatttttatctctaaaatgctgcttttatagcctgtgtgccagtcattctgaacttcttttgcctggatatcattctgaatatctctttctgggacctaaacaagtcggacctaaataaaatagtttctgcacagcaagagcaactatcaacagagtatggacaacctgcagaatgggagaaaatattcacaatctatgcatccaacaaaggtttaatatccagaatctataaggaacttaattcaaaagcaaaaaacaaccccattaaaaagtgggagaaagacatgaacaaattctttcatacatacaagtagccaacaaccatatgaaaaaaagctccacatcactaatcatcagagaaatgcaaatcaaaaccacaatgagataccatctcacaccagtcagaatggctattattaaaaagtcaataaataataggtgctggtgaggttgcagagaaaagggaacacatacactgccagtgggaatttgtttaaattagttcagccactgtagaaatcagtttagagatttctcaaaaaacttaaatcagaattatcattcaacccagcaatcccgttactaggtatatgcccaaaggaaaataaatcattctaccaataagacacatgcatttgtatgttcattgcagcattattcaccatagcaaagacatggaatcaacataggtgcccatcaacagtggattggataaagaaaatgtgatacatatacaccatggaataccacacagtcataaaaataaaataattccttagcagaaacattaatgcagctggaggccattatcctaagcaaattaatgtaagaacaggaaaccaaatgtcacatgttctcacttatagaacaatagacattgagaatcactagagggagtgagggaggcaagggttgaaaaactaacctttggggactattctcagtacctggcgatgggattaatcaagacccaaaaccccagtacatatacacatgtaacaaacctgcacatgtactcccgactctaaaacaaaagctgaaattattaaaaacatacaaaaacgttgttgcagataggtaggtttactctagagcatttgtaaaaattattatgctacgttgtacatgcttccttgggactgcctagatagtaaaatcatgcttctatttttttccatattttgattgccattggctttagtaaaactgattagattagtagaacaactaatctagttgttctagacacattcttaatttcttcagacacccaataaatacattattgtattaatctatacttttatgatttatgatggactcttgctaggattaatatattaaagtttctgtttaacataacatagtgtgacatgacacttattaaaaaagaaatcaaagattgaaatataaaaatgtttattttatccccaaagaccttgttagtgacagcatgtaatttgaaggtaacgtgaagatgcaacaaggaggtacaataatttgctaactaaggattcccttttcccatatgacttttctttcttccttccttcctttccttctttttttcttttttctttctttctttccttcctttctctttctttttcttcaatactgaatagaagcaaaacctgagcttttcatttttatcaaattactgactcgatggtagttttcaataatttcattgatcttttgttccatggttttagagctgaggctttctttcccttgtgaagctacacatgacaggaagatatattgatccaatttatcttaattcctcatgtctcagtacaatatttttgcaactttatgcaactgagatgtggaaattttttaaagcagaaaaaaggaagaaaatttaccatagactacatagtattgatattatgagggaaagcaggcagttttcaaacctttatttatttgctttgcatagatcaagctaacttcaatattagctatatattccagaaggaaacttctcacgttattttgagagttcattgtggtcttaaacgcagtgtttcatgtagtgcacaacccaataaaatactaaaaagccagtgataaaattctcttccataaagtagaattcagcaaccaaatcaaccagaaaacttgagccatgatgacattttcagtgaccccaaagcaatcgcctttatggttcaagcaatgtgtaatgttggtgtttaaccctattgagaatgttggtcacgacttacactggctttctattatctctgttttaacagctggaatttctgcctgagtagtgtgttttaaatttaaaaggcattcccagcattaacatgtgggctgcattttctgtttcaatgtgatatggagaaatttttcaatggcttctcttgtgcttgaaagtaaccactaatgtgggcagatacatgtgtctgtcagaaaaaagtgtctctaaaatataaatggtagatctctccaggggagttttcctctttgggccttgagggatgccctcagaacccagaatgtctgtggtaagctcttttcgacaggtgtgagtcattgcacagcaggtgccacatgtgatgccaactcaataaaatgagtttcccatttgtaaatcagcttcatgaactaatactcttttgcttgtcttcagtgccatagggatattctgaaatatgctagaagtcaactagaatattataagtactacaggacaaaacaaacaatcatttattttattagctatttctagtgattaggaaaaatagtaaaatacacaatgttcattacatatatttctgccaacaatggaaaataggtgaaagtgcagtattgttacacaatgtctcaaataaataaacataatatgcagtttaattctttaaataatagctacatgataatgtgtataacaaattaattctgaatgtgattcactctaccatatcttttttgtttctcctgccaagcaataaaaatatttattaaaggatatttgaaacctttcccaaagactaaataaacaagcagaaaaaatacaaaacaggagtaaaatagcaagtaaatattttgactgtaaggctaatagttttgcattttaattgcgttttaacatttttttctctaaaaaagtaatatatttgtatcatacattaaaatttaggaaatacttttgcatgtatttatcttgtttcatcctcacggtaaacctgtgaagtaaacagggtcaataatattttccacaaatattattttctttttagaggtgaggaatcagaggcagggtgaggcttggcaagtctcagtgtcttctaactaacaattccatattcatttgcagttttacccactttacttattgtagttggagaggagtatatgtgtttgcgttgttaggtgtggttgaatgtcatttataaggtacttaatgcataatcaaggcccaaaaatatatattaagatttttttcaaaaaaatcttattttatcaaattgcattttcaaacgtttgtaagtcctttaataccattggaatagctggcagatgttattagcattttttaataattcagcacataaatataatacatgtaagtaaactcaattgtcttattcctaaaacttttaataaatatttgcttgaagctatatttgaaggcaaaattctgttttcacttcccttgtgtatcctctaattattacgtcaggattccattctcttcctcaccctaagtgacctaactttatgccaatattacaactcccacactcaccctctcaaactctttaattccacattgacagctctgcctactggctaggtatgccacggtgtcctagagtatttgaagcaaatatccttcaaaccttatgtttttctgaagcctgcttttactggaaaaacatcatttgctgcctatgtcatcctcaccaacttttcaaatatgatcatgccagcctccttttcaaaaaccctgcagtgcttttgtttttgaaggaagtctaacctcaagaatgggcagctcaggcccttcactgtttgccctcaggctttgtccctcatagtttcccctcccctctccctcatccaatccacactcctgcacaagtgactttctttaaagttgcatgcatgataatactcatagctgtttgattattgggaaggggaattccattcggttttttgcttattcgtttgttttcctacaacattaactcctacttatccaaaagaaaatgctgtttaaaaatgactttgctggaaaaaaaaaatgacttcactgatattctctaagaaatctccaatcaaaatttctcccatggatgatgctgtatatctcttgtagcattatttacattgtattgtgattatgcactcatggataatttaacaaacacttaagaagcttatgttccaagcttactgtgtttcaggtattcaatcaatattgaatataggaagtatgatgcatgctagtcttttttaaaccccatgaaaattgagaaaatagactctaattgtcaatttaacatagaaaagccaaaatgggccgggtacggtggctcatgcttgtaatcccagcactttgggaagccgaggcgggtggatcacttgaggccaggagttcaggaccagcctagtcaacatggtgaaaacctgtctctacttaaaacacaaaaattagctgggcatagtggtgcacacctgtaatgccagctactcaggaggctgaggcatgagaatgacttgaacccaggagacagaggttacagtgagccaaaatcccgccactgcactccagcctgggtgacgttaaaaaaaaaagaaaagcccagatgaataccacggaatactatgcagccataaaaaataatgagttcatgtcatttgcagggacatgtatgaagctggaaaccattgcccttagcaacctaagacaggaacagaaaaccaaacaccacatgttctcactcgtaagtgggagttgaacaatgagaacacatggacacagggaggggaacatcacacaccggggcctgtcaggggctgggggagatgggagggagagcattaggacaaatacctaatggatgtggagcttaaaacatagatgacggactattaggtgaagcaaaccaccatggcacatgtatacctatgtagcaaacctgcacgttctgctcatgtatcccaggacttaaagtaaaataaaaatgaaagaaaaaattgatgtgaaatctttgaaaattaaaatgttatacgaaaccaaaagttactatggccaaggaagaaatttcaaagacaaatgggcaaagttcattacacaaaataactgagttgaacaaaatagaaaaggaagtggccacatagtcattgcatgaaaacattgattattaatggttgtctattggaactctgaaataaattttcactgcattgccaaaaaaaagaaaaaaaagaaaaaaaaaaaaagcccaagtgaacaggtttctgctattaatatataatatagtaggatatttttttcttcaatatattaactatattttaatagctaataacaacattttaatggttgaattatatttggtagataaataatttcaatggcagaaataaaataaagttttgagaaggaatgtctctctgtatctgaaatgtaaaaattaattaatgtagggttaaatttcttggaaagttaaatttttattagaaaaaaataaatataaattaaaaaatatatcttaatttgagttggaaacactaacgggtaagttaaaaaaataatataatatgattaagggttatcatatttgttctagaaaggtggcacaatctcagcttactacaacctccccctcccaggttcaagccattttcctgcctcagcctctcgtcactaggattacaggcacatgccaccatgcccggctagtttttgtacttgcagtagagacgagattttgccatgttggcctggctggtctcaaactcctgacctcaagtgatccacccacctcagcctcccaaaatgctggagttacaagcatgagtatgagtcattgtacccagcccaagcaagtggtattaatgggtaatttccaaatgacgtttttggcaattggtgttaataactatctataataaagaccatataggtggcaaatttgcgagaacatgttctagctcaataacatataagaaattaatgtggctgattgtattttccagcattggctataacaacaaggtcttttatccaatgtcctcttctgtgcaggtgccacctattcactccccaattaattggtgacttttttttttttttttggaatgctccctcttggaatccagctaccatgttaagaagctcaaagcacttggaggggccatgtgtaggttttctaattcaaagtctcagtgcagtgcagcctttgaatcatcacagcacaatttccagacatctaagtgaagatgtctccagacgattccagtctgcagccatttgaatattctcagctgaagccctaaaaattgtggatgagaaacaagccacctctaccaggctctgaataaatccctgacccacagaatccattactattaaaaaatagttttacacaattgcatttgagggtttttttttttgttgtgtggcaatagagcatggtttaaatagaagaaatattacttagaggtagttattactattaacataattactaataagtcaaatgaagcatttactatcaaaataagacaaataaaaagttataataacgtctgggagtgaaagaatgttaacagagatgttctcacactttgctaataaaagtgtgaaatggtataacctgtggaaaataatttagcaataactgtcaaaggtcttaagagaattatcacctaaatgaaacaatgcattgtcattttactggtaagagtcattgaaatgaaaacacatatatagagatatataggtagatacacaaaattgacataggtatcgaaagttaggcaatcatatatgctttttcagagcattaattagtgccatgattttgaagattaatttaggggtgcctattaatttcaaagagaacttgatcattttatcaagaaattctcctgattagaatctattctaaaccaagataaatgcataagtctttaccagccacatgtgtggaacagaaaaaaagatatccaacataaacattgatcaatacagaaaaaataatttatagtacagtcatatattgaatgcataaatcttattgtaatttttcaaatcacccaagaaaacaataatatatttcagcagggtttggtgctggggtccaggacagtagcttttgaaaacttttgctatgcatttgatatctttctgagtgtttggacttttgcaatttttgcattgtacatatattgaatttttaaacaaataattttaactacattaattttttcacttgaaagacaactctgtaaaggggctttgcactagtaccaaactcacacatttgttgcaaagattatatgatgtgatctgtgttaaaaatgtcttgttcaaagtaagtgatttaaaaaaatgattatcatttttggaaaagaaagaacgttaaaatgtaaatgtaatatatatatttggaggttgtttcaaactaatagttacaaagggaactgagtgtcttattgaggtttatatttcatagcatgttcccagtgaatcacctataaaagtcactcctggaccgactgtttacaacattgactcttgctcatatcccagatttactaaccgaaattcttatctttatttatgacaagctcctaactaaagtttctacagtcaagtcaaactacaacaaccttaacaatgcttcccaattagtttagaagcatcttttaaattaataattggagaagctttcacattctgaacactcacaaaaatatctattccataaaaatatatctctaaatacttgttgaaatattagtacattctgtgttctacaaaaaagctttcagatttttcaaaatctaaaattttgaagtatagatttacaaaatttctagaggtgttaaatgtgaatagttaattgtaaatgaggatacaagacaaagacgatacataccgagcaaataaggtgttgtatcattttatttgagggtgtagctcaaaagtttttatagctctatagcttatcaaagttagacataagaacagttaaacacctttcactgataaaatatacgatgatcccaatcaaacctcattattttgggaaagaataaaatttaatttaagaacatttcatagattttgtatttctatacttaataattttctttaaaataattatttatgaagaaattcattagaaactatatttttcatatattaggttggtgctaaataactgtagttttaccattacttttcatggcaaaacctgcaagttatgtttgcaccaacctactacatatatataaattttaaattctaacaacacatttgagaaactttccgtcaaatgaacacctaaataatctggaatcagcaattccagattgtttcatatattgctcttacttaataaaaacctgcaaattggctccctggaaaacaactttattaaactgatcaaaaatctttctcttacaaagaagacattataaaataatattgatagtattttgggttaaattcttttgctctggggactgccattttcaaatgcaacataaaatagaagatttaaatgcattaataagcagtatgcaatctcaaagcaaactttattaaattagaattcatccaatatgctttcaacttatcaatacattaacacagcaaaactgactagcgtcttagctgactttatttttaataataacaaacatgcttcttgctctaaaaaattaaactgtgttctatatactttcaagataaatgtgcacaataaaccaaatttacttttgttcttcctgatgccaattaccattttgtgccacactttggcagaattggctaatttgaggatagatttatttatcctcaactgtatttcttttttttttttttttttttttgagacggagtctcgctctgtcgcccaggctggagtgcagtggcgggatctcggctcactgcaagctccgcctcccgggttcacgccattctcctgcctcagcctcccaagtagctgggactacaggcgcccgccactacgcccggctaattttttgtatttttagtagagacggggtttcaccgttttagccgggatggtctcgatctcctgacctcgtgatccgcccgcctcggcctcccaaagtgctgggattacaggcgtgagccaccgcgcccggccaactgtatttcttatggatgtaattctaatagcattctcttacaaaaaatctttatctaaaaataagtgtccttttagtccatattgtgtccatttaacaaactaaatgttagaccttgaaaaagttctactctttttctcattgaggatgccacttttgttcatctgtgtgactcagttaatacatgattttgcacaataatatcctaattgacctgtaggcatttattatccaaaacatgtttgagttaacttgccataaactgttgcttacttaataaagaaattattgaatttttggcctggcacagtggctcacgcctgtaatcctggcactttgggaggccaaggcaggcagatcacctgaggtcaggagttcgagaccagcctggccaacatggtgaaatcctgtctttactaaaaaaatacaaaaactagctgggcatggtggcacaagcctgtaatcccagctgcccaggaggccgaggcaggagaattgctggaacccggcaggcagaggctgcagtgagacgagatcatgccactgcactccagcgtgggagacagagcgaacctccgtccaaaaaaaataaaataaataaagaaagaaagaaaagaaaaaagaaagacagaaactatttaatttttaatttattcttcaatatttatacaccaaacctcacctgtatattctaacaaaaatatcagatactctaagtgaatgtaacatcttcgtctatagttagttagcaatattatttatatcattggtctttcgtgatgtaaaattccatggttaatatacttaacttcatcttcatgtacattttaatttgtatcctaatattttttcaaaattattaaatgtttttctttccctctatatatgtaacatgtcattttctgtgtctatcataaagtcaatattcaactttaaagtagcaacaagttgagctcatgttggagcctttctttgtatagattacattgatgttaaattatttcatgatgtgtttatatcatatgatttaattgtttatgtggggaccataatatcaatactatatttggtaatgtgaaactttcagctgaaatattttttctcatgatacctgttactattcaaaagttaggcattatgttttatagtagttctctaacatatgtgtgtgtgtgtacacacacacgcatacatataaaacgtgtgttaaagatatacaacacaaataaatctaaaaggtcaggcataataagaaaataaaaatgttgtctgatctaataaactagtaagaagaaaatgtgggggaggaagaataagaagaggagaagaatagaaataagaatgagaataagaatcaagattttttataaagagagttaactcaagtggcagataagaaagatgaagtttctggtttgattttatagcctttcaacctcaatttcgttacttgttaaatatatatacatacatatatatacacacatatacatatatatatatttatgtttctgttactgctatcttctgtgactattatgagaatcagaggaaggaatgcaagtaaaagtcaacagagaaacttcaggaactagaaaatttaaatacatgatataagcaagtatacaaagaaaactgatgtcttaaaaatccaagggtttgcaagcagatattttatatcaaacccaatggtgcataatgctaattttactcagcattattttctttttgttgttattctacagttaattttaaaaccttgttcaatattggaagaagccaatatggtataagaatgtatatctatatgggtggttgtattagtccgtttttatgctgctgatgaagacatacctgagactgggcaatttacaaaataaagaggtttaattgcaacatggctgaggaagcctcacaatcatagcagaaggcaaggaggagcaagttatgtcttacatggatggcagcaagcaaagagagcttgtgcaggaaaactcacccttataataaccgtcagatctcgtgagacttactatcatgagaacagcatggaaaaggcctgctcccataattcaattacctcccactgggtcctggtggaattcaagatgagatttgggtcaggagacagccaaaccatatcagtagtatttcaaagcactatggataaatgatagattcttccataaatgttgtttggataactggattgtcatccaaaaaataataataataataaagtttgattatcacttcatgtcctacaaccttgtactaaaatttcagattgatcaacaatctaaacttaagatataggacaattaaagtaattaaaaaacattaaaagtttgtataaaacctttgtgggaaatgccatttataataaaataagacacaaaatccagaagacattaaaaaattgataaattttatgacttaaaattttaaagaaaaaaatcctacatgaataacataaactttttttcactcaaaaaacaaaggctttctttcttattttaaacataaaaatcagtgaaagttgaatttttaaaatgaacaaaggaaaagaacagtccagagagaaggaaactcaaatgactcttaaaatgtaaaaagatactatctcagccataaatatatgaaatggaaattaaaacaaactaagaagcagttatattcttagtcttctgactgtagtcccaaataacatttcccattaaaaggaacaagtgctccttggagaagtggctgacctcagaccttggtccataatgtaagatgggcttagaatcttttcattctagaaagcaaggaaactattaaaactattaggattatatcacaaagacttcgatatcaacttgaagagatacctactgggaaaagacaggacaacttgttcataataaggataataactgcaacagattgaaataagcctaaacaagcataagaatataaaaaattcaatgttggcaatatgtgctagaaatattctgtgaggccacatcagaaaatgtcatattataattaaatatcgagttctgagattaagaaaagaaattcagtattttaattctttgaaaaaatagcacaggcagtcttcgtatgaatgtaataatatctttggtattgatttttatttattcactctaaaatcacctgtgttttatttttttaagtcaaatttaatgtgatagaaaattcatcacatatggctagtcaatccctacctgggtcaccaaattaacctgactttaaatttataattcatgtagaaaatgatatagccttctataataaattacttaagtagcttacctggaatctctttacataaataaactacacactattcaaagcaggcccatacttaaaaagcagaataaaatgaagtttcgtagtaattgacatcatggtctagatatcataatttcaatcacttaataaaataccaagaactttaataaatgtaagtatgattggctattttttaacagttacacacatgccttcactattatagatattttaggacaaattttatagaaaacaatagtagtgataagcatttattcagtgtaaacagacaattaacttatgatatttactatgcactgcatgataaggcatagcatatccaatttgcatttgggttacaccataacggtctcttagaaaaaaaatatgctatatatattataatttaatatggctaaataattatatataataaaagtaggcatttatatattttaatatgtaagataaataggagaatgctagaaataaaatgagtaaacatttatgtatacacttttaaaaatttaactgaaggatggaggtaattatttagacgtttagacatggcaaggaaagaaccatcttgactccaagttaactttaagatatggattttctcttctgtgtctttcctgaccaccttctctgggtttgactgctctgctgttattctgaccacatagaatggagcaggaatcaaaattctttttttagaacaaagatgctttttataaaaccatgaatatctacttttcatgggaaggaagtcatagtctcgttttagtatgcagataggctttggaataattcttcagttctaaatcccttcttcccttttacttggatgcatttgaaaactcttcaatcctatgagtgttcctactgctgactgagtcatacttgatcacaaaggatcacagtcctgtgtggagaagaaagaaaggaattgctggtaaaagaaaacataaatccaccatctgcacagtaagaactggacagctgcgagggaaaggacgctttctctaacagccgatttgttattcagcccaggctgcagccatatagctctcttggagttaaaagtctcaacaaaggaaattttggaaaactaaggttaatgggcaaagtctttcatgatcatcagaggagtctaggctaagggctttttggttgtttctcagggagaggagaaaatgtacctatatcatagtgtactattcttatacagttaaagaagaattttattccaaaattattttcaaagctgataacaattaaataattatttctgattttatgatttcaacgccacagtctaacctgttctaatcagttacatacttgaaatgagaaaacttgctctatgagtcttgagtgtgagagcatattttgcacctttcttcttgcttctgattcctccttttatcaagacacaaaaattagcttatactacagaagcaaaagagacattataatatccttaacgtattttcttttcttgcatgatattatggtggcttatgcctctctatcaataacagaatagaatagaaatatgtaaaactcagacataggtaaccagcatgtggttctgcttcactggaaccacatgatcagtggtaaaagaatgtagaataaacacagtatctaacaccagcttttcaattcaatgtgcacttcaccactctgtgcacagcgtatgttaattctggtaggtcctgcaaacaatttctgcagagcactttacaagatacaaaatgttttttttctaaatattttcctttattgcttcatcacaaatatttaatagaagtatctaagttcatggtaatcctccaaagaacagcagagggtagaaactgtgttttctgggctcaacattgggaagtacaattagtataatgagtgcctcagtgtgaaaaatctctataatgaggtacatagtgttatgagaagaggagaacataggagcctatttcttgtcctggaggtggtagggtggtctggtttgggaaagggagtggtaatattctaggatgcttttcctaaggaagaaaagaacctaccaattggctaagagttcacattagggacattttctgtctgtggggtattgtgataagcatatttcttacttgtttattgtgttgttactacatcctcataggataattttatcctcattttataaataaactttcttagattcagagattttcagaaacttatgcaaatttgcaacctactaacaggcagatcttattccaaaatttttaaaccattcccctataatgggaagacattctagaaggagaacaaagcttctcattcaagacttagataaaaattagctgggcatagtggtacacatctgtaatcccagctactcaggaggctgaggcttgaacccaggaggtggaggttgcagtgagctgagattgtgccactgcactccagcctgagtgacagagcaagactccgtctcaaaaaaaaaaaaaaaaaagacagataaaagtctgtaggacagcagtgagtagcccagatggattgtaaccaaacacatataaggaaagtttaatgagcaagagggagagaagagactgagaagttatattagagccagactctgaaggacactagctatctgagatataccatttgaactcttcacttagtgtgcaatggtaaacctggttgttttgaagagacttactggatggcaagattaatttgacagcagagacatagtgagattaaaaagcatgtaaaaacagtaaggaagttagtgatagcagtcaaagataatgatagtcctggcaggaggaatagaaaaagaaatggattagaaaaacagtttatggatacagccaaaaggattctgctactgattcaacttggggaaaagttaggttacaaaaattaggtgttaagcatggatgaaaaggaaaaaagtagaagcatagtagaaatgaatgaaaggacgggtttttaagaaaacctgataacatttcatatggggaatgtgatttgccaatttgtatgtttttttaaataatggcagaaaataataaaaactcgatacagcatatcaaaatgtatgttagcactaagattcagatttgtgaaccaacatgcaatggcaatagttgatgccactgaagaatttagaaaataagtacaaaaaagaaagatatggtgatgctgctgctgcagctgggtctgccgttgatatgacaatgatagctatagtcatacaacatttactatttgccaagtagtattctaggtgctttatttacattaatttaatcatcacagcaaccctatatgtgaggtaagctccattttatggaggaggacactgagccaccatcagaaagagtaacctgccccatgttacacatccagcaagaaacagatttttaagcctacaggtatggatacacacacatatatacatgtgtgtatatatacaattaatatcaccactgtcatcagtttggattgcgtccttccagagaggaaaaggtctgcaagacaatgtaagctggtgagagtgttttttgttttatttttttccaaagaaaagactaagattggggtaatgttcaatcagtactttcaacttgtctctgttctttgaattctttacaaagaggaaggcaaaaacttgcataactataaatgaatgaagcaacatgattactttcaaattaaatctacatattatggagaaaaaatgtagaatgtacatacataaacctgtaattaatgattttttcataattcaaatatttggagataaccactattgaagatgtgttaaattcccctccagcctttacagaatctttcatatcttattccaaaaattcacattatatttgagttttacttagaagtcaaacaaataatattatgtcctatttccatttctttaattaataaatacttttcaatctcttttcaatatcctgtgctaccacattttggatgccgatcctttccttagccccaaggtttgctgatttttatttagacatcactggactgaagagatgtttaccagactcagttctgtttggaaacaaggcaggcaattttctgtttaactactcactgtccacttggctcctttacttttatactctcacatatttagccaatgtaaatttctattatctcaacagtgatttagccacttaaggaatgggaatcctatagaaagttcccaaagaaaaacaccatcagtgaagagtttacttgcttgttatttttctcttttcttttttctacgtttgctaaagctgctatactcggggtcaggtttttgtttgtgggttttgttttgttttgttttttatagcctttttccctacaactgtatgtttagaccatcctctacatcatgtagagttacgtgttttcactcagtccccttcctgatgttcctggccaggaaccctccaccctcctgagagtttaccagaacttctatgccccccatgaggaagcactgctctgtcaggtagaagtatttgaactttagcactttcctctaattctgcagcatagctaataaaacatccttggaatttccagtacattgtagcaactctccttcttagtagcttgtgtcgatgaagtagtccaagttgtgagggtgtagatatgagggactggggaaaccagaaggggaatacagagagaagagactgttggaactgagagccagaatttgagcagctctgtaatggtaaagccagaacaagtatgataagaatagaataaagctgacacagcaaagagacgtccagttactgcccatactaaccatcaaatcagaaagagacagggtagtggagtacctttgtacaggacctttctgacatggtgacggggtattggattgaagaagggacaaaaccaaaagtaggaccccaagggttggattagagctcctgaacaaaaatctgaacacttggaacatgaaagagcccattaggtatccacttctgacagaaaaagggtataaagtaaaagtgtcatcacaataacaaagcatcagttatatgaactggcttaggtcacagaagaattatagcaagacagactagatactgcctcccctgatgtattcaaccaaggctttgttaatttgagttaagcaaaggtttatttgcacagcctgatagatagcctatgattgattccaaatcagggttgaaataaaagcagttcactaaagacattatataagaaataaacatttaaattatgatttataaatgattagtatagaagaggaaacagtcaaagagtaattagtccagaaagctggaaagatcatcatatatatacttgcatatatgtgatcttgaattttcaatattgattttaaaaattcaaaaaaaatttaaagagtattcaaatatttgaacataccagttttaaatttaaaagtcaacataatactcaattctattcagaagcatcttttattgatttatattaatgcaacaactatttaagggtctagcaattaatagtttataaataactaggttaagttaaataacgttaagtaaaataatgacctgatatatatatatatatatatatatgtttattacatgttttcaatgaatgatttcaatgactgctgccagcattatgttgaagcatgaagatatagttagaaatgacagtctcttgagatactaattcaaaattaagttttgtcttaagtacaattaaaatccaaattaatcattgaagtaagtagcttcatctgatagaggttgagataagcttaatagaggagataatgtgtgatctcagtcttgatggatgagttaggatgttccaaacagagaataaggataagagttttccaagtaaaggaatcagcatagtgaatgcatggacaaattagagaatatagtctttgaaacatggcacaaaatctcgtgattgtctctttggtctcttttgttggagagtagagtcatgaaggaagcataggatctgtctcttcctcttgtcaagaggtcctccctcctttgtcaacctgaatgtgtagagttttatttgttaaaagaatggttatcttacattgtctctagggaattactttagggataaatgtccagtaagcatagaaaatgtgattatagatttctagataaagaccaattatgggaatatgattttggagccatccaacagagggtagatgtagctatgtaaagaaataagaataccaaggaaagcatgcaatgttggaaaacacggaccaagaaaagaattcctgcaatcatcaacatttaaaaggctaggaaggcagaatattcagcatttttttttttttttgagatggagtctcattttgtcacccatgccagagtgcagtggctcagtctcggctcactgcaaactccgcctccggggttcaagtgattctcctgcctcagcccccagagcagccgggactacaggcacacatcaccactcctggctaatttttgtatttttagtagagatgggattttgccacgttggccaggctggtctcaaactcctgacctcaggtgatgcgcccgttttggcctcccaaagtgctgggattacaggcgtgagccaccgtgaccagcctcagcatttcaaaactatggggaaaacatggtcctaaaaatgaaaggaagaaagcttctatttgaaaattactaacactgtcagatgcagcaaggaagcagtggaggaaaatgagttaaggaagacatttaccaactagaaggctgtaggtaacaataaccagtccgtttcaacaaagtgatagatgcaccttgagtggaagagtaaatggaagttgaggaagcaaagatagcaaatacagactattcgttcaagacattttagaaaatgctggagtcaataaatcagcttgtaggttaagtaagcttgaggcaaaatttttgtttgttttataatttttatttcagaatagagaactctaaaacatttttatattctggaaggtagaggtggatagaaaaaaaaggatatttggtggattaaagtaatgaagaaacaaagagatgtcatcaagagtataggtggggccgggcacggtggctcacgcctgtaatcccagcactctgggaggctgaggcgggtgtttggcctgaggtcaggagttcaagacaggcctggccaacatggtgaaaccccgtccctactaataatacaaaaattagctgggcgtcctggtgggtgcctgtaatcccagcaacttgggaggctgaggcaggagaatcgcttgaacccaggaggcagacgttgcagtgagccaagattgcgccattgcattccagcctgggcaacaagagtgagacttcatctcaaattaaaataaataaataaataaaaagagtataggtggaataaattatctgagaaagaagagtgagggcttcatctgagaaggggaaaggtagcaccaaatatttaaatttagaagtgaaagagagagggaagttatggacttttactttacggcctccatttgcctttttaaataggagatatttcaaatgctttgagttagaaaaaggtgaaggcagcattggagacttaacatgaacaaaagtagcatcttgtgtacacttactacattccagtccctaaggcagctgctttcccatttatgattcagaaaatccatgtaactttgacaagctactcattaaaatggagtcttaagtttataggtaaggaaactgaagctcaacgtggatattgactcagggttacacagttagtgtgtagcagactttggatttgaaatttcatgttagtcctaaagcctgtattctttccactacattaatctattcccatccaccctccagaatagtagcaacttggacaatgccaagagttaattaagggctaaaaaagattgaccacatgtatataggctcatctgaataacagtgaaggcatcttacaattgtctctaatgatattcagcagtttcaaacagcagtggagaaaacaaaagtttcaacagaaccaaggccaatgaattataaaggtgaatacacagatacacaaagaaccaagtagtttgtggtgacgttttgtgaataccactgcagtgaggtctcccctgtgtcagaaaaaagcaaaatctgggggcattgaaagactgaaaatgagatgtctgctgacagctgaggatgaagatcaaattgaaagagtggaaaagcagtggaaggtatagattcacacagcagatgctgcttagacacaattgttaccaacgttaaactctctacgtgacccttcatagttttacaaagtgcatcaatatagtatgtaatttgggaaagcaacacattataatgaaaataacttggcctttgaccatgaagctcaagttcttccagtactgtataatagcattaagaagtgacttcatttcttccttttttcatttgttaaatgagaataacatttaacactcccttgtgaagtgttatgagtatcaaaataaatgaacaaaaacaactggcacagggtatgtacttaatacacggtagctctatttattaatattcttattagaataatttcattcttacaataagattgtgagatagacaatgttacttcactatatactattttggatttagttgatgccctcttaactaactttgcaaatgagaaaaagaggattagagagaaaaacaaactgtcctgaggagattggactaggatgagagaacagcttgttaattttgttccaggattttattctataaataatgctgaatctatatactgatcaattaatcaatatagactacaaagtctgtcaagtggttcaaatatgagaatatgggtggacatataaaactctatgcaacattttggctgggactggtggctcacgcctgtaatcccagcaccttgggaggccgaggtgggtggatcacgaggtcaggagatggagaccatcctggccaatatggtgaaaccccgtctctactaaaaatacaaaagaaactagctgggcatggtggcgggcgcctgtagtcccagctactcaggaggccgaggcaggaaaatcgcttgaacccaggaggtggaggatgcagtgagccgagatcatgccactgcactccagcctgtgtgacagagtgagactctgtctcaaacaacaacaactacaaagtctatgcaacatttttcatcttagaagaaggaaggttatcgctggagaaaagtgaaagatgaacacggaagcttatttatttactccaactgcaaaatagaaaagatatttagcaagagagatagaaacattggaggcatatctctccagtgacattacagatacagttagaatggaaaatgctggagacgataggccagtaaacaaaggcacagtggccaaagtggtaagtgccgtgccaaatgatatttttccaacagtaggataacaaaaagatttatttctgtttgaggctcatatattgtttttttcaatttctaataggaaaataatgttaacacagtgagtcctctttttctactgaactcatccacttttctatctttctctgtccagctgtttaatccacacaaacactcaaaataaagtttctggacaaaatatctataacaatgtggaattttgaaagttaacacaataaatgagtaaaattagagttgacttatatttaaaataatttccatgtggaaagtaaaacctgacaaaattcatcttgccagtccggaaaaagcaagtcattttaatcaagccaatattttaattagcccaccaaatttaactctaggtacatctgttccatatcatgtccatgaattagcaatatagtgtgtgactgaatttataactaattcaacttgactacactaataaaattcaagttactgttaaggagtcgatgtattacttaatcacctaatattatccaaatatcttagtaaacatattcttaaaaacaaaaaaaattctggctgagtgtggtggctcatgtctataagcccagtgctttgggaggctgaagtgggaggatctcttgaggctaggagttcagggctacagtgagctatgattttgccactatattgaagtctgggcaacagagtgagaccctattctaaaacaaaaacaaaacaaaacaaaatccaagaaagtcctaccacgctagtatattttctccttagagtcattgtttcagcaaatgtgaaatatatctttagagttacataattttaatgtcttcaggtatactttttcaaaatttcttcagatcctttaaagaaaatttgaaaaccgaatctgataacatttccaaactaaagtagactaatgtagctgctacaaaacatccaccattactcagtagccacataaggaaaagaaatcatctggttgacacagtatcataaatgtgaaaagtgatgaactaggataacattaagtttttggtatgagagacaaaagttcatacatagaaagcctcagatttttctttgtaattgacttattatggacactgccccttatatcaagaattatgttacaattacgtctcaaagctcaaagatagaaaagttaataaaaatagctaccttatgttaagtacttaatttactactggccaaatacaaacatataacttacagtttaggtttgaatttttatacaattaaattttaagttttattttttaaattttatttatttatttatttatttatttatgagacaggttctggctctgtcgctcaggctggagtgcagtggcgtaatcttggctcactgcaacctccacctcctgggctcaagtgatcctgctacctcagcctcctgagtagctaggactacaggcatgcgccaccacgcctagctaacttttgtatttttggtagagacagggtttcaccatgttgtccaggctggtctcaaactcctgggctgaagtaatcctcctgccttggcctcccaaagtgctaggattacaggcatgagccacctcaactggcctaatttttattttggattttaaaaatattttatgcttaaaatattttatattcattttttatatttaatttcatatacatatataaatttaattttcactactgattttatgaagacaatattattaaaaaccttataacagatctaaactacagagacaaaataaaaacccaggtattcttgaatcaaaagcttatatcattaatctctactccctcacacactaatgagaactatacagcacatattttctttcggacttaacttgattgtcaataagttaaatatcataatcagaaaacgttggttttgttctctcttcctgtttctcttttctcaccccctaattacatacattatacacatataaatcaactactctctactgtttcctcccaattttattttggaccttgttttaaattttgttttaaacagcacagaagggggccataaaaagaattatctttcactgattattttctgtatgctgagtattgaattggatattttatacttgctccctcataaaatcccccaacaaacccatttggcaaatgtcaaacagctcttaaatggcaaactgaagacttcagctcaaaagtgactcaaagcctcaataagcatataaaaggcacacaattttcttgagcatcagaaagattggaaattaagaccacaatgtgatacaaccatgcagccattagaatcctaagaaaaagacagacaatgcttaatgtggggtaactagaaaacttatacaccacttgtgggcataaaataggtacaatgactcaaaaatggtttagcagtatttactaaagttgaacatatgtatcctctatggcacagcaattccactactaaaatatactaactaaaaacacacccataagttcaccaaaagatatggacaagaatgctcatagcagcacaattacagcacaattgctataaacaattagaatgatcagaaaaagtgggaaagtaaattgtgttatatccatgtaaataaattacagtaatgaaaacacatgaacgaaaactacacacaacatagatcaatctcagtataactgttgagcaaaataagctaaccacacaaaaaacacttgatgtatgattccattacataaaattctaaatgaggcaaaactaatctatgatgatagaaatcataatagtgtttattttgggggtagttattgaagggggacaacagattctggggcactggtgttctatttattgatctagatgctgcttaaattgatgtgttcaatttttgaaaaaaaatcataggttatctttttttgtctgtatacttttctttattcattttataagttaacaaaacaggtgtacttaacgaatgtctctgctgtttctgttatgcttaatttatgttttaaagaccagaaaagtaaaaacaaatacatattatcatgttaccactaaaccgttccaagagttggcagaatctatataattaaagaaaaaagttgtcaggagagggggcaataagctttggttgtgttccccaccctaatctcatcttgaattgtagctcccataatccccctggtcatgggaggaaccaggtagagataattgaatcatgggggtagtttcccccatcctgttagtgatagtaagttctcatgagatctgatgacatcataaggggctcttcaccctttgctcagcatgtctccttcctgccatcatgtgaagaaggacaggtttgcttccacttccaccatgattgtaagtttcctgaggcttcctcagccatatggaactgtgagtcaattaatcctctttcctttataaattacccagtttcaggcagttctttatagcagcatgggaacagactaatacagggggacttgcaaattccttttataaacactttaaccaacttaaccaaaaaagtgtttaaaaaaacaaaaattcaccaaatttaactaaatcttttacatattataatcaaggcctgaaattttttaatttagacttagaatcttggagttttacatcaaggcataaatgtaacaaacccattcatttatctacacattcattcattccatagttatttactactagattctaagcacttaagggttttgaggaggtgcatattccttctagtacttgagtagcaaatgcaaatgcctcttattgccaggtggagatggcaaactggcaaaaagcctgggtgcaagtgtgcattgtgtgcttgacagaaactgtggaatactgttaagcacatgtcccatgtggaaagtggggctccaactacttagcaccaactggttcttttcatgtgggtccattgaaaatcacaatttactatgtgaaaccaaccggtttttaaaagtatgctctttgcaagaaaacaaacaagaaacactgtctgtgacaaacaaagcacatctgtgagctgaattgggcgtattgctgccagtttctaacgtctgatcaaactaaagagacatgaatgcttgctgggtcacaattatgagaagctcatttgccctttaggtgccaaagcactcaaagcaccacactcgttctccttcttctggtttgctgtagcctcaggattaacagttgaaaaataaattgcttaattaaatacattatggtttattcttaccatgaaatactaggcgggcatttgaatgaatgagatagaattatatccatatgtgtatgtgtatgtatgtgtgtgtgtgtgtgtctgtgtgtgtgtgtatgaatgtccatgaaatattttgagtgagaatcaacaaaatcagaataaggactgcaaaatcagaattaggaatgccatggaagaggtgggcaaagatggctttggagcatttcacttttccttattttgacttcttccatgtatttatatttgttcaagtgggggaaaaaaaagccctcatagtggctccctgtgaattaagcctcctagttctttaattagttacagagttctggttcaacatatgcctctcccgctccctcattccctagaggccacctgcagggctgctcagcaacataagcatcacgctgtttctctcagggccttctctttgctcacaggcaaggtgagcagagtgaaggtgcaagagagtgaggtttcttactaactgcctcacacacaggaaggatgcaaaagagtgatccataagtgacatttgtcaagaagtctacctttctaatagctttcttataatcattttcagacaaaaactagcacaaggaatcctcttttccttcccatcagaaaatcatttaactagctttcactaataagattgacaggagaggaaggccagaaggaacaatccctctattctagaacatttttaaataaccttggatgttttaaaatcacaaaaataatagactgcaagcttctggagacagtgtcaggctcaccttttaatgccgtggggaacacagcactgccttttctattagctgcactgaaaagtatcttttgatttcagtaaagaaagcagaagaaacaatgtagaaaatggcatactccaatggataaaatgcataatttcttttaaagtattggtttccattgaattcttctaatgctaatttatatcatatatatatataatttgagatggagtcttactctgcaacccaggctagaatgcagtggcgcaatctcggctcactgtaacctctgcctcccaggttcaagcaattctcctgtctcagcctccagagtagctgggattacaggggcccaccaccacgcctggctaatttttttgtattcctagtagagacggggtttcaccacattggcgaggctggtcttgaactcctgacctcctgtgatctgcccaccttgacttcccaaagtgctgggattacaggcatgagctggatatttattgggtagctactatgttagtgtaaataattatctgtttcgcatttaactttcaatatcaactccaatgcgtaaaataatcccattctccctactgaaaaaaaaaaaaaaagtaccattgtcaggtaatctctatttttatggcccgtaatctccattacatttctagcaaaagacaaaacaaaagaaacaaacaaaaccatatacagtaattagtctgcagaatgaaaaactcatagactgagaccaaaacaaaacatattctgacttcataggggaatactcattaccttctaaccacttacttgaaatgaaaatattaaaaattaccataatttttaaatcagtaaaacatttctatatattattttcacataaatggatcaagaaattgcaggccagtcattcttcacatcatgtgaccaaaaagtttataaaagtatcttggtacaaattataatctggacatttttgttaactaaagtctagtttaatatataaaaattatctgaaagtataatgttataaaaatgtaaatattcatatatttattctattaaattggctattacccactctagatttttacaaattattttaaaatggttatctttaatatttttatttttacctactattaaagataattttgggccgggcgtgatggttcaagcctgtaatcccagcactttgggaggccgaggcgggtggatcacgaggtcaggagatggagaccatcctggctaacacggtgaaaacccgtctctactaaaaatacaaaaaattagcctggcgtggtggcgggctcttgtagtcccagctactcgggaggctgaggcaggagaattgcgtgaacccgggaggcggagcttgcagtgagccgagatggcgccactgcactccagcgtgggcgacagagcaagactccgactcaaaaaaaaaaaaaaaatatatatatatatatatatatataatgtgtgtatatatatttgataaacaagcaataataaataacagaaactttaaaataacagatttggaaatcttcagaatttcaggggtttagaattgggtgcaggaagagttgatattaaagaaagtggtttgtaaaattaagatatgcatatttatttgtgaaaggacaaagaatattaaatgcatggctataatgatctcagttgtgaaagagaaaaggcacatttcagtcacataatgggtgactttttgaacctcaaaaacttacaagttttgttgaatatcccaatgagtttactttgtactataagcagaaaaaaaagttaagaaacaaatatttataaaatacttttgaggaaaacatctgattttaaaattcatgtatttgtagcatgtatgctttatttggaataataatcatggcctaaaaatatattttcaatatttacttaaaatatggtgttcaagctctcagggatcgatgagataacgtgtaacacatatgactttaaaaggcaagaacattatgtctaaatagtaatctcctgctgtcacattacaaaatatttaactacagaatacaagcaactggaagacatcatttccagtctataacatttaactgtgggctaccttttaaaaacattatttgtgtaaagtatctacatattttcagagagatttgtactctcagaggtatatgtataacccttatgattttgaagccaatactatccaaatagctgtgctgctactttctgcactagaggaaacttttatcaaaaccatacactgaaaatcacagagtacattgttgattatctttgaggcaaaatatatttgcatgactaatttagcctgcatacttaaaacttaatataaatatgctctaaataaatatagactgagaaaatatactgtaccctgttaaaatatggcagcagtctatattcaaatgcttatgccctcaaggacaatcaaattttccgaggtttgagcagaaaaattctgcagatggcccacacattcatcccttaatctttgcaaggagaaatgcagttttcttttaagaggagcactacaaagttctaaaaaagaacagcttcatttctcatctttcattctgggcctatgccttgcctctcccagaaacattttctaaaaatacctgtattaatgcaacctttctttaacatgtaagatatggaaagaatactgtggtgggtagaatgcttatgatgttcaagaatcccactctcaaatatagctgtacgacacgatccccttcctctggtgtaggcacacctgcgaatacggtaagaaatcactccttatactactttatatggcaaacgtgatgggatagtcattgtcatgatgaagctgtgctgtatgattccctcttagtaaactgaacagaaagatttgcctgctggtctagaagaagtatgcagccatgttatgacagggccgcatggcaaggaactgcatgtgacccctaggagttgacagcagcccctggctgatagccatctagaaaatgaggaccttggtcttacaactgcaaggaagtgaattctgccaataacctcatgaacccggaatatgaccctgagctccagaaagattgcaacaccttgatttcagccttgggagacctttagcagaggagccaactaaacagtgcctggactctcacgtcccacagaaactgtgagataataagtgtgtgaagctgtgttttaatcagctacatttttggtaatttgtttgcaagaaagaaaatacaaatagtaacgtgctaatattcttgtgctaaagtcgtctcattcttaagagaaatgttggctgttaagtaatgaaaaccattttaattttgcaagagttcaaggtctttgccaattctctagaaatatgtgctttatacctaaaactctgtttcttattgtctgagcatctacattcaacacataatttccattttctttgagatgtgagtaaaatcagaggtagacataaacttgtagtagtttatatttgtatcacttgttactgtttaaaaagtgctctgagacttttgagagaatagcagcagggacactcattttattctccatgaaatccccccataaaaacagagggattaagtaggatgcaaaatcaaaacctcatcaacaacgcctgtagcaaaaaataaataatttaagttttctctacctgctattctaagaaaaatcttctttcagcattcttagactttttatgtttttctccatatttctttaacgactctattttatttatttatttatttatttatttattatttttgagttggagtctcattcttgttgcccaggccggagtgcaatagtgagattttggctcactgcaacctccacctcctggggtcaagcgattctcctgcctcagcctcctgagtagtcaggattacagatgccggccaccatgcctggctaatttttatatttttagtagagatagggtttcaccatgttggccaggctggtcttgaactcctgacctcaggtgatctgtcagccttggcctcccaaagtgctgggattacaggcaagcgccactgtgcctagccacgactctatttcttgattaaattaatgatattattacatttattatgtcactattcagtaatctcctttctaattacttatccccttactaaaactgtaccattgatactattaactatcattttaaaacttttctttttcaaatgtaattcggattttgcactaacctgatttgccttatatccaatttttctctgagtgctcatgacactccctagacattctaccaccacctaaataatggcacttttcaagttattttgggaaagtgagagtgagaaaagaaaagtgagagcagaatgacagagacagacagagagagagagagaagactctcagaggaaactattaactactcccccagggtttaataattcagtctattctgagaacaccctctcctagctccagattcattctttcaaataaccataagtgaaaatgaaaaaattaaaacagaaataaatactggacatctgttagattcttacaaaaacctaccctgcttccatagctctctcttgcttgtaagaactttgtatttcttcccaatcagcaagaaataaaattagaattgctttttaattccctttcatgtttgacatcagacaaaatgctaagttacagaaactctcctgctgagcagcttctcacttgagttcaacacttccttttctttcctattgcaacaacagtgttaaataccttcatgatctctcataacgatcatgtaatagcctccttaaatttctctgcttttcatctctccctgcttgaatcaatcttaaatattatgaatgtcttgtcaatcaaatactctgttcaaaactccatcgtctccgtgctgtctttacaataacacaaaatgccaatgtgtagtattaaaatcttccaccaacttatcccagttttatctcctgctgttctctaaccaacataaatttctgcaaaccgattccataaatccctgcctcttagctgcttaatcaaagtattctccttgcctaaatgatttgtaacttttaattccctcatgtaaaattgcatcaagcctttaaatggtgttttggggataaatctcatactgcttttattatcggatggtcaccagtttctcttgtgacatatatatatataattttttcaaaatatattatatctgatatttagataattatgtgggatattatttcaatcatataaacattcaactattggaatttgaaataatattcaatcatatttaaagattctaatatgactcaaatatttcaatcatatttaatatttaggtaattatgtgatataaagttattcaatatcatgtgtatgaagtggaagtacaccaagttccagttctgctaatgataatgcatcttacattggacaaatctttcaaagaaaatgatgataaactatatatatgtatatatatttatttatttttaaaaacttctagaaggcactggagatcaattaagaatagacaaagactaaagagatttttcacttgaggaaaccccttaattcatgtggaaatgaatggctagaactcaagcagaaaaatgagtggtgaaatctagaagctgtggtatgtacccttataaattatcttcaacatccctgtccaacatctgaaccgtatgtgcaagcaaatgaaaggtagtgcctggaaagttgaaaaaggtaactactgcccattgcaagtttacatgggctaatatacctttcaagtaaactatgctgtgtatggtacatccaacggggtgagcttagtagcacattggagatatcaggagaaatagtacatgaatttgaatataaatcaatagaatttttccaatctgaaaagcagaggaaaagaaggttgaataaaaatgaactgtgtgtcttagatcaatgcctagaagtctaataaatatatatatttttcttttttgttatatatatgattatatgttatatataataatatatatagttatatataacaaatataaatatatatgtatatatgtatatatatacacatatgtatatgtgtgtgtgtgtgtgtgtgtatatatatatatacacacactgaaggaaaggagtgggtaaatgaagaaatattatttgaagaaataatgaccaaaatttaccaaattagatggaaagaataacgttaagtatccaagaatctcagtatcctaagaaatacagatactgatccctcccactcctgcaaacataaagtcacactattgaaactgttgaaaaccaatgataaagacaaaatcttaaaagataaagcaattttaaaagggaaacatcaataggaataaagctttacattagaaagagattagaagacaaagcagtttgagatactgaaaggagaaaacaaaacaaaaccacaaagcaactattaacgcagaattctataaccaaggaaaattcctttgaaaataaaggtgaaacaaaagcattttcaaataaatgaaactgaatttgtttctagcagatttgcatcacaagaggtaaatattctgactgtgtatatacatacacacgtatatacataggtatactttgttgtacacatctatatattctgaccttacagtggcctgatttgccttccatatctctaaagttctacttttatatcctctgcattgtttctttaaaatgaatcaataaatacactatgatgtattttggatgttagttaatctacaactaggagtggttaacatttaaaatatgctaattgtcaggcctctgagcccaagccaagccatcgcatcccctgtgacttgcacgtattcgcccagatggcctgaagtaactgaagaatcacaaaagaagtgaatatgccctgccccaccttaactgatgacattccaccacaaaagaagtgtaaatggctggtccttgccttaagtgatgacattaccttgtgaaagtccttctcctggctcatcctggctcaaaaagcacccctactgagcaccttgcgacccccactcctgcccgccagagaacaaaccccttttgactggaattttcctttacctacccaaatcctataaaacggccccacccttatctcccttcgctgactctcttttcggactcagcccgcctgcacccaggtgaaataaacagccatgttgctcacacaaagcctgtttggtggtctcttcacacggacgtgcatgaaatttggtgccgtgattcagatcgggggacctcccttgggagatcaattccctgtcctcctgttctttgctccatgagaaagatccacctacgacctcaggtcctcagactgaccagcccaaggaacatctcaccaattttaaatcaggtaagcagcctcttcttactctcttctccaacctctctcactgtccctcaaccactttctcctttccactcttcaatctctcccttaatttcaattcctttcattttctgggagagacaaaggagacacattttatccgtggacccaaaactccggcacgggtcatggactgggaaggcagccttcccttggtgtttaatcattgcagggacgccgctctgattatttacccacgtttcaaaggtgtcagaccacgcagggatgcctgccttggtccttcacctttagcggcaagtcctgcctttctgggaaaggggcaagtaccccaaccccttctctccttgtctctaccccttctctgcttttctgggggaggggcaagcaccccaacctcatatctctgcgccccaatcccttatttctgcaccccaatcccttatttctgcgccccgacctcttgtatctctgtgccccggccccttatctccgtgccccggccccttatttctgcgccccatcccttatttccgcaccccgacctcttatctctgtgccccaaccccttttcccacttttctggaaggtaagaacccccaaacccattccctccatttctctactctctcttttctctaggcttgcttccttcactataggcaagcttccaccctccattcctccttctactcccttggcctgtgttctcaaaaacttaaaagctcttcaactcacacctgacctaaaacctaaatgccttattttcttctgccatgccgcttgaccccaatacaaactggacagtagttccaaatagccagaaaatggcactctgaatttttccatcctgccagatctaaataattcttgtcgtaaaataggcaaacggtctgaggtgcctgatgtccagacattcttttacacatcagtcccttcctagtctctgtgcccagtgcaactcgtcccaaatcttccttctttccctcccgcctgtaccctcagtaccaaccccaagcattgctgagtctttctaatcttccttttctacagaccaatctgacctctcccttcctccccaggctgctcctcgccaggctgagctaggtcccaattctacctcagcctctgctcctccaccctataatctttttgtcacctcccctcctcacacctggtccggcttacagtttcgttcagtgactatccctccccatcctgcccaacaatttactcttaaaaaggtggctggagctaaaggcatagtcaaggttaatgctctttttctttatcccaaatcagatagcgtttaggctctttttcatcaaatataaaaatccagcccagttcatggctcgtttggcagcaaccctgagacactttacagccctagaccctaaaaggtcaaaaggccgtcttattctcaaaatacattttattacccaatctgctcccgacattaaataaaactccaaaaattaaattccggccctcaaaccccacaacaggatttaattaacctcgccttcaaggtgtacaatagaaaaaagttacaattccttgcctccactgtgagacaaaccccagccacatctccaacacacaagaacttccaaacgcctgaaccgcagcagccaggcgttcctccagaacctcctcccccaggagcttgctacatgtgccggaaatctggccactgggccaaggaatgcccgcaggccgggattcctcctaagctgtgtcccatctgtgtgggaccccactgaaaatcggactgttcaactcacgtggcagccattcccagagcccctggaactctggcccaaggctctctgactccttcccagatcttctcggcttagcggctgaagaccgacactgcccgatcacctcggaagccccctagaccattatggacgccaagctttgggtaactctcacagtggaaggtaggcccgtccccttcttaatcaatatggaggctacccactccacattaccttcttttcaagggcctgtttcccttgcctccataactgttgtgggtattgacagctaggcttctaaacttcttaaaactccccaactctggtgccaacttagacaatactcttttaagcactcctttttagttacccccacctgcccagttcccttattaggctgagacactttaactaaattatctgcttccctgactattcctgggctacagccacacctcattgctgccttttcccccagttcaaagcctccttcacatcctccccttgtatctccccaccttaacccacaagtataagatacctctactccctccttggcgaccgaccatgcaccccttaccatctcattaaaacctaatcacctttaccccactcaacgccaatatcccatcccgcagcacgctttaaaaagattaaagcctgttatcactcgcctgctacagcatgtccttttaaagcctataaactctccttacaattcccccattttacctgtcctaaaaccagacaagccttacaagttagttcaggatctgcaccttatcaaccaaattgttttgcctgtccaccccgtggtgccaaacccatatactctcctatcctcaatacctgcctctacaacccactattctgttctagatctcaaacatgctttctttactattcctttgcacccttaatcccagcctctcttcactttcacttggactgaccctgacacccatcaagcttagcaaattacctaggctgtactgccgcaaagcttcacagacagcccccgttacttcaatcaagcccaaatttcttcctcatctgttacctatctcggcataattctcataaaaacacacgtgctctccctgcaatcgtgtccgactgatctctcaaacccaagcaccttctacaaaacaacaactcctttccttcctaggcatggttagcgcggtcagaattcttacacaagagccaggaccacaccctgtagcctttatgtccaaacaacttgaccttactgttttagcctagccatcatgtctgggtgcagcggctgccgctgctttaatacttttagaggccctcaaaatcacaaactatgctcaactcactctctacagttctcataacttccaaaatctattttcttcctcatacctgacgcatatactttctgctccccggctccttcagctgtactcactctttgttgagtctcccacaattaccgttgttgctggcccagacttcaatccggcctcccacattattcctgataccacacctgacccccatgactgtatctctctgatccacctgacattcaccccatttccccaaatttccttctttcctgttcctcaccctgatcatgcttgatttattgatggcggttccaccaggcctaatcaccacacaccagcaaaggcaggttatactatagtacaagccactagcccgcctcttagaacctctcatttcctttccatcgtggaaatctatcctcaaggaaataacttctcagtgttccatctgctattccactactcctcagggattattcaggccccctcccttccctacacatcaagctcgaggatttgccccacccaggactggcaaattagctttactaaacatgccctgagtcagataactaaaatacctcttagtctaggtagatactttcactggataggtagaggccttttctacagggtctgagaaggccacggcagtcatttcttccattctgtcagacataattcctcagttaagccttcccacctcaatacagtctgataacagatgagcctttattagtcaaatcagccaagcagtttttcaggctcttagtattcagtgaaacctttatatcccttacggtcctccgtcttcaagaaaagtagaatggactaaaggtcttttaaaaacacacctcaccaagttcagccaccaaaaaggactggacaatacttttaccactttcccttctcagaattcaggcctgtcctcggaatgctacagggtacagcccatttaagctcctgtatagacgctcctttttattaggccccagtctcattccagacaccagaccaacttagactgtgcccccaaaaacttgtcatccctactatcttgtcaagtcatactcctattcaccgttctcaactactcatacatgccctgctcttgtttacactgtttttccaagccatcacagctgatatctcctggtgctatccccaaactgccactcttaacccttgaagtaaataaataatctttgctggcaggactatgctgaatctccttaggcactctctaatcagatatcctgagtagtcccaattcttagaccttttatacctgtttttctccttctgttattccatttagtttttcaattcatccaaaaccgtatccaggccatcaccaatcattctatacgacaaatgtttcttctaacaaccccacaatatcaccccttaccacaagacctgcctccagcttaatctctcccactctaggttcccacgccgcccctaatcctgcttgaagcagccctgagaaacatcgcccattctctctccataccaccccccaaaaattttcgccgccccaacacttcaacactattttatttttcttattaatataagaaggcaggaatgtcaggcctctgagcccaagccaagccatcgcatcccgtgacttgcacgtatacacccagatggcctgaagtaactgaagaatcaaaagaagtgaatatgccctgccccaccttaactgatgacattccgccacaaaagaagtgtaaatggctggtctttgccttaagtgatgacattaccttgtgaaagtccttctcctggctcatcctggctcaaaaaacacctccattgagcaccttgcgacccccactcctgcccaccagagaacaaaccccctttgactgtaattttcttttacctacccaaatcctgtaaaacggccccacccttatctcccttcgctgactctcttttcagactcagcccgcctgcacccaggtgaaataaacagccatgttgctcacacaaagcctgtttggtggtctcttcacacggatgcacatgaaactaatgataaaatctccctatatagatagttaacagctgaagtagttaaagcacgggctctctccaggggcagctattaagcacttcaaatacttcgaattatatttgcacctgagggttaactaatataaggaatatcagaaataatattttagtggtgaaatggtgttctttgtatgtggtggcttaaaatattaatattttatggccactgctgcactttcataaatggaatataagaatcatgagtctagctgcttaacaacagaatatctagaactcgattttatctgtgccttgtcttaatgtaggactctgccttccaatgtagatgaaaaataacagattctacatgagtatattgtttcatatgcttcagggtaaaattgtgatatagagtgcttcaaaatatacttaaaagtaacgagagttgcgattcacccagcttacaggaataggttatatgactgatctttgagcctgcttgctagtaaatattatatgtgtggcaggattcagttgggatttgcttttattatgcagtatcacctagtggcaaagtcttagcggaagagatgtataactggcaccaagtaatatttatcttaactcagtttgaaatcttccctcctcctgcattccctacctcacctgaccatgagaaagtaattacagaatcaaaaagtctttgcatgtcccttgtaaaatattatattttatttatgtaaattatatatgtacacacacatacacacccacctatatacatattccagtttggtggttaaattaatgaaaatattaatataacacaatagagaacacagtttgatgttaagagatgttcttagtgggcaaattaagcaaataaaattattaagtgaattgagtgcatagcaaattaattggttcacagattttgtacttgacaagaattttaaaggcccagaaagataatttctctgtctcaagcaaactgattcagtacatcgcaaatgcttttatctttcttgggaagaaatgctgtagtctttctttgagaacaaggttgttttaagcattgtttttattgacagcaatgaatgaaacatcttacctccaaatgatatccaactctgatgaaggcacaaactggatcaaaagctccagtaccacaggtcagaaggtgtgtcctgttatagtgatgcaaaacccgaacataatttgcacattcaccctaaagcaggaaaaaaagggaaggaatctatcagtataataaacatgtttcgtcctttttgatttttgtttttcctagccctagaaagctcatgttttaccgtaaatctctgttgggtgaaggaggcaagaggggtagaagaaaagaggacaagaacttggagaagaaactggggtgattgaaacacattttggttagcagtgatgtgtaaattacattttataatgagactgcatcatttttcatgtattctagtttacaactgaggaataaaaaaagcactattcagaaatttcttcaagtgtaaaaattctcatgacaatatgttccactaagtaattaagttattcccaatgctgttagttttttaagtacagtataaacaatgaatcagcataaagtcattaaaaccaaaaatttgaaaaagcatagttattcatatggaaatatgcagtcttttttttttttttttttttttcccaagacagggtctcactctgttgcccaggctggaacacagtggtgtaatttcagctcactgcagcctcgcattcccaggctcaagtgatcctcccacctcagcctctggagtagctgcaactacaggcatgtgccaccatgcccagctaatctttttgtatcttttgcagaaatggggtttccccatgttgcccaggctagtctcaaactcctgggctcaagcgatctgcctgcctcagcctctcaaaatatgtagtctttagggcaaacagaattttaatgttttggaaagtaagtcttatattctcacactcacaaattcacataaagcaccttcagagagaattgttaagtaaatatggaaaactaaccaacaaaaataacattttgttgcaggactatgataagattactatattgctgtaagaaatagtagtagactggggatcagcaaactttttctgtaaaggacgagaatgtaaatgtatttagtttgatgagctatctggtctctgttgcaactattcacctttgcagctatagcatgaaaggagccataaacaatacaaaactaaatgtgtggggctgtgttcaaataaaactttatttacaaaaataggcaaaaagccaccttcggcctagaagctctagtttgtcaacactggtattcaactctaagcttcttgagggcagaatctattttacgcatctcggcatttcccagttaattgagcacagcacctaatacataacatgcttaacaaagttttaatatattcatcagtaaatgaattttatgatcagtatactgaatttaaaaaaatagtttacaatagctttcaaaatcaacttggctaaattaattttagcaagcattcttttgacaaattaggtgttgccattccattaaaaataaattatgaaataaatactaaactcttttagtgcccagtattacttgaaatcaatacatgcaatcatcagttactgtcacgttttataaggacctgttgtgatttcagcactttaaagtctatcctataacagtattaggaggaaaaggccagtggaatcacttggctagaatgaggagtgcactatcgaattgattatccagagcacacaggtacacttatttcttcaagtttgcattcacatgatattttattctttgggtgacccatatatttggtagaatcttttcattcaggcatggtgaaaatatgtgttgtttatttccataagcacctgcacttcctctcttgacacaccgtcacatctgagagggaacctattagaccacattttggctcagctgagctagattgacatggcctaagaatatgttcaattagtcagcatcatgctgtgggctaaggcaacaggaatgtgctgactcactccttggctgtgacccagctgctacagagaatgaggagttggtataatgtgtgttagtcatttatatagtttttttttttttaactgaaaaaaaggttaagttcactttcacaggcagatgtctaggacttcctccagggtgcatttgtgtcacaaaatcagctagccactgctcgcatgtgaaagttctatcactgatgtcttagtgtgttagggactgtgtctgggtgctgatacacagcattctgccactcacacccagcagggaaactacagaaagagagaataatgcttcttaaagtagaagagaccctaaaaatatttaggaataggtaaaatgtgtttattgcctctctcaaactttttgtttcttcattcatttctaatttactaaacaatgtaaagtgaaatctcacaaagaatgtgcttaactgttcctagaaaaaaaaaattacctgcaattatttttctgccaaatacatgagaaataagcattagtataaggaatgtataaacccaagttgattaagatattagaaaacaaaataaaaaccaagatctcaatggcatctctgcttcaactctacattgaaattaattttacataattatgttttatatgcctatatattttttcttcatgaaccaaattgcatacatacttttataagagcaaataaaaatttcagtgattcagttctttgtggttaactagggatataattgatgatttgtttaatttacaatgaatcatacttaccgcatcttttcccttcattatgcattcttccatttttagagctgtactcggccagtgtatctaaaataaaagataatgtactattatgacaactgcatataaaaataaaccacactgaaaaccatttcactttcttctacagttcaaaacatttccttttttttttttttctgttttctgataagatacagtgggtctttgtgttattcacagaattatttgcataattaagaaacgtatcgctgggcttttactttatgataaatccttttttttcttgaatatttttgaaagctcacttcaagtcttggcccttcagaggacagccatgccttaactagccctttcccatgttaaacctgagtggtgctccaactcaggcacctcctgcagtttcttgtgtttttactacttaacacagaacctgctgtgtggtgggctctcctaatgtttgctgcatacaatgattaaaggatgaatgactctttaaatgctgacttataatgtatcatccagtaatacaccatactgtctctttgattatttatttatttattatcttttatttttttgaggtggattctggctctgtcacccaggctggagtgcagcggtgtgatctcggctcattgcagcctccgcctcctgggttcaagcaattctcctgccccagcctcccgagtagctgggactatggcccacccagctaatttttttgtatttttagtagagacagggtttcacagtgttagccaggatggtctcgatctcctggcctcgtgatctgcctgcctcggcctcccaaagtgattattttttaaaaaacattgtttaactctaccagtttccaactgggtatccaaaagttttaattgtattttaagattgttggtttcttcctttatacattccttaaaacttatattttaagtttgttggtttattctctgataagaagaatatatcgaatttttctttttcacctctaatagtatctagcactttcctgagaccacaagcagaaatcagttatacttgttaactggttccacaaatttctaattgcaaaacttaatttatttttggaagaaattttttactttatcactttctttccttttcttttctcagactccttttggtcccctttttgcttaatctatagaattgattgtactatgtgccaggcattgtgttttgaactttattttattttttccttcttttgctttatcaacttacgtgcagaggtttgagtttgttatattactcaattcataattcattttcatcaacactcttaaaaggtccctcttttattttagttaattatttatttccttcttcccattccatgttttatttccatcccccaggaggcaactattgtatcctgttaccaggtgccttctttgtatgtattcttagaaagtgtatactattgctttttgtgcatatatttctaatttatgtaaatagtattgaagttaaatctcatctctttcttatctttttcactaagaactgggtttttgagttccctcaatagtcctatgcacacatatagtctgctgtttctgagtgttttgtaatgttaaggtgtggttcccccacattttcttttttttttttttttggatcttaaagtggaaaacatgtttattaacattcaaactcccctcatacaaggccatataaaaatccttagcattttgattatacattagtctacattttctacatagttacaatgatgtataatttagcttttcataatacagtgtttcaatacatcattagttctgttaaacataagtcacttactttcaaatccaatacttgaacagttttctctgtacatagtttagcagggctaattagcataagatgctatttgttaagaggtatatgatctgagtattaacagttgctgaagtttggtatttttatgcagcattttctttttgctttgataacaacactacagaacccttaaggacactgaaaattagtaagtaaagttcagaaacattagctgctcaatcaaatctctacataacactatagtaattaaaacattaaaaaaaaagtgttgaaatctgcactagtatagaccgctcctgtcaggataagactgctttggaacagaaagggaaaaaacagctttgagtttcttcgtgctgataggaggaaaggctgaattaccttgttgcctctccctaatgattggcaggtcgggtaaatgccagaacatattccaactcaacaactctaggtaactttatggaggtggaagctgggttagttcatgctaggtggctgtagcactgacctcatgtacaaaactcaaaacacttaaatactgtgatctaagtcttaattgcaagctatactgaggatttttttgtttgtttgttttggctatactttcattccaaaagaagagctgaattgatgtttgagttacagcaccagtctattattagtgaatgaagtatactcttgcagataaataccagatcaaaaatcccatttcagtaatttgattaaactgtagaatactaaaaaataaggtatttctacagaaatctttgaagggagcaaaaaatcaaattacagtatatacctaaatattttaaagtgaaataaaccaatcatcttctgaaagtcaaacagtatttgctatgttgtaatcccattcaccattaggctgcaactggaccacgacatcatgtttattaatttcattttctgcatcactactgtcagtatcttcattgtcgtcttcctattttcttatcaactctcccagcgatggatacccagattgcttccaagtctctatcacatcaaacaaattgttacctttttgtacatgccctttttggatctgtgtaagaaaatcgttggtatatatacacaacagaagaattactgctctccgaaatggctacatgtctataccagcaatccatgcccccataccctcacttagcatgatcaacttttccaattttggtgtcaggtgctttaaatacaatatctaatttaatccttaccacaactttatcaaagagatgctattattttgggagtttcttttaaaaattcatatttatctgtggaaacccacactgcaataaatatatgggtggaaacaaaggaatatgatccatttgagtaactaactgtagcaactggtcagttcccaaatgtttttgtggctcaagagcttaagtctcctacttaatattgtttatccccacatctgctgaatcaatcaccttccctcaccagaatgaaaaagctcagtccacctcctttcttaagttccctcggaatttcaagggagcaccatctgatgtatcaatttcatgggcttggctggtcaggtgatttatcttggagggatggtgtttctcaccgaaacactctacagtttttacttaattgcctccattgaagccagatgatatggttaggctatgtgtccccactcaaatctcatcttgaattgtaattcccataatccccatttttcaagggagaaaccaggtggaggtaattgaatcatggaggccgtttcccccatgctgttctcgtgatagtgagtgagttctcacaagatctgatagtttcataaggggctgttcccccttggcttggcactgctccttcctgctaccttgtgaaaaaggtgctttgtttccccttcagcttccaccatgattgcaagtttcctgaggcctccctggcaatgctgaactgtgagtcaattaaacctctttcctttaaaaattatccaatcttggtagttgtttatagcagtatgaaaacggactaataccacaagctacctaagaatttttctgattcccttttgtaggaagtcacttttcattgtcaagttaacattttgatgaaggagtgaaaataacacagccaagtagcatgggcctctcaagatatcattaacatttttacaaacagcttctttctcctcaggatgcttaagagtcctcagagaccttagttaagaaggattcaggtacagccttttccagtccagtgtcaatgtgtactgttgttagactgtattgctaggcctgtgacagtaagacagactcttctcctgtctacagcagtttgtttgttcccttaaagtctctattatcttctgcctccccttcctctatccatcaccatcccagcttatgctctgtcagcctggaaagatattctgattatcaaacaaaatattagatgttgctgattggcggtattttttatttagtggcaaattgtaattatttttaggctaggagccagcatttaaaaatttaaaaatcttgcataaaaatccatatttctgatttccctaaaaatatgatgaaatgcaacactaggcatgcattcctgtgcggaaatattcctctggagttgaaatggaacagatattctgatttgtttcagacttttcttttacacgaatgattcctataggtattttagtttctaaaatctcatatttgtttgaatcctaaatatgttcaagattcagcttttttaggacaggtgaggtggctcatgcctgtaatcccagcactttgggaggccgaggcgggtggaccacctgaggtcaggagtttgagaccagcctggcaaacatggtgaaatcttgtctctatgaaaaatacaaaactagccaggcgtggtggtgtgcacctgtagtcccagctgctccaagggtgaggcaggagaattgcttgaacctgggagatgaagcttgcagtgagccaggatcctgccactacactccagcctgggcaacagagtgagactctatctcaattaaaaaaaaaaaaaaaaaaaaagaaaaataagacgtatgctttttctttttcttaaagccatgccccataaaatatcagataaggcatgtaaatcccagaagtgaaagaggcttgtcacttaacttatacattatgtagccaaatccatttcctgatacatgagtaataatgggaatttatcaaagtgatgatagtagcattttatagtgataaatgctatctgatttaatttattatcatagaaacaagcactctatgttttgaattataggtataaaatattacttcgatgttgttattcattggtgcaatgagccccaagcagttttttactaacaatattcagcatcatgtgttctttaattttcatagtgcaatgtataaacttttaaaggaaaacacagttttggcatataaactttaagtgaaaacacagttttgtttttgatgttgcaacacaagaaaagataaacagagaaaaatggtgatataaaagaaaaccaaccctaaagcaaaaagcacacacataaaatcctagaaaagatgttgatgttagcaatgaatccatcagtgggtcatgcatgatttaggaaagatatcagtcaatatctggttacaatgcagctttgcatacacctgagaggagtcactgaccccactataggtcgaatcctagaagtgaagctgcagagtttataagctttacctgatctattattttggaaaatcattctcaaactgacagatagattttaagaaataatttgtaagacccattctaatttgacattcaatttgatttgggaattattattttactgtggatgtataaattattcaaatgtatatgctagagcatgtgcatgtatatatagactatacaaatatgtatacatatttattatatatatataataaaatacaaattcatttaggatcatctatcaggaaagattttcatgactaattcccttatcaatatgactagaatagataatccctcatccataattcagaataatgcattacggttattacataacttacgagatataggctgggcttctttttacaatattagcatcccttcttactcatttttcattattatgtaaaatgaaggcttctttaaactttagttttactgcatattattctgtattcccctaaatactggcttcaaaatgatcatttccagttaaacacactgtttaggggttaattctccatagcgtttttatacatcttttgacggcttttgttccagaatatcttttcaaatagcctgaaaagatagagacagaatctccctccagggcaaatggaagatttgtttcctgaccaggatagtaaagattcgatctccccctagacaaagtttagacagttttgctaacagcccccttataagattgggagtttcctaagcttggagtccctcaggtgtgacacgtatccactgagtgcggtgtctacctaggctgccacgcatcaccccctgcaggaccggaggggcaaggacactgatggaaacaagaagctcttgctgcctgctgtgtgccatgagtaatagtctttcgtctctgacccaagagtctaatgttttctgacagcatctatgtaactgtgacaggctaacctgtcttgagagcaagataaaatctcagacccttcacagtttttgtcacaaagataagatattatgtgatggtgaagacaataatggcttttctaggattgccagaacatgcattgttcctagcagcaaaactaataatggcaattgctgtaagaataacaaaactattctttcaggtgcatttcccaaagagtttcacaacaaaatctttgctgatattttttcaacggacagtatttctcactcctttgatccctcatagtgttcttattttctctatctaggatagcgatgatttgtgtacttaattttagctctcttattagactataaattacagagggcaaggcagtgacttatttctgtctcactaccagtgcctatctggcacagtgtcttaagcacagtctctgcttttcaacgtccattgattggcttgtatcagtcaatatgccttttatcacattcttagtgaagtcagtctgtcaaaggagattacagtaaagtttgagaaatcaggttcattgacatgaaaatgctgtaacatgttaaatgaataaaacaagtaaaattttccagtttaatcggaaggaaatactgtaggattttagcaataaccccggctctgaaagacttgtaggatttctgaggaaaggtagatggatgtttaacagatcactcttgagtagatggaagaaagacagaaaagtatgaacactctctacagtaaagttcaacacatggggaccctccaaaggaataacagaaatataggtttaccaaagtttttttcttgttattttggtttgtttggtattttaaaacagtttaataggctcaggactgcaaccaaacgttaactcaggtgacaatatatggcaaagaaagacctcactggaaatggaaagttatttttaaagccatcacgtaaaaatgttctgccaagctagtaagggaaatgatttccttcatttgttttggcagtcaggatgccttttggttctgctccagagtttagcatcaacaaaaccccataaaattaagctatttgttctgcacaaaacatttttaaaggcagttaaacaacagggtataatgtgatttccaaaatctctgtaccaaaaaagatacaaaagcaaaaggttaaatacacatcatttcatcacaatacccctacaatataatttaatcattccgctgcacattaacaagccatttactattcttgcatatttcaacggagaaaaataaaataaagtataaattaaattacaaggtaatttttttctggactccctactgagtcacataattataccaggattaaggatctaacagcttattgttacaagacgttatgacactcagagatttaggagagtgcaaacaaactaacgaatatgaaataattttttaattgtctaaaaattagattatctttttatttaaagagtaaataaaacaattcagttaatataagtctatcttcatagaatatattttaagtgactaagcctctataattttatcttatattctcttcctatttctattattctaatgaaaagtgtttgcctatatttggggttttctttctgtatttacatctatgtgtggcaccagtgtccatcaatgtacatcttaattatagatcctataaatattattaaaaacaagaaaatatattttgaatagaacacattaaaatagtcttaatggtttataaatgataatctttaacctgacacacattatctgtcattatgtttatgcctttatacttaattataataactgtcattactcaagcagtttatgtgccagaattataatattttgaactatagacaaaatttgtattttaaaaagcttattctcctaagcatttgaactagaaaaatatgataactacacacaaacatttgtagcctgatgcatggccttttgtatggataaaatttactcaattggtataattaatgtgaaatgccatctgacatttatgtacaaattgtacataaatgcctttcttctactcgataaaaaattaaattctaaaatacaagaactttttacacctttgatacaataaagttgaataaatgagaaaggcataaatatttttataaacagaattatctaacagaactataatatatatagatatacaaattaagtaatgtaattttggctttttttttttgagacggagtttcactcttattgctcaggctggagtgcaatggcacaatctcggctcactgcaacctccacctcccaggttcaagtgattctcctgcctcagcctcccaactagctgggattacaggcacctgccaccacgccctgctaatttttttgtatttttagtagagatagggtttctccatgttggcaaggctggtcttgaactcctgacctcaggtgatctgcccgccttggtcccccaaagtggtggaattacaggcgtgagccaccgtgccgggcccaattttagctttaaattatagtagtgagaataattttagaaaaacaagctgaaatttagaaagataaaaactatagatcaaagtttctgaaactgaaagtttattaccaaatatgaaatattctatgagttccccaaaatatggcttaaatataaacattttcattttttattttttcatgaaatgaaaaaaagaaaataaaattttatacattaaacaagtattcatatcttccagagaataattttgacttattttttaggaagtcttagtaattttcaaatgtgtacagattgcaaggggctattcatacagaacatagacaggataatctgttacctgtggttgaatactggcgtcttctggggctctcagcccttattataagtaaacaaagggtgtacagttacatctaataccagtcggtggttcttctctactactgtcactagcaactaattgttctactagttcataactattactagggtaaaatgcagccatgcaaagggaataagagccaaggagaaagaaacacctcataacaaaagcagaactagcaaaactaatggcacactgaagaccaatatgggagacaggaagttgatctcaaagcaataacctggttctcagtgatggcttctaatacagatgtacctggttttaaattctaactgctacttactggcctcatggctctattctcattttccatccatttattcatcatgctgctgccaaagtaatcactaaactacaattctaattatttatgcccatattgagaatccaccagtgactcctgcattgcctagaagattccgtttcaacagcattgcagtcagtattcttcacgaactagtctgtggtttccatccttaacccttactgcataccctcttcccacccacatgtcgccaacccatctatttacttcagccgaaaacatcagtcattattctatactgctctaaaatttctgtccttcctacccctgctttctctgttctcactctcaatcaaaattctattattcaaagcccaatttaaagtatatctcctccaggaaccactcctccgaaactttcttagcattttatttgaacctttattgtctattcaaattgtgccacctatggcacatgtatatctatctatcttgtctactgtattataaatattttagggtaggcactgttttattcatttttgcttacttcatatccccatatatgtttctagaacttagttaagtaacacctaaaaatatgtaatacttctatccctcactttctatggtagcacattagaatcatctagcttcagttataacaatgaagatagtaaatattaaggcggtgcttactatgttccaggcactgttctgggcacttaataactcacctaatcttctcacaaaagctaagagaaagatactatggatatctgttcttacagttaagagaactgagaaacagagctgtggactaatttgcctggaatctctcatttaataagaggtagtgttcagatgggagccctaacaatgtggctatagaatccgtgttctttgctgttacactctggtctctgctctcttcaaaaagtcctctaatataattgaattaaaataagttaaaatgaaaactaaaattaacatgttggcttcaattgttaaacacaataaggaaacacaaatacataagatctagtgcttctttttggtaaatataaataaatatgatgaatatgaataactaaaaaagtttttctcatagaaaagagaaaatggcagaaaaatgctttcaacactttcaggtgcaatgtggaaaatcttaccatgcataatattcagaggaattttatttttggttaatactaattttagctgactaaacaatattatcacaaccactattttaaaatgccattataggctgggcacagtggctcacgcctgtaatcctagcactttgagagacctaggcaggtagattacctgaggtcaggagttcgagaccagcctggccaacatggtgaaactgtctccaccaaaattacaaaacaaaattagctgggtgtggtggcacacacttgtaggggccaaggcaggagaatcaattgaaccctagaggcagagggtgcagtgagccgagttcgtgccactgtactccagcctgggtgacagagtgagactctgtctaaaataaataaataaataaaacgctattagtattaagatgttttaaagtcacagggaatgttttttctatactttttttttcttcaaagaattgtttgaattacagctaacagaatagttgtgtaaatagtgggttggctgtaacaaaatagcaagatattttgtagttattatttttgtttttggatttccctaaatatatttttgatatagctaaaatattcaattttctatgaattgcttttttagctatttaaaacttaacaattttactgaatctatttaagtcttcttagacttaagttcaattaaattttaccagcaactgaagtttaaataactatgcattatgtagaaataaaatttaattctgcttaatgaaagctcctaaccagaaaatctagtcataacataataaaatatcattatctcttctggtcgcatcttgaaattacaagttataaataaattgcagggaatgggtgtgggaagaaacatatacatttattttcaaattatctattaatagattagatgttcttcctcaatataaaactatatttaataattgaatagtaagtgaaagaaaacttaatgaggactcttttaataaaagaaaaatgaacggcaatttaaacatgaatagccatgaatgccaatggttagagccccatcccaatttagagactttgaagcttataaacacttttttttaagagacaaatgcagatgtgggttgaatctatggtcaatcaagcgaaaaatgtctacgaggatgttttgtttttccctttccaagtattctatccatacaagatcctgatattgtcacattatgatcagaaagtctcagatgctttaattttttacttagacaatagttttctttagttcagcccaaggtctttttgcactaaaggacactagagaaagcaaaataaataaataaataaataaaacaaaaacacgttttttttcaatttcttaaaacgttaaatcagaatttgattgaaatcaaaattctcatctaagaagtcttacattatctggggattttagagacttttacatagagtaaaatgcaaaaactattctctttgaggaggtgggagattctcacattagataacgcaaatggagttactaaattggaagttttagagtgaagagtatgctttagcatcagcactgagttttgcaatttatagtgagggtttagggtctttaatgaatgttatatacgtgcaacagagcagaagttcattgggaaagagtatgatcacatggtctgggaaatgcagtgagttaaataatttagaaagcaaagccattatctaaaaacactaatacaatacaataagtttattaaattacagattcttatctatttcaaagttgtatggaaaaattattcttataagtgtgcatattcatataagttctggttattatttagaaaataattatttagtaccacatataggactggtatttccaagaccagcaaggatagttaataccccagcatttcacaaccctcatgcacattacaatcacctgggagagtttcaaaaagtaccactatttagtcctcacatcagtttagaggtagagcctaaacacagatattatttacacaatccttaggtgtttactaatgtgcagccaaggttgcaattactgccacactgtgaaacaggattcttaccctgtttgccagaggagaagtgggtaggtggtggataggtggcttgggatgtaagggtaagaagaagggagacaaaattaacctaaacgaaattcaacaataactagtctgaaagtggctgtgataataagcacagtaagatttgcaagaggccaggcgcagtggcccacgtctgtaatcccggcactttgggaggccgaggcgggtggatcacgaggtcaggagattgagaccatcccagctaacagggtgaaatcccgtctctactaaaaatacaaaaaattagccgggtgtggtggcgggtgcctgtagtcccagctactcaggggctgaggcagaagaatggcgtgaacccaggaggcggagcttgtagtgagccgagattgcaccactgcactccagcctgcgcgacagagccacactccgtctcaaaaaaaaaaaaaaaaaaaaaaaatttgcaagaaagcagacagtgaagagaacagatttactggtggaagatgttaggattagcaacagacacactttcactctttcattacatcttcaaagatgaacataacacaatgcctactcttagggacccatcttataagtaaactgacagccgaacagccaatgttaatacaatatgggaataaaaatcagatcttggaataaggaaggacaaggagaaccttctccaaatctaggttaaaagagaaagaaaatagattttaaaaaattggatatgtttgaaggttattccagggaaggggagttgtaaggatacagaggtatgaaaaagagaaatggtctgactagcaatgtgttactggtggacaagtagagattaggctaagaaggtagaggagagtaagtcatgaagaactatatttgctcagctcaaaaaatttagaatgctttctaaagtgaaaattatggatcaggagttaactggggcctgaaaaaagaattcagggaatgtcccaactcagaaatcagaaaaaaaaaaaagtcattattgcattaatcattaacttctaactgaaatttagcatttctatcagataatatataaatgtagaaggcaaactatagtagtagtagtagtatctgcggtttcattaccaagagaaaatatatttcaatgttactttagagttgttgcaattatctcaaaacatcattaacactcattattaattggaaatgtgggttattatgagtgagacctgttgctaggttttatcacttaatatgttaataaataaggtatgtgtcatcatatcataaattaccattttaatatcataatagctgtattaaaaatatttatagtttgataactttaatattttactttgtaattctacatatttactttatgcatttaaggatccctaggttttgccagactgccaaatgaatccatgtctcacaaggaaattaagcacccctagacaaactacatttgtggttgatttttatagacagaaaaagaagaaataataatgtagaaaagacagaaaataacccttaagaaaggtcaacaagctgggacccagagcatgggcttaaggagtgacatttcataaaaggagggagtactgacaatataacaaggaaggaggtgggaaacatcatgtggaaacaatagatttggtgatgggagggtgaggatcaacatgttcaatggctcccattttctaaatgaagttaaaattgaaggttatttatcttccctgaagagatcatcaggactaatccatcatgacgtaccgctgttgaccatagtcaccatgggaagtattgacccgacccacttccaggtcaacagtgaatacttggactcatacatcacatggctctgtaccacccccaatctgaccccacctttccaagacctcaaacccatctgtgaaatcctttggaatgtcatggacaaaatccctgcaacttcaatctttctctccccattttcctttaccttcttgctctggttaaaatcaggctgtcccttgagaacactgtttctctatcagatatggtggtggcttttttactctaaacccacatgtgaggaaaatattttcactgaccactctcgccttctcactaattttttcctctctaaattcacctactcaataaagatttaaaataataaaaccctagctgctttaaacttcatatggtcacaatcataccacctgctaccttcctccttgtcatctaccatcatccattgctactttctcctcattaattgaatatgttttcacctagcttactatccttctcttcacatagatgattcatcaaccatcacaattgcaagtcaatgcctgtccatctgtttcaatgacctcgtccttcaaatcagcctgaggtacatgctctgatgttactttaccagttctgcagtgtaactagtcaaaactggtcattgagccttgaaaaatggatagtgggcatttaattttgctatcttcttaaatatcacctccctagaaaatattttcttgaccaccctactctcctcaccaacctctactgtcttacctccactaagttgttttattttctttataacatgtatcatatctggcattataatattattttatttttccagtgtatttcctaattctatactcaatgtgttctgaaataattctagggttattaaaattatgatcaaataaagctaagaataattaaaaataatattatagttgctaagatagagaggtattggtgcagagctaaataaatgaatcaagggaagagtgttgaggaatgtggggattgagcagaacaacagagtaagtgtgagagagtgtgtgagttcattgggaattcatgcagtgatggaagtggaactctgtataaccacattggaaagctatttggcattatcttgacattaacatattctatcactggcaactctactcctgaatatatgtgccctggatgcttttccacatgcatgtctcagaagaagtttactaaaatgatcatagcaacatcgataaaatgaaatactggaaaccacccaaatgtcctttgacatggaatggataaataaattgtgctatattcatatgatggaacatattacacagaatacagagtaaataatagcttatacatactgctatgtgccaagcactgctcttggtgctttacataaattaattcataattaatttttatcttcaaagaggaataatatttatccttttacaaataaagaaatagggacacaaagggatttaggaacttgcccaatattatacatgcatagccaggatttaaacaccaaaatcccagttgagtgctcccaattcactatggtacttctacagcaaataaggcatgggtacaggtacataattaaatataagaaatcatattaaataaaagaaaacaaaacaaaaggcaatcccggaagaatgcaacacaccatcgtatatgatttttacatagcccaaaagtagtgacactacataatatactgtgtaggaaaacagtatatacagaatatatactgtatgggaaaatatataataaaataatttttaaaaatgaaaacaagaaagggtagtaggtagtaattgctcctgggcagcagggtgcatgtggagggaaatagggagaagacgaaggtagctgcccctgcaatgggattggtgatattcagatgttgggagctgggttcagaagtatttattttattatatgttctaatgaatgtatgttatgtatatccttttctgtatgaaatgttatgttttaaaagatactaaagaaataaatagaaagtgagaaagtgaaaaaataaaaggctttggctacattttcaaggtgtttgatctgaaggaaagatgtatcaccgggtagatccatggttaatggtgtgtgtgtgtgtgtcttttctgttttttaagagagtgtctcactgtgctgcccaggctgatcttaaactcctgggctcaagcaatcctcctgcctcagccttcagagtagctgggactacaggcatgtatcatatgtttgtcttcatttagagggtctgaatcttgtttatagataggtaagctaaattaagtgtggagacttttcctgattatcatgactgtggagagggtgctactggcattttgtaggtacaagccaggaatgcagctaaacatcctgcaatgaacatggcactcccatccttaactatgcattatccaagatgtcagcagtaccaagtttgagaagctcagagatagagaaagcacaacgggagagatttaaaaaaaatgttatatcaggaaaaaattgagacagtaaagtccagacaagacaggaggagagctgggccccaaagcagacatattacatcttcagagcctggtgagcaccgaagaactgaccattttcttaagctcactcttttaagcagaatgtcataaagtagaccttactcctactccgctgctactaaaagcagcctcagagggcatattgagaatttattgcttatcattctgaagaaacgggaagaacaagtacaaaataagaaatgcaggtggggctgatgttacatcagagctaatgaagcataacaagcctcaggactccttcctggcacctgcccagactggtacctgcccagactggcacctgagaggagtctttgcaattttgaaatttttaaagtttgtgttaattatattagttaaaagtctcccactcccccaagttgtatacattttgggctcagcaaaataaggatttaccctggagtatggggtactcaaataggttttatagctactttccttgacatcctggctagatggcaccctgaagctcaatggccacatatcactctatttagttccctaagatgcagttcataaagcctcatcactctccgggtctcctacccttatatagttttcacaggtcatttcctcattgaaagcccagcttcctagttttaaagtgctgagggtataattaggccaaaacagtacatgagagtgagtaggtgattcaatttcccctgctctgaaggggaatcacattacaatgagaagctgctatctcttggtcttatggtccacataggaaacaacagctcaggaaaattgttattaaattttgtgtacatgagtcacctatttgttataaacgtggattccagggaaccactccataagagtcacataatattttggtccaaggatgataatttgagaactaattcttcaatgaaaaggttgttaattttctgaaatgacagatcttttataggttattctaatattcacatattaacaattttaatatggggatcaatctatgacagccttgtttatgatccctagattagatactccttcacagaaaatcagagtaagtagatggtatcagagagagagagagagaagaaaaagagagagaagaaaaagaaagagatagtggcaaagccagttaggattgaagctggaaagagatcaaccaagaagtgagagaaaaacccattgaatttgactggcaggaggtcgtgtgtgtgtgtgtgtgtgtgtgtgtgtgtgtgtattttatatatatggagagagaggaagagtgaaagagagcaattagtatacatatgtttgaagtcaaaagagaactacatagaaaataaagacattagaaagaaaggaaagatagggtgaaatgcaatatttgcttctactttaacctgtaatcatgaaaatgatagaaaaaggattaaaaagacataatccaaaaaggataagtaaaactggagtgtagatgccaaagaaatatcagcaacattttaaaaactctaaaacatatgggcaagtgttggcactttgcacgctaggaaaagcggaaatctaactgcttgcaaggtgacaggagccaatatgcaagctgattcataaaaaagactccagaaattcttggaaattagaagcctagagagtgagaagaggggtgggtgtggatgaaatcagaagtgtttcaaagtatgcataataagcagtaatgccagacaataaagggggaacaatctgacttagaggagtcccaggaagaaagtgaagaggagaatgaagagaagaaaagatacaacagaaataatgagcattctctagagctgaaggccatggggtccctggtagaaagttccactgtgtctcagtgcaaggggtataaaaagagagatgctaagagaaacaggagaaggttttaaaacacagagattaattaaagaagggattccaaacacatgggtgagagacaggttacaaccaaaactttgaaattagaaagaatcagacttctcagcagctctactagaagtttggaaacaatggagcggtatcctcaaaattctgaagcaagtggtttcaacctagaattttatatccatctatcagtaatgtgtgaagttggaataatacaattttcaaacatgcaagactcaacactggactctgtatccttcttccagaagctaggagaggatatgcttccgcaacatggcagactataggtggtgggcctgagaaactgaagttctatataagtcaggggctgagagaatgctccaggtgatggtgaagctaagctccagccagacaagtggagcatggaggataccttcaattaaaaaccaaaacattgtaaactgatgaaaactggtaaattgtactacattgagaggagtataaaaacttttgtagagaggctggcgaaaaattagtgaaactaatacaaaaatcttatcaaatggaaaaaatggggtaatgtttaatttcaagaggaacaagaaaattgtagaagtaaaggaaagaaggaaggaaacaagggcagaagaaagggagggaaaagtgtgataaaattccagcatgtggctcagtggtgaatactatcttcctaataggtaaagacactggtatttaaccaaaagttttggtataattattttgggaagatggagggcaagtgattggagggttgctgatgaagtatggtacacagaatattttaactgtggtattgcaaaagaaggatgctaaaattctcatcttccttaaagatgtatttcttaacagatattgcctaaaatgaaacatatcaataaacagtatgcaaatgttattttgaaatatgtagggaagaaccagaagaaacaacaagaagtttaaaattattacctctagggatagggaactggcagaaaccaaggaatgatgctttgtcataattaaaaaaaaaatgactttagaaaatatggacatggctcataaacataaaaatcaattataaagaaagtgtattacataatacatgcacttatgccaaaaatattgtgttctaaatatttatgtatgttttgtgtaagatttatatgagtctaagaaaatttggctcaattatttgtataattatagactataattacagattatttttctcttttccaaaagatgttggtagtttcttgttttaaatgtataagttactccacccaccaagttaaaggagcatccacctgaagtagtgatattaccaacagaactatatgaggtagttatatcgaggccacatatttaacatttcttcaagcttgcgctttggaataataaagcccagaggaactggtggtgattcatcatgctccaaacctaggtctcaggacattgggtgtggtgacaagggccaccatgcaagaggaatgtcaaatgcaccaggcaagagtgtctggaaatccaggtatcagtgttgtactagaaaagttcatacaacatgatttagaaatcatttcctcaaaatgatttcagttttaactaatattttatttaaaaagtaatcactcaaaattttaaagtggtcaatacaattaaaaaaaagacaagtaacattcttgaaatttccccccttttctatctctactgaaatgcagtttgatatttctatacctctttatagccgtcactgattctctccaagctgagggaatatacaaggtccctgcctcccacgaagagcctctcttgatattcatccagcagcattgtatggagatcaagaaatccaaaagggctatgaaatattgatgttctgttcagattcaagagctctgaaatgcaaagtgatacatacactaagcacacgagaaaatgtaaatacctttatcacccttttctcatagctctgttttcatccctattggaactgagtcattaacattcattttatcatacatatactggcaaagaattttaatgtgcacaagttaaaatatttcataaatttatgaatctaaaaacttcaacaatttaatatgtaagaaaaatattctatatttttaaacacagaaaaatagtcatccttcacaatctttaacataaagtgctaggtgaaagtcattttacagctcctctaatgtataatggttccaaatctacattaaacccaccagagtgtgtttattaaattccagataaatgccactcagaaaaataatgtttctacttgaaattggttttgatagtcacatccaaaatcaaattttcccagtctgcaaactctcagtgtcatcaatacaatgaggcattaatgtggtaacagttacagtagggatcactgataaaactggtgggaatatattttcaatcattgcaatttttgctaatactcttgcattcgtgcctatgccagaaatgttgagctatgttttacctatatacatgtaagaagtcagaatctggcaaacctctcatgtgtgtgcatttgtttgttgaacgtatttaattgcatatggcagtttagtacttaaggttggtaaaacgatatatgagagcctttggtgatgagagagaataaaaaccccaggcctagactctggatgctaaagaattcctgaagaggccctttggcaaatgctgacaagttagaagataactttttttacaaagatcaatgcctaatgcatctaacagagaatgtgaattcttagtgacgaggactctaaaatctaaacaaatgataatataaagtaggacaaatctacagcactgtgcccactcttacactttttgtttctgagaaagaagagctgaagtatatgcctctgtattaataatatattccttatctatgtctctaccctcaaactgttgatgcccaaaactttgtggagttaactttaaatctttagtttaaaatgaacaatactgctaaaagtatctgttcctctgtattaataatatattccttatctatatctctaccctcaaactgttgatgcccaaaactttgtggagttaaatttaaatcttttaaaatgaacaatactgctaaaatcaatgtatcccttataaaggtaaaactttctcttattgagttagctttgagatattgagtcttttgactattcacctaaataaataatctgagaataagttttgagggtggggaaaaaaggaataataggtataacacataagaggtttgccagattctgacattttaaaattaaatatgtataggtaaaacatatagcttgaaacttctgacataggcatgaatgaagagtattagcaaaaatttcaatggtagaaaatctattccctaatattccttcttttcccaccctcaaaacttacttgggaaggaaaagaaaatagtatgaaaaattagaggttcttgaatcctggaagacaatttttttccatttaataaaaagtagaatcatactgctttcctttgcatacagcaagagaagcacaggttgggatccactagcataacaaaaatatagctcaaaactgtctgctatcattataatttgtctttatacataagcatttacgtttatatcagggctgccaagtggatttttagaaaagttttctcagttattccaatagtttgcaacatttctcagttttaatgcacagtgaaataatctgaatgtgtacaactgatgaaaggatggttacgcactagcttgaataggttcctagactacagagctacccaaaacactccggtgtagagcttaggggactaagttgggaaataagagaaagtcatgaaaggattcaattatgagggattttagtaagaggcagcccatccagtaaaggaggtactccatgagtgaatccatctagggatgaccttgcctgctacccagtgaggtgattaatacctcattatccctgcacgcacatggcaagatagacaccaacttttacttgcttttatgacttaccaatttgcctactttctaagtatattacagttctaatagtctaaagatagtagttcttatttctttgtaaataatagtagaaactaattattgaatcatcaatcttattttattctggtgtatcaccttctcttgtaacctattcttcctctctatggccaaatctatcctatgaaatcacaaagatgtgcacgtttctgtgggtacatactttggagaaagcagagggaaagaacggaagtgtgcatacaacaaatgcaaatttagtgaatcttcatttttaatgatctttatgtttatttatatatatatgtacacacacacacacacatatacttttacaaaacagcaaacaaccactgtgtgacagtttaaattaccaatgtattttattttactggagaaacctgggtgctcaaaaatttaatgactatcttatggtcatacactattacaatgaaaatcactcaatttacctctaaaaacatgagaattaaagtataacaggtgcgtatattataaccaaaggtctttgtagactgagaatctggaaggccaggttttagtcttggctttgacaataattgcgtaggtaaacttgaacaacctcttaacctctttagactggattcttcacctgttaatcaccctttcacctttaaaattcttaattatttgactaaattgcatttttaaaatgaagctgataaaacagtgcaaaaaaagaagcaaatcgacacttagatgttttatggagtcctttaaagtacagtgctgagcttttatttttgtttttcatactgttggaagcttatcaaagggagggagtggtgaatagcaagtctaactatcacatgtcccatgtttaagcttgcctaaagtgaagtagctagaaaattcatttacaacttttgctctgactctaaatgattataatgtcagtgaaaaaaaatataataaggaatttcagagattacttttcctgattcattcatattgcctcagagaaaattattgccaaaatatgtctggatacataaaactgaatatcattacataccataggtaataaattgagaaatatcattttatttatgaagatacttcttagaaacatttctaaggtcattttttaaatttataaacctaataaacagactatagttttctttaaacatttcataatataaaaaaagaaaaatgcattgaatgcttcggctactctctaccctgaccaatgccattcaacaaaacagtgacaacaattgaattcctaagacattaagacttgtcagtaggtagacattattttaaaatcatagcactaactagagtttatgaatgccatggtttatatttttcatgtctactttcactggcataaatcctatcttgatccttaattttctctaaggcctggactgcttttcctaactggttacaattttgtaacatccttgactttattcaagaaaggttagaagtatccattataggtgaatatttgtgctttagacatatatctgcaataatggacatggagccattctaaaatagaaactatttttgaaaagatgtgaatgtttattatatatttactcttatttattcaatattaactcaatttttctactttatttgattaatttgcctctttccaaaaaggatctgagatgacttatacaaatatatccgatcaaataaacaaatatatttctagggagtaagggtaagagaaaaacagttaagatgagtgggttgtaataaatttaactggaagtcatccgctaatatctgttacattattaaaatgaatcccaaatttgacctcagccttcccaaaatccaaagtagaggaagtcattgtaacacaagaaaaaaaaaactgtatcaattgcttaggagcattatctagtattaagaactaagagaaatttcttctaaggttttaataggtataccgaaaaatactatggtggacattcaacatcactaagaattaaggtgtaaagttctacacctgtgcttataactacatcccttaataaaagacaactaaactaacatcaaaattcactccaccaaaagtcactttatggccttaggtagccatgttatttggaatattaatgactgcaatgaacagagattaaattaaagtaatgtaaaggtgaggacagaaatcctggcttcatggtaatcggaaaacaaacagaagccaaggtaatttatctcttagaagatgctgcatctttgcttcttgcttctcttaatgccaccgcttcactgtactgattctaaagggcttattatttagtttgttcatggccaaatatgtctgttagctcccaattatatataaatttccagctcccacatcaccacagtgtgacaatagctcctgcatttcccaattcaaattctcaagggaaataatgaaattgtgtcagctagtgttcataattcatagattgctggcttcatctagattgaatgtgttgtgaacaattatccatctgcggttaaaatgtggaagccacatggtaaaaagggtggtttctataattaatgtgtatggggtcagagcagtcaacatgaagcatgtttcaattccatagcaaacttagccagtctgtctttatccatgaacaaatttataataccataaatttgttacaatctgtatttctgctagactaaataagttggcctgctgtcgatagcttttcatgattatataatcatgtttagatgttcatgatgtttagatgttcattcatatatagatgtttatgattatataattatattgcatgttggagagtatctgccaaatatgaaaatttgagtcttcattaattgatcttaagtcatttttcccgataataactggattgtgaaagtgactcacatgactggataataaatttcatatctgcatagagaagaatgcttctatttccaatctattttataatgagattttcatctatctcatccataagaaattcatagaaattgcagtatgctttatttgtaaaaagagcattataaacataaaacaattaatgagatcaaagcagtaaactttgataaatcatggaattctgaagtttaagaaagaagcagaaacataattattaggggaaacatggggaaaaacatacatatagcacgtatggaaacaaattgtttttaatatgttcttttaatatgttgaaaaaaactattttaaagaagtaaaaatatcaacactgttctgtgaataggacatcaaagacgcaaaaagtgaatttgcataaaaagaattcaacttcattaaatgttcaaaggaatgaggataaaatatcattttaagaggtatttttaaaaattacaataactagtgaaaataagaattcaggctcttctagagacctatgtaaaatttctatattacacaaattttctccagtgaacatgtgttactttatcaaaaatgaaattatataagtaaaaggggaagatgtacgagacgtctcattttttatgcaaccaaatttcctcctatatccaggtactggtcctccccaccctaactctcaaggtgataataacagttaataaatatttattgagcagttacatggcatgtactatctaagggctagacaattttatgtcatgtaatcattgtgacatctcctcagaaatactattatccccattttctgtatgcaaaaagagaatttattagagattcagtacagagctaaggttatttggtcagtgttggtgacaaaatttgaacgacagaagttgactggagagctttgttacaatgcactgagatttctaaatattattttaaaaataccctagtaattaaaagtctagtctattaagggattataatgtgtcagaaatgaatgcattttttgcagagcctgatataaataataagatagaaggttttcaaaatatttaataggttgtattgagataattcaaaattatttaatggcaacaagataaatagaaaaattcaggttaatatcaattcaactttaatcacctttattgtgtattttataaactatccgaaataattacaaattttttttgctttgacttattgattcatgacatttttagttttacatatctcatatttgagaaaactgaaatatttctatctaatttgctatggagtttcaaaatgtattgaatattttttgcatatactgaaggcaatataaaggcaagcaaggctttcttccctccttaagaatttttcctttcttagttttagagtcactcctttaagtcatattaattatctgaactccaaatcatggtccctggacttggcatatttaccaagtaatggctgactcctttaaatcccttcatgctgcttcaagctgcctggatgaaagaaacagaaaatatacaggaagatggggacagaagaaactctaatctcaggtaatctcaagaaaacacagtgaaataatggacagtgctgactccgttaaatgaagcaagctcatcttgagttcctcctactctaaaaataacatgaattgcttggggatggaatggacaaagaaataagatgaaactgaaatgcaccaactcagagttcatccggaaattttctaaagagggaactaattattattgctaagctgcatgctagttatcagctgtcaatgaagatatactctgaggatttagtcatttcctctcgtggcctttccttttaacctgcaagagacacagttttaaaactcactgacatcactatattacaaagacagttctctacactttgtcaaaatatatttaaatgctatagttccttgtgtacgatgaaggagaggagaacacacatttttcagctctcaaacaaaaatagatttcaggggagaggtgtttctttcttgaatgcacatttcttgttccaccgtcacctgccaagtaaagacttcctaagactcaagactttaactaaacttgtcatggttttctgagttaattacgttattcaatattgtcctaaggttaattcaacaaaaaaaattgaatttcagtcagtaagcattgttaatgaaaatgaaatatggaaatagccattagaaattttctttaactttgtaatggttcaaaaggaaaaggtttctcacaacatgctttgatgattttgacagatttgactgatgatcactagtggcttatgatgttgaaacagattcgtaaagaaataagcaattaactttttaaaaactataaacacagactagctcattgatttgctaattgctctttttagcaatggacaatcagcttgtctttcatgcagtctttgaacttttaggttctattattttcacaagtcaaaggtgtacaataggcattgttgtactaaaagttgctcagtcataaaccactttccaaagaaagcaggagttcagatatacataggaatagcctagacattaattctccagttaaaagaaaataatataatttataattttcagattccttgtgttcttatcatatgtaaattattatttaatgttatatggaaaagtaaatatgtaagtgaagatgtatttaatgattaagatgaagacattcatgataaactacttctacttaataaatagtaaatatattttctcttatggttttcttaacattttcttttctttagcttatttgattgtaacaatacagtatataatacatataaaaatatgtgttactcaactgtttatgttatcagtaaggtttctggtcaacagtaggctattagtaatgttttcggggattcaaaggttatatatactccagctttagactgcactggggtttagcatccctaactcccaagttgttcaagcatcagctgtatattgaacatccactgtgttaggaattatatctggagtttcagaggaatactaaagatcaatataattctataaatataacacaaatccgattttagtatccattttatttatgaaatttagagataatttttttcaaacttgtgtacttaataaaatcaggcacattcacttttttttttttgaaacagagtcactctgttgcccccgctggagtgcagtggtgcgatctcggctcactgcagcctccacctcctgggttcaagcgattctcttgcctcaggcccctgagtagctgggattacaggtatgtgccactatgccctgcaaatttttgtattttttagtagagacggggtctcaccatgttggccaggctggtctcaaactcctgacctcaaattatctgcccaccttggcctcccaaagtcgtgggattacaggtgtgagccactgtgcccagccttttataagagaataaattttatggttcaaaagccaaaagatataaaggtttagagtgataaagataaacttccttccatctggactttccctctatttagttcttacttctttgccctcaatggattaatcctgtctaaaatcttgggcattccttcaagttttttatgcatatgcaacaaattagatgtataaatctttattaattctcaacttttttacagtcaaaaggaatcataatataaacctttttctttacctttcttttcttcactcaaaatatcttagaagtatttctgtatcaaaacttagagaggttatagttgcaaataacattttgttgtatggatcacctgcggtgggcatttgaaatcttttaaatttttactactaatacagcactgcaatgtatatatatgaatatatgtccattcacagatgtgcaaatatattggtaagataaattttaaagtggaattaccgggtcaaaagcatttgtaattttaacaaatactgccaactttgcttccatagggattatatcactttaaaattccctgactatatgcaagagtgcctgtatccccataacctcataaaccatatgtaattaaagtttagggtgttttgctaatttgatggagaaaatatagtttgaatttctcttattataaggtgaggttaagcatctttcatatatcttagggtacttttgtgattgttcttactacattcattgtctatttttctgttggattaaagttgcttgcccatatttgaatttaaggaatttttaaactgttaagttttaagttttgaaggtcatggctgagagatgaaggaaactgggcctttaaatgtagaaattcgtgtatcacttatgttggaaagatattttaaaggtgttttattttaaaaaatagagttaattccctttttatctcatgcagcctcctctttcataaacttaattcttgattatctggagtaattaaccaatttaacaattaacagcttatataaaatgcttataattttaaatacacatatgcacatatacgcgcatgcacacacacacaatgttactcatcagaagtgggcaaggggcattctcagtcttccagaggctgaatttggacatcaacaaagtcctatgcactcctattcaactggcgaattatgtggggataagaaatgtgtggctttacccaaaatagagcacttatttgtgagaattccagaattttgactaatgaatattttataataagatgttatagatattcagtcaaagcagaagttaaggaagccaagaatatatatgaactactgtggtatttttctgcaacattagccacttaaaacttacttaaaagaggccgggcgtggcggctcgcacctgtaatcccaatactttgggaggccaaggcgggtggatcacaaggtcaggagttcaagaccagtctggccaatacagtgaaaccccatctctactaaaaatacaaaaattagccagggatcgtggcaggcacctgcagtcccagctactagggaggctgaggcaggagaattgcttgaacccgagaggtggaggttgcagtgagctgagatcaggccactacactgcagcctgggcgacagagcgagactccgtctcaaaaaaacaaaaaacaaaacaacaaaaaaacttacttaaaggaggggagagaatgaaaacagatttctaggaatcctaccaaatgctttcagtagtacaatagcccatattttataggtatgatcatcatctatacatctatctaactttcttcctttttttttttttttttttgagataaagtttagctcttgttgcccagactggagtgcaatggcatgatctcggctcactgcaacctccgcctcccaggttcaagcgattctcctgcctcagcctcccaagtagctgggattataggcatacgccaccatacccggctgatgtttgtatttggtagagatggggtttcaccatgttggtcaggctggtctcgaactcctaacctcaagtgatccacctgcctcgccctcccaaagtcctgggagtacaggcatgagccaccatgcccggcctcttcctttcaaaatactttcatgtattctatgaaattgtctgtggtaacaaagctttgattttatttaggtacttattttttaatgttaagcatgtttagataggattcattttacagcaatattttaaaagtcagcttttctggattatgccattttacagagaattagctcttatacaatatttaaaacttaataagatactattattttatacatttacatcatattctttcttaggattaggtctgaaataaatggatgatatctggttacttcatcattaattcacattaaaatacatatttaacaatttttatttcattcgttcaatctgcaccaccataaaacaaaatgcattttgctagatgccttctgatttatgaacaaagttagctaatgtgtacaaaagtgtaatgttataattacatattatttaaatcataaatacatttcggttttatctcaactcaaaaatatcctgttatagaactaatgtattctctacgatctgtatttttaactgaagtcatgctaagaagttgaataggtctatcatctacttttttttgttctttttgagatggagtctttctctgtcacccatgctggagtgcagtggcacgatcttggcttactgcaacctccacctcccgggttcaagcaatttttgtgcctcagcctcccaagtagctgtgattacaggtggatgccaccacacccagctaatttttgtatttttagcagaaacagggtattattgccaggctggtctattatctacttcttcgtctgatcattttaatgacaggtctaatgtaacttgttaatacatatataactttttatgtttttgttgaaattgtatacttttctctagcaaaaactttattgatctttggcctataacatgttttctctagttaataatccatcttataacaacaaagaagcaaattaactaaaactggaatcacattttttcttcatatactgaattgaatatttgataatttaagtttttcaaatatgactcccaaatttttgtcttctatcttgacccccaaatccatacttgagcagccaagtcctaatagctatcttctcttagagtctaaaagtcttctgaaatttagcaaattaacaatatggtcttgattaccagagacaaaccaactcctttcccaggcttccactcagtaaatggttctttggctcttggcaaaaacctagaatttgtcctgattcttctttcttgagtgccacactatctatccttagcatctcctctaccacctctcatctggaccactgaatgttcttcctattattctgtcttctatgctccgtgcctccctcgaccaccaccaatcagttcacctcacagtagccagagtgatcatttctttccttaaaaatataaattgggctgtgatgttcctaccgttgtttcccaactcctttagattaaaatctggctcaaagtctgtcattacctcttggttgcctacctcagccctggtgttgctccactttctccttttctcacagagctctagggcttgggctttagagtttggcctggactctccttctgtctgccacccacctccttctgacctccatgctgttggctcctcctctcatctggatcttcactctgtcttcccagtcttaagaaataagccctcccagtcttaagaaataaataagccttcccagtgttaagaaatctaaagattccaaccaggcattctaagttgcaccattatcttttcatatcctgtattgcatgaatgctactaggttttgtgttttttaaaatttgtttggttggtttttcttatatatgttttctctcttctgacaaggaacatgttccataagaaattgtaagcctttccatcttggtcactatgatatccccaggacctagaccagttcctatggtttatttcgtaagcactagataacaatatgttaaatgaatgaacttttctgtgtctcactgtcctcattgtgaaatagggataataataactaactggtaggactgccgtaagaatcaaatgattcatagtacctaatggacagcaaatatatatgagtttctttctctctcttttttttttttttgatgtcaataagttatgggtcaagggcagtgaatgcaaatttcccttgttgaaatagggctttcttaattacgttctgtcaagtgggcatagttactctcagggctcataatataggctcaaaatgaaataggaaatttcacaattacatgattactgtgatcagtgtaaacagctactgcgtatttttagggaaaaacctcaattttctaccaatagtaatttgagtcaattttatatttcttctttttatccattcccatctcagattgcaacagaaaatttgtctttatttcctaggaagtttgtttttttctttatttattaatttataagctcagcctgaaataaactatacaaagcatctctagtttacccttgaaatttgaattctaagtgccaaactggcaggcaaaaattatttaaatattttattcttactattactattaaagtttaaatttctaggagttttctagtacagtcatttgtcatttaatgatgggaatacattctgagtaatacataattaaggaatttcatttttgtgcaaacatcatggagtgtacttacaccaacctagatggtatagcctactgcaaacctaggctatatatggcctatgtatcctaggctacaaacctgttcagcatgttactgtgatgaaaactataagcaattgtaatttgataagtatttgtgtatttgaatatatctaaacacagaaaaggtaaaataaaaatactgcattataatcttatgagaccaccctcatataagttgtctgccactgacctaaatgttgctacgtggcacaagactgtacttaatttggtggctgacttgtaaggacagaaacagaattgtcaattttcctacagatgtatggttgaagtgatgttacaggatcacagcaaaatagcctctacattttccccacttgacctctaataaagaccgtcagtcttatctttataaaaataaggccttccctcaactcacaaatttaatcctataaaatattctaaaaacacacggtttccagatacaccaggagtttgcaatctgacatctgaaatggttgcacctttaaaaatctgtagttttcagactgacatattaccaaagcaatgactattgtataatttgaatactttatcaatatcacatttttctcataattactaaaatgatagaataataactgaatttcaaatccaggcagaatgaagtgcaactttataatcttttatatcctgttaatttcatagaaattgaacctactcatctacattataataacaaagaaaataacactgttggtagatgctatgtggatgtagagatgaggctgtgtgttatttaccattacttcataggtttggaactgtcagacaatcaccaaaatcttatttgctgttaaattacgtgcctcaattactgtagtggctacaatgtgagctggatgcttcttactaggtaataggccccctgggtacgtgggttctctttagatgtggctaagagaaacatgaagacagaagacaaaccaatgctgtgtgtacagttcactgatgactttctttcacaaaaagttgccttagtgactaagctgctaaccaaattcttcttctgttttccttttctggcaattatcagttagtattgatttactatccagaaatccctgttgtttataacctgtcgtgaggcaaatagtacctaagaagaccacccatgttttctctggaagctatgaagggagggcaactcacattcacagaaaggctcttatgtgttaggtactgtgtgaaatatccaatatacataatttcacttacccttcactccaccagtaggtgcatatggcttctattttacaaattagaaaaacagaagctcaccgagaaagttaaaaaacttcctattgtcacttatcatttgaatattgacatttctggatcttattcattttgcttattacaagttacaataacaaaagaagttgtataaattatatagtggtttcttcatggattaagattagtcataagttttcagtaataggcattacagatatttcccatattttatgcacatatcaaataatatttacttttaataaaaggtcatagataacctttgggggtatacatttttaaaattgtatttcagccttttttcataaaacctgattttcagcctcaatcatccaaaattctatctcattgcagcttatgttacaaacccaatcaaaacaaataaatgaataaaaattaacacagaggatcagacaatataaagatcagaagcaaataaaattaatttaaaaatctaagtctattaacctcaaacaaataaaaggagatcatatccctaaaaataaaaggtaattaaaagaaatcaagatacctgttttgttcccaaaattaccactgaatataccatttataggaaaactattttttaaatttaaacttccccatttgtggaagtataggagtggatgggatgagcaccaaggtttctctcacttcataaactattgtcatctctagttgggaaaagaataaactgaaattgtccagaggatgctttctagaaattttttatttgttaatttttggaaaccataagaattacagaattagttctatcattatggaaagataagaatttatgctgaagatacaattatatatatttgtggccgggcacagtggctcatgcctgtaatcccagcactttgggatgccaaggggggcagatcacaaggtcaggagatcgagaacatcctggctaacatggtgaaacctcgtctctattaaaaatacaaaaaattagccgggtgtggtgccacatgcctgcagtcccagctactcgggaggctgaggcaggagaatggcgtgaacctgggaagcggagcttgcaatgagctgagatggcaccactgcactccagcctgggcaacagtgctagactccgtctccaaaaaaaaaaaaaaaaaatatatatatatatatatatatttgctcagttcttgtgaagctgtcagaaaaaaagtatattgccttgggtacaaaaaaagtaaccaatttattcttattgatctgttttcctgtaatttttgataggcttcaaacataagtggcaagcactgttcacaatagctaattttggaagcaacctaagcttccatcaacagatgcatggataaagaaaacgtatagcgcatatacacaatacagtattattcagacttaaaaaataataagatccagtcatttgcaacaatatggatggaactagagatcattacgttaaatgaaataagccaggcacaggaagtcaaatatcacatctcacttatttgtgggatctaaaaatcaaaataattgatctgagggacatagcagaaggatagttcccagaggctggaaaagggaatcgggggcttatggtgtggatgtgaggatggttaatggataaaaaaaaatagaataaataagatctagtatttgatagcacagcatggttaaaaaaacataaggggcaagaaatatattgataattgtatacctgtatcacacactttttaagaaaatgagaaaatataacttaggtcatgctaaaattagaagaactgaaagatttacaaaacccatataaatcataatgtaatctcctatgccaaaacattattactcagaaaacaagtaagttggcaaatgtgaacacctttccacacacactgagaacaagagaatggatgataatttttttaaagtatggaaaacttggaagacacttttatacgataagttaaaatgtctattatagaactcactgggtaaacttcaaggtataaaattagttctagacgagcaatttattagtagagcaagtttcaagaatgaaactgaagttgtgtcacaaaattgaagatcaggttcttacattctatattttattttagactgccaatcatctcctttgagaatcaactaaatttctgagaatatcattcctgccagctggaggcaagagcaaaattcattaccatgtagctgccctatccctagaccccaactttatcagaacagatgctagtgcccaggtaactggccatccatcatctagtcaaatatgatctttaaaatagttggatcctctggcaaggtcactacccctatctggaaggaaaaaatccatgtaaaattgagaacaggaggtcaattttctttttctgccatgattaagaagagggagcctccaccactggaagggagcaaatgcattaacctccctgactggcaggtacccattaaagtgatgatataattcttcacagtgcttgcagtgaatgactgctgggatttatcacttcaaaacagaactctgtgtgtgtgtgtgtgtgtgtgtgtgtgtgtgtgtgtgtgtgtgtgtgtgaaagggagagacagacagagatggagacagagagacacaaagagacagagacaaatgaagaacctgaatgttgggagagcagcaagcaggggcaagcaggtggtggaaaaacttttacttcaacaataattctttcactttgcaatagggaaaagaaacatgacaattaaaactgatgcaggccaggtcgcggtggctcacacgtgtaatcccagcattttagaaggccaaggtgggaggatcatttgagcccaggagttccagaccagcttgggcaacatagtgagacctcatctcatctctccaaaaaaaataaaaaataaaaaaaatgccaggcatggtggtgtgcacctgtggtcctggctacttgggaggctgaggtgggaggatagtttaaacctgcaaggttgaggctgcagtgagcatggccacaccactgcactccagcctgggtgacaaagcaaaaccctgtctcacaaaaaacaaaaaactgatgcaaataatatcaagaaatgagcatatcagttatagttcatagtactaaaaataatataaattaacagatatgatattgaggcatttaaaactatcaagtctcagcctgcttttgtaaaacttgtcaattacagccctcagagagcctccttattttccttgtaaagattaaaacaatattattatacctgaattgttaaatgccttcaaactgctaaaatctttttagtgtgaacattcctgaatataaaaatattaactaaatgattgattgatgacataattttctttttctttttttttttttttgaagatggagttttgcttttgttgcccaggctggagtgcaatggtgcgatctcaactcactgcaacctctgcctcctgggttcaagtgattctcctgcctcagcctcccgagtagctgggattacaggcgtgcgccaccacacccggctaattttgtgtttttagtagagacagagtttctccatgttggtcaggctggtctcgaactcccaacctcaggtgatctgcccacctcggcctcccaaagtgctaggattacaggcgtgagccactgcgcctggcttataattttatttttcaaaggcaaaattactggcagaagttgtaactccttctataaaatcaattatatttgcaatatttatacttcatatctttaatattcaatgacatagcatagtacatctgacattttaaattatattttattataaattatctatggggaatttaggttgtaggatgacaagtatttagcacatttctcttagtaaataaagataaattttatgcacagtggcaaattgccatgggtaaaataataattaatttccaatgtaattgactaccctactatatgaccaaaaagactccttatgtccaccaaaaagacaaaaacatactttttgatctgataatagcaaattcgttaagtacattataaacagaagcttaatgttttcagtagggtttaatctaatgggcaagtttgcacacctggtgtaatttgaagggggaacatgtaaagggccccttgagcccaattatttaatcctcccctagttactcgtgtcattaaagttttacaacttttatatttttgactttcaagagactctattaaaattttgggacccctgggatgtattatacttaaacctttattaactaaaaactttgctttgtcttaacacttgaactagatctagcataaatataacactagataaacctaggagagggatgattttcaagggagaaaatgaggataatattaggtgagggctacgtgtttaggggtagggggaaaacatgaaggttgatccaaatgcagttttcatagtgttgccctgaagggccctggcacacagatttgctattttgctgcaataaggaggccagagccaattacactgttcacttctgtctcagtttcctggaggcaacgagacacactctgtgacatatgagggtatgtcccaaaagtctaggtaatttggtcaaaaatttaccttacccttccccatgacagaaaacaaaacaaaacaaaacaaaaacaaacaaaaaaaccaacttatatctatggtaaattcagtgttcagtgtgggggattttcttcatttccaattttgactctgcttccgtatcttctagattctctacctgggttgcacattggaatctcctggaagctcttaaaatgttgatgcctgggacccttgccaagagagtatggcctatttgatctgtcactggaattttaaaaaaatttccccaggtaattctaatgtgacaaagattgagaacttctgctgtagaatgtttctgctaatgctcagctattagataaggtacatacatagtatttacttagtccctgggttcacaagcttgtagatcagtcacaaagaattgccaagacatcaaacttgccagaatgttccagccattacttaatcccaagtcaataatagtaggaaaataaaactgaccactactacttgacattgtagacaagatcaagaaggggagtgagaaaaaaatcttgcttgactattacatcaacatattaataatggatgtaaaaatgttgatcctcacattcttgagtattattgtctgttttttggaatggccatcaaaccatctaataaaaatacaaattgatcattgatgagatttaatcctgtcaaatccactccatttttaattaagcaagtgtttattttagaggaattagaaaatactcatagaccctttttatagataataaggcattgtcttcaatttgtacaggaataaaaattcagctctgatgagaatatgcaatatctaccaatttcttttggtctatatcttttcacaagaggattttaactgtattgtgtattgtaagcttctcatatttctagaggtttcacacatttatatgattttaacacatcatctttacagtaagaggtggagtaatacaatattgcatatcccagtagatatatactaatatagtgtacttgcgtgcttccaaactttttccttcaaacattgaaccatgaagaaatgccacagatttccaaggttatcaatactttcctcttctagtagagaaaatgtatctctctcctctccacagagaaaaaggatttttcgatagaatattccttatcaattgttatgatttttacctggcaaaagttgagatagaaactcactctatttattaaaaccacaaaatctggtagttgtgtaaaactgccctaaaagctacaaagcaaatgtggtttctcctaaatatttatatacatattccatgatgtggctagttgacatttggtgaaatgtcccttgtctggccaatgagataaccctcgtggtgaatctaatttgatgaatctaatgctcaagaaaataattatatgtataatatcacactttttttgtaatggctaatcttgaatatctcattggcagaaagttatttttaaaagatggtgtttcatcactcagatttattataattaaaaggggactaaacttaaaaaaataagtctgtgttgaaatctacaagtttgattttagcagctgtcaactttccaaattttttggtaaacttcttgtggttcctgtagtctgtagggtttttaagaccctaaggtaagaaatctagctatctaaaagacttccagccatatttaactcatgcagttataaatggtggcaggacaattgtactaagtgcttgccaatgttacaaatgaatgccttctttgggttagtcttaaatatgtttttttttttttttaatgagaaaacagacattttaggatgaaaagattcaaagaaatgtcaaaggattctaatgcttcattttctactaaaaccagaattaaacagcatttatagttgccccaatgattacagtcctctattcagtagatgagcttttcagaaggtctgaggtgatctacttcttaactacctgcagctaaacatttctaagtgggtaagggtctagagcaatcaaatctccattcagaatttgaggttggagtcatagtgaaggttcccctctattctccaatagcaacattaaatgaaagaagagtcctagtgcggtggctcatgcctgtaatcccagcactttggaagggcgagacaggtggatcacctgagttcaggggttcgagaccagcctggccaacatggtgaaactctgtctctactaaaaatacaaaaaagaaaaaaaattgcccaggcatggtggtgggtgcctgtaatcccagctacttgggaggctgaggcacgagaatcgcttgaactccgcgaggcagaggtagcagtgagccgagaccgcgccattacactccagcctggcaacaaaagtgaaactgcgtctcaaaataaataagtaaagtaattaaaataaataaataaaagagactgttgcatgttccaattgttgcaacatatgaaaagtattttctaagaaagaagcatacaatgtctgttatttcggtacaagagattaaaagttacgattcattagttttattttttttaccccaaagaaataaaaaaattatcatttcatgaatgctaagaatggttttaggcccctaaagacaaatttgtccaaaaatggttttatttcactgaaaaggtaatccaggtggctgatttcctccaccctctgaattgatctttgtctagaaagtgtgcttgcttgttaaaaaacagtacccccttgaaattttatgcatagaagaagcaaacacacttcctagacaaagaaagaaagtctttggagaggagcagctctcaagctagcaaccccacgtaagctgtatgtacactgttaaattacttacggctgaaacttttgatgagtctacctagagggactcacaaaatagagaactcttgaaatacatgccgtggattagctacattcatcttactgtgtgcatacatgctgagtaagataaggcaaagagatgggcattacattcaaaaaagatattacgttttgttctgatgctctgtaacttctaaaggaagaaacagaaaaaaaagtcagataatgatatttcagagatagttgtgtttaacattaatttgcacttaaaaagaaagcctaaaatacgtcaagtttctttacaactataaaggcaattatactaaatcaggtaaataagatgttttaaatatcacaacatagctattatatttctgtactttgaatatgatgatacaacgtatatacattgtgcctgtcttaattttgatgtattattgcaataaaaataatacaatgtgttaatactatcaatgtaattttaaaactttatttaatatttaaaaccaaatactctgaattcaaagcttttccaccattaatggaaagcattttactcaggtttttacataaaggctaaagtaatgccatacattactaaaggctaaactaatgacatacatattctttgaaacacggatagtaaagaatttatatttttgcaatgtaaaagagcgagtatcacatcaattataatatgaaagtttctatttatcgcaatattgattttaacgaattaccattcatatttggttgttccagttctttgtttttggagtcattaagaaccatgctcactcatttccaattagttagatgtgtcttcccaagtaataggtggctaccagctttctagttttcaggctcaatgaagcagtggtagtcagttttggctcaaaatcaaggctgtggcctctgcaaccatcacatctactttaatctcctccagggctattccttgacaaatttcctggacagcataattaacctcttcccatagcacttccaaatgctccacacacagttcccagggaatcagccagcagtgccataaatgttttaagttagaaacaacaaaaaatatgcatttctaaaagtagagtattaatgaatacaattagcccaatgttgattgcacaaacatattttaaaatgttgtatattaattacatcctttataagtgaaggggacattgccacaaaattaaaagtctgggagactatatttaggttatcttttagctttaaaggcaacattatcactgggtcttcttgaagaatacacacatacaaacatatgcacatgcacattcacatacaagagaaatgattttgctgggtaatttccgtatgtaattttagacaataattataaaacatgtctagaatttacaaaatcaggttttcaaatattaataaattatatatgcttcaaataaatgccgtgctatattgatcgagctggtaaaatctcttcaaggcttttaatataaatgtaccattgtcagaggcatgtgatccagagcaactccatcttgaataggagctaggtaagatgaggctgaaacctactgggctgcattcccagatggttaaggcattctaaatcacaggatgagataggaggtcagcataaattacagttcataaagaccttgctgataaaacagattgcagtaaagaagccacctaaatcctaccaaaaccaagatcgccacgagagtgacctctggtggtcctcactactacactcccttcagcaccatgacagtttactaatgccatggcaatgtcaagaagttaccctatatagtctaaaaaggggggtggaggcgcatgaataatccaccccttgtttagcatatcatcatgaaataaccataaaaatgggcaaccagcagccctcagggctgctgtctgtggagtagccattctttcattcctttacattcttaataaacttgccttcactttgcactgcagactcgccctaaattttttcttgcgtgagatccaagagcaaaggggtcccgatacagtcctctcttggggtctggatcgagacccctttcctgtaacatatttctctgtcctgtaatgtcatgagttcaaattcaggatcattttaaaaagctttcaatattgctgtaatttttaaaaaagatcttgtgttgttgttgttggtttttaaaaaaagataaaatctttgttgtttagtgtaactgcataccaaacattaaatatattgtatatattttataagctagtagaatatcataattaatgcatagcccagattcttttccctttttaattggaaagtatccaaattgcagaaggagaaaaacatccctattcttattctaaaggggaaaaaaagcaaatgaagttagaggtacatggccattattaactagacattctgtaacaaattataattaaatggaaatatattgctttcacctgcatccatcaggatttttttttaagaatcaggagagctaggaatggtaaaaatatgaattctactttggataataatttgatatcatatttacttatatattttagctacctacaggtgtgtacttacatgtatatacacagaaaataaaaaatgaggaaaactattttttccacatactattttctcctcctccttgaaatagcaacctctgttgccagtagaaactttactaattgaaatatttattttccttgccggagcaaataagacgttaaactaagcaacagtattggttagagtgaggagacaggaaattcagctcacacccagctacccttgcccagcgcccctcctctcctccttttccttctcactgctccaggcactgcagaggcctctcagggaagttcctgtgctgcaggtgctttactttgtgtagcactttttaaactcaataaatgacttttcttatgaaaaaaaaaaaaaaaagaaatgtcctaggttctgagtaagtgttgttacaaattacttgagttaagatgagttgttctcctttgttttaaagtctatctaaaatattagtgcaaattattaggaaaattagcagaaaatgatactgattttcttaacctgttgccttctcatccatccttcccatgctgcttagaggagtggagagtatgagatattcctaatgtacaccatattcccattacagggtacttccaaaagtccacagattgcctataccataattaattcatttgcttaatccttagagtttactacagaaataattattatccggaatcttccagatagactgctcacctcagcaatggggaagatccctagactgtaaaaaattgtatgtaatatttctttctcccaaatgttgagtctctacacaaaacagctggttgttcgaggggagtggtggctcatgcctgtaatctcagcactttgggaggccgaggcagatggatcacctgcggtcaggagttcgagaccagcctggccaacatggtgaaaccacgtctccactaaaaataaaaaactagctcagtgtggtggcgggtgcctgtagtcccagctacttgggaggctgaggcaggagaatcacttgaacatgggaggcggaggttgcagtgagccaagattgcctcactggccttgagcctgggcgacagagtaagactccgtgtcaaaacaaataacaacaacaacaataacaatacacaaaaacccaaagaaaggaaaacaactgtttgtcagtgatcctctcagatcattaaattgacatttttgtatagcatcataaatcaaccatataagtaatccttttctacttagttttattcattaatttaatatgtatttttatatactggactaatttctgggcacactaatacatgcaatagtcatggactctggcttcacagtttccctcctttaaagtgaaacatatatttctttctaaacaggcatttagacaatcacataagtttaaaatataatttgacaaaggtacaaagacaatgtaaaaatattttcctctactttttcaggttactgattttacttagaagataatttatggtaagggtaaagtatttaggaaaaaacatatttccattacaaaaacataatgaaagtataaactcttccagaatgtaaataatacttagcaaatcttaacacagggaggagtttctattatttgattttgacattgctgagggattctatttggttaagtaactgaagaaatgtcaatattatgtaaactcttacttacaaatcatctaaattgcttagaacagagagaatacattaactataaccactgaagccaacgtattctgatattttcagcacatgttaatattcaacattagtggagacaaaatagtgtgttgaagtagtagcagaaaattaatattttcttcttcccctgctacgttatgtttttaactatatcataaaagtcaaaaatgcttgagagcatttgcttttaccagtaccttccagggaaactacaataataaattttagtaataacagtaataatgtacactcataaacacatacatgcatttattgagtatatatagcatatatttatatatatatatgtatataaaatatagaaagggaatttgctactgtcagagaaaggcatgcattccatagagtgttttacttactggatacaatctacccttgtgactaccaaaatgaaagaaacaccatgcatctttagtattcctataccaagtcgaccttactcctttcagggtctataagcacatgcatttaaattgagcatctgcattaacaggaaagtcttcagcaatagccttgatgctccaaatcatgtgtttttgcagctgctttatgctagacggagcatgaaagactttgctctatggcctttacacactccattctccaaataacaaattggctttgcagaagcagaggaagagtaagcaatgaagtactgtcacttggagagatttgtactaaaatcatcaacaacgttgaaagctttacccaaacacttaggagaagaaaaggtattcacattttggaatttaattgcaattatactctaggaaatgctgcttttgctactcctccaacttttgacagggataaaagaaaaagattaatcactaagtaaagaatttgcaatgcattagctactagattccattgttataactacacccacttctgtagagatagaataattttctttcttagctattcctttacctttattatgtagaatggagtgagaattagggagagaggtagcagaagcctagagctgccaaactgctgtaaatagaagaaaggaaaaagaaaaatagggaatgaggaaaagacaatcaatgtgtatggaaaagtacctccagagatcaaactttaggcattaatcataacaagtaccccatatacttgttatgcaaaggaaaatgaaatttcctggtttgtaaccactattgggatctgagcaagagtaatttgaaagacaagagagatctgaggtagatgataatgtgtctacacagtggtagcaaatgaggaccatggtggagaagactggtttggggcctctgggtgagaaaagtaattaacagagttaattccattaagggcttagaaatcccaaaactgttatttccatcagagacaggtaaacatgtctgtgtgtggagggtgcaaaaatggcacagaaatgtgaacaaatccatgtgaagtccctgcttttcttcatgaaagaaaagtatggcagcttagagttgggatttatttgtagttagtacataaggaccatagtctcaatttgagaggtatttatggggaacaggtcatagaatggacaagatgcacacagaaaattgtctggggaacactaagaactcgactgaggttgcagaacatgaattaacgtgttcatttgccaaatgtgttcattagctcagaaaaaaaaagatagcagatgagtgagtacttacaagtcataggtgaggaaaggaaaaaaaaaatacaaggaaatctataggttggagaaaggtggcgggacatataaccaggaaagaggctgatagattggaaaagttgtatagaaatgggctttggtttcagtctaatgtgggttcatatctaatctcatcttcttactaattatttgatcctaggcaaatcacttaaacttatttcagtttcctcatccatacaataaagatgatagtatttgcctgataggatttttgtgaggattaaattaaatgataatagttgactattacattcattattaaaaagagaggtaaaggtgcgacagacctcagaacgttaatggaggccttttctctgtcctgctgcattccttcttttgcttggtgatgcccaaagcacctatcggaccagagtctagctcacgccttcctctcaggaaagctccctacttctcctttctactatttcacagctctgaaatttaacccttgtttccatcagagggtctgtttccccacttcatagcataatgaaactccttactgcagttctttgttttctcaggaatttcttttcttttttacttgtataatcattagatttcctttctttctttttattttattattattatactttaagttttagggtacatgtgcacaatgtgcaggttagttacatatgtatacatgtgccatgctggtgtgctgcacccattaactcgtcatttagcattaggtatatctcctaaagctatccctccccgctacccccaccccacaacaggccccagagtgtgatgttccccttcctgtgtccatgtgttctcattgttcaattcccaactatgagtgagaatatgcggtgtttggttttttgttcttgcgatagtttactgagaatgatgatttccaatttcatccatgtccctacaaaggacatgaacttgtcttggaaataccaactcaaatacatcttcttcactaaacctagaaccatctttccagaatctgtcttgtctaaaaccctacaaaaaagtttacattgttttagcatgactcaagcctatcacccagcttcattctctagcatactgccagagtcttttctaacagtagatatactaaattttttaagattcctagaaatcaccatgtttatcatatctctgtgtcttttctggagtccttgttttcttctcgtctccctagtaaagccttcaagattcataccaaactctaaaactttcttcagactgagtaactgctgctatgagtatcatagctccgggatgtatctcctattatagcatttatcatactgagttttaatcactgtttttcttatctttagcccctactaaaccatgaaaatcgtggaagctttgtcttatttctgtacgcatagaacctggcataaacaatgatacaattaacctcataacaaccacatgggatatgtatctttcttatctttgctattttgcagaagaggaaaccatgagatgaagaggttaagttacttgcccaaggacacagactttcaaggtgtagaactaagacatgactagattaccttatctgtccagtcctccccaaaacttttactagcttctcaatctaaagcttgtcacatcatagatgccctataaatatatgaacaattaaataatgtgtacattacaaataaggcttacgataaaatcatccctgatattcatttgtcattggccctgctagggtggtatcttctttcatgcaatttttgatatctctgttctctgtaaactttaaaacgattctgcaccacagatcttgcattcattcacttaaatatttattactcaatgaatttacatcccttctttcaagttatgcctaagagagtacagttgaaaaattccattcattaggagattggggaatctcaagaatgggcttcactagacagctgctctggtcttagttactgagctccttccaaggaccaaggaaagtaccttggagagaaagacttggcaacagaatcaacattcattttctccctttctccattcctttctccgtataatctagcacaaaagttaacccagtttttccaacaccctctgcctctactaccactgctacttcaccagtgggaaattgaacaaaaagagaagtgctggtagagaagagaaaaagtctgggtagaatcaatgagaacaagctcaagactgggtctgcagcagtagaaggtcaaaaactgcctaaaaaacaaaacccacctctatcatcagttactagagtgccaacatacaccgtatttaagatacttaatagatgcaagtttagcatttccaatatggaaactattcacagggatagataggatagaagttattttgagtcctaaagacacagctattcacaaacaattttaagtcatacttggggctagattgttgatcacactgaatggacaagttaattttttttgtaactggtcagttaaagatacctgccctagagaataagctggaatattgccagcattgctggctggctcccaatagcaatctgccttggctctgtttacttctctacacgtatggggcattaggttgtggggtgactgagatgtcagccacatggctaactcccttttctgcagtgtgcctgtaaatagattgttttcattgcagttagtggatactttggtccctgttcgagaaggacctcaacttttaagatttttttttttttttagattctgtgtatagatgcacaaaatgttggtagaagttttatggggacctctgtaggagttcttgcccataagaattttcttttcaaatcacagtctttcctgcagtgtcttagagaccagactctcccaggatgcaaggaaatcatggaaagaacacttttaccaagacaaacaggcagcattgaggttcaacctggaaagtcatgacagcaaatcagggcagaagtctattccaatcttgcacaatttataacaatgaatacgagaaaattacatataggatggctcagaaattgcattattgttcattagctagggcatagttggtattacaaggaaaaacagtctttctggaattttgttttaagtttcatttttttcctgaagaaaataaaccatgtttaaacatgagcactggcatatggtactgttttagtctgcttaggcagctataacaaaataccataaactgggtggctaaaacaacagaaatgtattgtttgcagttgtggagcctgggaagttcaagatcaaggtgcaacccaatttggttcctggtgtgggttttcttcccggcttgaatatggctgtcttctggtgttgtcctcatggggaacagagaaagtgtctggtgttgtcctcacaggcaatagagaaagaaggagtgccctcctgtctcttcatataaggacactaatcctatgagggccccaccttatgactttaattatctccttactccaaatatagtggcttcaggggtttagggctttcatatatgaattttaagaagactcaactcagttcattgtaggcacttttacaaaaattaagccacgtgatatctaaagtcatgatgccaagatggcactcagggcagagacaaaaatttgacagatatgttctattatagagattagctctatatctattataaagatatttatacagaagcattataaagatgtgctacttagaagtgtcctatagatgtatcataaatgtgtctcatggttgattcttcagaaattatcagttttctcctaaatttcaatgctaccttaagcaataattttatacaaaggtactctatctacaaattactttttgctttcctttgtttctttctatatgtttatttctaacttggtgggcttttattcctgacatttttttatttgtggttatcatcagattactgtcattagctaatggagctatttcatcaacacaacagagaaccagatgtgcctgggaacttatttcttcagatagccattgaccaatatttgacaggtacaaggatataaaagcccaggtccctcgactctatcagggtacatctaggggttaatttataatctaaagttcactgtaggatcaggctgaagctaccctctaggggattttgcctgagattgcatccttatttgtcttttcccctccttccttgtcctgatccccccaactttaccagtgtttcctgagatcacttccttaacaaatcatttgcacacctcattttagggtctttttgggaacacaacctaagacagcatgtgagataagatccatgacattattaagaagatacaatggagaagaatagaaaaatagcaattgttaaatgttaccattttttagtatgatatctttctagctgtctttctgttcctacctcaatgccttctgttccttccatccttatttggttcagtgtctcatccaagactttttccctcacactttgctcagtctgcctgagagacttagtctcacttgaattcccacttttttctaacaatcctgttactctcgtaagcccctaagcacaattctcaggattggtgagaatacgttaggaaggtgaggaagtataaagctgtagcatttaaacaactatgcacagagacttgaacagcacaggctaatggcaacaccagcataagaacggggtgaatccgaggaaataggaagttggcagatggcaggagcaaaaagagctagagggagtataccagagcaaatgagcatcagagattcatgttcagtgcaggcacacactatgcactcagcggtgattctgccccttattataattatggtattaaggactgagaggtttgccttccatcttcctgaacttgacctttgttgagttggagactgaacagtttttactcgtgtttgtcccagatgaaagagtgatctcaagagagtaccagcttttagttttgtcaagaaggagaaagtattcaggaaagaggtcaggggatggagagggaggaagtcagaggcatgttttaaaaaatgtaacaaatttcatttttaatggataaaatatggtttttcagtctcaccaatccatgatagttacatccaggaaggtaatcaaacagccctatcctgtcaaattgactgctaactctcctgtcattatcgcttttctctctcagtggcatgtgcttctcttagccattctgccatcttcaattctgtctgctttggatttcctgacactttcttgtgtgttctccctctctggccaatcaccctgtctccttggtggatttatcttcctccgctttatgagaaacaataaatattgttaaggccttttcctatctatgtattttcctttggtgtccatacattgtatctatgatttccactgtattttataaaattacagtaaataatatacacgtatttttcttttttaagattaaatgctgcattattagggcaagaacatgttttgtccttgcattcacactgcctaggacatagaaagcctggtaacagatatttttaagaaataaacatttaataaaatatttcacgtttcttttgagaaaatgcttcaaaaatcacattttaaaatctcataacagagaaacattatatttgctcaatcaaatgcttatgtattaatttaaatattgttatctactacttcataaacaatataaaccaacaagattaccttagtaaaaatagaacacagctttgagcaaaaattacattttgatttatacttagataagcttgcctcatagaccttgtaagatagttttctttctcccttaataaggaagtcatatcagtagaaaagtttataaatcactaatgtgctaatattctgtgagtccacctgaggtaccttagaggaaagaatattctccagtcttcttcagcagataaataaaagaaatatttttgtaaataaaaaggccaaacctgtctttacaagccttggaccaaaaattttgaaatctgagacctatcttatatcaatttggacatttagtcaaaggaaaaagaaattccaaatagtttcattactcactaagttagcaattctaggaatttagagagcacatttgtgcaggggccacacaacattcctagaagcaggtggtgtgttttatgaatttaacacgtcattcattgtacatagtatagaattgtgagctctcgtgctattaaaatattgtgacattttaaaagcttatccctgaaaaaaagttatacatgatataaatatggctttttccttctttctgatctacttttaattctgagatttaatgttctctttctgtctctctttttaaaatctgcttagttttctaagtttaaattaggaattcaacccgtaactctctactggttgtctaaatacctctcaatgctgtgggatgcatcaggtagtccatcagtttcatcaccttaaagaaatctctcctggagcctctgcttggcagcacagtggactagccaccctctgttggtgcagctctcatcctgagatctcacatcactcttactctggggattccttttgcttcttcctgacctgaatcccttctttctggattggctactctttcttggctaatcatcctgttttactgaagtacatcatctaagagttttctaagaaacggtgcatcaagcttaactttttgagaacttgcatgtctgaaccgtgtttattcaatgccctaagttaattgacactttgtctgaatacagaattctatattggaaaacattttcctctgaaattagatggcattttctgttgcctcctggattttagagttgaagctatgaagaacaaagcaatattaatccctgaaaattacgtaacctgttttttcattttaattttttttccctggaacctcacagagccttttatatttctccagtgttctaaaatgttatgatgacctgctttggtatgagtttgttttcatccattgtactgggctctctcaatctaaaaatacatttatttaattactaaaaaaagtattcaattactttattgatgacttctctcacatatgttctgttttctctttctgcaatgcttattttttgaacttctggggtgacctcagattttcttgttttctcatgtatttttttcatcatttccccctacttctggaatatttcctcaactttaatttttacaacttcctctgagatttttattcttcttcgcatacttttaaattcaaagagctgttttattttctgctcatttttaaagtagcaatttgatcttgtttcatggatgcaatattttctctgatctttatgaagatctttattttcttccagaatagtttgtttcttctaagttccttcatttttgtttgtttgggtttttttttttttttttcgtctctatatttcattttagatgatttccttagctatccagtgatcttgggttgtatacttgtgtttaaaagcagctcaagaatggaatctctaagcccatgggtagagcttgtcaactgtaagctttgctatagaaagggttggtaggttatttttttttttttaggaagtccagcatcaatatatttctttagactagtcagattcctctgaggagaatatttcaactgtgtctctggagagctgccagcattctgaagccttaggaaaagaaggctaggtggctctcaatagaactggcatgaattcaatgataatgacagcctatacacatttcttcccaagttgacattctaggatatcatgttgactgttagaaattggatgtggtggtacaatttacaccatggaggtcggaaaatcctacaaatcaaggctctttcttcccagagagatggtttttaaacacatagcagcacagcatctgtcttgatatttaatatttattgtttcacttgtttccctgatttcagtccagtacttcagtgcaaagatactctgttctacctacttcaaagaaaaaaaaattatttcattattttcagggatattggagaggaagtagaaaggttatattggataaggtagaagatctggggttccaactgcttattaaacagactttttaaccaaagttttgaatccaacctctgccctcactgatataggtgcttggcactttcaattcctgaagctttggaggagattccatggaacaaatcaagttttttcttgatttgtgcctttgtgggattaagatttggccacctcggttctgccaaatcaattacactcatccatgtgctatccacttgccaagattaagttgctattgttttctatccccttcttatagttcagtggtttgtgctttaaaagttctttttgttttagaaggaataggagaatatttttaaaatgtgtatatgttgtcatctatctttattcaactgaatttttaatcaaccagttaaaccgtgggagggtcccaagtagtctcatattgtggctgcacgtggatcagctctgactacctccatgtccctgttggaggttaattgtgacctcataatgatatgttcaagccccaacccccagctttgcgagtgtgaccttctttgcaaatagagtcttataaggtaatatgaggtcatactggattagttcttaaccaatcactagtgtgcttgtaagggaaggggaatttggatatagaggtgtggggaagaccatgtgacagtggtggcaaagaatggagcaatgcatctgcaagccacagaatgcccaggactggcagcaaccaccatgagctaagaagtgggggggaaaaaaaggtttttttctctagatccttcagagggaacatggttctatggacatattaattttggacttccagcctcaaggactgtgagaaattaaatttctgttgcttaaggcaattccacttgtggtactttgttatggcagccctagaaaactaatacaaccaccagtgatcttctcccaaggctttactcattccttggagtaggtggacaaataaggagaaaggaagtctaggccatcggcagcactatgaccatttaagcattaaaccctgctcctatggagtatatgacagttaggtccctgcttctgccaactcctgctcaattatcttaggtattcaagaatttaggttacaactacaccctagttgtaaagcctcagatatatatattcaaagatatttatacttaaacattggaagctgtaagtgcagatcagctttggggtttcaatatttcatccttgagattggcaattttcaatcataattggtagcaaagacttcttgagctaagatagcattttcatgaagtattttcccagaatcatatatattgtcaatatttacgtagaatttttgtgattttttttttgtttgttgtcattagtgatattttgggaaacaacttatatcatttgtggcaattaatataaaaatatttacacagtgattatatttaaaacctgttttctgcctaaagtaattgagtacttaaacatctaaggttaagaaaaccaagaaaaagaataagttagttataataagacagatgaccttttaaacaaaaacgttataacccatgtctatacatataatgaaaatgattatttgatttacactgaattactgaacctataaaatatattcttacatataatttttgtcagaattcttactataatgccctttttggtaggaaaaagtaactgtcatctaagttagcctactgacaatactgaatataaataaaatttaaagtctctacataatatacattataaaaactaatctttagcaaatgagctatgaagcatttctaacttgggaaactcaaacaaaaataaatcttgaaaaataatttaaaacttgaaatatcaaaaatcacaagtgtagcaaccgatattttcatctatttctttgaagttagaatagaaatacaatattatcagggattgaataggagctttgttggaactgatgataaggactgtttaagactagctgggatttatgagagatcagaccatgaaaatcgttcaagtagtaaactgtcaattataaggtgtggttaacaagagcacgaagcttggcatagataagtaatattgccaaaatttctttataagttcaatttactattgattttaatattaaatactcattcaattatctatacaggcaagaaaagactggaaaagtaaaacctaagtcttcattataaaagctattcttatccaaatctttaatgttttcaacattttaacttaccaactccacttgcaaactatgaccaataaaataaaatataatctagttaacataattagggtctcaaatttttaataaatctttgaaacaaatacattttcagaaagagaatattatcagaacaaaaaggatgcaataacatttaaatgaaaaaatgatttattagtgttctctaccttcagatagtcttttagattttttaatgaattatactataaagggtttaaatacgtgaaaaatatgctcaagtggagaggtaaatactttttagatgatgaaagtgtcatatctctacaaaaatcttccagacaaggtctgagcttaaaagagtattcaagttgcccatttaccctcattataagttaacattctggtagagtatttgaaatcattcacatagtaatcattggaatgcaacataagtgtttaaaatagtaattaaagaatttacaactaccaggagaagcagctcttcagatgactagaaaattacatgcttgataaaggggatgaaaggtcatttctaccacggagcactctaacttggcatgcacgttatgaatagcatcatggcctaaaactgtacttcagttattgtgttaatacatttgtcctagtttgcccatgaccttgctttctttctaagagtgactgattcatgaagacattaaccaaggtatagaggagttaatagctgtttctgtatactcttggtaattatggtaatttgagctgcccgtcaaaaactagcaaatatgttttataaaataaacataaaagcatattgtaaggagattcaattccttatgaagattagatcttgacttccaaaaaatttacaaacattttgtgaacccaggtaatctatgcatacgaagagactttaatcttaaaatagccaagagttagatcattcatacttgactttagctagtctatccaggatatactgttatctggaaagatgtcagaaaaaagctgagcagagtgatagagaccctaaccaagtggctggaatccattgaactgaaatgctaggtagggatactaagcaaaaatcaagtattagtattctctcaatagtgcaaactcaactctaattgggtcaagcatttagaaaaggaaaatttgggcattcgtatgcccttgatttctccctttccctccatctctccttctctccccttcccaaatctttatatcggattatactttcttctctccatctgtagtaaagcccacttaatatttatttataatctaaaaattattacataaattattaaatatagtcatttttctgtatgtataaacacatcatatttgagttcaaattttactcaatcatattttctatgtgctgtcaacttttctaggccgtgggcataatgcagtgatcaaaagagaatcattgatgagaaggaaacttacattcagtgggcacagatctagatttaatgttgttgattgtttactataaggttcctgctactactctaaggcctttaaccttgcttattattcattacaataaccctgtgagtaggtaatatgattttctccattttatagattagaaaactgaagaacaaaaaaattaatttttaaaacgtcttaaataaccagtagcagaacataaatcaagtattctgcctaaaaatatgtcttcagaaccactttgtaatactgcctctcactataaacaaatatcagaaaaaacttttattaatgttatcataaaaagtcttcagtgctaaagttgatactacatatataggtattggttaaacaaatcactgaagaattttacaatggaacagtatatagccattaaaaggcaggagtaaattttattcattctacgtgaaacaatttccaatatatattctttttaaaaatattcaaggtttggccaggcgtggtggctcatgcctgtaatcccaacactttgggaggctgaggcgggtggatcccctgaggtcaggagttcgagaccagcctgaccaaaatggtgaaaccccatctctactaaaaatacaaaaaatcagtcaggtgtggtggtgcatgcctgtaatcccagctactagggaggctgaggcaggagaatcacttgaacccgggaggcggaggctgcagtgagccaagattgcgccactgtactccagcctgggcaacaaaagtgaaactccgtcgggggaaaaaaaaaattcaaggttctagatagtcagcagacatgaatttgatgtagtttgtattttataaagtaattaatattttataatttattttatacatcacacacaaaaacacatacgtacattttcacatacacacagacattttccaataaaattaccaaggattatttttaagaaacagaatgtagtatttgcaatagcatgaaaagttttatcttagtacacattatcaataaaacatatttataaaataaaatcatcttgccctaatatgtgcttaccattaaaatgactctataattaagcatctaaagttaatattttatttgttcaagtataaatatttatttctactttgtaagaaaatcaaacaaggagtaaacaagttgggaaaattcatagtttttttttttttaacaagttatttgtgtgcatgtgtgcttcttgattggaatattctttttttttttttttttttttccgagatggagttttgctctgtcacccaggctggagtgcagtgatgcaatcttgactcactgcaacctctgcttcctgggttcaagtgattctcctgcctcagcctctggttccagagtagctgggattacaggtgcgtgccaccatgcccagtgaatttttgtatttttagtagtgatggggtttcactacgttggccaggctggtctcgaactcctgacctcaagcgatctgcccactttggcctcccaaagtgctgggattacaggcgtgagccaccgttcccagccaattggaatattcttaatagagacatcttcaaatatccatatttttctttcatgtttgcatgacattaacttatctaaagtttattttccaagttagagcagatactgagcgtaaaaatgaataaattttaagatagcaaaatattttacttaaatagttcacttcttttgtactgtaaaaattatggagtgaagatttgtatgttttctctgattaatttgaaccacattaagacataagattggcacctatgaaaataattttaatataaatatttgcattcaactattccatatgggaatcatcgggagacaggacatttggcttttggctctgaaaacaacatgtgataaacgtgactttttaaagttagcatgcattgctgactgttatttctgggtaaaacatgtataaattagggaaacttgaaggagatagttcaatgcaaaaatttaagacaacattaaaaaaattaggaatctttttagattttaaggtttcttcatttcaacacctctttatttttcttgttatatttttcttgattccttattttcttgggatttgagaacataaaatggagttaaaatgctcttctcacattctggagagataattggcagataagactttaggaaatccatactccactgtctttcctgtccagaactgaatattctcaaagtgatttaatatttatttcccttactacagtatggaagtgatgaggacacacaccaagatgactcattctacttttagagagaagcacttagtagtgactggcacatcacaggaatttaatcaatagtctctgaaagaattaatgaataaatgtgtgactggactgcattacactgtacagtacagcgggatgtaaccctttccttaagaagaacgtaaagacaaatgtattgccctggtaaaaacactccataatcaggaatcttgaaacctgggatcaagtttcttctctgtgcttactctttctgacttattctctcaatacttcaatttaataagcaactgaaacaaaccaaccaaaaaaaaagggcagataattttatatgatcttgaagtcttttccagttttgagatataatctgactgaaattatttcctgttttttttttaaaaaaagaaagaaaacagcaacaaaaaacaaatatgaggctttatcttgcttcaaccatttgtgtgtgtttgttaattaattaacacgtgatgtgatctgtaatgtaagaaattctcaccacgggaactctcatcactaaagatgttctacatctttaataaagatgaagactaagtccaaaagataaaatgattaatgtttacatggtttcctcattcacctccctccaccccacaaatctctaggattcctttatccccaaaacactgtgtcatcacaagtcactctgtaacccttcttctgtatctttctctcctcctccttctcctccacctgtacaactgacattacctaaatttccttagggtatcatgtgcagtcccagaagttacaacctaaaaggggaagttcccttttctcatcttaatttctgtttgaaacatacttggaattaaaacaagcaaaacagggggccaggtgcagtggctcatgcctgtaatcccaacactttgggaggccaaggtgggcagatcacttgaggttaggagtacgagaccagtctggccaacatggcaaaaccccatctctaccgaaaaaatacaaaaattagccagtcatggtggcaggtgcctgtaatcccaactactaggtagactgaggcaggagaatggcttgaacccgggaggcggagattgcagctagccaagattgtgccattgcactacggcctgggcgacagagtgagaccgtttctcaataaaatacgataaaataaaataaaataaaataaaataaaataaaataaaataaatgaaacaagcaaaatcatgaggcagtagaatagaggaaatcagaattaaatgccacagaagtccttcacctgagacaagacagggaggtgaggagattcaggtccctactgtgcctccatctgaaacttccttacgttttattattgtgcttacctgagatctgaatgattgcaaataaggaggaggaggaaaagtagaaagatatttggaattgtggctggctggctggcccaggcacagctgactgggaaggtccttccctgcctgccttcccagctgtggtttaggctattgtcctaaagaggaactcagccatgattgcatttcagggagggcttcttgcctctaggactctcctctttatcccaagttctagtcaaaattcaagtattgttctaaatagcatatcatatgggaagaaaatgaagtttccatttttaagcttctgccaattctatttaatttggagcagttttcaaactttttagaccatgcccagaggtaacaaatagatttcacttagcaatcagtatacacatatatgtgtaatataaatctgaaaacaatgcttcccaaaacaagagttacaacacaaaataaatactgatattttctgatttattctatctcatttttaaaaaaatactggctgggccaattacgtctgttgggagcaaggctcaggcattaggatttttttgaagttctcgcctttgattcccatgtgtagataactttgggaagcaccactctagaggtttttcaggtgaattctcttgggtttctaaggactatggctttaccatttataaataacagtactttttatcttttcatttacaatcattatatattatatttttgtctcttattgtatcttagaattttaagaatgatattaatagaaataaaagtaaaaatctgtttttagaagctggtctataaaattgatttcacaccccattaaatggtcacaattcacagtttgtaaataagctggtctacaggaagagtcagtaaactatggcccatgggacaaagcaggtctgtcacttgtttctataaataaagttgtattgatcacaaacagccacatccattccttaatgtattatctatgaccactttcctgtaacaatggcagaaatgagtagctgtgacagtgactggtccacaaagcctataagctctttattatttgtctttacagaaagcctgccaattctttgtttaatgtaagttttttgcattggaggtgaagtaaagaggttggaaaaggaatgaggatctaaatcatgaatggtattccaatctagtgataggattttatcctcggggcaataataagccattcctctgcaggaatcaagctcccttctaatcaacggtctcccactgtgttctgaaaccctgaaaatggcactcttaggcaggaataaaattgttttgtttcttgtgcatttccaggctccaatggttggtgttctctgtaaatatgctaaatgtgaaatcagcctttgcctaattttgagtgtgaatctgctggaatttttaacttcctatctatttttagataaagactcttactgagtctcatcaaagagtttcatagcttgggactaggttcactggaccatttgactccacataaatttggcttttccttgctttctaaggaggggtggtattgggcatcaaccatgcttcctgcctgaatcatttgctgtgcttttgtcagtacataaagtaagcaacaaacccatgcaattaaacatgaccaagagaccagttttaaaaagttacttttttttcaagcaggtaatatttcattcattcactaaggagacagggcaaacatttatacaatctatcaaatatgttttgcttaggtaatcacagcagtcacagaattcttaatggtaatttagagtctattcacacttgcctcaaagacagcattaaagaacctatcaatgaccctgagaatcattactaaagtcattattgttctgatattacaatccaaagctgcatgtttatacctttttataatctaagaagtatggccaaaagaaaatgcttgaggtaaaagatctcaattactttaatattttattttctttaccaggtggattttgttaacaagaggttagaaaattagaaagatcttcaccacatgcttagaaataaagatcttgtaaatagtttataaaaaaatgcagtgggaaaaatttcaaacctaaattattattaaagctgcactaaatgtgaagaaaataaaggtgatttccaaaaagaatggttaggtgtcaagagtgagaagtgaagaatgtggaaagattaataaaaccaagcaggatctcgttaatcaaacttccccaagtggcacaaatgatttgatttgaatttgcctctatatacaccaatgatggaatctgctgtttttgtgaagcagccaaaatgtctacttgataaatggggtaattctttcaaaagtacctattctgttgtttcttttatatgttgatgatgtacacagtaaaactaagattaattatttgctaaaaatataaataaagctttgatcacttttaccagcttttgattttttttaatgaattgaccaaataacatctttaaactgaatctccgtttaaagggttgaacatgcagagaaatacctctgcatggaatgaatttagttggccaggagaatgtcttagaccaatgaaaataatatgtttctcatgtcaaatgttaaggctttgaataataacaattttttaaaatagtacaattacctatacattttaggtctaatataaatgtacctgaggaaaaattaggttaatatttctcctaaatggcaccttttctcatcattctcttgaaaaatatgacaaagatttgtgttcaagtctacctaaagcaaaacaagtaaaacaataaaagaatcaagcctacaaacaggctggttggactttttaaaaatcagatatattgagatagttgttaaaaaacacatcacaaaaggtacaataaaactttgggaagattagctaaatgaatataaatattaaaaaaacaaaaccagacaacaacataaaacagcattcttaatattgttaataatatcctcagtgacagtgacctcattggcatcttggcgaagaaataatttttgtggccaattttatcacagattttctgtagaaatatccagtatttagtttccattttattcaaagttatgtattggtatggactgaattgtgtccccacaaattttgtatgttgacaccctaaccccaaatatcactatatttggagaaagggcttttagaaagtaattaaggtcattaaggtgggactttaatccaataggattggcaaccttatgaaaaaaatctttctctgtctctctctctcttctccccccttctctctctctctcactctctctctttcttctcttcccctctctcttcctctcttccctatgaggatacagtaagtaggcagtcatctgcaagcaggaagacagccctttccagaaacagaatcacctggaaacttgatcttggacttagcctccagaactataagaaatacatatctgttgtttgaggcatccattctgtggtagcttgagctaagatatacacattcacagtttaaatagacaaatatttaaacaattttttaatatttgttataaaaatatccatacctacatattgcagctttcttcccctccaattcacaatccctagagcagtggtcttaacttgggaaatccccgctcccttgggagccctttggtaatgtctagagacatttttagttgtcacaaacggtgaagggagagagaattgctactggcatctggtgggcagaaatcaggcatgcttttatacattctataatgcactgtatagctctggacagcaaagaatgaatgtcagtagggtgaggaattctgccccagaagcaacaaattttaatgctgtaactttttagtgtttaccttcaatctctaaacaatatggtttctttcctgcttctcaatctttcttttttataaacagctttataattcacatagcacacaattcacccatttaaagtgcacaattaaatagttttcagtaaagtcacagatatgtgcaaccatcacaacagtcaatattgggacatttccatcacctctaaaagaaatcatgtattctttagcaatcacttgttctgcctccaccaccactgtcttttcccagccttaaacaactattaatctaccttaatctacttgctacttttttcactagtctctatcaatttccttattctggaatttcttctcaatagaatcatatggtatgtgaacttttataacttgttttttttacttggcatgttttcaaggtacatccaagtagtagcatatatcagcatgtactcatttcattgtatggatataccatggtttgtttatccattcatccgctgatggatatttgggatgtttccaccttttggctagtatgaataatgctactataaacatttgtatacaagtttctgtgtgaacatgttttcatttctcttgggtatatacctagtggagtttctgggtcatagggcaactaatcatttgaggacctgccagactatttttcaaaagcagctgcatcattttacattcccaccagcagtgtatgagttctgatttcccacatcctcccaacactttttatctgactttttgattctaatgattatagcaggcatgaggtgtatcttattatagttttgatttgcatttttctgatgcctagttatgttgagcatcttttcatgtgcttactgaccatttgcatatcttccctggaggagtgtctactgagaattctatctgcctcatccttcctcaccaacctccagtaggcatatgcacacatccccttctcccaatatactgaaattgttaaatcattattttttacatgattataaaaatgattaagatataaaatgtatcaataattttgatagctgaaacatattttatgatttcataagtttttccctctggaaaaattatgttatattgttgttgtttgcttagttatctttgtacttctcacaactatatcccagaactctattttagttgtatcagtctcctctcaatatattttaaaaatttcatcttcttgaataaaccttttcaggagccatctcatctgctgaaggtcagctacacaaatattattttgggatctttcttctcaattgtctagggattcccgtcgctctctcttatgttggagacttaatttcctggatcccatgactttaagtctttcctcaaatactttgtaagactcatagctgtctgctcatctataaaactgggccactaaaaagttgattagaagctctgagtgggtaggtggggcttttcagtttacagacccacagaatggttttgtttggaaacattctaaggatgtgtaggatcttattttggggctgtgtgcatttatcacaaatgatacatttaatccttttatgttagataaagcctagtaccaggctctgggagcccagggggaagctggaatttcaacatgctctagtaaaaattcccttaatctccagatttttagaagttatcccccatcaacggtgcttggtatccccgagtcagtcagcttctgctttatcttctacagttaagaaacctaacttttccagtgataaagcaacagacatttggttgtaggcaagggagaggctgatgctccaattactttttaaatagactttcagcaaatcttcctatgtagagcgccaatttgtcccaatttttgataatctcgtacttccaactcctaaacttttgtggtgttccctggtagactgaattggctctaagcctcctttattccagtttggttccagctttcttggtttgctaaatcagttactacttaccagtttctttcagctttccaaaccgtttttgctgcgaaatcctttcttatgctttttcctaatgtcatcactgccatgtttcctatcccattctcttttcctaatatttctgctaagttatccttcattgggattattttcatctgatgagttttggagaaaatgtgaaggctaatttgcatgttcaatctgtcaaacataagacaaagccttctttttgtgttttaagttaacttttttgttttgttttgttgtttctgtgtgtgtgtgtgtgtgtgtgtgtgtgtgtgtgtgtgtgtttgaagtggagtctcactcagttgcccaggttggagtgtagtggctcaatcttggctcactgcaacctctgcctccctggttcaagcgattctcctgcctcagtctcccaagtagctgggactacaggcactcaccaccactatgcctgggtaatttttgtatttttagtagagacggcgtttgccatgttggccaggctggtcccgaactcctgacctcagttgatccaccctcgtcggccttgcaaactgctgggattacaggcatgagccactgctcctggcctaattttatttttgaacggtgttgtagaacaaatacaattagctagtctactaacactttctttgcacacaagaatatgtatattattctagatcagaaatagccagtaggcataatctttatacaaacattaatctactaaaccacattattttgatgtattatatcagtggggaaattaaacagtactactggtctttgaattagaaatgatccaatatatattaagctaagacattgctctaagaacatatatgattaaaatatgctttgataatatttttcccttagactcagccatatattatgtccctagaatgcatgtacctattctaaatagatcactctaaaaatatggaataatttagtaactagatatgaatattaatgtcctatcagatattctacatctgcaactaagttatgtattacttaaagtagtacttctcaagggttgatccacagactgttttcaacacaaatgcaaaatttaaaaataaagatgtaggttccttaatcctgcttaagaactgctgtgtatgtatctctgagtgtgaaggcagaaggtctgcattttgattcaactttccaggtaaatctgaaacaattaaatgtgagaataatactgaaataaaaagaatgcatttaatgaggttatgaaattagttttatctgtgagctttaatgactttgtttttatgtagcccaaatggcataaaacacagggtgtttgtttaaatatagctattttctggaataaaaattttgacaaagtggtatccagatgacttagatgtcacaaaaaataattaaaagaaagagatgagttgccaagatcctcaataaagggacaactgagtactttcagatgcacacacccttaggggaaggcttaaacaatgactgtgatcaagttaggtgagagtctggggagggaagttctggcctgtgctccaccttatcagttttaggagaaaaagtactaagaatatagatgacttttcacatatcgtactgacttccttgctagagggactgggtaggtaggactcaactattcgaaaattctttgaagtgatgtgaagtttctatatattatgaaagcagggatcatgtctatcaaaatccttattttatctatagcattcaacacagtgcctaccacacacagtagaggtcagtaaacatttggtgaatcaataaacaaataaaagacacttgaccatgagaggccacaatactgagaaattggagatgtttcgcagggtggatgctgctggattcaacagagtttggtactgggagcctcactctctgtcagtttctctcctctgctcaagaaaagggcagaaatagaagtcactgttagctcatctgagaaccatcctcaaaggccaacgaagcagcaacaagataataacgggagattatggaaggggtgtcattttggcttaactttgccctctttaagcagatagaagaactttggacaacaaatgcagtattgccagcaaatgcaagaaaacagcagtcatgatgctacctttcagagaaagtgaaagaggatagcatgactctgatgtaagttcttgagcgtcagacctcaagggatgctggctgaaacacacagaatgataaagtgagatttcgtatgttggaaggagtgtatatcctctcatgtttccaagaagagaactgcataggagaacatactctagaagaggccctggaatgagaagttttaaggaaatagaatctgcaaagagaaggtgggaagagtctgacataatgttgcttggtgctacagtcagccacatccttataggatttagctcttgaatactcctactgtgtagtgactcagtgacagtcaagaatggccagacgctatggctgactcctataatctcagtattttgggaggcctaggcaggcagattatttaatgtcagaagttcaagatcagcctgggcaacatagtgagaatctgtctctataaaaaagttaaaaaaaaaaaaaattagccaggcatggtggcacactcctgtactcttgcagtcatagctactgatgagactgaggtgggagtatcactggagctcaagaatttgaggttacagtgagctatgattgtgccacagcatgagactctgtctcaaaataataataataaggtcaaactcttgataactagaattagaaaaatcaacagaaaaccctgaggagcattagtgagtttgtattcattgaaagtgaatattttctttattaaatcttgtttcatatttgcaaagtcttacaatttaaaatattttaacatagaagacaatttcattttatttcctatatgactttgttcattagaattttgcagtatttgaatagttgactaaataaaataaacaaaatccataaaaaaaaaactgaccttttcaaaagtaaaacttgaaataacatgtaatatttcaccctagaaagcagaaggaaggtaggggaattttgtggctaacacagattgtgttcttcccttttccttccagttacttggtcttataatcagctaaaatgccatctcttgctagactgtaaactcctgaatagcagggtttaggtagtaatttatctgctttcatgataaatttctgcctctaattcactataactgttacatggtagatcttgaaaaactttttaacacatcttaaagttataaattcatactgtaatcagggaagatagtagagaattttaaacaaaagtctttttgtggcttgtgagtccacaaaagtgtgatgctttatatatgtacagactaaaaaaagtttactagtcttaaggctttagggaagttacttactatgttaatatgggcctcagtttttcctaattatacctacctgtaggactggtatagtgttaagttctttttattatagtgtatgctcagtaagtgatggttattattattgatagtcttgcactgataaaacacatggattgacaaaatgtttgttctggggaagcagaaaaaacagatgtaaagttatttggataagtcagtcaaaaagaaaataaaagctcacaaacttcagtcttaaggcagttaattgccatgaatacccttaaatgtttaacatgttgttccaaaagcagcaataaaataaaactgaatgaactttttttttattaaacaagacaaaaagccaaatttgcaagggttgcaagtaccaaaatacttctctgattccagagagactgcctatgtgtccagactcatataaactcaaagttgtgttttgatttctcaatatggtaaagttccatctaatgtcattctcttaacaagctcttttgtaatgggaagtttgtgatttaatagctttagaaatataatgtgatacatgactgtaaaaatgcttgttgattccctacaagctaagacagctctattgtaactaaaacggtaaagtgaattcctcctggcagaagatgatatagatggaaagaggtgaggaaattgattaaatatggctcttttcctaagcagatgaataactctatattgctcgttctgcatgcctataaaataatacaatgaacaatgttgacttcataattgagaacatactcccattttgctaggtataggcaaaagagaaaacacaagctaaaacctcaatatcaaggtaatgtttatagcactatattttcacacttcttgatcagtttaccttaacgtttaatctttagttaggtcaaacattctttattcattatatttttgatgtaaccttccctcccacaaatgctttctaaattgtcactttctcttttctctttcacagagcaagttcccttagaataaagacattaacaaaaaaattatataaagtaccaattaaattatttcctgagatttcctgaaacatgttggaaataggcacctgtatcattgcccagtagaaaataactaactatttgtgggtttttaatggcaggcttgttaaaatacatttaagagaagtatataaatttcttttattgtgttcttccttacttcgccatttatttaaaaccttaattacagataattgagaagtacagtgcttgaacaaatccattatatattatatcaaataataatgttgtttagaagtggtgttaattcttcattcgagcagctatgcctataaataataatcagttctaagccccaagttaatgactatttactcatatgatttgtagaagcctagagagatccaactggggaggcatgaaagcttcactgatgagaaaggtttctgctgtattgtgttccaaaatcccggttagcacagtgccagacactaagtgctcacatgtatgctttttcctaagtaatttatatgcattatcttatttaactattgtgacaactcaatgttgtagatatgaataatattttcattttatttatgggaaaaactgaaggtcatgatttacatcgtttccctaaagacatgttgcctataaacaggtagaggtgggattccaagtatctctgaatctaagccttgaagttggcattcttaacataggccagtaggattcttaggctgtagtttcatattgtttccatctcatctaggtgggaccctttatgccactgcttcatatctccttggattagtcatgtgtatttaaagccatgatttaatggtttccttgacttgaacgaaatatatttgctgaaaaaattgaatgtttaatatttttcccaattcacagggataattaaactactagatgaaagcattttcaatcataaacatttggtgccagctaataaatgctacaatttaacaaaattaatgaaccagcaacagaaatacattaataggaaacttaggatatgatggccttgctaaatcagaaagttagctattacttgttgattccaaaatgaatatttgaagatgtgattttattgtgcatttatacctcattcagtgctaggaatgtttagaaacgggagccataattgaataagctacatgggggcatagcccatctagaactatgttcatttgctaagatggcaaatgttcttcctttgtcttccaagcctcttaaatcaactaaactcctggggccatgccttcccccagtcccattcctatccattttgagtcagtccttccaggccacagtgatttttatcatgcacttcataattacaaaattcttcccccaatccccaaatacctactatgatttgtcttgaaagcttttcaaggctttattaaacttgtagttttatatccagtgtgatacccttccttggcataattccccagctatttaggtcaaaactgttgaagagaaatgaaaaaaaaaaaaaaaaagaaatagtggagaaaacaaacagatgtgccagtcaaaactagggaaatgctgtgcagtttgaacttttaactgttaaggacatttgacagggctctcttgcctctactggggataagtcagaagaaaattatatgttagcaccattttccagtagtatactgtatggatgtatatgtatgtgtgtgtgtgtttatgtgtgtatccagtagaatgtgtgtatatatatacaaatatatatccagtattatatatatatataatatatatctccagtagtatgacggatatctatataacattatatattatatatcatatatgataaaaatattatatattatatatattttattgtgcatttatacttcatttagtgctaggaatgtttagaaatgggagccataattgaataagctacatgggggcatattatataaaaatattatatattatatttttatattttatatataattatatatgtacacatattatcccacgatgacaagtattataatgtatcagtattagataagattggataaagaaaaactgcaggcttttatttgggaaaaaaatttcatgtttgatagaattatctataccagtatcttataatgttccactaaaacaccaatatttacaaatcttattaccctgaataactataggcttactagatgactggataacttaactagttgaatactaggtgcttaatgaaacatgttaagatgcattataataaggggtgtgtgtgtgtgtgtgtgtgtgtgtgtgtgtgtgtgtgtgtgttgagaaaggaggggaatatagtgaatgtgggaccactagctctagggctagtggggaggaggaggctgccaaaggcacagagtccagtcttttggtagcatgggagtaagaactggcaaggatggagaagacaaagacaaaacataaccagcatttcctacgttaacaattttactcaagacaaatcttacattcatttgtttttcttccattagctgatatagatttcactttaggatcaacattagatttgtatcaataccccattatgtactttgaaataacttcttattagtgtcttaaactttttcatgctatccactgagtctagacaaaagatttcatgttcattgtatcactatgtctcatattccaatggaaaataaattaatgatgagtaacacagtgcacgttcaagttatgagtgtacgtatctatttagcaataaagatatggctgatttgtgtcaaaaggcagagcaaactggttgaagtaaatgttaccaaatcctacatcaaaattttattgatgaagataccttactcaaacttgtttaaacaaaaagtgcatgacaaatttaagatgaaattaagcaagcctaatgtctgattataaagcaagaatggtgacatttgaaaatgataagcaatgataagcaaggctgagaatgaactaataagctgtctttcctaaaatgtcaaccaattgcctatgtgatacatcctgagagttttgaaaaaccaccaaatgttaactggagccaaattttcttagaatactgatttaacatcgtaagtgtattttaataaacattataattttatttctgaataacaccttttggtaatctttatgaagtaatattttaagttattattaattagcatttaggcagagtcagacatcacagttgatgggacttcatattattcacccataaataccacacaagtctaacaatctgagactagttcatcgagatgctgtcagtagaatcattgctctataaacttttctaatttttctccagttggcaaaattgcagctagaattttaacacgaagcccaaatctatgtaagaaaaccatcaactctgattttctttatgggtgtgatttcccttaacaatggaatcacttattctgccacatttcacagcctaaataaggaaggtaactcgtggtagtttagttgagctggtccgctgtggtcagacatactttggtataactgccaccaaaatgatgaatgcatggtattattattttcttatcaaatcatgtctaaagatttatgtttaaccttaggaaattggctgcttgccaaaacctcttggttgctgctagagatgttggttagcaggtttgtctaaagcaaacacaggccaaggcaaattttcttccacccacagagtttcagaggggtatatcctgccttttaactgccaggtgaggcaagcagccagactccagtaggcttactaaagcagacatatgaaaaagttcacccactctgaggctagagtaatcattaatctttcaacagaaaataaatacacaagatgaggaactggtagcatttcccagtctggatgaggctgccagatccagaggggtgaacttggctaccctcagtagaatatcctcttccatatctggctccagtgagaccaaggtgggcacatgaaccagagatttagtctcctctatttcctgtctttgttccaggattaatctctctctacttccttttaaacacactgtatctatcctgaggcctttcctttctccattttcacatctatgtttaagagattttagagaaacagagaactgagatgaacttgatcacttctgacacccacattgatgctataattttggaagcaattaaaaatatttaatgactaagttttctccaccttacagctctacttcaagtttttcatggcttgctagaaacaagtcaaggtataaagatctgtgatttactacttccccagggcctgtcttctttatagaagtatgactattacaatattctagttaagtccaaaaactatctctttatctaaattaaattatacatgactctgagactccactaaacagaaaggaggagtttcagtcgtgtgcattattgagatttttttccctctctagagagtctagagatctttagagtcttttatatctagaaagagtatttggtaagtggatcctttggtctttggtccacctggtcacctctgttaatatttgtagtcccaggctgcataatcccttaagaagttgtcaattctctgccgtttctaaaacttgagcactgagattcttactgaggctgacagccttagtgcctagcacactaatatgttgttcctaaatacaccacgcagccttttcctcttaggtatgactgcatgcctgaagcaaggaaaataagagtcctcactactcccagatgctccaactctgacctgggtccaataaggacctatcttattcacaaattctattcctccctctcctcctctgggcataaactctcaacatttaggatttagagaacaaaatccaggaagaagtcgagcaactttctctttcagcctatcacaacatatgctccaaagacaaagaagcccaaaggcctggctaccatctgggaatttgcaagtatgcaaataagaaggacaaaacagaaactaatatctcatattaaacaatatttcatctccaaccaaatagaaacttttgatactggaattctacataatgaaaactcaatttttgagttatatggaaacattcatatcaacattttataccaatttatatttgtatagctctttaattgacattatactttaacatgttatctcatttaacgtctcaacaaactagcactactcttatctctattcaagcacaacttttacatatcataaaggctatttgctaattataaatggaacagcccatccatcagatggacctgagttagagtcctggttttaccatctattagtctgattatcaaatccaattatgcttttcctgtctttgacatttgtcactattttcctttacacacaaacatggcttctttaatgatttatttttcattttaaatatacttttatcccattcgtatcattaaaattgaatggaacctgtgctcatatttaggtatttcatcaatttccattgaatcattattgtctctgtatctaatgtctaactcaccttttcttaattctatatccataggacattttcaccaatattactattaaagataaacagtaaaatgtaaacatgtaaaaatgactttatccacttattttcatcttctgctagatcccagacaagtatactaaaagttctaggcttcctcatgagtgtcagcaacatgagtgctttttcatttttccataatctaatcattatgaggttaaacccattctttcttcccttttcttctgtgcatttatggccgtaacagtttcagctcagcaatgaatggcaaataatcatatttaggagtttcatttccaaaatcaatctttttctaggttaaagcatccacattattaacattggcatgtcaaaataccctcgtctatcctgcagtaaatttctttagtccataatttttgcaatgtaaaaaccacagttttatttacgccatttgaggttacacaaatcaatccacaaaaaaatatgttaaagaaacatcgtaagccaagaaaatcaactgtcttcattcatctaatctgcttcgatattaaacacatatggtattgactatataggtcgcctatcatttagagaacggataacacccacattcacaattgctttagacagatggtattttgtgttgatccaaatccttgttttgaagaactaatcaaattgttatgatcttacaatggttattctatccatttccagtaagctaacttctgaattcctgtgcatgtgtgtggcacccagtgatatcagtggaatgctgacatatatagtaaggcatgaacaggcattacttcatttcaacattttatatgagtctgctccaattaggggaaattagggttgttgctcttccttcttcaccattgttgatttttaaaaaattgtggcatatctttttcaaaaggtaaacaaaataatacattctaaatgtaaatgagaagctattatctgacattcatttattgagaaaacacatgccatttaaagagaatttttgttttgttttgtttatattacagaatatccaccagttttagcatcttactctattattgtatccattattttatcatctactcatcagaaaattcatttctatatcaagaagttctgataagatgaccaagagaaactccaaccatttcctggaatcattaatctgtgacactgtacaagagagttggtaaatatatgagaagtcccacacatcaacaagaaaaatgcaaacatcccactagaaaaaataggcaagaaatatgattagactttcacaaaagaggacatacatttcaatacacatataaaaagttttcaacctcattagtaataaaagtataacataattaaaacctcaatgagttattttagatgcatcagattggaaaaaaattaaaaatcaaagtactaagtgttggtaaacatgtggatgaaggggaatactcacattgtctgttggtagaactataagttgtaatagcctttggaaaagtgtggcattatctaaacattcatccatataccctatgacctaccaattcacttctaagtatacacactaaagaaatggttttacatgtttctaataccaaaaaaaatactgaaaacagcctaaatgttcatcgaaagaaaagtggctttatggacttacgaatctggcatataatcaccatgttggaaaaataacaaaatatagctactctcaacagtgtgaaagagtcttcaaaacttcatattgattgcaataaaaacacatagctgaaaaacacttagatgataatactgctattataaagtaccaaaccaagcaaaatcaaactatttaagaacaattttttaaacaaaacaataagagtgataaatataaaattcaagatagtgataccccttgaaaggaatgaggaggatgagacagagagagaacacacaggtagatgtcacagaacagtgaaggttttagatctttaagtgtgaaataggctcacaggtatatatgttttatgatttatagtataatttactcatactaaaacatttgaatacatgaacaataacagaactcagagcatcattttccttagactttttataaaatatgatcaataataatcttggagcagactttcccaggctcaacactattgacattttggctcagataattttttggggtgtggggctatcttgtgctttgcaggacatgtagcagcatccctagcctctacctgctagttgccaatagaaagctcccagatgtgacaatcaaaaatgtctccaaatatagaacataaaaaacctcagtgttgccactattagacgcactctaacatctacacattatattttatattagacatatttttaattgtcacaatgtctttgtattatacatgaaaaatgactcaaaagtctgcaaataccatgcacttttaatgccctaccatagttctgaccctgaaaaacatatatactccctcactctttcataaacttgcacagattattttatcaggaatagcttctgtctctgcttaggttactgccgtcctacattgttgcaggaagtcagggaccctgaacagagggaccggctggagccacggcagaggaacataaattgtgaagatttcatggacatttatcagttcccaaataatacttttataatttcttatgcctgtctttacttttatctcttaatcctgttatcttgatatgctgaggatgtacatcacctcaagaccactgtgataattgtgttaactgtacaaattgattgtaaagcatgtgtgtttgaacaatatgaaatcagtgcaccttgaaaaagaacagaataacagcaatttttagggaacaagagaagataaccacaaggtctgactaaccgcggggttgggcaaaaagagccatatttttcttcttgcagagagcctataaacagatgtgcaagtagggaagatattgctaaattcttttcctagcaagaaatattattattaataccctgggaaaggaatgcattcctggtgggaggtctataaatggctgctctgggaatatctgtcttatgcggttgagataaggactgagatacacgccctggtatcctgcagtaccctcaggcttactagggtggcgaaaaactccaccctggcaaatttgtggtcagactggttctctgctcttgaaccctgttttctgttatttaagatatttatcaagacaatacatgcactgctgaacatagaaccttatcagtagttctgcttttgccctttgccttgtgatctttgttggacccttatcagtagttctgcttttgccctttgtcctgttccctcagaagcatgtgatctttgttagactcttattagtagttctgctttttgccctttgaagcatgtgatctttgtacctactcctgttcttataccctctccccttttgaaaaccttaataaaaacttgctggcttggggctcaggtgggcatcacagtcctaccgataggtgatgtcacccctggcggcccatcggtaaaattcctctctttatactgtctctctttatttctcggccagccgacacttatggaaaatagaaagaacctacgttgaaatattgggggtgggttcccccaatactgcatagtctctttcctcctccatacatccatgtataactccctacagtcctccacttagcagtcatccacactcacaattttagtctctttcctcctctatgcacccacacataactccctacagtcctccactttgtactcatccacatgcttacaattttatacatatatacaaacagatatagatacatatatacacatacatttgcacactcatccatctggtttcttccagttaatttcctcagggctagtaccatgctttcttcaattttatattaccaaaccttagcttaatatctggcctcggtgagtaatcaatacatgcttgttgaatatatacggatgaataaatgaatgaattaactttggggcttttagggacctcaaaacaactaactagggttaactaaaaggttttggcattatttttgttcaaaaattaacattttgtttaagattttctttttatatttttgtaagtttattttcacatagacaaagttgtcaatcctagttcataagtcaaataaaaaaatcttcagtgactcattgaagagctatgtgtctctgttaggtcaaaatgtttatatttttattatgtaaatttccaaaaatatgcaagagttgagaggctagtactatgaatctatactcacctatcattcaaatctaaatgttatcaagattttgctctaattgctttccctatcctttttaactttttaaaaaatttgctgaattattaattcaaaagcccatttatctgaagtatttcattgctgcatacttaagtatgtaatgctaaaataatttaatatgttaagaatatattctcatagttacatatttaaaataagaaatatgtataatgagttgtttacagcatgtgtttaccctaaattcatgtacattgtacatggattttcacctttttatatttttacatttcatgaccaaagtaacaattactgattttctatttaaaaattggtatacaaaatccatactatcttctaaaatttcaacagtaatcttaaatcaggattttcaaacttcaaatagtaagcaatggaaaaatgagtcctcatagaaaagttgaaaccaaatgacttgaaatgaggtagcactcgtattcctccaggcctttgggtaaagatacgtgcacgcaatactgctttcgatttctacatagagctaagacaatctttctgaccgttctagagatgtagacacattcaacaaaattggagaggaaaagatgataggggcagttttttttaacccagtgtacaaaagagtatgtcaacagtttccaaatgtagtaatgtaatatcaaaagaagaaaaagtctcctttgaatttttcttttcaattacagaacatttactttataacaagattactaacactttaaagacatgtgcttctctctgggtgcggtggctcactactgtaatcccagcactttgggaggccgaggtgggcagatcacgaggtcaggagatggagaccatcttggctaacacggtgaaaccccgtctctactaaaaataggaaaaaattagcctggcgtggtggcgggcgcctgtagtcccagctactagggaggtagaggcaggagaatggcgtgaacccgggaggcggagcttgcagtgagccaagatcagaccactgtactccagcctgggtgacagagcgagactccgtctcaaaataaataaataaataaataaaaatggaaaaaaaaaagacttgtgcttttcatagaaacaattccatttaatagaaacaatttaactataagtgcaggaattattcattatagagaataggtgcagtcttgaatttcattaagtactgcttttcttactattatttattgtagaccaaaaatgcattttacccaaaaataaaaaataaaaattcgccctgacctgagatatagaagtaaatccatctaatgctagcttgctttctgcatcaaaaagttgaagtgtcccagacgtcaccagtacataatatatgcatgtaacacaactgcacttgtgccgctaaatctattttttaaatgttgaagtgaattgatgtgttacttttttcttttttctctctcccatttaaataggcttaaaaaataaagcacatggtagaagtcacagcatttaattgtctcaccataaagataaaagcatgtgttttattagataaaattgtcacatcctggattattcctactctctatgctattcatctacgactttctcccactagaggcaaacgtattttccatgtctacaatgaggcttaaagaagttgaggtaaagtgtgattgcgatttgcccatctcttgttacaaatcagcaaatcaatagactcctaatatttggagaaaaaaggtacctagaaatgctccagcttaattctttctaacaattggatctgtctggcatcttcatgatgccttctaatttttttctctgaacatactaatttattttatactttagcaaattctatttgctgttccttgattcaaattcatgctcggtagcatgggtcagctcattattatcctctcatccatggacatttaagaactaagaatgtggagaccttactaaggaatttccacacagagagggtctatgtcatacctccagcattttctctgacaacctctttttcaaactgtatactttttaacttctgtttttgctccatataattgcccttaatccaaattctaataaatgagaaagcactaactgcattttctctgttctctttccagtataacaggaaatgttcataaacatttatatgtttacattatatgtttatgaacatgttatacgtttttatatgttcagaaacttactgattttcatgtaggtaacatgaaattgttttttaaaaaggacattctccctccactgcctgcacttaccttcgctttttgagataactattgataatactttagcatatatctttggaaaatatgctttccaggttgccaacgactttgcatagatattacatatgtccatgcaaataacctgtattatcaacactaaatgcctactgctagtattagtcattcattcaatagctatatatggagccccttattaaatgccaggtcgttttaagagtcataatacattagtgaacaaaacagacaatgattcatgctatcatgtatgttacatttcgtgagaaaattgtgtttagaaaaagacctagacattgaggggccagggaacaagttgtcaattttaatgactatatcttgtttaatatagtataaacagtggaagcatttgtaggtacaagtagcaggcatgccataatggtgtagattgccatctggggatctcaagtaaattattataagatgcaaatttataatctgacttaggaattagtttactgctacagcttgaatgtttgtgtcctctccaaaacttacgttgaaacttaatccccagtgaaacagtattaagaggtctggtcattgggaggtcattaggtcatgagggttctgccctcatgaaaggattcgagccttacaaaagggctggaggagacaagtcaggccctttctggcccttttacctttccatcctcaccttggacttgtgaggacacagtgttcaaggcaccatctcagaagcaaagactaggatcttaccagacaccaaacctgccagagtttgatctttgacttccagcctccagaactaagaaacaaattcatgttctttataaattacccagtctcaggtattttgttatagcagcataaaccaattaagacatttacagagtttataaattactgaataaatgtaaggaatataatatattgaagatcaaaagtcttatgtcaaagtattttatttgaaaatgaatattctttttattactaaatttatgtaacaagtatgtttataatatttcttcaattaaatgctttggcattaaaatgaaccttactaatttttactgtacagataaaaggaatttatatgaatctataaaaatatataaaataaaaattattactattatgcttattaaaaataagtatcaacataaatattgatcaataattcaaactaattaacaaagcacatcaaaataggattttattttaatcaatgctcttattatggtaaaacaactaaaattaatttataaacgtttcagtgttcattatttccaatgtaaaaatattaaaggaaaaccagttgccaaagatcttttcattaatattttaaactaatattagttatttgaaacaaagcattagttaatatttgacaaggtattcaaaaaatcatttcacaggtttttataaattaaaacaatgaatttaactctatattatgtcagtaaagatgctaacaattacacaaagaaaatatattcctccttcctaccgattctttagaagaatgagattactattatcagcagcttatgtctcgacttcagcctaacagcaagctagctcaatgtgcatccctctaagaattgctctaagaattatacttggaagaaggtaggaagcaaacttcagttttattcctaggtataggacattagcactttgtccaaaatgtacacaataggcttccaaaatatttagcttctcatttgcacatatgcccaagaaaggctgtaaaacccagtacaatggcttttctatttgaacatgatccagaaggataaatgttccttctgtgtacccaggttataggaaacatttgaggaccttttccaattaagttatccattgatttgttgtgtaacatatattcctaataatagctttcataatatttgtaatttaacaatctgggagaggagatacaatgtagtaaacaatttcagtaaatggtggggcaaagccttgagataactagagatgtatatatattttttaaagacaaagattggaagaaatcaccaaagatgccatgttctgccacattgctgtgagcaatgattcaaataattatgtatgtgaaaaacataccagccttgatttttcaaaatgcacatttttcatattgtttgaatttacaggaactggcaccaaggttttactgaataattttgtggtctactgtgctactggtatttggtttcaaaagacaaatacaggggtgcttaaagagcatttatttagtaatttctctttaaaatttaaactgtgtcatttcaggaggaaaacagaaataaacatccatttttcaaaaagtacagttgtcaaattatgaaggaagaagaaaataatagacctattaatatcagtaaagatgtattccagatgcatttttaaaattatggttacatttcagatatgaaccaactattttagtatattttaataaaaatatggctaagaagcaatgctacaatgacaaaccacaataaaatgagataataaaactactttaacaacctaatattgaaagattaaaactcctaccttaagtgttattaggaataactaatagtgtgtcatgtcactacaaaaatcaaatttttaacaaatacaaatattttagtgaaaaaagaaatacaatataaatcaaatataagatttaaatttggctcccctttttgctttccctaaatggctaactctagctaactcatcaattgaaaatgatgttttttgacctttttcagtccatacatttcaaatagagtataattttaaccagctacattgttggctgaagattaaaaaccattttggtgttgtgttaattataaataaagcaccaataattggtgctcatctttgactggatcaattttgatgtagcaggaacagtattggacttggagctgagaacaagtccaaatctttgctaggacagttgctaactgcaggagttcaacaaagctacctgcttgagccttggtttcttctcccatagaaggatagctttaacaaatggtatttgacaagattgaaaggtgatatatacaaggctccagcattgtgcaaccataaaaagtcatggaatggaagtcatcttaaatgttttgttatatccatatttgttttaatattctaagtattattactgtcaggaaataacacttttaaaacaggagaaaaaatagtagtgtcagacatctcacagaagaaggtattcagatgacaaatgagcaaacgaaaagatgctcaatatcatctgtcactagggaaatgcaaactgaagcaataggatactgctacacacctcttagaatggccaaaatccagagtactgacaatatcaaatgctggtgaggatgtgaagcaacaggaactctaattcattgtcggtgggaaggcaaaatgagacagccactttggatgacaatttggcagttccttacaaaactaaacacattcttaccgtacaatccagcaattgcactccttggtatttacacaaaggaactgaaaatgtatatccacacaaaaccctgcacactgatgtttataggtgtattcagaattgctaaaacttggaaacaatcaaaatatccttcagtagatgagtggataaaataactatgctgcatcctgacaatagaatgttaccaaacaacagcaacaacaacaaacctatcaaggcatgaaaacacatggaggaatcttaagtgcatgtgaaagaagccaatctgaaaaggctacacactgtatgattccaactatatggcattttgggaaaggcaaaacaaagaacacaataaaaagatctatagttgccagggactagtggtgggcgggctggggatgaataaatggacaaaagaggacgtttagggaagtgaaaatactctatatgacactaacacaatggatatatgtcatcatgcatttgtccaaactcaccgaatatacaccagcaagagtaaaccctaatgtaaactatgaactttgggtgtcattgatgtgtcaatgtaggttcatcagttttaacaaatgtacaactctggtgaagaatattgataagacgggaggctacgcatgtgtaggggcggggagtatatgagaaatctccatatcttcctcttaattttgctgtgaacctaaaactgctcaaaacaaaacagttgttttataaaaacatagtggtgtcttgtccagctcatttaactgcttttcatgatgaaaactgataatgctaattattcttatccatagaaattcagagaaattttgtgtgattatatagaatttattattgccttgtggatagatatgttttgcatctatttgtaaattcatttcaaaattccttatttcctatgcatgtgtggttcttagaattctcctttgaactgattatatcatcttactagctttctctttagtaagctaaataaattttgataaatgtttacttaatatttatatgagatgatattttagtcttaaaaatcctttaaaaatagtctccatttttaataaactgtgtgatctaggtgccaatgaactttgccatcagaaaataatttttcagaagattgctttgagtataggttatcatacttatcatactttttaaactttcatgctaaatatctttataaagtacgtaacagattttcaaacatatggattggggtaaacttattttgtcaattatataacactgctttccaaagcatagtttaaaaaaatcataaactatgattcaatttcctggaatttactaatttagaaatcctgaagacattataatatgtgatcatggaaatgttagtgccctttttttgcatccattaatagtgctaagaaagtacaaatgttctaacaggatttaaaaaaccaacaggttttcaggaatttgtatttatcaaattgtgcacaatattgccaatgtgaaaataagttaatgagttgagaattagtcacggtttttcaacatgaaggatatgaaaacgcaccttgatctctataatcatctgttttaagtgagatttaattttccacaaaataatacttgagtttattcaagtaaaaaattattcatctttctattctccatgtgcgataaaatgtttcccatagggttctcctgattgccttagaaatctgactacctatcttccttccaaaataatttcactgtagacttttcaggtttttgcaaacacttcaattttctctttcctgttttttgcctgcctcctaatccctaatcatattctttcctctggcagaaaactttgttcttaacaccctgccctcaaggaatcaatggctgctttgagttaagctgctttttttaagcatctgcccttttcaggagtgccctattacataatctcatgcgctctcatagtaaccagctgatagcattttcaattcactttgaaaattgtatgtcaatcttacctgtagctgcatgatgacaaactgactttaaaagttagtctattcatttgaagtaagtatttcaacaatatgctaatgaaaatgatattttaagatatccttttactcacatcaatagcatcactaattttatagttaacacatagaaatcttgaaaatcagactttttagcttagatgagtgtgaaagtatactacataatatctaaagattgagttttcaaagagtttttggccacagaagcccttttgaaagaaaatcagacacgaaatccccactaaattcactattgatttggagggcgcatgtattcaatggcttatatcagattcttatgtacacaatatgtaaaatacaatgccaaaagataacccagcatattcataagtctgacattttagttcaattggatacgtatatttgaaatgaaaacctttcaaaggaaacatttgaaaaggatttctatttttttaaatctaaaagcacagagttttcttaaccttaatttaaaatggaaaactttaccttgaaggatgatttttggttacagagatacttttgcatttttttgtgatttttttcagttgagagtttcaacttgaaaatagaaaaaggcctgatattttccaaaactgactataaactgcatttgtataatgtaattgagagtcaatatcttttcccaccttgctctggctcctgccaagaggcactcagaatcccagatatactttcagggctacaggtagtggcagccataggaaggctttctgaacttcctttttatttatttatttatttatttatttatttatttatttattttcagttgtatgtgtgatggaaccactatatcaagagcgctatcttctaaagtaatatcctcccctagctattccctgaaattggcagacatggacagttaaagcaggatatctttatcccagagaaactttcttagacagcctgttcctctgtggcagaggaaatttggttttaactgaacctggcttctaagacctttacaagtggctgtttgcaaattattccagggaaataagtctttaagtcctagcctgggctttttagtagcgcgaagaagaatcatatccaatctatctccaaaaaaggagagagaggtaagagttattgtgcagatactgaaaaatctcatcagaatcccaagaggaaacaaaataaagctaccttcagtggcacagggaagtcatctgaaacagaccagttgccttcaaggatgttgttgtatcctctcagctctattctcctttctactaccgactcccttgtttactcataattttcactgtctcataattttggctgaatccatttactcattcacttcattgttccagtgtctactgtagacaggcatgctctgtttctgcctctcagttcagattcctgagactcaggatctgatcattggccagcctgtggattgagtaaactatgcaatcaagaaggttatcacagatacagcgttgatcaacacagacaaactctctggcctcatgcagcttatggtgtcatgattatcacctgtaatagaacatggtcacttaaaggcagaaggactgtggctatgaatcagctagagaaatagcattcaacaaaatacatttctctgtagcttattattttgccattgctttacctctgccactactgttagtattattgcttttattgttctgatgaccttttatactcaaatgctgctacttttaaccagacatactccatgttaatgcctctcacaggtggtctctggaccagcaacagcagcagcagcagcagcagctagggatttattagaaatgcaagttttagagttttatcccagacctacttaatcagaaactttggagtggggcccagcatgctgggttgtatcaatattctgatgcatgccaaaggtgagagcccctgctcttatgccttcaatccaaatatgttagtctgcctttattccacctgcctcctagaaacttaaatgagttattttttaaatttttcataaatattgagtcatatgaaaatatatggctgttaaaaatgattctctcctctccatttagccttcctttctctaaacttagactctttccattaatcttcctcctgcccataggagtcaaagctgttgatccactccaatttaatacctgtctgaaatggtgcctacaattcacttcaccaaaaaataaatataattaatcaattttaaattttatatgaaaacatttcaactaaattgaccatttctccatttctcagccagttcaactgattgtgcatgcagatagttgccaaataagagctgtcaaacttcctagaattccatatagaagccgataatggaaatgtaataaaatagaggattaaaatattgtatccaaatgggcagtgaactcactttctctaaaaagccattattttacatagtctttagaaatatattttgcaaataaaatcattttttaatattaagcataatttgcaggacaactgttctgcaagaaattaaaaacatgaaaccctgtccctattaaaaacacaaaaattagccaggcttggtagcacgtgcctgttagcccagctactcaggaggctgagacaggagaatcacttgaacttgggaggttgaaggttgcagtgaactgagatcatgtcattgcactccagccaaggtgacagagtgagagtctgtatcaaaaaagaaaaaaaaaatcttgaaaacacattccttgaatgccatggccaagttttactgtgtcagtgttctctattttgtactgttgttagtatattttaaaaagttttccatcaatacataaccctaatctttactaaaatattttagtaaacattttgctctttagtcactgttgttgctaacagttaaattaatcatttacacaatcactctttctcccaattagctgtcagatacatgggagtagaaacttatctgtttttttaacttctataactttaacacctgacttggtatctgacttacatttgttgttcaaaatatgtgttcaggaatgttgtaataggaaagatgacaattacatggttggctaaaaaaaggatacaaataattttttaaagaagaaagtaatgatgggttttaaaagttttatggaaggagatagagacatgaaaaaccctccaaaaaatcagtgaatccaggtgctggttttttgaaaaaattaacaaaataggtagaccactagccagactaataaagaagaaaagagagaagaatcaaacagacacaataaaaaatgataaaggggatatcaccactgatcccacagaaatacaaactaccatcagagaatactataaacacctctatgcaaataaactagaaaatctagaataaatggataaattcctagacacatacaccgtcccaagactaaaccaagaagaagttgaagataaagaaagataaagaaaatgcggtacatatacaccatggaatactatgcagccataaaaaacaatgagatcatgttctttgcagggacacggatgaagctagaagccatcatcctagcaaactaacacagaaacagaaaaccaaacactgcatgttctcactcataagtaggagttgaacaatgagaacacgtggacacagggaggggaacaacacacaccagggcctattgagggatggggaacaaggggagggaacttggaggatgggtcaataggtgcaagaaaccaccatggcacacgtatacctatggaacaaacctgcacattctgcacatatatcctggaacttaaaaaccagaacttaaaaagaaaataaaaagtattatgcattcagaatatatccttgaattaatagcaaatgtatgaagatttaatgtgctttctgatcttttatcaatttgtagatggagtattcagaacatatatttaatatacaaacttaaaaattgttttttagaagggacttgagggtgtttctgctacagcttccttgaccaaaggctacagaataactacattgtccagaaaaaacagctatacgtgttttttccagtttctaagggtgaaaattttatgaccttctttggaattcttgcattttatcttattggcaaaggagttcctacttttgccatcacaagacagcttcttaatttatttcttttaaaaagtccttttaatagaattgtaaatcttaccatcattcaattttacaacacatataaaaattgtatataatttatacacttccttacttaccaatgtttccactctttttttttttttttttttgagatggagtctcactctgttgcccaggctggagtgcagtggcactatgtgggctcactgccaatctccgcctcctgggttcatgccattctcctgcctcagcctcctgagtagctgtgactacaggcggccgtcaccacacctggctattttttttttttttttgtacttttagtagagacggggttttaccgtgctggtcaggattgtctcgatctcctgaccttgtgatctgcctgcttcggcctcccagagtgctgggattacaggcgtgagccactgcacccagcccaatgtttccattcttttgcactaaacatatcaaactcttttaaccctttctcgtatgctgttattgcaaccttataatcaatgattgactcttggatttgctcatgttttctattttcatatgtgagattactatttcagagtagttcacatattttaactcttggccccattatcatatacaatttttaatatgacctaatatggtatttggctttttttccctccaagagtagtgaaatacttgtttactttcagcctgtaggtccaaaacaatctcatgccatgaaacctaaacggtaatctcctagtctatgttgttggtgttatttgtcccaacatacttacgttttctaaattttaacatgttttgaaaaattacttttccccttaagaacataatctggaagctaaagaatgatatccaccaacatgaaaccacatgaaagtttaaaacccactgccagagcaaacacacaaataagaaatagaaaggactcaaatattaccactacatgaaaccaccaaaccgcaatgataagaagagagaaagaaggaacaaaggacatataaatcaaccaaaaatcaattcataaaatgacaagaataaaccctcacatatcagtaataagctttaatgtaaacatacaagttttccacctaaaatatataaattgtatgagtgaaagaagaacgactgccttcaagcaatttacttcatctctccagatacacatagacaaaaagcaaaaggatagaaacagaaattccatacaaacagaaacaagaagcaaacaagggtagctttgcttactcagataaagcagactttacgtcagaaacagtaaaaatagatgaagaaagccattatatagtgacaaaggaatcaattcagctagaggatgtaacaatcctaaacgtatatgtgcccaacggtagaacacctagatatataaaacaaatattagatgaagggagagatagactctaatacaataaactttggggacttcaacacctcactctcaaccttagacagactatttagacagaaaattaacaattaactttggattaaaactgtacttttaaccaaatgaaccaaaccgacattcacagatatttcatccaacagctacaaaatatacattcttcctatcagcacatgaaacattccacaggataggccatatgttagaacacagagcaagtttcaacaaattttcttaaaattggaatcatatcaagtatcttctgagatcaaaatggaataacaccagaagtcagtaacaagaagaactttgcaagttttacaaatacatggaaattaaacgacatgctcctgaatgaccattgagtcaaagaaaaaacttaaaaaatttttttaaatattattgaagcaaatggatcctgaaacataatatacaaaaacctgtgggataaagcaaaaccagtgctgagagcagtttataacaataaaagtctacatcaaaaaagtacaacgattttgaataaacaatctaacaatgcacctcaaagaactaaaaaagcaatattaaaccaaacctcaaattagaaggaaagaaataataaagatcagagcagaactaaacaaaatagagagtaaaatatacaaagaaaataaaaagttgttttttgaaaggataaacaaaattgataaactgctagtctaatcaagaaaaaaaaactccaataaataaaatagacaacaataaagttacactgcaacttatacaactgaaatacagaagatcataagggattattatgagcaactatatactaacaaactggaaacctagaagaaatagataaattcctggatacatacaatctaccaagattgaatcaggatgaaacagtaaatctgaaaagaccaataaagagcagtaagactgaataagtaataaaacatctgccaacaaagaaaagttgaggacttaatggctccactgccaaattctatcaaatgggtaaagaactaacccatatttccctaaactattctgaaacattgaagaggaaggtattctccctaactcattctaagaggccaacatcaccctgataacaaaaccagcaaagagtcgacaacaacaaaaatccgtaggccaatattcctgatgaacgtagatacaaaaactctcaacaaaacactagaaaaatgaatccagcagcaaataaaaaatatagtacaccatgatcaaacatgatttatcccaaggatgcaaggatggattaacatatgcaaaccaataatcataatacataacatcggtagaatgaagcacaaaagccatgctcatctcagtagacacagcagaagcatttaataagattcaacatttctttgtgataaatactctcaaaaactaagcaaagaagaaatatgcctcaacataataaagtcacatcatgacaaatccacagctaatatcttacagaatgagaaaaaagctgaaaacctttttctctaagaactggaacaaggcaaggatgccctcttttactcttcctagtcaacatagtactaaaagtcctagtcagagcaatagacaagaggacaaaaagaacaacaaaagggatctagattggaaaaaaggaagtcacgttattcttctttgctgttgatatgatcttatatctagaataacctaatatttcaccaaaaaacctcctagatctgaaaaatgaattcagtaaaattgcaagatatgaaattaacaaactattattaaagtagtagcatttctatataccaataatgagctaactgtgggagaaatcaagaaggcaatccaatttgcaatagctacaaaaaaaaaaaaatcttataaataaatttaacctaaggggtaaaagatctctacaaggaaaattacaaaacactgatgaaagaaattgaagaggatacaaacaaatggaaagatatcccaagctcattgataacacactcaagaacatactcatcccatagacaagacaatataaagcaattacataattaagtccacaaaacaaccagctaacaacaaaatgacaggatcaaaatttcacatatcaatactaaaatattaaatggtctaaaagctccacttaaaaggtatagagtggcaaactggattaaaaaacaagacccaactctctactatcttcaagagacccatctcacatgtaacaatacccacaagctcaaagtaaagggacagagaaagatataccagataaacagaaaacaaaagagagcaagagtcattattcttataacagataaagtagatgttaaccaacaacaataagaaataacaaaaaaggtcattgcataacaattaaggattcaataaacacgaatacataactcttctaaacgtatatccacccacgatcggagcactgagattcataaaacaagttctccttgactatgacagccacacaataatagtgggagacttcaacaccccagtgacagcgttaaacagatcatagagacagaaaactaacaaagacattctggacttaaactcaatgcttgacacactggacctaaaagacatctacagaatactccacctaacaaccacagagtataaattattctcacccatacatggaacatattctaagatcaaccacattcttggtcaagaagcaagtcttaataaaatcaaaaaatcaaaaccatagcaagcatactcttggacaacagtgcaataaaaatagaaaacaatacaaaaagatttttcacaactacacaaaaacatggaaacttaaaaatttactcctgaataaatcttgggtcaacaagaaaactaaggcagaaatcaaaaaattctttgaaattaataaaaataaagacacagcttaccaatatatttgggatgcagctaacgcagcgttaagaagaaagttcatagtgcaaaataccttcatcaagaagttagaggccgggcgcggtggctcacgcctgtaatcccagcactttgggaggccgaggcgggcggatcacgaggtcaggagatcgagaccatcccggctaaaacggtgaaaccccgtctctactaaaaatacaaaaaattagccgggcgtagtggcgggcgcctgtagtcccagctacttgggaggctgaggcaggagaatggcgtgaacccaggaggcggagcttgcagtgagccgagatcccgccactgcactccagcctgggcgacagagcgagactccgtctcaaaaaaaaaaaaaaaaaaaagaagttagaaaggtctcagactaatgatctaacatcacacctagaggaactaggaaaaaaattagaaaccaagcccgaagttagcagaagaaaataaataactaaaatcagaggagaactggaaaaaaatgagatgcagaagtccatacaaaagaccaatgaaaccaataattagttcttttaattggttctttgaaagaattaacaatattgatagactggtggctagattatcaaagacaaaaaaaaaagaagatccaaataagtgcaatcagaaatgataaaaagccattacaactgagcccacagaaatttaaaaaaagatcctcagagactattataaatacctctatgcacacaaattagaaaatctagaggaaatgaataaattcctggaaacacacaacctcctggttgtgtgaaccagggatggaccaagaagaaagtggaaacctgaaaagaccaataacaagttgaaatggaatctgtaataaaatcccaccaaaaaaaaaaaaggaaagaaagaaaagaaaaaatcctggtcagatggatttgcagccaaattctaacagatatacaaacaacttataccaattctactgaaactattccaaaaagttgagcaggggctcctctctaactcattccacaaagccagcatcattctgatgccaaaatctgccagagagacaatgaaaaaagaaaacttcaggcccatatccctgatgagcatatagatataaaaacttcaacaaaatactagcaaaccaaatccagcagcacatcaaaaagttaattcataatgatcaagtaggctttattcctgggatacaagtttggttaaatgtacacaaatcagtaaatattattcaccacccaaacagagttggtaacaaaaccatatgatcatcttcacaggtgtgaaaaaagtctttgataaaatccaacattcttgcatgataaaaaccctcaacaaaccaggcagcaagaaaacatacctcaaaaataataagagcaatctatgacaaacccacagccaacatcatactgaatgagcaaaggctggaactattccccttgaaaactggaacaagacaaggatgcccactctcaccactcctattcaacatagtactggaagtgctagccagaggaatcaggcaagagaaagaaataaaaggcgtccaaagaggaaaagaagaattcaaattatctctctttgctgacagtatgaatctttacatagaaaaccctgaagactccaccaaaaggctcctagaactagtaaatgacttcagtaaagtttcagggtacaaaatcaatgtataaacatcagtagcatttttatgcaccaaaaacattctagatgagagccaatcaagaacacaatcccacttacagtatccacaaaaaaaatgaaatacttaggaatacatctaactaaggaggtgaaagatctttattatgagaattataaaacacctctcaaagaagttagagacaacataagtaaatggaaaaatattctatgttcatagataggaagaatcaatattgttaaaatggccaaactgcccaaagcaatttacagaatcaatgttatcctgatcaaaataccaacataatttttttttgcagaagtaggaaaaaattctaaaattcatattgaaccaaaaaaagtgtatgagtagccaaagcaatccaaagcaaaaagaagaaagctgtaggcatcacattaccagacttcaaactgtaccataaggctacagtaaccaaaacatcatggtcctggtacaaaaacggatacactgtaatcccagcactttgggaggccaaggcgggtggatcaggaggtcaagagatcgagaccatcctggccaacatggtgaaaccccgtctctactaaaaatacaaaaattagccaggcatggtggcagccgcttgtagtcccagctacttgggagtctgagacaggagaatcgcttgaacccaggaggcagaggttgcagtgagctgagatcacgccactgcactccagcctggagatggagcgagactccatctcaaaacaaacaaaacaaaacaaaaaaacaaaaaaaacagatacatagactaatggaacagaataaagaacccagaaaaaatgctgaacagctacaaccatctggtctttgacaaagttgacaaaaataagcaacggggaaaggatttcctattcaataaatagtgctagaataactggctagcacacgcagaataaaactggacatctattttttatcatatacaagaattaactcaagatagattaaagatttaaatgtaagacctcaaagtattaaattactagaaaaaacaaaaaaaacaaaacacggaaatacccttcttgatatcaggtttggtaaagaatttatggctaggtactcaaaagtgatttcaagagaaacaaaaattgacaagcgagactgaatcaaactaaagaacttctgctctgcaaaataaattatccatagagtaaacatacagcctacagcctacagacagcctacagacagaaaatattcacaagctatgcatccaacaaaggtctgatatccagaatctataaggaacttaaatcaacaagcaaaaaacaaataatccaattaaaaatagataaaatacataaacagtgtcattgtcatttttattgtcatttttattttattattttatttattatgattttgtcatttttattgtcttcagtattttttcaactatcctaatattgaaattcatattttcatacactatcatatttaataaaattgaaatttataccctatgacaaagtgtatgtaaatatatacaaatgtataatttgtcttaaaaattttcataggaaatattgatattgtccagcaaagtttgcaattccggaaatggaggaaaagaatcttgtttgtttctatcactattctgaaattatctggtcagttataaaaataacaggaggataaaggcatttttattgaagcataaataataaacatctttgtaattttcttcattatttgcaattaaatcttcaaaattagggcatttcagattacttaatatctattgtgtaagtttccttgccttacctttttagggtaactactaatcataaatagagaaaggtctacatgtagacgattcatggtattctttatagtgataataaaaataactgcttattatatatcagatactatactcttcttggatattcatttttatcagaaaaatatttaattctttataatactattttctttagcattttatataataaaataattttttaaagctctaattaatttattactagctactgaaaatcatttataaaaatattaatattttgagaaaggcattaaaaatggactaaaatgtaaatttcaaaaatatgctctctttaatctgtgtaagtgcttaattttttatatgcaaatattaacactgcaatttgatcttcaaatactatccttgactttttctcccaattcttcactaaatatgaatgcaaaccaaatcctgaaggatttgcattaaaaaatcttaatgcagaattttcatcactcagggctaattctgtctgaaggacatctcaagtttgtttccagcacatttaaaattgaagaacaaagtgatagatagtcaaatgccattactagagtttggaaaatattgaatttgaattttttccttgtagtataaatgagaatgggtaaaagaaaatgatatggcatagagccaggagagagaaatctttgttatgaagaagagattccaaagacaaaaatatacacaatgagtgaggccatacactgagaaaaagagaggaggagaagtaaagtttaaaaaaaaaaaaagagagagagagactaaggtagattgtttgcaaaatagccacaataattcagttcctggtatctgtacttttgggtactctttacccacataaacttgggtttagccatgtgattttctttgctcaatgagacaaaagcaaacactagaggaagagattttaaccatgtctgctcttggggtccccctttctttctgtgattataatccttagtgaccactaagtgaacaagactgtgctaatctgagggagaatgaggggccatgtggagaactgaggtgcttcagccaataatccccaattatctgccaacagctagacacatatgtgaggccattctagattgtccaacagccagctgaccacagtcacatgggagaggccagcagagatcacccaccagaagtactgcctgttcaaccacagaaccacgaactaaagtgactgaggtgttttcaatcactaagttttgggatagtttgatatagaacataaattaatggatacaatgaacaataaatggaaatgagagactgtctcttttgatgagaaatcaaacaagttaagcttatttatttttctacttgctggtttagtttagatgttggcttcagaattggtgactatttcactacactttgaaatatgcattagtttaataagttcaattcatcataagtttgtttttaccctgaaaattatatttgttgaaaattctaaaaataacagcacactcccaccacctacccccagttgaaggagggtagcaggatggacggagaaacatcttgaaattgctctttagatagaaatagatcacagtgttattacctgcatacaagatagagtcaaattaaagattaggcattatattctatgactatgagattctcagtacaaggtatcttttagagacaaaagatgaggtaatttttatcatgtaaatattatttaatagttttacttacatgttattggatatactttatttgattctacattaaattcaacaggtatttattaaagtcattttaatgtgcttgacattttactaacatttacgttttctacccattttgagttttaatatacaaagctctcacaaaaaaactatttgtttatttttatgtcagccccgggcctcataattatctggaacagctgtaacagatctgctttcactggtcattaaatcgtattgtaagctgtggatcccttctttctgaacaccaaaggtctgtaccatctcttttctttggtttttctagcttttgattaattgaaaaagaaaatatatcttaacatttttattgtgtttataaggaaaaataccaattcataactcctttttggaaggacagagatatatatactgtgaccgtcagagtataattgcatcaaacctataagcaactagttaagttggcaatttaaaacacagtaaaggtttgttaatgtagcactcaggtggtgaagcatttattgaattgcatagttttaagttttcaaacgatgtattgttacattagtttacaaagaaaacagaaattcaagtgaatgatgtcatatgactatcaaattatatgtattggcatatatacagaggcatataaatctattagaaagtataaaagttattttaattgtaagaattatacaaatgacaactatccaaaggtttgtttctcatagccggcatcttgttaaaataatttgaaatgtttgttggcatatgtgcaataccttgctcaattatttttcaaatttagcagtactctttggaagcttatctatcaacggagttaagacagttaatatttatcaaccttttattggaaaatttcaaacatgtaaatattgagtaactcatatgctagttacaatgaaggatacggaatgtaggctttaaagtgggcagcaataagccaagcgaaaattggattttctgtttctaaaaagacttcatgcttatatatcacaggatatataagcatggaatgactacaacttaccaagaattttctaattcttgatctttttctataagtcagtttgccatgcaaatgtatgtttttttcaatatccaagatgaatgtgtaaaataggctatgtcgaaagagcatgattcatctatcgatctatctctctatatataatttttattttattttttgagacggagtctcactctgttgtccaggctggagtgcagtggtgcagtcttggctcactgcaacccccacctcctggattcaagcgattctcgtgcctcagcctcccgagtagctgggattacagtcacgtgccaccacgccaggctaattttttgcatttttagtagagatggggtttcgccatgttgggcaggctggtctcaaaactcctgagtgatccacttgccttggcctcccaaagtgctgagattacaggtgcaagctaccatgcccagccaactcatctatatttaatagtaattatcaataactaaaattccaaataatttccatcgtggtaataagtttgctttatatcatttcaatatttgtaaattggattcaacattttctcccttatgcaatgtaagatttatgttcacttcacttatatatattgtccacctaatcactattcaaaacaccagagttagatattgatttagatataaatatgataactaaaatttttatgtaaacatttgtatcatcagataatgatagatatacctgtatgacagattagagataaacagatagatagatagacagatcgaccaattgatctatactgctccttttgtccaaggagaccaaaaatttggacagttttgaaaagcgtatgttgcatgttttcccttcgttttgaaagtttatgctttcaataatcattactcttttaactgaagttagaatttgaaaaataggatgtaagtaacttaccaagactcaaaatgctaccagagggcataatgtaatctccaaggcaagttctagtggtcataaaagtcacaaaagtcttgcgagtagccatttcatcaatagtgcatttatttattttacaggtaggagaaatcgttgtaatattatattttgtctgtatattttgtaatgttttgcttaaatcaattatattctaataatcctctaatataccaaactggatgcaattgatattgacaataaagtgttggcaaattctccattcatttttcaaacacagatgaaatgtgagatagatgttagaggttttaaagcattaataaaggagaattggctctaggagagagaatgtaaagtgattttttattattattacaaagtcataggaatatttctcaattcagaatattgaaagtaatttaatatattatttttcatagttatcataaatataaataatctcataacatttatatttaacaatagcaaaaatgtcttcatttacaattttatcttgactttgatatgactcttttttacctttaaataaagtcatctaaaacacattcattttgaggaaacgtgtaatctaaatagcttccagaatttaaaaagtagctaaacattaactcgtattgttagcatatgtaagaaaaaatattaccttagaatttctaccttcctaggatttggtgagagaatatatttacatccagtaatgactgtgagagttttctcattaaaaaaaaacaggattaaatgataaaatagtttcatttaccaccagggagttttcttagatttctgatatttaatttggcttaatggctatattgtgttaacattgctatgccaatgaatttttatactattgtagttaataaaagatagaatcctcccagcactttgggaggccgtggtgggtggatcacttgatatcaggagttcgagaccagcctggctaacatggcgaaacccacctctaataaaaatacaaaaattagccaggtatggtggcagatgcctgtaatcccagctaatcgggaggctgaggtaggagaatagcttgaactcaggaggcggaggttgcagtgagctaagatcgtgcttctacactccagcctaggcaacagagtgagactccgtctcaacaaaaaagatagaatccgtaatttggtctattaaaaggcactgaccaacacagaaaattgttttatctgttcttaaaaattcataaaacaaatggtagaaaaactggttataaaaaaaagaaggtagaaaatatttattttcttatactgcacaactactcccaaacaaactccctctcttagtagaatcagttgtaactaagaagagaaaaccaagaaatcaaggacttactataataaaaatctgatgacttcaaaatagaaatgattatgcctaaatttgattaaatatagacataacaaaagagcttattcaaatattggccctttagacttggagctttgcaagtctttgaataataaaaattacagaagttctggaatcagttagtaccatgatttgaatcaatcagaaatatatagaaattaaattaataactatcgatattatagtatttaatataagaagagcaaagtgtggccatgctttattaagatgtatagatttcaaaagagagaacatgttatcctattataaagtttaactatttgcagatacatgttgaattgagtagttatgttaggtttcaaaaatgacacattatttaattaattgcatttaaatctatcagggcagaaaacttttttaaaataaaaatgattggttatttattatgcataaactaggtgttatgtaataaaccatgtaagtgcaatctattagtacaattaagatgccttagtgtgacaatctcattttggattgattagcagaacagcttcaggtattcttttttaaaaatttcaatctatttcaaattcaaaagtgcttaaatttaaaaaagtcttagagaaatttgttttaaaggaatcattgtctatcaaataagtagaatttagggttgtatagctgttcagtatattctgaaataaactaagtcaaattatgaataaaattggcccactgacattggcacatatttctgcatttcacttgtagcaagacaaccattggtacatggtaaaaagtaaggaaaaagtaaatgttattagcaatgctaggtcaatgcaaaatggcttgtaccaggtcccagttaattgacataatgtagatttgaatgaaaactctagaaacaaatttttaatttgacaattattctttttctttcttcattcacttttactatagcaaggttaaaatctcagaaatctcagaagtcactactaaataatttatacgtgtaacccaaaaccacctgtacctcaaaaactactgaatttttttaattggctagctagaaaagtagttaatactagcccataaatctggcttcttgatgtttgtttttggaaaattagcaatgaatgaacttcctgagagaatgagtcattcttgggaacatggcaaatgttcttgcttttgctcagtttagtcaacgaaagcatactctactctgtgcctaaagcagcaatcaatttaattttatgtgtcaattccattagaaaagcgaacaaaacaaaaataaaaaacatgtacaccgacaactatctgaactttgataagataatgaagtcgatgacatcttaaatctctttatccaaaatgatttgtaaaacttgataggaatacttacaaatagaaagaatattctaatgtttctattgcttacttttaaaatgtttggattgcctgtaagttattaatttctctcaaatttaccttccttgaattactctcttctactacaaactaagtaatatagtcaaaactgacctcatcttctccatcaccttcaccttacctaaaatgctagaacctatagaatcattctagatggcttcctttcaatcatttccttcatttctattctctcaacaaatgctgtatgctctggtcatttactgtctatcatgtgcatccctacctctttactttcactgcctattcctaaattcagaattcagactatgatctttgcttggttgtaacttagtgattattttccacttgtctagaatgcactttccaactctccttcatatagctaattccaactcatcaagcatggttcataaaacatctccaagaagtcctccttgacttttccacgtgataaatttcttttccatgcttccttaatcctctatatcatagtacttatgccattgaaccgtaactgtcaatttatataaccctctcctatttgccttgaaggtagatagggtctatattattttaattttaacttcttttccaaacaaatataaggcactaaatgctgtgaatatttgttcaataaatacagttaccaaaaaatttatttaagattatcatagctattaatatgttgaattctgtgtcaaaaatgatattagatctttattattgcagttcattatattccctagatgatgaactaggactttaaaaacaagggtaaattaattttcagtagtctaaagtttcataaattaagcctcataaatgtctactttgaaatgggcttattatcctaggctgtcaaaagtaacatcagaacacaaaagtcattctatatggtaagtgaaattaagacataacttcacaagattcagcatctgtctagggatacatatcatagctaatatccttaactcctcataggtctttaaaaataaaactcaacacgtatttaccaaatacctgccctttgtgtatcattccatcagtaaaaattacaaaccattttttaaatggtccacacacaattgcagcagatcgctgcactgcccatagtaatatttacagccatggatctttaattatttttcttgtaatttaaacttctgtgttgcaagaacaaggaagtgaactctatcaattttcccgtttgaaggaccagtcctaatgaagaataatactactgggtttttaattacacatactttttaaacattttaatggtaggtttatttaactggtatatagcattttaaacagtgtacatttttaaactactatttgttggtgtttccaatttaataaattgaattttgcaccatggaaaagcaattttgcaaacatcagtagcttaaatcaaaaataaatatggtataaaacgacatcacataacttcaaaatcgctgcaagtgataatttcaatctggaatttgatcaaagctattagctaataaattgatcattaaactgctactggagtcagagtatcagaaaatggactaaaactccctgtgaaacaatctgtcagagtgtacagtcaatgttttcatttcattcagaagcagaattttttctgccaatcaaggataatggttggagggctttttggagcaataggaaatcctgtcaccattttcacaagtggaaagtaattgaattaacctcaaaatactaacattattcttcctcatgtgctgctgaaagaaatagaattacacttctaaagaatactgaagtgtttaaggcaggcttaatgagggatcataactctacactaacccttaactcccaagtcacggggagaatattgcattctattgcagtctcaaatgcaagcatttttcccatatataaaaggaagaaagactataataaactagtaattttatttatatttaaataaaatttaaatgtaaaaataaaattacattaaaacaaatacatctaaataaaaataaatagtaatatatacatataaataataaactaataaaagcttcatttatgattaatgaactaataaaatagcagaaaattaaaatttaatttttatttttaaaataacatttagattaaaagcccatactcctaataaacaatggaatttgaaacttgtcacgtgagtggccctaagacacaaattacagctctgttttagactcctcaagacaataagatggtaaaccactcttttcctctgtttgaatgaagttctgagaatcaggagccattccattctgtagacagttgcacctctaatcaagtgttcaaggtggaaagctaaaatccctgggataaatggctgatgaaagcaaaacttcccaacagcacagaccaggaaaataatgaccaatattttatcaaaataatttaatatctatttggattggcagatgccggaggaattaaattgtccagttataggaattatggctaatctctcctttgaatttttttagataaattttcttctttacataacaataaaacaaatatttcaaatattcatttatatgttatatatacatatatacacatatacaaacacaaatacacatataaatatgaaaacataagtaatgaaaaatatttcatccactttttgtgtatatgtatgtaaatattttgtgtatatgtatgtatatagacatatgtttatacaaacaaaatttaaaatgtgctttactttttgtggctgtttccttgtctggattaaccagttatattattatagtaacattacttttctgaatttgatataaaaattctgataacactaaaattacttattgacaggtattctcacaagtctctgcccatttattagtgaattgtttaatcaagtgatatagaccttttgtgtaatatttatgtaggtctaacatctttctaagactacatggagttaaactgatgtacctttagaaacctttgactagtattttttaagttgatacataatgattgtacatatttatggggtacagtgtgatattttgatacatatatgcattgtgtaatgatcaaattaggataattagcattttcatcatttgaaacacttatcatgtctttccattggggactggtatctttcaagatgtgagtggatgttgagaaagggcttgtctttgaaggaggagaagcagtatcaaaattaactgtgaatccatccctgtgcaagagcaaacatagctgggggcattctcctgtagcagattctgctttttatctgcttaccattcgttcacttctttcttcttgtccttccccatatttatttggctagccactcgattccatccccatctcaggagctaaatatctactgttctcacccaattataacaaccccattttcttgtcagtaactggttagatgttgacatgtgacacaattctgaactggttagatgttgacatgtgaaattttgtctttcatgtgatatgttaaagaaatttggctggaggattccttgaaaatttccctcattattaaaaagatacattcaagaagagataatttctactttcaaaaatgttcattatgcctgcgtggttgagttgtgatgcttgatgctgccacagccgacctgtgactaggaggagtctgaggagtgagcttaggataggcattgggaaatcagaaagaacttgagtcctcattgacgttgttgagcctacacagctatgtgtacaaagagggactagactcttgtactctggagcctcctatatgtggatttgtgtgaaattaggtaataaatgttcttgttttatccagttgaggtagtgttttattatttgcatgttacagcattctaagttctactccaggtaagaaggggattacaatcaaagaaaattactatatattaaccataaaaaacaatgttactaatatacatgtaataaaactttttttcatatgttctttctcacagctataataataaacattttacaaatagggggagtgagtatctcggaaggaagttacttgcccaagttacgcagctaatgaatgccaaagaccagactcaaaagttgtgcactctgtctattgtctaacatccataagctgaccttgtgggatctgtagaacccaatctttgataaatttatttccaaattaatgattcattgacagatttataaaatgagtaggactcgaacactaatttctaaaaaataccactggtagaaaattaaaatgtgtattatttctcagtcagtttgtatactggaaaattttaataggtggtgttggatgctgtctcaggaagcagttgaagcaccagctcagaacgttccaaacagttcaggcatataacacaaagcaagctgctctacgccttccccacttttctcctgccaatgtcactccccagagtagctacaggtagcagttcctgtaatattgacaatagatgtaaactttaaaaaaatagtgtaagtgtaatctttagatatatgagtcaagccattatttaaatgaagtttaaatattgacagataatttgatgttctcaaagccctttcactggtcccttctcctccactcttgtcacctccaatctattcttcctagaacagcaaacacaatcttcccccaaaaaactcagttatattgtttccctgtttacatcttgcagcgttttccccttactactgggaaaaattctcactccttaccgtgagcaagagtcgacatcctctggcccctgcctaggtcatagtaggtgacattcctaatactaattcctatcagttctttgaagacactaagcattctctggccttaggttatttgcatgtgctgttccctccatctgcacagctgtttctttgctcttctcaggactaagtccttgtctgtgcttctacctctgcaacagtatcccatttacagagaagccttccctgaccactctcaccatcccacctaaacaaagattccttcacttttctctaccagagcctcccattgttttcataacactcactaaaattagcaatcattttatatatttgccttcttgtttctttgttgcctgtctctcccaccagtatgtacgttccatgaagaagggccagcattttcttgttttgttttatcagtatatcctgagtttgaagcacaattatctgatactccatcaatggtgaataagtgaatgattgaatgccgtttatgccagaatgtggagatttgtatttatgagtattaaagagataaaatattacatgaagaatttatagtcagcctcattgtattaggatattaagacaccatagactgctaaatggctggataaatcagctccttctgaattctcttaacaatttatatacatttctcttcactgtatgtgctttctattttgtatctcagctatttgtgttaatatattttctattttattaaatcacaaagcccaagaggactttaaggacatcattggttttgttttctttgggaaacaaattgagcttttcctattaagccctgagtggtgagaatacagggcaagcaaaaactccaacactgactaagctgtgtgaagtctagaatgttgcttaacctctatgcatcttagtgccctcatttgtagtgggacctgccttgctacctacttcatgaaatgttggtaaattcagaagaaatactacattcaatggcctgcacctaacaaatgatcaataaatggtaactttgggtagtgggtttaatggtgtcccctcaaacatatatgcacatcccagaatgtgttaatgtgattttaactggaaaaagtctttgcaaacaaattatggatctctagatgacatcattctggtgtagcctaaagtcaatgacaaatgttttcttttaagagacacactgagagaagaaatccttatgacaaaggaggcacagactgaattacttgagctcaaattgtatatattacagaaagcaaacgtatcactgcatgtgtatatgcaaatagaaagagaaacgcatttacaagataatttggacatacaaccccatgtcataatcttgctgaatcatttttattatctatgaaacagttacattggctggattaggagttgtgaatttggcattactaaaccatgtgggacacctgggggttcctgaatctctgccaatccagtaaaatgttcctttttctagggagaatgtgcatagctttcatcagatctcagatgggtctgggactgccaagagagtaataaagtttggaaactcttgaaagttctttctagttgttgtattaatataatatgttaggtttatatcactttaaagcagccaaagggatttggcacgctattttaatcagtaagactctctctttgaagaccaagacaagcagaagaagggattataatagaggtttctttaagtaaacttatctttctcaacattataataaaaatctgcaggttttcctatccttgtgtacagtctatcattacccagcatgctccagcaaaggaaacaatctctatcgtcaacaatgtaagtacagactccaggtttccttgaactccgaaattgctatattcaagttaaagggtcataggtgcatgaagatagagaaaagacagtaaatgacaagtacacagtttccttgtttctttcagcataggagatttcatgcttactggaatagctgtgattctgcattttgtacattgaaggctgtaaaataaaggttagaatagatatatatctgagaattagtcactatgaagttcttagaatccagtttgtcttttattcctttctaaagtttaccaaagagaaacttaaagattttccacacaatatcatcacctaaagcaaatgtcaaccgtacaaatatataataaatcatatgccaaacattctttaaagatttatatatatatgttcacaaactcaagttagaattttaaccaatttgaggcttgtaagaaattaggtagtgcctctagaaagtgaaagcaaacttagttttcagtttattcaccaggaatacatatgaagaatatagggaatataaataaaattattagattataacaaggtgctgtaggtttggcataccagttcattttacagagcatatggataagcgtccctcattatttgcaaagcataaaaaaagttacgtggatgaaagtcttccacttagaagtcatcaagttggtcttagaagttgtacatttaaagagagattgctttcctctaaaaataaaccttgctttggcttttaaaaataacttgcattagacaaggcatggtggctcgggcctgtaatctcagcacttagaaaaaatagtagaaaaaaactaaaaaccatttgtatatatataaaaagttgtggatatatggttgtgtaaatacattatagatacccataattatacacagtatatttgtaaatatataatattgttcagaaaaatgacagtataaatataaatatttaataatcatgattatatgaaaggaatgaagatgaatttcagtggcaagatatgcaactatgttgtgtaattttttcaacccaataaagtattcaagaatgatttatataattaaaatatttaaatgctattcttaagcaggaataaattctatatttttataaccttttatacttcagttatcactagattaatttgcttattatgtatttaaattaattatattttgtgtaaaaactgacaatatttatactaataatcttttacttgatgatttttaaagtttctctgtttttatgctggatataatacttgattatcacaagtttaaagaagctgaggccggcgcggtggctcatgcctgtaatcccagcactttgggagcctgaggcaggcggatcatgaggtcaggagattgagaccatccttgccaacatggtgaaaccctgtctgcactaaaaatacaaaaattagctgggcatggtggcgggcacctgtaatcccagctactcggaggctgaggcaggataattgcatgaatcccagagacggagtttgcaatgagctgagaccgtgccactgcactccagcctggtggcagagcaagactctgtctaaaaaaaaaaagaagaagaagaagaattgtaaaaatctctgtagttgaaaacctgggcaggtgaacattaagaactggcattctaaagcagtactgagtgatctaagcatggcttggtcagagaaagagggaatacccagttaatgtgaagaatctccagtgtataattagaatattaaagcaatgccatctgttaatacttcaaagtagtaaagcacatcacagaagtcactcattactatagatgcatttccaaatagcttaaaatttaagtgtttgaacctttttcctctatcctactcaccttaaaatgatttaattttgatcctaaatgttttaaattgtagtacatatttaccttgaatcacagtagcatgaaaagtaaatgagtcataacaataaaaagcaagaaaacacaaaagcttacccagagcgcaactgtataatctgaaaacctcatccccaaatccctagggctacttcttgaagctcctgggggatctttcagctatagcatgctgctccttagatgcccccaagaaaggctgaaaagctcttgagtctctgtggtgacatcttttgaaacttcctaaggaggtgatgttgtcacttccctcatctggactgctcactaagctgaagcgcaggaattggaaaggagagctctccttcacatctgtgttcaattaactattagattagcatcaagcgccgcctcagctctgagtacttcattggctcagccaattatcattttcttaagttaattataatttgactccatctttattataatggctaggccagaaggtaatcagattggcagggtttcctgctactctcaacactttctttcttcagatttctgacaaataattattccttttttttacactcctctcttgtttcttcagagtgagtttctttcctacctgagattattatttatccagatatctatccagagtataattatctatgagattaaaaattaatcttattcctgagagacttaaagatttgagtttcatagatataacttcaaaccaagcacatccagtcactgattttcacatggggttgctcagcgcttatggagactgcaatctaaccttccccactcacgagacatctaggcctgagccataaagtagacatagaatgtgaatcacagatttaaaccacatataaaactttacatcgtttgtgagcaacattaacaataaataaataagaatcagatgaaaattattttaaatatattttaacccaatatatccaaaatattatttcaatatgtaactaatatcaaaacttattaataagatatttttatttattgaaatggagtatgtattttacactctatggcacatctcactttgactaaagttacacttcaagtgcccaatagccacatgtggctagtagttattgtattggatcattcaaatatgaatgatccagaaatacctggtttcaaagtggctcaacaatgcatgcttggtctaaaaaccttaatgcttttattaagtatcaaatttctgtataccctgtccagggatagacttctcacaccttgagaaatggcttcctcagatcaatatatcatagcatactatctgaaattatatgctttgttcttcttttttggattgcagaaattgtatttctttttactgtaatcatttttgttgtatactacattgctaggaaaaacaattttcttttgttcttaagatacaagattagtaacacattttcactgtaaaatgtcaaacacctagaaacatgaattaaaaagtgaaagtgctctcccttcatagtccctattctgttttctagagttaactttagatttactgtgtatcattctaggcaactttctatatcagagatatttagaaaagggtattaaaaacccagatttatttacaacatttaatgtaggttttcttcacctaaacaaaaatgcatagattcactggcaaaatctggagcgtaaatatatttgatgactattggaaatattaggttgcctaaagcaaggcattgccctgtcctttcttgatgacagaacccctattttgtctgagtgttcacgctcaccattgttaggtgtacagagaagcactaaaaagtagaatattgatcatttaaagcaaattaggtaattccatttcctagcccatgactgatttgctggacatatgtgatgtaattctgcccaattaaaatgagggataaggggaagggattttcttgttcaaaaaacttagctgcatggaaagaaacagtcttccatttcttctggaccttgctgtctagctatgatgcctgtagacatattgggcttctgaaaggtttcagcctaagagtacaagttaacatacagagaatcagagggtgaaatcatggacagtgcctggatctttaatatgatcgcaaaactgctgctttactagaatgtgagattataataaccttcccatatgttaactcattgttagctgtgatttctgtgttacttgaagtttaaagcatcttaactgacacaaaacatgaaggaaaatgtttcatatactttagtaaaaatgaaataggaattatttccattagtaaaatgaaattttaagctacttgttcttgagcaggaagttttaattttctgttaatttatttcttaatgttatccatacattataaactttatcttagagttatttgcaaaaaaaaaaaaaaaacaagaggaattctttaaggaatagataagtaaatgtttagttttactgccgatagaaatacaatttacaaaatttagataagcaaaatataaacacactctcagaattatttatttttaaagtattttgagtgcatgcaaatctttattggattataggatatcatgggacctgctgccagtaacaaattaaaattatttttatagtatggtaattttgttactgttaaaatgctacattctgtacattgcttaatgagtttttccagcgttccaactccaagtttgaataaaaggtaacataaaatttattatatttatgaataaataaatatatttaccatagatgatacaatattaacaaaaaataattttagctacaatttggtaaagctgaattcaaatgttctttgaacatttctatctattttatggtttttacacatataaattaagaaaatagtttttgtaaatttaatagaataggagaaaattatataagaaccatataaaactgccattttttgtaggcaaaatattcacagatgggcaatctcacaaggtttgaacaaaataaacacataaaacttttgcaaaaagtacaaaaataaatatctttgcatttcaagggtttttgaaaatcatcaaataagtgtagacttcttatgccacttgccctaagaaacaaatctagagctctacttgatacaacaactggaatatagcaaatgagacagggtgagtgaggattgcattttttaaatgtattcacatcaatttttctatataattttaaatcaagcattttgatccagttataacatgaaacctagcttgcatatatagtcatgcaaaaaatacaaccataacattgccttataagtgtaatgttttgttccaattgtgagaatagcaatattcagaagtatttgtatattaaaatagcatggtgcttatatattaatgaatattttaacagtttatggagagtataatgaaaaaattctttaccataagctttagaaatactgcatatagtaacggttttattttttaaatgttatttacatataaaataatgaaattcggacatctttttttgctgtgagaattactattcaatatcaaacatacttcatgctaaaatctggactgaagctagataaaatgaataaatatatacttaaagttatgctaataggtatgttggtggtaataatttgcttgctgtacttgcaaagtgtaaattatttccaggtttaaagtactgttgagtctattctgtgttttagtagtctttttggtttatgtaattttaaaataacagatctaagtttaaattgtttttccacctacctctaccaatggccattacttagattaagctaaaagacctgaaacattttcaaacaccacagtaatatttaggagttgaaattatcaatatttgatgattgagtattgagggacaaattaaatggagagaagaaagcaataggttcaatttgctatgcaagaggacatatcaagtaataggcagttaatacgttggtttggtatgtagaaaaatgtctcaactgaaggtaccaaatttgcgagtaattgccataaaggtgcaaactaagataaaaggagtgaataaaacaactgaagtaaagcctggtcccagaggaaagagaaataggagagaaaggtgtcttggaggatgacagaagcaggtgttttaaaaaggaggacatgaataaaatcaattaagctgagatctaaaaggtattcattgtagcaggctgctaaggtagtttgtggcccaatcatgaaagactttgtttaataaacattttttttcttttagacaaggccttgctctgttgcccaggctggagtgcagtgccacaattacagctcactgcagcctcaaactcctgggcttaagcaatcctctcacctcagcctccaaaaatgcttggattacaagtgggatccaccacaactggacaataaactttagttactagctagtagtggagcatcaaatcatttgaagtggggaggggcaagatcataaaatcaaatttatatatttgtaattatctctgaaacctctctctctctctctttcgctctttctctctctctctgtctctctctctctctctctctctctgtgtgtgtgtgtgtgtgtgtgtgtgtgtgtgtgtgtgtgtgtgtgtgtgttggggagggggaaagagttttggagttgagatcagctagaaatacataatctgctctaacacagtcattgtaggattggaaagtaaagcacatagatgatacaatattaacaaaaaataattatagctacaatttaaaacaataaacaatcttaaaacaatatttagatatacaatcaagaatacttagtacctgtgagtagaggctgagaagcagtgagaaagaataagagattctttctataaaccctgggctttatagactgaggccaccacaaggacagtggtgcccttaactgaaagtaaagatggaagagagaaacaggtttgggttttgttgtgatgaatttcattttaaacagactgaatttgggcagtcaaggtttatccatatggagaaatccaacaagcagtaagatgcccgggtctagagataaaagagagttcggatgtacagatatgtatccaatcggccctcagtgcaagagcagtgtatccatatatttttcaattttactgtggaaatacatagcataacatgtactgtgtaactggaagttggcttcttttgatggcatttggataactataattaccttcatataataattgttaaactatattcaaaccagacatataaaaatatttcatttcacatttgttaaagagtgtttgtatttggaggtacatgaaccagctctgtacttttttacaatactatcaccagcatctttagtattgaggctgttccatatggtgaattatgccaatatggagaactttgccaactcattccaattacagattgtttttctctagacagcatggagtatttttatgctgtctgtcaaaatacacttttttgtttgcttttcatataacattcagtgtgtaagaaggtgaagtgcttacgtgagaacaatttaaatttgtgcagccggcaggaagtttatttagcgctttgttccataagagggcacctgaattttcaaatgaaattaccaggattttccaggtgcaggtgatcagattagggatgggaaatatgccaaatatatgtaaacaaacgaaccatttccaagaatgctgaaggaaacaagtggaaaaggatcagactaatcagtgctggaatttaaaggactgataagttaacctactgggtctcccccagattgccaaaataattatagcgctgtgctgtagagaggatgagcgcaaaccttcctaggtttttctggaagggtatgaattttggagtctgtctttgctcccatattagaatatttattagtaccagatcacatgtatgatttttattttgaaaatatgttatagtggatagtggctcattactttctagtatccgtttcccctttctaagaacctgattttagtctgtatatttaaaccatctccacatagctcagcaccccatcctcagctcttgggtgggtatagtatccagaatttgctggccagtgattgcttttagaaaccaagactaaaataaatggtctgaatgattcactttgcatctgcaatttgtttagtaatgagtatccaacccaatttattccagttatgtttggggagggctgagttttccagagaacttctgggaaaaaaaaaaaaaagctccctgtttttaaagacagaaattagtaggcctctttccctggacattagtgatagacctggagattgtgtagttatctcatcaccaggttgagggtaaagcagcttgtgaaggaaggctaaactaaagagaatctaagtgaaaagaagctagagtcatgtttgaatgacatcttgattgagcatcgcctactttcaagatttcttcttttaaataagtcattaagacaaaaaaattggtttatctattacttgctatcaaaagcatcctcatactaatgcttaaacagccgtttttcacaattccatgacatataaaatggcttctctttttctttatgtaacacatttctttttactttattttcagattagtttatatttacagaagatttgcagaaacagtacagagtttacatatatctttcctctggctttccctaacattaaaatttgactatgatacacatatcaaaactaggaaattaatactgccataatgttattaactaaactacaggctttattcagatttcactgatttttccactaatgtccttttattttctcaggatccaattcagcatcccagattgcatttagttgtcatatcttcttagtctcttctattctgcagtatatattcatcctttccatgcctttcatgatcttgatacttataaagtacaagtcagttattttgtacaatgttactcagtttgggtttctctggtgttttctcataattagattgatgtagtgcattattgggaaggataccacagagaggaatcacatctcggtacatcacggtaggaagtttatgatttgataagttacccagatcacttggttaaggtggtgtctgccaggtttctccactgaaaaggtttttttctttgtaattaatatattttagggagaaataatttatgactatgaaaatattccatttatctttaaacttttgcccactaattttagcacccttccttgtgtcttgcctgcagcagttagtactgtgacattctaatgaggatttcttattttcctcatttcttctacatttttaattgtaattattctgtaaggaagagttgtctcttctctcatttacttctttattcagttacttatttatattagtatgactcagatatttatattattatttgggttatgatccagtaatatcataactgattttattgcccaaattgttccagcttcagccattgtgaggtttttcaggttggtccctatgttcttttgacatccatcttttcttttctgtctttttccttctttttgagcacattaatgctctagattcatcttatatttttcctgctccagatcaaccatttcaaccacttctccaaggaaccctggcttcttttaacggagaacgatatccactggatatgctcattactaacgtcactgctcctaggctctcagtggctaaagaaaggagacatatgtatgtatagtaacacattcatacatatagttgtagtttaactatataataaatatataactgaatacagaatatttgcttttatagctagttctgtgtgtacagacatatacatatatgaaaaattcataaaaataatctaggaatcctggctctccaccctacttcctccacctgcttttccaataccttagcagatgttgcttaccagtctctccgtacccagttccccattcttattcatcattctactagacataggatctctttttattgaagccccaatctcttttcttgctctccctgtgatctctgatctcatgatggcatcttagaccttcctatatttatctgtgtaaatcttttagctgcttattaaagttgtcataggcacagaaaagtaatatcgccagggtcaaataatctaaccgaaataacttcctaagggcaaggttttaggaaactcttcatcctacagttcctcttccatcagtcatttgagttgttccaattacagtatgcccatttaacactcaaatctatgactacagtgtctcatcaaaactgtggattgacagttagaccaacggaaccggtgactgcctaacactactagaaagaacactaatacttagcttatagaaccaccagtgctatctattttatggatatcacccacatatctatactcctggaaagggacatatccacataagtacctcctctgataccaacaatgtggttcaaaaagtctatagccacagtgtgccagactagacaaagaccaaagacatttaaaattatgatttaagtcccaccaaattcttggtcatgaaagtctctggttattgtagttctcaggccttatgtcaaaaaatcttgatactcttttatgataattatttttgctaaatgaaatgtgtctcagccaagaagggccttagtgatactcattctgtaatcttctgtatctgtggactttctagtaaggcttcaatcaaatcaatgctctgtattagcactcggttctttatattcatccattttactatcttaactgtgtctttctcaacacaagttcctttattaccagctttcactcattaagttgtcctacttagccttagcaagatttctaattatcttgctcattttcagtcagcaattgatgctacattttattggacttatattcactttgtccaaacatagattcagcgtgtataaataatatagcacaactatacttgtcttggttattgctatggtaaactaatatgaattcatcaaaaatgttctatgtaggcagtctggagccaagtcattgcaatctaacatcaaacccaattctaatactcacagtactacccctgatgttcctatagaacttttatatttcatactcttgtataaagagagaattatcctattagctaaaatattatatgtataggtatacaagaatgtatataagagacaaggagtttgaaataatttagattagaaaaatgatcaggttcactttgtggtgcatttctggaagttaaaaggaagagaaatatttcgaaggcattgcaactaactttgtactgttgtaacaaagcttcatatcaatatatgagttaggtttccaaaggttctcacataaactagatttattctcatcaatatggagagttgtggtagttggctccactgggctgagaatgctgaagcaggggtaagctagatctacctttagtggcaggccttatggtagatggcacagatgggcaccaggactgtgccaaaacctaaatgcagtaagatcttggagctagcattattctagtatttctctgcagatgtgaaatgttcattatatcaaaatgtaattgttttagagatcctttaaaagactctaagaatgccaccatgataaatgatgccattttattctgtcggtcaattttagtcaatgagttagtgaggaaaagcattgaaataattaaataatataaagaattgaatatagtggcttttataaagtgaccttgggttttattcaactattctttgcttgcccatatagataactaagtcagtgtttatgtctgaaatatcaatggtgagtcgatgctattgtacaggctagagtcctccctttggaagcatgctgtgttaataatgctagcggtttgctgctgcaagcatttgcagagagagttgaaactgggagaagtccaatcttgtcttaaagggaccaaacgttcatagtcaattaagcttctccccactaagatatttaccacaagaaaatctattgtgacaccccttggtgtttctgaatcatttgtatatgtctttgtcatcacttatctcattacatgctatacacctaagtgtatataaatttactctttaaaacaaaatctatatgttatatatctttatacctctttgacataaaatatgtggcactcattaaatgtcagttaaataaatgaataagcagtaaatattgtggaatttttttataaacacagtcactgggaaaactttcatcggcaaaacagttaaatttgcctaaatatttaaacttatcttttgtcatacttcagaaaatgcatatcaaatataaaaattgtaagaactctcatttttaaggtaaaaaataaaattagataaagctctatgattttgaaagccttggtaaagtagtaaggacacattttattaaatacagaatgatgtcattgcaagtcactagtgcttaatactttccatttctaaccttttctaaaatagtaaatctagaggaaacattaagttacacagaacacaatgtccctttcattagctatggaattactttcttttccccttctagaggggtaaagtattctgtggttaagcaaaagtacaaaacttcctatgtgaatataagacacaggagagaagtaatttgatcattttaatctcatggatgccaaaatagttcatttagactgtgagctcaaattcaaggaacccgcttttgctccaaagttgacttgtagccattaaatactttcatagctggtttttaataacagtaaaattaagtttatttttgttaacataagtatgaatagttatactcaagatgaatacaatggaaatgagtatatatttttcccattagataactattacctaacactttacatacaaataactacattcagaaaaccagttaatactattaaaaatcattagaactacagaatggtatgagcagaataaacaagcctttgtttaagagtatatgtctatggtgttccaaccatgttttacacccagccttgcatgaggtcttgctaatgtgttgatgatggtgtccgtgtatgtttgtgtgtctgtttcaaaacaataaatagtacaattatttttaaaagaccgtgtttgaaatgttagaggcggaacccatgtgtacataaagaatggcaaacatttttgaatgggccttttctacacaaaaatacatttaaaagtaacagatttgtaaaatacttaattttgagtaattatcatattcccatcaatcatactacataaatgcatcacagatcagtttgaaaaaatttatgatatggctcccaatctacttttactctctcatccttccattaaataatccctacagactcgataacagacttttctattcttattccatgtatacattgctctggcagctttgttcataaaaatccttccaatttaatggctcctttgctctcatctttgtcaaaattagaactctgcttcaaagtccatctcaaataatgaatgagttacactagaaaggaagcatctgggaattatcaggaccaagaaatattaattctttttttttttttccttgaggcggagtctcgctctgtcacccagactggagtgcaatggtgctatctcggctcactgcaagctccgcctccagggttcatgccattctcctgcctcaacctcccgagtagctgggactacaggcgcccgccaccacgcccagctaattttttttttttttttttttttttttttttttttgtatttttagtagagacggggtttcaccgtgttagccaggatggtctggatctcctgacctcgtgatccgccctcctcggcctcccaaagtgctgggattacaggtgtcagccacggcgcctggccgaaatattaattcttataagcacggcagaatctcaagaaactttaagatgaaacagaaaaaaatagtactttttgtcaaacaaagtcatcatcacagataaataaaaataataagaaatgggtggaacgtgatgttgtaaaaagactaaaatgtaaatcccaaagtgcagtactaagtggcaattacttagactagactctagagagtcatggtacttggaataatggcatcctcaaagatgtctacaccccaatctcagaaacttatgaatatgttatggcaaaagagaccttaaagacttgattaaatgaagaattttgagatggggagtttattctgcattatctgggtgaaaccaatgcaatcacaagagttgttttaagagaggagcaggagaatgcgagggagggaaagagatgtgatgacgaaagcagaggtcagaatggtgcaaggaaggggccccaggccagggaaagcaagtggcctctagaggaaaggaaatggattatccctagatcttctagaagggacacagacctaacaacccacttaaggcttctaacctccagaaccatcagataaatttatgtttaaagagactatgtttatggcaacttgttacttgatcatttcctaccagcagtaggaaactaatacaagagtcaacagacttcagtgagagctacttgggtagcagtcaatgaaaaccactcagacaaaaatctacattttaaatcacattttgccatttatttgctgggtgaacttgggcaaattacttactctttttttttttatcattcttacactggagaatgcacacaagttttctttctctgagcactcttcctccgtatgtgttctaagtgaatctgatatataagctaatttttttggctcagttttgcatatctgacccaagctcttatagtcatatattctttcctgaaattttagaatggggcttgagagatagcaattaatgttggttagcctcctgaagctgtaaagtgactacctttctctcgtcatgtgtacaaagaaatagagaaaatcaagctacagatatagagagaaaagcaaaggtaagagactgagggagtctccttcctgagatcttaatgtactgtcaggtcctgatgcttctgccttcttgaggcccagttacgttgaatatctctggttcgtgaaacatccccttatctaataataaatttgtcctgtatgtttaatctagcagaagttactttctttcacttataaatgatttgacataaaacataccctgatggggagatgtaaagacaaataatgatgtaatcaatgtgagcatattcctgggcatatactaagagttcaataaatggcagctgtgcttatttgtatactctcattactactagtactactacttctgttactactgccattacgagtcactctaagtagtggagacgattcctgtatgctctgggttacctggggaatgagatgggtgaggattttgtctccctaattcagtttcaggataggagtaatgtagtttttgtttccatccctgtctaatcatagggagtcacaataaagtagataacaccaataagacaaagctaggaaatgtgagaaaaacaagtcatattctctgtcagtttgaaagtgtcacaaattacaaatcataattcatcagcatatgaatgccactgccttcacaaacttcttttgatactctacctgaaattttcacataagcatgcctatctccacggccctcccctatccagacagatatgccctcatcttacctagagaggtctaaaatacctggcatttagaagcactttttttttttttgagacagtcttcctctgtcgccaggctggagtgcagtggcttgatctcagctcactgcaacctccgcctcctgggttcaagtgattctcctgcctcagcctcccaagtagctgggactacaggcatgcgccatcacacccagctaattatcgtatttttagtagaaacggggtttcaccatgttggccaggatggtctccatctcttgaccttgtgatctgcccgcctcagcctcccaaagtgctgggattacaggtgtgagcccccgcgcccagcctagaagcactcttaaatattagtttcattttctttttatggctctcatcaccttttgtttgtaatgatcctatactgtagtaatacaatttgcccatgtgattcatactttaacatgtattgttattattttacatcataattgtcttaatagataaaattacacttgactcatttgaatattatagatagcatatagtaagtgtgcaataaatatttgttaaattgaattgagattaaaacttaacctatcagaaatgtgtaatttttattgctttatgcgtaggtccaagaaaaagaagctatattgtataaggtttcttcgataagactccaacccaatattgtatttctttatgatataccactaacccagtggtccaagtcttctactcctgggagtaataaagcatttagaaaggtactgtgaatgtgtacatcaatagctctcacccaaataccacccaagaaaaccctgaagttcatgtaaataaacatgaacataatctaatgagtattagattgttttcagttctttctggccatattagggaggtgaaacacaagacataaaagagagtaaaaaagcctgaaactttgtgacaggtcctttttgaaaaaatttatgctatgaataggaatatctgtaaattaataccaggtagaagggatgagaggaggaagctttgtattcttatgattaacaaagctaatactacttaaataattcataactttaaatatagaaaaatgacatatcttttcagaaaaaactagatgctactgtaaacattttattaagaagatgagaaagtactccatctgtagtattagtttcagtttagttgtttagcaaattgattctattaacagcagtgagatagatatagttttatttaaagtgtaaagaagaaagaccaaaagcttaagaactttttcacagaagcaaatacattctaacctttaagccatattgtttcatctactgtagagctttgcattcttctaaaatattgtttcaaatctatctttggagcagtctattgcaacacaacagtacttgtaacaagtgcttatacaagcatttgcatacttttcattggacttggctactccccttacatgcgtgagtgttttttaaaggctataagaagaaaattaggtgctaagaaactgaatagaaaattaaatttgtatagaaattatcctgccaagttatcttctatcagaaatttcttcatgtagagagaatgaagagattcatatccctaattgcatggttctcttaatgaacttgactataaccacagtttctggaaagctaaaacttctaacaattgataagaagactctttgtttaacagttacaataaagtacattagcaaagcaaataggttgaaggaggacagagaaattttactctctccctttaaagtgaagcaaaattagtttaataagtaaaacgcatatacagagaaaggaaacttctttcttcagatgttttattccatttacattctatgtctatgctctgaatcaagttgtctataatttggaaaaagtacttgaatgttaaaagtctctgactaaatttaggtagaaatgacacagttttttgaatttggttttaaacttaagtggttttctctctctatatatatatgtatatatatcttgaaattttaaaattaacaattttaaaaatgaaaaattttgacacatttatgtgtgtgtacatatatatacatatatatgtatatatatatatgtacatacacatacatacaactggtatataacccaacatatatatatatacacacacacatatatatatgtacacacacatatatatatttactttaagttcagggatacatgcacagaacatgcaggtttgttacataggtatacgtgtgccatggtggtttgctgcatctatcaacccgtcacctaggttttaagccccacatgcattaattatttgtaatgatgctctcactcccctcgccccccacccgctgataggccctggtgtgtgtcgttcccctccctgtgtccatgagttctcattattcaactcccacttatgagtgagaacacgtggtgtttggttttctgttcctgtgtttgtctgctgaggatgatggctttcagtttcatccacgtccctgaaaaggacatgatctcattctttttggctgcataggattccatggtgtatatgtatctcattatctgtattcagtctatcattgtttggcatttgggttgattccatgtctttgctcttgtaaatactgctgcaataagcatatgtgtgcatgtgtctttatactagaatgatttaaaatcctttgggtacatacccagtaatgggattgatgggtcaaatggtatttctggttctaggttcttgaggaatcaccacaatgtcttccacaatggatgaactaatttacattcccacccacagtgtaaaagcattcctatttctccacagacttgccggtatctattgtttcctgactttttaataatcaccattctgactggcatgagatggtatctcgttgtggtttttatttgcatttccctaatgaccagtgatgctgagcttttattcacatgtttcttggccgcataaatgtcctctctttttttttttttattgagatggagtcttgctctgttgcccaggctggagcacagtggtgcgatctcaattcactgcaaactccacctcccaggatcaagcgattatcctgcctcagcctcctgagtagctgggattacaggcacccaccaccacccccagctatttttgtatttttagtagagttggggtttcaccatgttggttaggctggtctcgaactcctgacctcaggtggtccaccctccttggcctcccaaagtgctgggattacaggtacgtgagccactgtgcctggccataaatgtcttcttttgagaagtgtctgttcatattctttgcccaccttttgatagggttgtttggtctttttcttgtaaatttgtttaagttccttgtagattctggatattagacctttctcaggtggctagattgcaaacatttttctcccgttctgtaggttgcctgttcattctgatggtagtttcttttgctgtgcagaagatctttatcttaattagattccatttgtcaattttagttttggttgcaattgcttttggtattttcgtcatgagatctttgcccacatctcaaatattttaacattttgaaatccagaatcccaattacccttccgtaagcagcaatcattacatgttttgtcagcattcagcatcctgctggtaactgtacttgacgacaaaattgaaaattgactgctgtctgggatgcatttcaagctgcaaaatctttgtaagtcttggtttacagaaggaagagaacaaagtagttaatggttctttctgtcatggtgacctagaaaaagctattgaattgctgattcattggccttaatattttagcaacttgcccatttttggcaatctaatgagatttttttaaaatcagatttgggaaccaacccaaatgtccaacaatgatagactggattaagaaaatgtggcacatatacaccatggaatactatgcagccataaaaaatgatgagttcatgtcctttgtagggacatggatgaaattggaaaccatcattctcagtaaactatcgcaagaacaaaaaaccaaacaccgcatattctcacgcataggtgggaattgaacaatgagatcacatggacacaggaaggggaatatcacactctggggactgtggtggggtcgggggaggggggagggatagcattgggagatatacctaatgctagatgacacgttagtgggtgcagcacaccagcatggcacatgtatacatatgtaactaacctgcacaatgtgcacatgtaccctaaaacttaaagtataataaaaaaaaaaaaattaaaaaaaaaaatcagatttgaaattattgtttttaactaatgtatgtattttctacttgcatattatattgtggccaatattaaattacaaaatgagatttgctaaagtgaagcttccaaaaaatatctgatgttaaagctaaaaatactatcatttcacaatctttctgttatatgtaggctacttaaagtataatgtagggaatgacaaatattcctattttttaactgttaagtccacacaaatgcttctatgtataattgtaccaacacttcctgtttggtgcaactggaaatagttcctatttcaaccatttgggtgatgctgaagagctcccactgagcgaatttgtgtgtccatttgaaacccctagtgtgaaatgacctaaagctgtacttacataacttttaaaaagtacagattcaaccagtcagttattgtgtccacatgacaacagataatgtgtttaaattattctttttacaacttgattgactttctctttttgaatatatgaaaatcactggaggtttaggggtcgtgttatcagcctaactaaaattcttctccactcactcactgagcatgttctttactcttgtaatttcattgccatactgtcttgtagaggctttgctttgcctatgttaatcataaggggagaaggctgccaatattgattaagttagccagagtatggcagtgcttcatcctcatttttacctatgtagagaaaacttaatatttttaatatttataagattctatacaaatataaactgggtcattggcttattcttgatttattcacttgaaaaatgctataaaataaaaatttggaatactataagtatgatcaagctaaaggatcaataggagcttccccaaagaagaagtaaatgtggagctgaagtgtaaaggatgagtaaggtttagaagagaaggaaggaagacaaaagaatgaatgcataaagtcatatataaaggcagagagcctttttctaggaaaggctggtgaactggaggaaacagtgggaggaggagccttggagacccattcaggatttttattctgagaggaattagaaactattgaggagttttaattagaggtgtggtataaccagattggaattttttaaagattattttagctggttgggtgtggtggctcccacctataatcctagcactttgggaagccaaggcgggcagatcaccaggtcaggagtttgagacctggccaacatggtgaaaccgcgtctctactaaagacgcaaaaaattagctgggcatggtgacatgcacctgtcaatcctagacactcgggaggctgaggcaggagaagtacttgaacccaggaggcagaggttacagtaagccaagatcatgccattgcacttcagcctgggtgacagggcaagactcagtctcaaaaaaaagaaaaaaaaagattattttagcttcattcaacagaatgaaaagaaagggagcaagagtggatactcagagaatagataagagattattgcatttgtccagttgtctcttttgtaggtttctcctattactgtattattttttaatacaaaataatagagccttaataggaattttttaaaggaaaaatttattcataatcctactactctttcagaactacttttctttttttcatgattttttaaagtttttgtccagagcatgcacattttatatcattgaatttatagtacatatataattctgagcttcacatttttcatacttttagtatggtgagctttcagttcatcataaacaacccctctcttgttctcactgtatattacattccatcaagatgataagtcaaaattgttataactaggcttctttgtgggtctagaagcactataatttgaattccataaatattcatggattgtcttttggggatccatgaattgtttgaattcgtatgcaagatttttagtgtatgtaagttttgtatttttctggaaaattcattagattttcaactggtatataacccaacatggttatgggcatattaaaacactcgaagttggtaaaatcccaagtctcattgtttgagagatgtgagaaaaaaagtagactgtggtataacttgcagcatagaatttcattcatttgaaagattcaagggagtcctgccaagaagtaaaagtaaagccatctgacaaatctctacgtaacaagaaattgtagagaaacttctgagaaattactaagtattgagaaagataatttaaatagtgttatataaagtgtatttcctacacatacatttcacatctcttaaaaacattttaaataatgttttaacctctactgtatattttatcatatagcataaccatgaagttcaaaaaatactcaatagtacaaaaaaaggttatgttgaaacagtgtatgtcagtcccctacttcataaaatgatgatatttaaatagaaaaactctacttaacaacaacaaaggtttacatttactagaaaaaaattatgatacggatcaggcacactgtctactttaaacacatgtttaaaagtacatgtatgtactttctcaaacttttgcttagaatctatgttttcagagacaaagtgattgagttggctagcatctaaattttgtgaatattttaggtacatttctgcttaacttattttaatattgtattgagataggctcttccaaatataaataaatattttaggccttaggaaattatcaatattgtactttgtgtagctaacaaaattatgctaccctattaatcaataccactctcattcaaacaaccatcatctcctacctaaactatatattgtgatcaacggtgattaatttaacaataaaacaacagatttttacttaccaaatcaactatatctcatataaattaaaacttggtttatttaaaactcattaaaaacaatcttgcataaaacttgtttatcactttcttatctgaaacaaatatcctaagttaactaaacaaattatttttcaaaatcatagttaaattatgtactgaatgcttactttattttctaatgtattttaaaccttacatttataaaattaaatattgtatattgaataattatggacaataggatttctaaaaagccaaagagactcccctctatttggaaaggaaattaaacgaaatacagtacaatgaactgcaaaataaaatcaaaatatttctggaaaatattatctatcaatttaaagataaactacaaagaaattgtgaaaacaatgttttaaatacctgagacaaataaagcacaagactttattaagaatataagaatgtattacagattggcagactggattttagtctgaagttcctagaatgaaaaagatgtagaaagctcactctaccaatctatcctgtctttctagttttctaattttcaccctctgtaggcataatttctgatataatgaatatacagcacttgatgaatatactttgaatgtgtgtgcatactgagtaaatctagagccattcctcttattttctattttattttctggactacttagaatacagagtatatgttcagaaaaaagaattatttaatttaattcatatagttattaaaatttaaacttaattgtcccttgaattttttaatcttatagatattataaatgttacaactatgaatggtctactacattaatctaaatgctgctctgcaattttacattttcctagcccattctagaaaatatgatactttccttgaattttaaataccttgttaggggctaatgtatgtccctcttaatattaatataaaacccatatgttgaagtcctaaagcccaatacctcagaatgtgactatatttggagatagagactttaaagaagtgattaagctaaaatgagatggggagggacacagacagggaagaccacatgaagaatgaaatcacagggagaaggtcatccacaagcaaaggtgagaagcttcagaagacactaaccctgctggtaactagatctcaggcttacagcctccaaaattgtgagaaaatcaaattcagttgtttcaatcaacccctctgtggtacttggttatggcagacctagcaaactgataaacaccttctctcttcctccactccttcagtggagaaacttgctttatatttaagagaaattccgagttcccccaccaccatcaaatctattaggttggggcaaaagtaattgcggatttgccattgctttcaatggcaaattttaggcaaattcctaactacctgtgtcagctacctccaccctgctgtctctctgcatctctatggcagcccagccactgctctgctttaagaaatcccgtctcttacctactcaaggaaatcagctccccttttgcatcatcaaatttttccgtaccccagatcactccatatatatttatatatattatatataaatttatatattatatattaaatttatatattatatatataaatttatgtataatatataaatttatatattatatataatatatgtgtaaatttatatattatatatataaatttatatattatatatatatatatatctcacatccagattggtgatatatattatgctataggtcactcatcttcaaccattatcccccttgaccttaggtcctcatctagctaccactcatttctcttcatatttatacttgctcctttccagcagccttccccatcaggaaatgacagcttcaatcttccagctgttcaggccaaaacacttggaatcatccttggtacctctctacctcccatatcctacaagaatctactggcaaagcccatcagttctacctttaatatccataatatcttttctttcttccttcatcaatatcactcattcaagcaaccatcatgtcctacataaactattaaaatcccctacagatttatttccctgtttcaagccttgcccataaaatctatcatctgccagccaggattccggccttttcagtctgagagtcagaccaagtcattcctcacttcaaaactctttaatggctttccatcatacagcttatgtcttacctttagcatggcagcagaggcccacatgatcagctccccaattgccttgctgctttcatctcccactgtcctccctgctccctccactgttagaattcacagaaggtattctaatgtcaatgcctttgcaccagtcagtctctctgtccacaatgctttccttccaggtttccaaattcctgtaattctctactcacatatatcaccttatcagagactccttgatcatcctatgtaaaaaagaatccctggaacactctaatcctcttaatctgttttacttattatttatttatattcagagtactactcaaccaatagaatatataatatcttcccctaccagactataagtttaattagggcaggaaatttgtctgttttattctctgttatatccttggaatctataacggtaataatacaattcctttcctaaatgtatactctcatgctctcagtaaatacaattttaaggtcatactatggcaggcactgtgatagaaactttaaatatgatacttaaataaatccaaagatcaatcctatggaaaaaataggtatatcttacaaatgaagaactgaaacttaggtagcaaaatacccaaggtcacacagccagaatttgactgtgttttcaattgattagaaaaataagcaaataaaaatacctgctgagtcctgactgccttcttaatgctaagaggagattttgataattgtaggttcgtccagtttgaacattccttgcttaatttagccctggattttaaagaacagagtgttctactgtcactaggggtgggtaaaacatatacatgtctatttctaggacaagcccacacttgcccttgggaaaaagccctttggaaactttgctttggagtttatatagtaattccccaataagatctcttcatctttaacacatatgttttataacagttaatatttcattcagaaaactaacctgtataccattagaaaagagtttgatatataaagtgggaatgatctttcaaaactcatatccatgattcagccagtacagacactgaatttgaattcagttttgtcatttgctagctacatggctttaaatttaaatacatttaaataatttaaattttttagcttgtatgtgatatatgaacaaggatatgaagacatttgggagattggagatggtacaacaaaagcattgagatatagtagatattttatgaaaataatttctattcgtatttgaaaaagcatcctatcacaactactctatagtccgaaaacaatggagaccctgcctttttgagtattctaatgaatccatttaacccatcctgcctttctcctcatcctcctgtcagtaagaaaatgacatacagaaaagaaaatctaaaaatatacagaagtaaaacatggaaggaattatcaattcttccctgtgaatcagactgtatgactgcctaaaataggcctaacaatgtcatgtgtttttaatggaacactgtaaaccacaaaacaatgtgaaatgactactgttttcagaaagtgctctttctttactcatttcatctaaaattgaactaacaaagagccctatttaccatttgcataaagaaatgggcctactctaatataatctaaaaccagatttcaggcctaaaaataattcatattagtatgattaacaaagcttttgaattaagattgtcagtatttttgatgcacatttcaattgtttggatcatatcttattcctaagatcaagatagtaaaattaatttaaaaaataataaacttaaaacagcactttggggatgatacaaacacattttgaggcagttctttaaaataaaatacttttcatgtatctctcttattttccactgaaactacatatttcgtcttagtttcctagtcatccctattaaagagtaaaaaatgtacatttccttatatttatttaacaaaaaattacaaaataatgacttctaaagatgtagcatctcttgaagcacttaaaacacaaaacaatattcatacataaaagcaggaaaataaaatttcaaaaatatcactgagtctctaattggagcatcaagtacgtgaggttgaaaaatggaagtgagaattattttctctacccttcagtctttcttgatgttactaagagagaagattttctgtttgtccctgaaagtctcaagtaattaataattgcacctgttgcaagataagccattgcactgcatactttttaatacctaagatgggagaagaaggaattttggacacaatattataggtaaattgagcttttcacattctttctcagtgccaaaattcaggacgtaaacagccagacagattttattccccgttcagcactatggacagccagccagaagtagttttcccgttcaaatataacagatgctgtgtttcttccttgtaaggaaaggatttcaccacatgtactttagagaaagttggcatggcacaatcagttatgtggagtgacacctgaacataatttatttgtgtgcagagaaaatagtttgcttagtcatgtctagtagcaaaaatattttcttcacaaataagtgtgttgccagttatcagtcaagagagggcaagttatgccacaataaaaaagaaacccccaaaatcttagtggcttaaaacaacagacttttatttctaacccagtttacatatccaaagtaggtgttcaaatgagatcctgcttagcaagcaaccttgggacccagggtgacagaagttccatcttgggaagtacattcatgactactgaggcaggaaaagaaaatgtgacaaattacactctcagtctcaaagctcacagtttctgtgcacaaatgtcatttatcaattctggctttatttcattggccaaaacaagccaaaaagtcaagctaacttccaaaggatgacagggatgtgcaatgatgaatgcccaaggaagaattaaaagattaataaatagtttgaatgactagttcaccaacaatcaaatttaaataacatcctatccattgctcttaaataaaatattgtgttattaatacacactcactgatcatccactttaaatagagcagagcactatactccaggagaaagacagcaaataagatacaactcctgctctaacatatttaaacaataccaccaccaacacaatcttcatcataactaataacaatagctaatagaatagggcattttctctgtgtccagcactgttcaaagggtttctggggcaactttataccttatctctcaacaggtaacctgaaatgactaccattgttatccttagttggagatttgattcctccaaataattctaaaatgtaaatatacaaattgtacagtttacactacaggtgacgttcaattcatatgagatttttttttaaaccccttacttagcagacagtgtgggactgagggccctgaaaacagaataatataatgatgatgaagggaataatttagggaaaatgtaagagcttggactatgacccagaggaaaaaataggctctaccaaaatgtgatcaaccataggtgagtatgggtcccctagaagctggctggggaagaaagatgtttttatttttaaggaaagatttataggttaaaaaatacatgaaacttttgggggtcaaaaagaataacattaataatgtcactctttatacacgccccatcattttttactacagttggaagggatttgcacctatcacccatactttcccacctaaatgcagattatagcaacgataaagtaatacttctattgctgtaagtgaaacacacaagactagagagcattgtcttcagtggaagaagcgtgggggagttaccttagatatcctgaagaaatgttttcagcaagcattgttaaacacaagccaaagcaaaataccaagggctgttgtggaatctctctctctctctccagaggggtttatttactacacagaattttttcatcaggagaggttttaaacaatcctgcttaaagtaagaaaaatggactaacttgattaagaaaaggaaaaaaaaaaaacattggtaaattgtggtgggttaaatgtatgcccttgaagagattagaccatgagctagataacccgttggggtccctttcaaatctgtgctcctgtgatttcaataattatgttcagttgggggtaaatagctcctgataattatgtgtgagtctattctcttaaccttttggcaaagagagtatatgtattacaaaaccatttcaaactgtggtagtaattatggtacacaatatagaaatatttggattattacaaaatttgaggtagctagggcaattgtcattcatgctatgtcctattttgcataagaaaagtaaatgttttgcatttcctacttttgtatatgtgtgttatagaccaaacagaaatgccaaacatcttagagataactagctttgagatgaaacatcttaccagaataggaaggggaactatatttgacttttcataaaaattgctttaatacattttaataagattctaataaaaaaaaatagcgggcaaactggctccagtctacttattcaatgatattccctgctgtttttcaaaagtgcaactttcccctgaaactccactaaaacttctactttattcttgcctttttacttgagcctgcagtttcctcctccatgtcttttcttcattcaagttgtgaaggcccagatgagatcccacctctgacaagaaacactcttcattcttcttctttctttcttttttttttttttgagacgaagttttgctcttgttgcccaggctgcagtgcaaaggcgtgatctcctctcactacaacctccacctcccgagttcaagtgattctcctgcctcagcctcctgagtagctgggattacaggagcctgccaccacacctggctagtttttgtatttttggtagagacggggtttcaccacgttggccaggctggtctcgaactcctgaactcaggtgatccacccaccttggcctcccaaagtgctgggattacaggcgtaagccaccgtgcttaaatattccaatttatgctctttattttcttcatttttaataatcaatttggttacaataccaaactatacattaagaattattgttttaaatagaaaacacaaagtgaaaaatgtattttggaataatttaaaatgttttgtagcccacaaatttctttctattatttttgtctttttaatgttttatgttcctatataatcttcattttgcaaggtttatatataatcctcctctgagaatgactaatttctatttcatatgtgacagataataaatgccctaaggttaagtataaaggggtgaaactaaccccaccaaatatttttccttaatcatgtcacagagtatgaaaggtttccatttcacttactggaatttattattagaataaattattaatttatattaataattttatataaattttatataaataatatataattttatataaattttatataaataatatataattttatataaataatatataattttatataaattttatataagtaatatataattttatataaattttatataagtaatatataattttatataaattttatataagtaatatataattttatataaattttatataaataatataatttattaattaataaattattatagataactaagtcattttatgaaggaggaaattgtaaatcactgtttgatgggctttttcaaggtcgactcatgtgccagatgctgatctggaattctgacaaagtaaagtagtgtttaaaaagcattctttcacaacaattaaaaaagtaatatcaatataaaacatgattaaaaataaggagtcgaatgactatgtcaccaacaatctaaaatttaaataatgccctgtccattgctcctaaataaaatattgtcttatcaatacacattcactgatcatctgctataaatagaaaagaacactatagtccataaggaagataacaaataagacatagccctttgtgcattttgctttactcatcacctaccttttatggtcaaagtgggatggtagatgacagaagagatggcaccagcattgggagtggtgagaagtcagagaagaaagaagtcagagtaagaaaggtaatgagaaactggtaaagtgaacattgtcagtacctattatgattcagagttttaacaatgaagtagctactgttttacttgtagttgaaaaaattgatgttgatgaaggttaagtaattaacccaaaatcacacggtctgaaaaattagaacagctgaggtttaaactcaggtttctcagataccgtggaatctttatcttctctctgatctcattatacagctagttgcctttgtgtaagtgacaagtaagtttttttattttagtacttcattttatagctactacttcattctggtaaagcttataagagtttgtatttaatagtatcagccaccatgtcctcaggatgcttattataactagagtggctttatcaataaaacaggaatatacaaagtctgttgcctcaaggttattctcatttggacagtaattgatcaagtattggtaaaatttacctcaatgactttattttttctattatttgagtagctagtatttttgttgctgttgttaaaataaaatagctttacaggcattctaattataaatgtcaatataaaagacagttcaactaggtattcaagagaaagtgaacataattcatatgctgctgcccaaagataaatacaataaaatacaataaaattggggctatctttcatacacatgcatgcatatatattttctcaaacatgagattgttatacataatggtttatcaaatatcttatattttcatcacatatgatactgcaggcatacacacatgcacacacatgtatatgtgtactgtatacacacatagaaaaacatacccatcatacattcttatatagtggctcaaaaatggtccaaaacattatattctgatggatattagaaaactgtcttttagaaaactataactccttctgttaaaatcattcttttatttttacattgtaataccttatttaacaagtcttgcagaacttcgggtcatttaatctcttctggatgcttatttttgttcttattatgtattaaatttatggaacaacttttagtagttattataattttatattttccggccatttttctaacatacagaaaaaaaattctttgatttgccaaacttagccaagaaattgaaataaaaaattttagataaatacaaataattttaggataagtatgtccactaacaatatttggaacacacttgaacaaagcaaaatataaaaacccagaaacaaaaacaaaaaacatcgtgttgcttatctggagtttacttaattgacttttatattgtatcaagcaaccataaatgtgatcccttgagctacaacaacctattattaacacatttttgttattttaaatggtccatcaattctatttgttttcagtagaaaaagagaaatgaagaaaatgttggtggtgttcactgaagccctgtactaagaatcttgatgctatctctggtcttaaaaggaaaaaaatgacacaacttattaataatacctgctatggatatactaagaaggagttatcacacttgccttgaatttgtcacatttgagataatactatgtccttccctcactacatattttaaaaggagagacaaaatgaaagtacataaattagaaaaaaaaatgagtgctactgttggaaaagaagatataatatcattaactgtgggtaatataaatatatacctgtgtacctgtggacagagatagatagatagatgatagatagatagatagacagatagatagatagatagacagatagatagatagatagatgcaaaaccatgtttgctcttttattaaaacctctaaaaataatatcctgacatttagtaggtaatcaataattatgctcactgaaagtagttaaataaatgatctattctttatttaataagtcctgggagaaaagagggagtttctcattttatatggcctccatagctcagaatgaataaagtgataggaatgagggattttaaaatattcaataaggtcttctgcagacttccatactaaaaaaaaatacaaatgatgaaaggaacacataattttgtgagataaatttgttcactgactttggtgtatttctgatttgtatttactaatcaaaagtcagaactgacatatacctaatattgagaataaaaatctgaataaacctagcttaaagaaagtaagcatgtttaacctaccaaccaaaaacagcctaggaccagatggatttacagctgaatgctaccagacgtacaaagaggagctggtaccatttctcctgaaactattccaaacaattgaaaaggagggaatctttcctaattcattttatgaagccagcatcatcctgataccaaaatctggcagagatacaacaaaaaaagaaaacttcaggcaaatatccctgatgaatatggatacaaaaatcctcaataaaatactggcaaactgaatccagcagtccatcaaaaagcttatccactatgataaacttggcttcatcagggggatgcaaggttggttcaacatatacaaatcaaatgtaattcatcacgtaaacagaagtaaaaataaaaactatatgattttctcaatagacacagaaaaggcctttgataaaattcaacatctcttcacgttaaaaattctctataaactagatattgaagtaacatacctcaaaattataagagccacatatgataagcccacaaccaatatcatattgaatgggcaaaaactggaaacattccccttgaaaaccagcacaaggcaagaatgccttctctcaccactcttagtcaacatagcattggaagttctggccagggaaatcagggaacataaagaaataacaggtttttaaataagaagagaggaagtcaaattgtctttttttgcagatgacatgattctatatctagacaatcctaccatctcagctgtaaagtttcttaagctgataagcaacttcagcaaagtttcaggatacaaaattaatatgcaaaatttgctagcattcctgcacacaaacaacaggcatgcagagagccaaatcatgaatgaactcccattcacaattgctaagaagagaataatatacctaagaatacagctaacaaggtatgtgaaggactttttcaaggagaactacaagccagtgctcaatgaaatcagagaggacacaaccaaatggaaaaacattccacgctcaaggataggaagaatcaatattgtgaaaatggccatactgcccaaagtaatttgtagtttcaatgccattcccattaaactaccactgacattcttcacagaattagaaaaaaactattttaaaaatcatatggaactaaaaaagagcccataaaaccaagacaatcctaagtgaaaagaacaaagctggaggcatcacactacccgacttcaatgctacaaggctacagtatccaaaacaccatggtactggtacaaaaacagacacattgaccgatggaacagaatagagaactcagaaataagactgaacacctacaacgatctgatctttgacaaactgacaaaaacaagcaatggagaaaggattccctgtttaataaatggtgctgggagaattggctagccatatgcagaaaactgaaactggaccccttccttacacgttatacaaagattaaatcaagatggattaaagatttaaatgtaaaacccataactataaaaaccctagaagaaaatctaaacaataccattcaggatatatgcatggcaaagaattcatgatgaaaacaccaaaagcaattgcaacaaatgcaaatcttgataaatgagatctaaataaactaaagatcttctgcacagcaaaagaagctatcatcagagtgaacagacaacatacagaatgggagaaaatttttacaatctagccatctgacaagggtctaatatccagtcgacgaggaacttaaacaaatttacaagaaaaaaaaaacacttaaaagtgggcaaaggacatgaatagacacttctcaaaagaagacatacatgcagccaataaacatatgagaagctcaacatcactgatcattagagaaatgcaaataaaaaccataatgagataccatctcctgcccgtcagaatggtgattattaaaaagtcaagaaacaacagatgctggtgaggttgtggagaaaaacaaatgcttatacactgttagtggaaatgtaaattagtttattcattgtggaacacagtgtggcacttcctcaaagatttagaaccagaaataccatttggcccagcaattccattactggatatatacccaaaggaatataaatccttctattataaagatacatgcacacatatgttcattgcagcaatattcacaatagcaaagacatggaatcaacccaaatgcccatcaacgatagactggataaagaaaatgtggtacatatacaccatggaatactatgcagccgtaaaaaggaatgagatcatgtcctttgcagggacatggatggagctggaagccattatcctcggcaaactaacacaggaacagaaaaccaagcacagcgtgttctcacttataagtgggaactgaaagatgagaacacatggatacatagagtaaaacaacacacactggggcctgtcagggtggggaagagttgcgaagggcatcaggaagaacaactaatgggtgctgggcttaatacttaggtgatgtgttgatcagtgcagcaaaccactatggcacacatttaccacataacaaacctgcacatcccgcacatgtaccttggaacttaaaataaaagttgataaataaataaaaaaataagcattttaaagtgcattgatgtcagggtgatgcttggataagaagatggtggaataacatggaaaaacaacattattctaaatctatgtgaggaggttaccaaaatatcttctcatttgccaggcaattttattttaggaattcatacatgggaaataatcaaacaagtgcataaagacatatgtatactaatgatgacaacaatataatttataaaaagaaaataaaactagaaacaaccaaaattgcctgcaataataaaattgggtacatgaattatggtacattcaaataaaggaatatgatgagataaaatggaggaagcatatctctaatccgaggcataaaaagcacttcatagcagatgaataagcaacatgtacaacatgaacccattcttataaaaataacctgtgtgttcaaatatattgctacatatccgaaagaaaatttacacaccaacatattaataacttgtagtgagattcataagtatacgttatgattttaggcactttttgtactttcttctaatttatatttttcttaactgtcaataaaagcaataacatttctgctttataaatctctacctgaaaaaaaaaaatgctacttcacatttaacatgaatttaggtttagaaattatatttgctaccatatttttagaacacaattattccttacttacctgagatagattaaatttaaaaattgtttcatttcttttttttccttttttattttacatgtgcataatgtgcagtttattacataagtatatatgtgccatagtggtttgctgcacccatcaacccatcatctacattaggtatttttcctatggctatccctccccttgccccccacccccaacaggccccagtgtgtgatgatcccctccctgtgcccatgtgttctcattgttcaactcccacttatgagtgagaatatacaatgtttggttttctgttcctgtgttagtttgctgagaatgatagtttctagcttcatccatgtccctgcaaagggcatgaactcattcttttttatggcttcataatactcagtggtgtgtatgtgccacattttctttatccagtctctccatgatggacatttgtgttagttccaagtctttgctattgtgaacagtgctgcaataaacatacatgtgcatgtgtctttatagtagaatgatttaaaatcatttgggtatatactcagtaatgagatcactgggtcaaatggtatttctagttgtaggtccttgaggaatcgtcacactgtcttcaacaatggttgaagtaatttacactccaaccaacagtgtaaaagcattcctattactccacatcctctctagcatctgttgtttcctgactttttaatgatcatcattttaatggcatgagttggtatgtcattgtggtttttatttgcatttctctaatgatcagtgatgataagcttttttcctatgtttgttggccacttaagtgtcttcttttgagaaatgtctgttcacatccttcgcccactttttgatggggttgtttttttattttcttgcaaatttgtttaagttccttctagattctggatgttagccctttgtcagatggaaagtttgcaaaaattttctcccattatgtaggttgcctgttcactctgatgatagtttattttgctgtgcagaagctctttagtttcattagttcacatttgtcaatttcagcttttgttgccattgcttttggtgatttagtcatgaagtctttgcccatgcctgtgtcctgaatggtattgcctaggttttcgcctagggtttttatggttttaggtcttacatttaaatctttaatctatcttgagctaatttttgtataaggtaaaaggaaaggatccagtttcagttctctgcatatagctagccagttttcccaacaccatttattaaatagggaatcctttccccattgcttgtttttgtcaggtttgtcaaatatcagatggttgtagatgtgtggtgttatttctgaggcctctgttctgttccattggcctacatatctgttttggtaccagtaccatgctgttttggttactgtagccttgcagtatagtttgaagtcaggtagcgtgatgcctccagctttgttctttttgcttaggattgtcttggctatatgggctctttttggttccataacaaatttaaaatagctttttctaattctgtgaagaaagtccatgataccttgatggggatagcattgaatctacaaattaatttgcacagtatggccattatcatgatattgattcctcctatccatgagcatggaatgtttttccatttgtttgtgtcctctcttatttccttgagcagtggtttgtagttctccttgaagtggtccttcacattgcttgtaagctgtattcctatgtattctattctctatgtagcaatcactcatgatttggctctctgtctagtactggtgtataggaatgtttgtgatttttgcacattattttgtatcctgagactttgctgacgttgcttatcagcttaaggagtttttgagctgagacgatggggttttctaaatatacaatcatgtcatctgcaagcagagacaatctgacttcctctcttcctatttgaataccctttatttctttctctggcatgattgccctggccagaacttccaatattatgttaaataggagtggggagagaggtcatctttgtcttgtgccgattttcaaagggaatgcttccagcttttgcccatccatgatgatactggctgtgggtttgtcataaacagctcttattattttgagatacattccatcaatacctcgtctattgagtgtttttagcatgaaggggtgttgaattttatcaaaggccttttctgcatctattgagataatcatgtggttgttgtaattggttctgtttatgcgatagatcacatttattgatttgcatatgttgaaccagccttgcatcccagggatgaagctgacttgattgtggtgtataagctttttaatgtgctgctggatttggtttgacgaattttgttgaagattttcacatcaatgttcatcagggatattggactgaaattttctttttgtgtgtgtgtctcttccaggttttgctatcagaatgatgttggcctcataaaaagagttagggaggagtccctctttttctattgtttggaatagttttagaaggaatagtagcagctcctctttgtacctctgtttaattcaactgtgaatccatctggtcctgggctttttttggatggtaggctattaattactgccttaatttcagaatttgttattgatctattcagggattcaacttcctcctggtttaatcttgggagagtgcatgtgtccaggaatttatccatttttttctagattttctggttcatttgcatagaggtgtttatagtattttctgatgatagtttgtatttctgtaagatcagcagtgatatcccctttatcgttttttatcgtgtcaatttgattcttctctcttttcttctttattagtctggctagcagattatctattttgttagtattttcaaaaaaacagttcttagattcattgattttttgaagagtttttcatatctctatcttcttcagttctgctctgaattagttatttcttgtcctctgctagcttttgaatttgtttgctcttgcttctccaagtcttttaattgtgatgttagggtgtcaattttagatctttcccactttctcctgtagggatttagtgccataaatttccctctaaacactgctttagctgtgtcccaaagattctggtaagttttgtctttcttctcattggtttcaaagaacttatttatttctgccttaatttcgttatttacccactagtcattcaggagcagattgttcagtttccatgtagttgtgcagttttgagtgattttcttaatcctgagttctaatttgattgcactgtggtctgagagaccgtttgttacaatttgtgttcttttgcatttgctgaggagtgttttacttccaattatgtggtcaattttagaataagtgtgatgtgctgagaagaatgtatattctgttgatttggagtggagtgttctgtagatgtctatcaggtccacttggtccagagctaagttcaagtcctgaatatccttgttaattttctgtctcattgatctgtctaatattgacagtggggtgttaaagtctcccactattattgtgtgggagtctaagtctctttgtaagtctctaagaacttgctttaagaatctgggaactcctctattaggtgcatatatatttaggatagttagtgaatctgggtgctcctctattagatgcagatatatttaggatagttagcgaatctgggtgttcctctattaggtgcatatatatttaggatagttagctcttcttgttgcattgatccctttaccattatgtaatgcccttctttgtcttttttctgtttgttggtttaaaggctgttttatcagagatgaagatcgcaacccctgcttttttttttttttttttttttttgctttccatttgcttggtaaatcttcctacaaccctttattttgagcctatgtatgtctttgtatgtgagataggtctcctgaatacagcacactgataggtcttgactctttattcaatttgccagtctgtgtcttttaattggggcatttacccaaattgcatttaaggttaatattgttacatgtgaatttgatcctgtcgttatgatgctagctggttattttgcccgttagttgatgcggttacttcatagtgttgatggtctttacattttcatatgtttttgcagttgctggtagtggtttttcctttccatatttagtgcttccttcaggagctcttgtaaggcaggcctggtagtgacaaaatccctcagcatttgcttgtctgtaaagggttttatttctccttcacttatgaagcttagtttggctggatatgaaattctgggttgaaagttcttttctttaagaatgttgaatgttgacctccactctcttctggcttgtagggcttctgcagagatctgctgttagtctgatgggcttccctttgtgggtaacctgacctttctctctggctgcccttaacatttttccttcatttaaaacttggggttgctcttctcaaggttatcttcatggtgttatctgtatttcctgaatttgaatgttggcctgtcttactaggttggggaagttctcctggataatatcctgatgtgtgttttccaacttggttgcattctccccatcactttcaggtacaccaatgaaacatagtttggtttctacacacagtcccatgtttcttggaggcttttttcattcttttctttcttttttctctaatcttgtcttcatgctttatttaattaagttgatcttcaatctctgatatcctttcttctgcttgatttggccattgatacttgtgtatgtttcacaaagttctcatgctgtgtttttcagctccatcagatcatttatgttcttctctaaactggttattctagttagtagttcctgtaaccttttatcaaggttcttagcttccttgcattgagttagaacatactcctttaactcagaggagtttgttattacccaccttctgaagcctacttctgtcaattaatcaaactcattctccatccatttttcttcccttgctggcgaggagttgtgatcctttggaggagaaggggcattctagtttttggaattttcagcttttttgtgctggtttttcctcatcctcatgtgtttgtctaccttttgtctttgaggttggtgaccttcagatggagtttttgagtagtcatcctttcagttgatgttgatgctattgcttcctgcttgggagttttctttctaacagtcaggctcctcttctccaggtctgctggagtttgctggagttcactggagttcactggagttccactccagaccctgtttgcctgggtatcaccagtggaggctgcaaaacagcaaagattactgcctgctccttcctctggaagcttcatctgagaggggcacctgccagttgctagccggagctctcccgtatgaggtgtctgttggcccctgttgggaggtatcttcccatcaggaggcctggggatcagggacccacttgaggaggcagtctatcccttagcagagctcaagcgctgtgctggtagagccactgctctcttcagagccagcaggcaggaacgtttaagtacagccaccccttcccccaggtcctctgtcccagggagatgggagttttatccataagcccctgcctggggctgctgcctttctttcagaaatgccctgcccagagaggaggaatctagagaggcagtctggctacagtggctttgccgagctacgatgggctctgccctatctgaatttcccggtggctgtgtttatactgtgaagggaaaaccgcctactcaagcctcagtaatggcagacgcccctccccccaagcttgagtgtcccaggtcaccttcagactgctgtgctggcagcaagaatttcaagccagtgtgtcttagcttgttgggctctgtgggggtgggatccactgagcaagactacttggctccctggcttcactttcctttccaggggagcgaacggatctgcctcactggcgttccaggcaccactggggtatgaaaaaaacttcctgcagctagctcattgtctgcccacacagccacccagctttgtgcttgaaacccagggctctggtagtgcaggcacccgagggaatctcctggtctgtgggttgcaaagactgtgggaaaagcatagtatctgggcctgagctccatccctcacagcacagtctctcatggcttcctttggctaggggagggtgttccccaaccccttgcacttccctgtgaggcaacaccccaccctgcttcggctcaccctctgtgggctgcacccactgtctaaccagtcccaatgagatgagccaggcacctcagttggaaatgcagaaatcacttgccttctgtgttcgtctcactgggagctgcagatgggagctgttcctatttggccatcttgcccgggaataaaaattgtttcatttcttaaagaaaaatggactttgacaatctctataataatgtaaaggaatgtatcttttatttctccatttcctcatattgatgagattgtcatattaaataaaataggatagcaaagtttggccctatcactttaattaatgtctataagttagaggattaatattatattcagatgtactagaaagcatctgaaggcaatatactgatagcaaatggaaaaacatcccaaagatatctgacagggtacacaaattcatttatgtagatttatggtagagcagtgagtctgtcatgtgttatcttctgagatcagacatccttgtttatcacagtgtgatattttgaaatattatcaattcattattgctacaagaactgtaatatggataggtgcatatgatcattagtgatattccttatactgatgatgttttactcttcttaaaatagttcttcctgtatactcaaaattccaagacagtataagcagctcataaactggtaatgtaggaaaagagcatttggtgaagttaatcttataacaaaaacaaaatagaggctgcaaagagatttggcaaaaatatagggttattttaaattttgaggaaattatgaatatttttaacgcataaagtcttttgtaaaattattttttacagattaccatttgacttacaaggagttaattaaaaattattctgaaaaattatgtgcctttttttaagaacatgggactttctacaagagagactggcaaatctacaagatttcaagcaaattcaagttataaaattaagcagtcacagctatgatggtattttaattcttccattctgttgtgaccattccagattctttttaaataaaaaattaagacatttaaaaagcttctgtttattttagccatgaagaaagacggttttgtttcttcatattaaaaaatggttatgtttagctcatttatccagaccttgaaattgatctttcatttactataagtctgtaaataattttataatatttataaagaaaactggcagtgacatttattggtctacatcatccagggaagccagaaaagcatacattttatatactttaattaaaatttacttcaactgtatgttaaactccttccaaatactgacattttagataaagcccatgaaatgtgtattttaaatttaaaaagaaaaacaaaacgactttataagaatttcgacaatgaatgcaacttttaccattttaactagccagtttcctgaagacattaaatgtggaaaatgatgctaagcaaattaagcaaagacacaatagcagaaccatatagtctttgaatataggaatgtctcactccaaagtgcatgtctttttcagggcaccacacactgttactacacatatgatctacattctagactggagagagaagagggttttccttaacttcagcaaacaaaccacgtgcatgaaataaaggaaaaagttggttcaacagagtccatgagaaaatccttagaagggctgacagcaatcaaataaaatggcatatttgcccataagctgctgtcaactcgggtggctttaataaataaaagtcactggttggccgggcacagtggcttatgcctgtaatcccagtactttgggaggccgaggcaggcagatcacctgaggtcaggagttcgagaccagcctgaacaacatggagaaaccccatctctactaaaaatacaaaattagccgggcatggtggtacgtgcctgtaatcctggctagtcaggaggttgaggcaggagaatcgcttgaacctgggaggcagaggttgcagtgagccgagagcacaccattgcactccagcctgggcaacaaaggtggaactccatctcaaaaaaaaaaaaaaaagtcattggttaacagcaccaccactattctgtaaacaaagcaagcatctctggagtataaattctggtgctccattttaagaggggcattagcaaacaggagaataaccaaaatactgaaagaatagtcaagatattgaggaatattcacctatgacaaaagagcatgataactatctgatatggctttgttgtgccccacccaaatctcagctttaattcccacgggttgtgggagggacccagtgggaggtaattgaatcatgggggcagtcttccccatgctgttcttgtgatagtgaataagtctcatgagatctgatgcttttaaaaacaagtctccctgcacaaactctgtctttgcctgctgtcatccatgtaagatgtgacttgctcctccttgccttccgccatgatagtgaggcttccccaaccatgtggaactgtaagtacattataaacctctttcgtaaattgcccagtctcaggtatgagtttatcagcaggatgaaaatgaactaatatactatctttatgtatttggaggtccatcatgacttatgtccttcctgctggcattaaagaaaaaaaactaagactaaaatatggaaaatgatttgagattaggtaggtaagtacttgctcttcactggactattacaaaatgaaatggaattccttgtcaggcagtaatctctctctcaatgaaaatgcacaaattcaaaatgataaacatgtgaccacctatctggaagccatggacatgatgacttcacagagtgggcagtagtcactaaaattcctaccctcaataaaattatccaatttgggtaaaattatacaattttcctaaactatagtctttttttaatgaacgattttgttgttgttgttgttgaaataagacgtaaaatgctaaatccataggttgattttaattccctaattccagttattagcttttctacttagcaattattccttcctccttttccttcctcctctctacttctcctcttccctctcccatgcccccttctttacctcttcttcttctctctgactttctaacaaacaccttcttagcaattactatgtgccaggcactactctaaatacatttaaaagctctttcatttaatccttactataaccaatgagaaggtgatatttattatacacctcctttagtcagagaaaggttaagtaacatgtccaagatcacaccaataaatttgcttctaccacatttgatttctaaatagtgcttaacattggaaaaaaattagcaatgtgcaaaaggaaccaatttgtttatcttgagcagccaggtataagagagtcgcagccagacgaggaaaacattttagggaaacataatttatatgtttttttaaacttcagcagaaggaaagattataaaattaaatggaataataaagttaggaaaggacccacccaaaattatttagatgccaaagtaagccaatctcagctgttcttctctactctgcctgccatcctcagcaaaagcagtatgggagagagtgtgggcaaccggctgcagtagcagctgggcctatttgttaagaggaaaaaaaaaatagtcattgaggataaagggagattttgggtgtctagcagtgtgagtggaaacttggagcttggctggggagtcccagaagtgaaaagcagcagtgctgtcatcaacaaaattgcaatattacacacaccattcacagggagatcactccctgaagtagttccttaactggcaagaattcttttccacccatagcaaaacaaccaatggcaattttgtatttgttttctcacattaacagtattctagacattcaaaaatgaagcactaccaactctgctaactatccaatagatataaattagctgactaaaaggacaaatggcatttctaacttaaaacaatatattactattactatttgttgactaatataaaaacttaagtgtctaatacgcataatattatattctaaacataaccacatacaataaaatccttgaattgtattttatgtcccttgagaccagtactatagaaggcatctaacgtgtttctgagtgataactgctttattagtgtgtaagctatctcattggtaatggttttttagttttctcatttttattcttgtttaactttattaatttttaaattagagataattcagttttttttctccagataggaaaaatccttctgcaatcctaaaatatatcagacttcagtttgggcatacacattttggagcaagcaaaaaacatttggcaaaaaaatctgtcaaaaacagtgcccagtacataacttttgtcttacttctgagcagtataatgacaaaatgctatttcattcttttgattgtttttttaattgtatagttgacttacctataatattttccttcttattatggttatttaaatattattacaagcgaattttgctttggggaattacaaggaaattaaaccatatgaatgtgttacaggagtttaaacacattaacttcttatgactgtaacaatataataataaaatcaatattttgggtggctcattaaagccattctagtattttatagtcctatcttctccatctactttcttctttctggacaaaataagaaaaaattattttctttctcatattaatggaaataaacaatgatttggataattgaatgtcccaacaactaaaattataacatttgactttgaaaaaagttctttctctttataatttacgttttgattatgggtgatatggttattctaagaatataccatatggttagctcaagtttatccagaccttaaactgatggcaagctcaatattctagtactcattctaaccaattataaagtatttgtggttaccattcatctgaccagaaatatgtgtaacacttatgctttgtgacaatgtcaagcttaaaattactttttcctttctttattttctgtttgcttttattatattatttattttgcttaggatcaggaaaaataagttatgtcagtttcatcaataatacgctgttttcaaaagaaattattttttccttaccattatttttcctaaccctttctttaaacatatatcatttttgctttgctcaggattatagaagtgatcctaatttctatagacttctttttatagattatctttagtttctaaaaataaaataatccagtgcttcccatttctatttttatttactctttataataataaggtatggtgacaaatgtgtgctttcttcttaatatgacatttctatttatgcccattagtttacagtttgtgttaagtgcattgtatttaattaattatagtatagtaccaaaaaaaaacaaacttaaggatatagcatttcaaaatatattatcaattgattttgataaattaagtacatgaaaaaacattttttcttggcttatagatatagtaaaatcttagtaaaatgaaattttcataagttctttctcaaataacctgggttgagaaagtcaaatagctttcataaactaagtagaatgataaaacatagccattgcttttccttctcactatgttactaccaatagctgtgcttttaaaatgataaatgaaagacaaatggccaaattattcataaaacttttgcacagagacagactgacaaaaaaaaaaaaaatcttgctttggtcaattgggcctttctgaaaaaaaacaaagatgggtaaattatcactctttcccagttctgactttcttttctttctgctttgtcatggtattcttgtattcattctttttctctgtttcttcataatttgtcactgtagaaatgaatgaaattggaaattgggagatcatgattggagcaagtgggaagaaaagttgagtcaaatgtgacaataatcatttgaatggcccagatgaattcatactgtcctctgccacagcctcaaactatatcttttaataatttacagatattttctgaataattttaaagcagtcctggatttctcttcagaacttttgtaatggaagagttgaagccaaactagtgcctaatatgttgcaaaaggggcagaagagaaatagtctcatcatatctcctgtattctcaatgctctcccaacactatcatttcattttctgccatctctgttaggaattgtatgtggtattcagcaaaagaattaagattggtaacactagtgtgaatagatatagatatgtatctatatagatagaattaaattctgtatattaaatgcaatacataaagtatattcagtacctaaagtttattagattctaagatttgagcaataaaatgcaatataactgccctcagtattttcagactctaattgtgaatttgtagtaatcatatttctcatacaaaaaatctgaaaattcctcaaagccatttagaaatgggggaaattaaatttagcaaggacaaagaacgtgtgatactagtgtgtgtggtagagtcatgttcccagtggaattaagttaatttctgggagaatacagtgcattatatgcagtgggatgattgtgggcacatggcaggatggtgcaaggcaaggtatgacatagctaatttgttcataacatcttgcccaagctcctcctgttcatgttcaagactgagctttgggtctcttttcagccccaacttcatgctttcatagcatcccttgatatataaaaaaagcaccctactttattacgacctgtctccttttacaactggatcttaagcttcttgagaactgggtttgactaaaagctatgtgtgagagtgtgtgtgtgtgtgtatgtgtgtgtgtgtgtgtgtgtgaaacttcttattttaaaatagttttaaatttacagaacagttatggtgagtacagagagttcccctatacctatacctagcttcccttgtttacaatatacattgtatggtacatttatcagagttaataaaccaatattgatacattattattaattaaaattcatactttatttagatttccttagtttttatctaataatcctttactatcccaggattccaaacagtataccacattatgtttataaaactggattttttattcttaaaatcctagcatgatgctcagtacctaaagcattgaagaagctgaacaaatacttataaatgatttaataataagccaaatctacttaaaaattataggctcttttaattctctgaaggcaatgatatggtttggctctgtgtccccacccaaatctcaccttgaattgtaataatccccatgtgtcaagggtgggaccagatggaggtaatgaattatgaaggcagtttcccccatgctcttcttctgacagtgtgtgagttctcgggagatctgatggttttataaggggcttttcaccttttgctctgcacttcttctgctgccatatgaggaaggatgtgtttgcttccccttctgccatgattgtaagtttcctgaggcctcctcagccctgtggaactgtgagtcaattaaacctctttcctttataaattatccagtctctggcagttctttttttttttttttttcattcaaaatattctgctaatttaacgtatattttagaaagaggagatccttacaaggcggtaggacagtggtttctgggctggtgtccaagatcaaggaggaaattgttgtattctgtcccttgaaaagattatgatagttaacaaatgcacatggtcactttacctattattaatgtgattaaaattaaagtgtttaaagcaataaactttgttaattactcattatatatagctatccactatttcccaaagctatatccattgattttaccccaaaagaatttaagggaaaaaactttagaaagcctttctctatgataacatagcatcctgtgcactctgaaatgaattatgtgttttaatatgtatattgtgtggaaacaacacagctttatcgtgcatggtgagcaatgaggtcattcataacaatattaatggaatgtcttaattttatcacactgttgggcagttctttatagcaacatcagagcagattaatacaggccatgaccaagatgtataacaaaggggatgaagtggtaagcgacatctaatttcatttctccaggaaaacttctctttgagacatggaagaatttttgaattttataaaatgcttttccatgatcgatccatattagatgttttctcatcagaactcaatcatagctacatcatgctacaatttacaccatcaataatctttaaaaatatttaaattatgtgctaaattgtcatcaatgaataggcacactttatatttaatacaaaaatatgcagataatggtaatatagttagatatctatgaatctaagtatatttatcaagatcaaggctgtgatttggacattcaacaacacccttaacctaggggatgaagctaaaggaggaataaatgaaaaaggtaatatgagcttgaggcttttttgtagcatccttccacacacacagcccagtgtttctcatagctgagtcttcactaagaatcacacacaggacttgttaaaacagagattcctggccgggcgcggtggctcacgcctgtaatcccagcactttgggaggccgaggcgggcggatcacgaggtcaggagatcgagaccatcccggctaaaatggtgaaaccctgtctctactaaaaatacaaaaaattagccgggcgtagtggcgggcgcctgtagtcccagctacttgggaggctgaggcaggagaatggcgtgaacccgggaggcggaggttgcagtgagccgagatcccgccactgcactccagcctgggcgacagagcgagactccgtctcaaaaaaaaaaaaaaaaaaaaaaaaaaaaaacagagattcctgagcctcagaattattgattcagtagatctgattcagcagctcccagggaatgctgatgttgcagtccatggaccacactctgtgtagcattcatttaactccagtttccatctcctttctgacccagctcagaagcagagcagaagaaaattatagtaacatcatctcctgtgcaatgtaattcaatcaagacttcctgcaggtgaattatttagcagtagctctgaaccttctaaaaaataaagttagcctttatagttgtgttattttgaccataatatggaagccaactaaatatatatacatttcaattcagtagataccaaagcccaggcggtaattatagcctttaggaatgatttgaagtgaatttattccatccccaagggtcttacaaaaaattactccttgccctgaaggacctttaaatatatttaaaaacaattacataaattagaaagtattataagatactataacaccatatcattcatctttgtgatacatttaaatttttttctaccaaaaccatacgagataggaagtgttcattagtccctttataatgatgaggaaaggaagcctcagttcgatgatttagcaagaataagacagcatcaaataaaatatactgtagattcaaaaattgtaagtctataccctttccactacagcatactatctcctaatacaagtttcagaagtgttttggagaaacacttctgaagcctggtaaggagaagaaaggagccctacatttctatacttggaaaggacctgaagttcataataaactttgtgactcagtgttaggaaaaaagcaatcaggaggagtaaacagctatacacaatgctgagagtacatttcctatttgactttacttccacagtgtatcttaaagcccctctccattcccatcatttcctgggaaagaacaagtcaggagggaaagagtcagtgtcctcagctgacctctgttttcaccctcttttattctcattttctttgctgctgttcttttccggttctgaagttgatctggctacctaaaatcacccctgggacttattcttagggattctgttccaccactctatcctgtaaataaaaccccctttttattctggtttccctaaattaaagctcaaaactcagagaaaacaaaccaaaagtgcatagaaataggtttacatcaataatattttaactgacatttaactccagtttagctacagaatacttggctggcaggctctgctctctcctgtgcagtgccctaattcctctcctctccaattgccacaatcccatgttgcctgagagcatcagcttcccagcggaaaaacaggttggagaaagagggcacattgtccaggtggctagtaagctatttacttagtatttcattatttcctacatcatggatttcaaccaattttcaatacctagtaagtttaaagtttttctaaaaaattcaaaggttatgttttatatttattgtgttaaacaaaaatgaaacaaatattgaaggtacacagaaggccaatgaatacatatctttcactaaaagtatgttttctttccccttttggcttaaggtgaggaagaaatcaaaagtatttatctggaagagaagtagaagaagagaaaaagagagaaggggtggtgccagcctcacaaaggggtacacagaattaagtaaaaacagaaagggaggagggggtatagtgataacccagaaatgacaaggataacacaagacagatagaaggaggaggaggagaggaagaagagaaagagaaagagaaggaagaaaaacaagaggaaggaagtagagaaaaaggtggaggagagaatgtagatgaaagaattcaactgatgtgtcaggagggtgcctggaggtcccagctgtttcactaaatgcagcactgatgagaaagaaggtgaatagacagaaagccccagccttttctctaacatatgttatgctaaaggggctataaatagttgtccaggattcctcagtttcatgggtattcctgcttatcccaccccatcatcttttcctttgaaaaacacagttctaaatcattttgttttattcagatactcacttgatgagcacttgttgaatgcctactaagtgtcaggaactgtgcatggcaccagatatcttacctgttcatctaagggaaggcaaagtgggagactttctttcactttccaagtaaacaacacatgctgagctgatagctgcctataggacactgtttagttt

SEQ ID NO: 2737 - DNA, 285258 bp, Homo sapiens
  source 1..285258: mol_type = genomic DNA
gagacggagtctcgctctgtcgcccaggccggactgcggactgcagtggcgcaatctcggctcactgcaagctccgcttcccgggttcacgccattctcctgcctcagcctcccaagtagctgggactacaggcgcccgccaccgcgcccggctaattttttgtatttttagtagagacggggtttcaccttgttagccaggatggtctcgatctcctgacctcatgatccacccgcctcggcctcccaaagtgctgggattacaggcgtgagccaccgcgcccggccaggtcaattcatttttaaggacaacagctgctgtttgtttcatgcttaacaccaacactcaaaatgacttatagtattttacaaattttacaaatgtttataattactatgaagatttacaaaaccctaaaacctatagcaaatatcgaacactcattacaaacattctaagtatttaactaattttagatagaaaaaactctaaaatatgtatggaattgccacttactaaacaggcagactttctgttcccttttttctagagctcttattagtgtttatccttatttttaatccctgtttctccaagttgatagctttgctctgaaatattcagtaattcacacaaaagaaaaaattagcaatatagaattatagacgtggaatcacgaagtaaaatcttttttgttaacaaatctggatctcttgcccaatgggtgacgttgtgctgaaggaggaggtgaatgggcattgttttatgtcaaaactaagtctatccacaggtcctctcctgtaacaaagatagaagaggtctaaagaagcaggagaccggccctcgatggaggtgcctcttagaaattagatgagtggttatgatttttgctcaatgttgctagagagcatggtttctctccttctacaagaaagagaaaaatggggaaaatttggtgagatgaagggtgaactcttaattcctccaagtcttgtaggtatctaagtatgtgccctccctgagttcagagaagatccatccatttttaatttttaaagcctgggcatttctcacaacagattctgaatttgaattaattctaacctcagacagaacaaaagactggggatgtatttttgtggtatgttttagattctcaagaaggacagaacagcatagattgatttatttgtattttgatagggcagtgaagatttattttatagtatgtgaggggtgtgtgtgtgtgtgtgttgggagagagagggagaaactgagaaaatggtgggacatgaaacatatccttggaaactgctttctctctcccttcgtctttctctctccctccctcttctttcccatttctcttcagtactgccataaacaggcgggaagcaagattatatacatatatatgtacatatgtgtgtgtataattatatgtaaaatttagtggtctcaccaaattgtggacttgggccctcaaagttttcttatcaattttctttcaaattagcattgaataaactttctttgggtttgatttattttcctataataaattttagcattttatgtaaaatgtttcttttctggttaatagtcactttattttaatcaaacgctcttcagtatatggacttcttatgacttgtgtcatagaaaagctattttcctctgcctattgcttcagttaccaaatatttagtttacaagttacaccattgttatcatcattaactacttgtctgtgttattgcaattaaaatgataactatttatgtcttatctgcctttttaattttaaaattcagatacaggagaaaatcctgctttctttcttgtgtgttaatggaaggcaattttcaataaagtgtacttaattgacttatttgttcagacataaactttgtaaggcccctgtgatctgtgtttgtggttctatttctccaaattgagcaggcttttactgaatatagtttttaaaaatacatttcactacatagtcttttcagttattatttaatggcagtaatgacctccagtggattcttgggtaaatagcaagtggaattttcagaggatgtcaattttcagtatatttgcatttcttagatcttttgaagcatggtgacttatctgaataaacttaaatttttcttaaaatatttatgtatttgttcattttacaatgaaattgcaagtgattatgagcactttaacttaaatgtataacctataagctaactttgaaaactgaaataaacactgtttaagattaatatctaaataaatgttcataatggttctcctgtgtaatccacttgctttcaatttttatttaggtgaaaacatcttacaaaatttcatattttagaaaggtaattgctaaatatttaatagaagaaggaaagactttgataaataaacattcttaaaaatacaattgttttttataacatttaagagagaggtaaaaatgctctgaatatctcagtagttaagtgaactcatgaaacaattttctgtctcttaatataaaagagagaagaaaatttgatatttgagagcaaatcactttaatatttttttcacaaataaaacacggttgttatagtatattttagatttcagcgaagattatttagaaacttaaaatttggagctttaatagattttcagtgctgcaaaatcttcatttttgacttgtgagataaattatctataaacaatactttcatattaaagtatgatacaaggattaacatgttttttatttcagttatttgtttctgcaaatgaacttgatgtatccatgtacctactgataatctgctttcaaatctttcctaaacagatatccgtctgtagagaaaaaagaaatgtgtgagaatataattttttttaccacaagagggaagcaaaaatcttttacagtagttagaatcctaactataacttcatctgatttgacattctttctgagatttgatatctttctgagaagttaccttagtttttatttccacagtgagtgaaaattaaagactgtgttataaagcaaaaatagtgtgaatgtactttaatgaatattttacgaagggcacaagcctcagaatgacatttttcctttcatgggttacagcactcacaacacacctgctacttaacactcatggcttaaacaacactaataaaataatccttaaagagtacagaaagttcacatgagaatgccaaagtatcttgtattctgcatatcttacattgtgatggaaaagaaaaattcagaaatattaaaacatatttagttttatatttaccatgattataagtctccaatttttcttcaatattctaataatcttgtcttccaaaagtaaaataataattttcacagaaaagcagccaagtactgaaaataacagctacagttgttttttgataaacataatgagaaaccattaagcaatgcatttatttaaaaaattagttaattttatgtaaagtttatccagtcaaatgagtatgtagaataatttattataacaccttcatagtcattcctgtattacagaaatctcttttaagtaatgcaaagaagttggatgatttatttttttacttttttactttccaaatataaattcttcaaaagacagtagatagtctcaccccatcaggagtccagcgtgtgcctgggcaggcggtaatgctcaggtttggaacggagcttcttttcctgagggttggcatacttccacttggagggtgacattttaagctttttcctctttctatctgtgcaccatactttctcgcagtattcttccactctctggaagttgctataaccgatcagctgcaagaattccttgtaccatggttttgctccctgcgagatgctactctgagcaggacaaggcatcctgtgatgcctgtcctcctcatcgtccttgttaaacatatcctcgactttctcctcttccactacctccaaggtgattttacggaccgtatggacaaagctatgctctactgtctggcaaaaataggtcccagcatctgatttgtgtaaccttaggaagagtaaaccaaggtccatcttaaccactctgtcatctgtcttcacctgcaaaaacaaaaaagtaaatggcactgaagtacacaggagagaaaataacaatccatcaccctttccactacctatcttgaattttttcattttcactgtcacataatgaaaccctgaaaatcatacatacacaaaaatgctaaataattacatctctctctctctctctgtgtgtgtgtgtgtgtgtgtgtgtgtgtattctgaagatatttacattggtggtcacttcatatcaatgaccttgagatcattttatatcaatactgtaaagtaagagggttttctccctaatgattcaattaatcattagaaaaaatacatttcaatatagcagtcacagtaagagtgaaaggaaaatttctaaaatttattttttaacatttgtttttcaatggacagaacaaataccacttcccacattctttcaggaatgattatgccctccagatggtagtgaccaatgtttctacaaggacctctctttggagaactgggctcctttcactttgtcgtcttacaaaaaaattcatcagttaatcagttcagtgaacatcccttacattttcataggctgtcctttacaagagattaaaaaataaacaagtaaaatccagttcctgctctaaaggatcagacggaatagcaaatattaagtttcaatataccttcagtgctcaaatatcttttgtcatgtatttgatataatactcacattatttctataaataaataattataattcagagtaagaagagcaagataaggctttcaacgaatagctcatgttttatcacaaatagctggactagtaagtaaatgatttgacattaggcagagttagagtcaaatattgccaccactatttattgtgtgatttagggcattcatgtatgtttcttgccttagttttctttgtaaagtggagataacttaataacctgaaaaattgttgtgaagattaaagaaaataggtgaggattttttgcacagtgctatcaatagctacctctacctttctactatacattcatctaaccaaaaacaatcatgttttcctgtggcccaggatcttacgataatggtataaaggtggttcacagtatgctgacagatttcacctttgagaatacaaaaatgaaagcaatattcttctttgtcaatataaaagaaatgtagaggcaataattacaaacaatttggcaataaaggctattaatgataagcatgtttttgtccctgtgataggtcctggccaggcatgccagactcagctctttcctgccttgatgagacctggcatagatgaagtttcaatgtgattactcaggtgtagaaactggtatccacaaaccacgatttgtggaacagatggcaaaatgtagtaatatagtaagaaatagggatgttatttttaagttatgtggtgccccaaaggcatttttttcagccattataagtaagttaataactcagaagcttcagagtgtcctagttgggctaataaaagagtctccataagtcttttgcaggtgcttcccttgacttggtgggaccatgtcctggtaggcagaatgctgtagccattaactggagagtgaaatcctccagtgaggaaccaagaagaccctcaaagcaaaatcatcttcaccacatagaaacaatctgttttactgatacatttttctcagaatatccttagcaactgttataggcaactaacttttaaaggactttgtgtacctctgcttgtttactcatgcctccaggccaggcttctgaacaaacttattttccagcactagctttctccataactttaccatctattgcaacctatgaccaccccgtgcctcacatgatactgactctgaagtaagcctccagtgttttaaaatttatcgctgcatttgatatggatgaaatctgcctccttaaacatcttttattttctgtgaggtatgtgccattatactgtccttattttccttactctttcttggtttcttctgcagatttctcattaccttaaggtgcaatcctccatccttcactgatcttacattttatttccatccatttgatagtacttttattcctttgtttcagccagcttccctaaaatggtacatcttacacatagataatccattgttttgtgttttctgttagttaaaaaccaaaaacaatggatttggtgtttttaattaaagaaacataaataaccctttaatatgtacaattcagtatcttcccactcaaactgccctccatttactaactttcctatttctggccatgacatcattattcttctagtctccctatcctcaattgttgatcgtttatacttctctctcattatatgctatcacaaattcctatttacatttcttcagtggtgacccttaaaacaccccttcctcatcaccatttttgctgcaatgttaaattctcataccttataactgtctctttgaccttatctcatgacaaactctccaaatcttccctttttttctgtttcttctttcatacccagcttgattctgtttcaggatctctgtgtatatctctgccttcagatacttctttaaggctgattaattctcatcctgcgtaactgaattaaatatcatcttcccaaactggcctttctcacaccctgtaaaagtgtcctccctcctttattaccttcgtttcgcctgttaaccttcatatacttgagcatgcaacattacatacaagtatctaacaatagtccttcaattaaatttcctgtgtcatctttccccccttatttcaacaaatggatactaatttactcttctttaaagctcactttcttttgtcaacatcctgatttagaacttattcagatctctatttcttgcctgagcagtaagaattgctccattaaccagatcctgcttttgtaaatctagaacccaaaattgcttaatgtagtgtttctcaaactagcgttggtggaagaggtgcatttgtggggatgtggagatcagctcttttttctataaggattttttaaattattgtgtttattgacacaaaaatcaatatgaattaataaactatatttggaatcatgtgaaagatcaatctcagtgttagtgtttatgtttatcatagattctgaaccactttcaaagccatgttcccaaatgataaaaagaacaaagatggtataatatgttaatgataagttacagcgaaatgaaaatgaaacaacatccccatgtagtaatacacataaaaagtttcaaggtcacttgaataaagtgttgggaggatggagtcatcacatggtatagctacaggcagaaagtgttatacatacacatatgtggcaatctgtgtctcatcttacaaccatagagatacatatttcagtaaaaacaaaacacacagtaaataaacattttaatgatgcgtcaatttgtttataatttatctttaattttggttcaatattttaataaaagctacaagcgtaaggaatgtatgtgttgttttattcttgtgaatatttaatgaacatattaatataaatcgtgctagcagcccaggaagatgtttcacttttaagggcaggtggtgggggcaacctgtacattaccagaatcaacccctccttttcataattctttatgctgccattcccgtgtatcgccaccctgctttccactcacagctcttactctgaacatactctttttcccttaaataaactcctttctactgtctaccaatccatttgttttttcatttccttccaggcttaactaaactttcccttcctttataaatacttcctttatagcccctaaaggtattttgcttctttttgtaacacaataccatttacatttgtagcacaaaagctgttatttatatttcttttcaaattatttttccacacaagtttcatctcttcaaacatataagtttttaaagggcaaagacctatttctttattcttctgaattatcctataatgagtaaagaattcagaagatagtgtaaaatgagaacatactaattcatttttagagcacaaacatgtatagcaatggggtatatccatacagacatatccaaaagatattaaaaacttccaggtaaatccaataataatttgaataagaaggagcaaacatggtttcaggagcacttagtaactgatgaaagagggctacatcacagatacgtcttaggacattgcctttacctgaaaaaaaaaatgcatacaaacatccttattgaatatgatcttttgttgtctctgttatatctcctgtgagagtgaataatacatgagaaaatattaaagtgatctagcctagtttccagcatatagcaagcagtttatgaaagtgatttaaaagaaagcaaaaagcaaaactaaaaataaatacaaattcttgaccactagaattagggttgtttgtttgttgcttgttttttcaagtttggtaagttaaaaaagcagggtttaaaaaaaatcagaaacccaagtttgagaaacactgtattatgtacatataaagtccagattggtcaagatacaagatacggaatcatgacaattaccatagaaattgtcctacattgtttatttccatgttagagatagtgcctctcagaattttgatctacactcttggttatgacaaatacacattacaaagacaggaatataagctgttttcatgctcggtctggagggccatacattatgtaggttaaatcacctagaaagttagaggtatcttacatggactataaatacccaaaaatataaaatgacttagaaatttgtatctgaagttcttccacaatttagtctttccctgtcagtttacttgggtacctccaacatcaaatcttgattacagaattgttttcatccatctgtgtttttttctacgtctgcagaccagattttctctgtcaagaagatagtgcataatacatcatttctatcaaatattcttataggcaatctatataaatacaaaatttttgctgaaaacggttttattattcttagctataaagattgattcagtatgttttataatttctagtaaaaaaaaaagtaattgaacaaagaactctgaacatctggtagctggtcaggaagaagcagttatttccatgtctaccaaccatatggttccatactttcacaggaaaaggacagacataggccttgaattgatttagttgagaatacatttaataataaaatcagttttagttaagaaatagaggaaacaatttatatatttgtttgtttatttatctggcctgcctttgaccaattttatacatatacacacatacatatgtatatatatttatttattttacttacagaaaatatacctaatatgacagagcataaaaatagaaatttattttattaaaaacactttccaacataaacctgatatatgatactgatggttacctagtagacaggatgaattgtttaaaagctcattcggggaaacctatcacactacgtggagaagaacaaatgtggaaaaacaacgcttattttaatacaagattatgcaggaaagaaagtcattataaataactcaaaaccataacatgtaaaacatgttatattcaaaaacatacacgatatcaaaggagaaatttagggcatttatattcaagaatgaattaatgtctagaagaggcaaaagagtttttcaagtcaacaaaaagagaaataaaaaagaaaaaatggaaaaagcatataaatgggcacttcagagaaggagaaacccaaatgtttagtaagaatgcaagttaacattcaacctcactagtaaggttagaaactcaaatttaggccgggcgcggtgtttcacgcctgtaatcccagcactttgggaggctgaggcaggcagatcacctgaggttgggagttcgagaccagcatgaccaacatgcagaaaccccatctctactaaaaatacaaaattagccaggtgtggtggcatatgggtgtaaacccagctactcgggaggctgaggcaagagatttgcttgaacccaggaggcagaggttgcgataagccgagatcacgccattgcactccagcctgggttacaagaccaaaactgcgtctcaaaaaaaaaaaaaaaaaaaaaagacagaaagaaagaaattcaaatttaaacaagacgttaccctatagccagaagaaagacaaaacttagaaaacaagataataccaaatgttggtgagcatgtggggaaacaggaacccacatgaactgctttgggagtccagatggcacagatatcctgagagcaagctgacaataattacataaatgaaggatgctgacaaataataatgcagaaacttccactcagatctataaggggttatttgcagagatgactgtcaaagatgtgatagcaagagttaattacactctggatgtccacatttaggggaattaagaatgaattaagagcaatgtatgcatgctatggtatgttaagtaacagtcaagcaatgaaatagagacacaaacagcaacagggataaactgtaaaaacatagtgctgagttcacaaagtaagaaggagaatataatctataatataatacatttacttttacagttcatgcatactcaatatgttatatacctgttcaatttgcaaacatactattggacttattccaatcattcaacagatgcatatggagaaacaaggatgaaagtagaaaaaggaggtccaggaaaaacaaaatcaaacaagagaaatttgtataaaccaatcatcacaatgtaccataaactaaatcgtatgattaagtaaattatgcatctgaagtgaaaaaaaacaagagccaaaatcaagcaagcaaaaaataaaaaccaaaaacaaaaactcctgttgtttgtaatgattaatgcggtttgacaaccaataaactaagtttgtaaagagaggtttgtgattaatggtttattcaaattttccatagataagaatctcagactgaagagaaattaagtttaaaaagaatgaaggtaaagacaatgtttgaaaacaaaattgcacaatataaggaactgtacaacaactataattgaagtagaaattcaatactaaatttcctagtaaccaaaggaaagaagaaagtatgataaatcctaagatttaaaatgtctctaaaatatatttttaaaattactccttatgataagtacatctttcctggcactgagacttgagaaaaatctctctgcatgtccttataaaaagagagggaggtttccaacaacagcaccataataaatacatttcctttaggcaacatctcagtgtagggtgaagagataatgcctgataatagttcaatattatagctattctgtagagttaaaacaatgtagtccagatatacagttctatactgggatatcttcatgcacacgcatatttttatgatctggaagaccatataaattataatttatactagaacaaaaggaacttgcaagtgaaaggaattggtattttggagtatctactgtacatgtgtgcattgggctttctgcattaccatgttatccggtttaatcagatgcacaaagctagaatggtgtcagtggcatgagacttagatccataactgatatcatagatctaagagaaaatgttttaattttgaaatatactcaatattctcctggaaaattaacagaacagagttcagttaaaaactctagattcattcctcttgttatgaccataagttgttttatattctccatttatacaataggaactctgtctccgccattgtaaaagcaagaaacatgaaattaatgggctagcctcctaattattgtgcaactaaaaaatgagataaatgatattatacaaatatgtttgtcaaggctagaaaagtaaattctgaatatttacctgttgtaaagagttgttagtttagaaagatgagcacattttttaaatagactgaaaaagaatgccaaaactacgaaacagatggttcaaatgaggcaagagttcatgcactttacattataaaaacaagaaaaacaaagaaataatattaatggggaacaaaaactgatgctttcagtgttgtgcataaagataaaaatgtaaacttatggctggctttgatcccttggagttactaccataggatagcattggtaaaagttaggaaaatatgagtcatgtaacaaacaaaatggtaaaataaaaaggagattttacttcataattctcctagcttcgatgacataacccaatattaaaagttgtaatttgtgcactccatttttcattgtttcatttttgtagaagctgtctccataacgcattgaattatcaataaaattatgttttattttagactatagaaacttagcacagaggcaatgaactctaagttatgtggaatgagctgctcattgataagctaaccatggttattagattactcaacagcgtttaattgactttggtgaatttattctaccttgtaagtagtctgaaggcagagttgaaaaatgccaattttggtattgagtaaaacaaaaaatttatagcaaagcacaattaaagtttaagagtttttctgtcaatatacattcttttttgcatttactacaataaacatgcatatttgtgcattatgtaagcagtctatataatgcatacaattaactattttaaagtgatacactttatttttaagacacagaaacacatatttcctcttaaatagagaatccacaataaaaagatcaataatgatcatggaaaaaataattctttcatgcttaccaaagagatctacaaattataatgctggtcttatgggccagcagttttcttgtctgccttacaccaccccaaaataggcatagatgatattttatgtgtcttgagtttgcccccaaattcccctacaggagatttgtgtaaattgatttaactcactcctagaactcaatctcatttattgtgtctttgggatatacttagattttgtcagcaaatgactgaactccaaaagaatgtattccaagaaattattcacattgcttgattttattgaaaatccattgcaatgaaattttagttttagtttcagaacaaagtgagagctaacttttgcacaaaaagactttttccccccaaaatagaggcatttttcacaataatattcattttatagggctttacttgtgtatgcattttcatttcagcctttaaatcagggatcaaaaactttttctgtaaagagctatatagtgaataattttggctttgcaagtcctgtggtctctgttgtagctactcgactttgcagttgtagcctaaaaacagccacagactttaggtaaacaaatgggtgtggcagttttcaaatacagttttatttacgataggcagagggccagatttggcccccaagtctttggtttttcaatttctgctttaaataattgtcaggttcaggggaacctacttttaaaaaaaatatggattaaaaataacatattcctaagacagaacatttaaaatgtgtatgaaattgaagtgaggaattaggtactaatcttctgagcagcttgaagaagccatggttttctttactataactgaaattacacacaatcactaataaccatttacatttaaataaataatgcatatttaaatttttcctcatttactcagttttaaaatgtagtgcttatccattttatagaaagagaaatgcatacagaaatacttcaactatatgaccttaactatatgtctcaacaagaatgaatttctccacttagggatgttactcagtattaaaatttttgtagttattatggaggttcataaattcaagtatgtggaattgcagaaattgagtcttcataaaccagggtatagtggtgatttggctataattttaacagttttgtcctctgctattacagaaaaaaatgatttatacacccttcatagaaggaagatttaggcttgtatttcagattaaaactatatgtggaaatatatatagccactgaatttaaatgaagatagaagacctttggaactgctaaacttaacttctgttgatgaaattacattatccacataaatgaatcattttattttctcctaattcagagagtgaagagtctctgttttccttctaagaatttaccccttaaattttgcctgtgattatattctctcccacatgttctttattttgcttcatcaactagttgcacatttcttctttatagctacttcctttcaacctataaacatgaccaagtcacctttttactaaaaagaaaacaaaacaaaatttatttctactcttgtctacctttgtggatctctctctttgtcattcgaatattttggtagagtacactaaactagcagtttctggttcaacagagcaccattcatcacttaacctgttattagatgaatcgtgccttaacatcccacttcacacattatccctggaaacttggtcctcgttttatgcattgttcaaagaatattgtttaatatatcttatccaattccttttttcctggttttattacaccacaccctcctaatttcactgtttctacttatttaagccatacagctctggaggtactaactagtttgtattttgtgccatttacttaactttagtaaattagcacaacctttatgaaaaacaatatagagatttctcaaagaactaaaaataggattaccattcaatctggcaaccccactactaggaatatacctaaagggaaagaactcattatatcaaaatgatacctccattcatatgtttatcacagcattattcacagcaataaagatatggaatcaacctgaatgtctgtcaatggatgattggataaagaaaacgtggcatatatgtgctatggaatactactcagccattaaaaacaaatgaaataatgtctttcatagcaacatggatggaactggaggacattatcatgagtgaaataactcaaacgaaagtcaaatactgcactctcacttataaatggaagctaaacagtgagtacaattggatatatggagtggaatactagatgctggaggctccaaaaggtgggagggtgagaggtagatgaggatcgaaaaattacctattgggtataatgctcactatttgggtgatgggtacactaaaaggccagagtcaccactatgcaatgtaataaatatgcacctgtaacccccaaatttgtaaaagtaatttaaaaactactagctacctcagagaagttttgttagttctaaataagttactacatataaagcacttagaatagcatggcatatagtaagcactaaatgaatgctaactataattacaacttattttctacttttactttctcttttttagtttgtcttctaacttttccttaaatatgtgttttccccttgcttttggagttagttcactttgctttttatttcatcactctctaaggtaagctatactagaggaggcatcactgcattgtgtctaagggccccaaattaaaaccagactgtctgggctcaaatgcaaactgacttcacaagctgtgtaatcttatgcaagtaactcagtctctctgtgcttcaattttttaaatctgtaaagtagaaacaataaaaatatctccttcatgggactgttgcaaggattaaaaatattaatcatgcttggtacacagtaagtcatatttaagtaccgattggtgctatattcttcttacttttattaattcccctgaaattgatactacatttttttctgatgtctctccaacatctcttgccatgccaaatcttccattgggttttatattcctgaacactgatacacagcaggacagctccacctgaatgatttataagagcttccaattcaacacagccaaaagttaactcaacaactttctcccaaacgtgcttcttctcctgtattattggaatcatgttactgtgccattagccacacagacactcaaacaataaacatgtgaatattttgtgattgcttctcttttttctcaaatatgaaatccacttaatattatctcataaaaattgaaacctgtcttctccctttctactaatactgtttagttcatgtggcacaaaattttttcaataactattgaaatatcatcctaaatgttcttgacattctgtttatctcctaagtctgtgtgccagtttctagaataatttgtgtacacagtcaagctaagttgttctcattggcttagagacaaactgaaatggattccttgatctgtctactcatttttgcatcctcatttctagccatgatttacatgtaccatattgtttttcatcttgtaacataagctaacattattctctctactaattaccctctactcatcctttaagatgtggctcaaatgtcatctctgccatgaatcgtttcccagttggttattatgccaccaccctacccaatctcttggttgagacaattttctttttccttggtttcaacagaatctttaaggaacacatataattatctgtttgcactcttgtctttattacaaggctgtaaacttcacaagagctaagatgtatttattcatggcctattaaagtaggctccgagtagatatttactgagttcaaaacaccaattgcagacagttgaacagagagaagagaacagaaggtccaaaatagtattccatctgagatgctaaacagccttcacatttcttaatagtgaaaaatatagcaaagcacattgctacaatgtgtatgaggcaatcacttgcaaatcatctggtcttgaaggcatgaacacattaagagttgtttttaagcatgaagatttatacttaatactgtgtgttcctatcacctcaatgactacctacttccacctttatccccatcccaacatactataatcttaatacaataaccaaagtgatctttttaaatacaaatgttaatgatgtcacagctctgctgaaaatacacaatggtttcctttttaattcagaacaccaaaaccctatgaaatggctataggtccctgcgtgagcttttccttgacctcacctctctggttcatggtctattagtctccctactgctcactaacctccagtcacactgctcttcactcagctgttctttgagtatatcacatatgctcctatctcaagagtcttagcatctgctgttcccattgtccagaaagtttttatctcatactgttacatgacctatgccctcacttttttcagattttttttccaaatgtcacttttatggtgaccttcttagtgaggccttctatggccacccttttaaaattctaacctctccctataatttaatctcccttgcatttttttctttatcattatctgatatatttaatatcattcttagtcattattgttattattttctttccacattcttcagaatataagttctataaggcaggacatagtaagtgcttaataaataaattcaaacaaatgaataaaacatttcttttagtgaaaaaacacccaataaaattagatggagtactctgtattttatatctacataggctcaaatggtggctcacattttccttgatatagaagtcatcttgtactaccaataggcatatagtagaagcttgaaaaggaaatttgagaatggaaatacattgatgtctatattgtgtatgttgtgtaacaatggttcctggcatcagtgcttagagtggcgatggttcaaattatgggcaggttctctggcatctgacaatgaggagtaatgcctttgtcattaagcctgcagcagcatgctccactcaactctgacaaagaaaaatctatataaggatcaatctgacatcaggagcattttttagaaattgaatcccagaacttctgctataagcagttttccatttgtgttatgtcccaaagcatctgaagctgtatttagaattttgatttcagaagattttgtgttttagtagaaattacatagacacctggatttgaacctactttactggctgcaagtaaccaggggagttattaaatatcctgtgcctcagttacctcatctataaaacaattctttataataaaatggtatattccataaaatacacatagaacagtccttggtactgtagcactgaatgtgaaacagcacagctttcgagttaggaatacctgagttcaaacgtcaggtctgtccctaactttgtgtatgagctataactctctgagttttagcttctgcatgtgtaagatgaagaaaattatgtctaacatgcagttgtgagatctaggaataacctggtacctactcagttcctgtttgcaataggtacatataaataatagcctcagttatcaattctgtttatgagtctcttttctctcaggatatcataataattgatgctatacatagtatcttatatatttaatttacatttataattcttaataacttattattacttaattataattaataaggtctacaagtcaagggaaaatgctccacatgaagtatctagcaaagttggctttcaataaatacttataaataaaatatatagagattatgttccatttgctttgtttaagaaagcaggagtctataaactgcatatttgagagaaccactataatctagagtttagaaagtagacaattgagtttctaagtgctttctaacaattcaggtatgtttctaaagattaattcagtttctaaagattaatttgggcaaaaactttatccacatgaatatgttgcttctggataactccagagggctgagtttgaatctgaacaggcagacattacagaatcaaaaatttcagttaaataaaaggaagatgtatatactctgtggtctgataaattaatgacttctctttgtttgtagcatcagagatgaaccctgatgagcatcgtcaggggtactctataaagcacttacccaggaggtaagaattaactaggtgaaaataaatatccttcaaaatggtctagatttgataagaaagtgatttcttatcaaaataaagatttgataagaaagtgatttcttatcaaaataaagatttgataagaaagtgatttcttatcaaaataaagatttgataagaaagtaattatgtttcacaaaaaagagacatataaatggcaatagtggaaaaattgttattaaagaaaattaagaactcacatgcaaagttattctgctttgtgtatacatcatgtatattcagcctttaataaagtcagaattttgtgttttgttttatattgtgaataaatcaatccgtatatagctaggtccttaaaagccaagtattattattagctgattatgacataacttttgatgcaaagagtaaattcaaagtccaaatatcagcaaatacattagttggggaaatttgaatgtagttgaaaataggtactaaaaattataggaatggagaagtagattatatcaacaatatgagaaagaaccttataattgaacattgatggattcagcatgtcaaatgatttggtaaagatttccaaatgaggcagattatggtgagttccaaattagaaacagaacatactgagtgaggaaaaccactgataaaagaattacttcactgtcttctgaagccattcagcttggaggaactatggaagattatcaggtccttttctgccaagggaattacaaggaatttaaaaagccatttcacctcagatttgtgaagtggaaaatactttaatactaaatcaacaacttaactcagtgcaatatgctgtacatttttggacatgtgtttattcttatgacatcatgaacagaattttcctttcctgattgcatttctatattatttctaatagcctttgttaggttgaggtgactttctttctaaaacctgtccaaagaatcaaggatttacaaatttaattatctcccagaatgtactgtatgattttgatctaaaaacatgttaggttttaaatttcacgataggctaggaaaaaaggaataaaaagttcaaagtgttccgcatttggaatcagtaattttgtattccaatgacaaatgtttagtctgcagtgccaaaacgaggtgaagccttccattgattcactctctatccaaaatgcacctattacctcttctctgtaatagagacaggtctctagagcttattttcattattcaacttgcaaccttttctttaccaaggataattttttcaatattcatcatttaatattcaatattatttctccttctaaaatatccatttttttttctacttgctatctttgtaattccacttttgtgaaactgagttcaaagcctacatcaccatgatctgccttacctaactgctttatgccctggacctctttatgccctggactctttctatagacagcccttgactcacattcttttatccagtaactgcctcctattctacacatgtgctttaaagctgcctattcttccatctctacaagcatccaagtcattcctctcccatcatttagatgatgaaagagcggggtctttcctttgttcccagcggtcaagaacccttgtgtcaatgtctcatatataattgaaaaattttcttctacaatgagcttaatgttgtagctgtgttgttattttaattctgttattattcatatgtctaagacatatgtgttaatgataattaagttttgctatttctctacaacactgccttgggagtcatgatttaagactatcattttgacaacatgaccataaaatcatgagttataagtacctctttaaaaaattcttacttccaagatccaaattaatgatttctatgtatgtgtatagcatatatatatttatatagtatatgtatataaaatctatatgtatatatatttaaattattgtgtgtatataaatcacacataacaaataaaactgacttattaaataaggcatgcatagtacaacagctagcttcatttttcagcatccaaataaatcatctatttactgatcacacactatatgcaaaatactatgttttgaatatgcagctatgaattacctcctcttttcttgtctcacgtcctttctgtacaaaccagataactttcgcttgtaaagatcgtggggtacattccagcaaagtactgttgttctctatgccataagccagatgttcttcagtcttatccaaagcatcccctacaacaggaacattaatgccatctttgagacttagattttataggtaaataaatttttcaaacattatttagatccctgcagtaacatgattaactcattacttattgcttatttctgcaaaaggtaatttaaaggaattatttagaaagagtggcataccaaaatttaggcatgaaacaagcaagcaggctatggggtgggacagaagtaggtaactgagagtctggttccaaaggatgggacaggatagtcaaggcagtaagaagcatcagtgttaaactcatggaaagtctattgcaacctctattgagggaagagaaagggaacaccaaagcacaggacaaaattcgtggatacaaacaaaagcagacaccagaaatgcaggcaaaatgccactacataaacacaaatgtggattatatcttgacaagggattgcatttatctgggtgttgggctgctgtagtgagaagagaatatgagactgaaccagggactttgtgaaataaagcttgattataatctgtgtcttggaccagaaaggctcttactggacttgaactcaaatttgcacacaggcaagtacacttagctgcagtagggaataaaaggaagcaggattactctctctttattttaaactaagacaaattcaataactggacctctggatttatttttcctatgcctgaatcctactcaccttcagaactgacccctaaacttccctaagatgaaggtcctacttttctcttgctagtattcccagaggcttgagtcctccactgaatcctgagtcagtctggggtccaacaaattgatgctggagcacagtctctggctctgcgtatagccaccgctggtttctcatttatggtgtcccttcttattattacttcctagtgagctcagtgacactaaatacagcctattcaacagtcactaccataatagaaagagtcaggagttaacagagaagttctttcttatattccttacttttgcctaaagatgagatttcctccattcctaacccatcagttaccaccaccctatcacctttattgaaccaccaaccccagccctaagcttggtcaacttagataaaagagtaaaagctttttcactttatctatcccaaagcttaggagatgacttgatagaagtaataccagttgataaaatcaccagaaggtacgtaacatggtgaagatagtccccagtatgagataaagaggtaagtcataagagtcactgtggcatcaaccacctaaagtatgcagcattcttgttctagggtttctttgttttaataattagtttaataataaagcttggtggtagcacataaaacttattttcctaatcaggtaaaaattagtcaaattttcaaaattttaactacatgtcagagaaaaagaatacttattacattgttctagtatacatgaatcacaaagaaaaaaaggactctttttaagaagtttgtagtttatgttcaatgtattctctgagtaacccagaacaactgattttctatggattaccaacaaactgttgtccaaagcactgctgagctgcatttccatgtcgaacatcttgtctccggaaacgcctgaaagaaagtaaatgcatttagatgttcattttttcaattttccagactttaaaatgcagccaattgcatttcatatacaagtagtattctgctactgaaaaaaatgatcattcatatgaaaaaagaataaaatccaagtttcatagtttttcatatttccattatatgttcttcagtagctaagatctatgttaccctgttctttatttacataatgttgaattctggaaactcaaacaacaatggaatgtatttctctttactttttgttaaaaatttagttcaacaagaaatcttctagtttgagaatgtcttgaatggtaaggtatttgagcagataaagacaatgggatttgaagtaaagtatttattgagtacaaaacagttattttgagtataaaactcccatatataataaagtgcaaatgaaaaaggtgttaaaatccaaatagtttgttctatagccattataatcaattagtacaaatagaatttctaacaataagacataaactaataatatactgtagtcagcttacttttattcagatataacattgcctctattcaatgtgatagtgtgtttttcatgtttagcagaattttgtgcatctagtgggactcaagaaatattagtattttccccctcaatctgcctcgtataattagagtcatttctagtattgttttaatttcatagattgtttagatatataactgaaaaaaatacaatattctgtatctgcggaaaaattccagaatatatatgtttatatatatataacgttatatatatgtttatatatatataacattatatatatgtttatatatatataacattatatatataaaattccagaatatatgtaatatacatatgtttcgaatatataaaatattatatgtatatgtaattcaagaatatatatattatgtatataatataatgttttgaatatatataaaaacattagccgggcatggtggctcacgcctgtaatcctagcactttgggaggccaagacgggtggatcatgagctcaggagttcgagaccagcctgaccaacatggtgaaaccccgtgtctactaaaaatacaaaaattagtcgggcgtggtggtgtgcgcctgtagtcccagctactcaggagactgagacaggagaatcgcctgaaaccgggaggtgaaggttccagtgagccaagattgcaccactgcactccagcctggcaatgaaatgataccccatctcaaaaaataaaaaaataaaaaaaaatatatatatatctttaaatatataatataacattatatataaaatgatttaatatgtaagccttttttctgaggaattaaacaatgagaattatcattagtattaatagtattgaaattctaaaatcaagaactctggcatacttaatttagcttagagattaaaatagaagtattacataaaggtagaaaataccacttgcttctctaattcatggcatttcttcaagactgagggaaaaacagaaggcaaagcagaagttttaccctagagggtgatagcatagctcccaaagtgacaatgagatgctttaaccatatgcaatgatgaaatttggaaaagtgaaccagattcaattcccaataccaccactaatgttctgtatgatcttatgcatatttcttccctttcctggctctttgtgtcctcccttgtaaaatagaggtggcaaaatgacacctaaaatctatttcagtcttttttttttttttcattctagggtgtccttactgtctctaaataacaataatagaatgctatttcaagagatcaagtgctttctcacacaggagttcagatcttatttaacatattaatagatattaaaaactagggcagatcaacatctccaatcaatttttgggattatgacctgtgtacaaaagtatgttttagttttagtttttttttaatgtagagattgctgattagaaaatcttacctaaaaacctgagattttacaaagttaatattagatctgccacatgtatcattctactgaactagattgaaaatagagcttatgaaaaaataacaagcaaaagtagaaagttgtatgattctatattgttttatactagtatgtacaattattatacaaccaatagcagatcaagatgagaattaaaatgctgttgttaatccctcactttgttgagtattgcttctatattgagaacctaagggctgatgagcaataatgaataatggataggaataaaatcaacaaaatgagaaatggcttccacttggccgagatggtgttgtataaagattattatacaagtgagatgaggataaggaaactacaatcaaataattctagataagcaatgtcaagaactgagtgcaaaaatatcgctgaaagttattggaaacatacatttaaaaagaaagacatcacattctccagcaaggtttcagttcattttatactatccccgtatagttgtcctttatttcagtatacatatatacatacacacatatatacacgtatatattacatgtatacatacacacacatacacgtatatattacatgtatacatacacacatatacacgtatatattacatgtatacatacacacatatatacacgtatatattacatgtatacatatatacacgtatatattacatgtatacatatatacacgtatatattacatgtatacatatatacacgtatatattacatgtatacatatatacacgtatatattacatgtatacatatatacacgtatatattacatgtatacatatatacacgtatatattacatgtatacatatatacacgtatatattacatgtatacatatatacacgtatatgtgtatagtgtatacgtatacacatatatacgcgtatatgtgtatacgtatacacatatatacgcgtatatgtgtatacgtatacacatatatgcgcgtatacgtgtgcacatatatgcgcgtatacgtgtgcacatatatgcgcgtatacgtgtgcacatatatgcgcgtatacgtgtgcacatatatgcgcgtatacgtgtgcacatatatgcgcgtatacgtgtgcacatatatgcgcgtatacgtgtgcacatatatgcgcgtatatatgcgcgtatatatgcgcgtatatatgcgcgtatatatgcgcgtatatatgtgtatattacatatttacactatatatatatggagaagtttcagaaagttgaacaaatttgctttcattctcaaaattgcgtattattcttatatctctagtcttttagacatatttaaagagaacactggaaatagacaaaatagaagagcaaggggaagaaaaagattctagcattataaaccatagtgtattttggaagatcattttaaacaagtggtttggattgtgaattactgtttttcccctgttgactcattttcactctttgagcagaaaagtatttattttaatgacctgttttcaatttctgcttctattcaggtctgaagcaaaaatgatctgctataaaagcaaactattttaccttcatgtgttggaacttatccaaaaagttatcttccaggggtagtgatggttcaaaagaatttgacagcactgaaagatctccattacatgtcactgaactgaactaattcatttacgagcacggcttctgattccagcatttcatgccttcctgtctactatttttctcattcacttgactttttctaagtaactctttttgtccaccacatctactgtattaacaagcttaaggctggacactgctaaaagatgcaccatatagaaaaattaactatggaaactgctcaattaaaattcattatcactactgcatgcctaacacaaaaccctgtcattcataagcatttggtgcaaggcttgtaaacagttttattgttgctatgacaataaaataattaatgctgttattcgtggttacattcacattctaccctcatattcttctatttcactcctgacccatggtacggcatgcttgtttttaagcattctatttctttgtgcagacaattaattccctttgactggaattttcttatatctctaccttcaagattaagctcaaaagtgagattattttgagaattaaataaagtattatatgcattgctcttaatccaatagctcattcatagtaagtgctcaacagcaagctactactatcattatctacaattccattcttcactttaggttccaatttcctttagacaagaggttatgcttgtttcttcatatccctggcacatagtacagtaattggcttaataggtgaatacactaataattaatattttcaaataattatgtgactatattcttcaagaattgttttcaaacatcaacaagcacgtctgcaaaatcaattaatttgctcaattctttaatacatttggtaaatttagttcagaaatgtcctctcgaagcataattttactatccacttattatatcatttttttaaaatactcactggagtgttaattttgctcaagtaaaattaacaaaagttttgaattagtgaagttttaatgagattctgctatatatttgaacctataaaacaagaactacactaaattgggttaaattatattctgaaaaatgtttacagaaaagtaacccaaagttaaataataaaaataattgaaattaatacaaactgtttttcagtaagaaaattgtctatacttctattgtttgctttattttgtctttggtcattttattgcaagaaagaaactgcttattctgtaagaaataaaaatactttttttcctgaggtatttccacaaagaatgcacaacttcatatggcttgagtgaagagatatccttattcttcaaaatacttaactgcacctcaagatctctgcttaaagaatcctgggatttaccttctgtaggaaatggcaatgacctcacagaattgtaggcattggagtttggaggtctttaagtacctttcatttgtgttgaattaaatcacacatttcattaattatacaggtcatgcatttgcctaggagttaaaatattcactttcaaaatgaaataaatgaagaccagctggtagagaggacatggggcaaatgcaggatgtattttagaatttctttattgattttccttttaagtctttgaatctctcatgtgtggtggcttgtcgtttccacattttaactttatctgaactcgtttcatgtcttgcagcaaaagtttcaaaagagggaaaaactgactcaaacctgggtgaaaaaataaaaggtcaacagcatgttcagtgccagtctctgtacacaataattaatacaggtattttctggaaaacttcaagttaaaaaaaaaaaaaaaaaagcattagggttttcctaagcaagggaaatagttaatcaggtagcacgtctcacctttttgcatgtgtgcctgttgggtaataccgggagcaggatatgccatcccaggcacagtaagggtctcgagccaggcagcagtcagcacaagcacttccatacatgtcacagtgatggaatctgacttgagccacagcagaagcagatccaatatacagctgttgctacagaaatcagaaagaggtcactagcagaaatggacaaaactttcactgagctattacacctagttttcacatttatacacaatcacctcagaaaaaattcacttaaatttaattcacttaaattagcagtttcaggagtttgagaccagcctgcacaacatggcaaaaccccatctctactaaaaatacaaaaaattagccaggcatggtggcggatgcctgtaatctcagctactctggaggttaaggcaggagaattgcttgaacctaggatgtggaggtggaacctgggcgacaagagagaaactccatctcaaaaaaaaaaaaaaaaaattatagcagttgttcaatatagataatatttatactttcatttctctaatatttgagaaacattcatagacataaatgcaggagtaccaaaattgctacactgaacttgacaagaactcaagaagctgtgttcattatcttgcattacccaacactgtggatcttcctttaaagatctatagaaacggctgggtttatgcctgtagtggcttatgcctgtaatcccagcactttgggaggctaaggcaggtaaattgcttgagcccaggagtttgagaccagcctgggcaacatggcgaaaccctgtctctacaaaaaatacaaaaattagctggtaatatgtgcctgtggtctcagctactcacgaggctgacacagaaggatgacctgaccctggggaggttgagtctgcagtgagctgtaattgcaccactgaactccagcctgggtgacacagtgagactttatctcaaaaacagaaaacaaatctatagcaaaaactaataagagatttggaaagcaaatagtcttttaaatattgacatataacatttagaagagtgatgtgtatatctatctatctatctacagaacaagtggctgaacatttaatataatatctttccttttgcctgaacatgaaggattatttataaataaatttggggcaatatatgcaacaactgtttctaaagaagtttacaccaaactgatttcagtgaagtggaaaggaggtgtgtttccttgcacactattggattatcattgttcttgcacactattggattatcattgttaccattgtttttgaaaaacattagtgaaaaataaccagggaataaagtgttatcatgattgtagaagtaaaactactctcatcttcctttctatagagatagaaaatgaaaacaagtatcaaatgtaaatcatgataaacttttgtcagaatcaatcaatggacataaagtttcagtcaaacaagattaataaggtttagaggtctgcagtataacactgtacctataaccattaaaaatgtattgtatgcttaatattttgttaacagggtagatcacatgttaaaagttcttactacaataaaataaagtaataaaagaaaaataaaactgtaataagttcatatttaagcacatgtactaatgttctcatatcctttgaccttaccttagctcacatatagaacacacacacctacacacacacacacacagaacttacccgctttgaagaaatctccatagaaataataggaactggatcctgaaattttaaaaaagttttcatttttaagaaaacagtataaaaacatttaccttaatatggttgtaaacccctgaaattacattacttatataagtggttatgtgttaagtactgtatagctttcattttagtaaaccaatatgcaaacacaattaaaatgcagctttaaaaacttgtttctaacagggtgggcagatatgcagatgagaagagcagcaggaaatctaaccagcttactgtttggaatatgatttttgaatttgtatttgaatattacttgcgctttggaaactcaagtatctttaaataaaataataaagtcagaatgttctattaaagtaattgagtcattaaaatgaaaccattgtgtctttcaataggtgttattgctaataaaccaggtgattttaatcatttgaacccaaacctaaacaaaatatttttctgttggagtgatcatggtgaatcataattaacccaggattctttgaatgagatgaataacctgattttcttagaactgcaccagaggaaggacaatttataccatagctttgggaaccaacatgttgtttttggattgttaaggctagtgcatccctaaggagcacaataaactcagatcagctgtgcaagtggaaaaccacaagacaggtgaaatccactctggggatgattatcctttgaaaagctgtttgttaagagggaacatttgatcctctatgtcagtgtttttttattttttatttttactttaaactacagaatctttatgccttcatacattcactcaggcaacaatgtttcttaagagttttcatggacaaaacactgtggtgagtgaatattaaacatatttcagtttataacatgaaatgaaatcttatgtagagtcccagagtgcaaaataaaaaaaagcatagctgctccggttgatataggatagtggttagctttgagtgtggctctagggaatctgtgttctagtacagcaaaggcaaaatgtactgcttctcatttataaagtcttttcacatctacccatcataaacatatagagccaatctttgttattcacagattctgtatttgcaaattagcctacttgctaaaattagttgcaaccccaatatcaagatgttctgtgtttttaactcatgggcacatgcatgctcagagtagcaaaaaacttgagtcacaggacatgcacattcccagctgagatgaaacaaggtgtcactctgccttcttgtttcagctttcatagtgtaaataaatatctttttcatggactatgtagtgccaagattttcacatgtctgtgctttttgttgatgttttgtttttaaaatggcccccaagcatagcgctgaagtgctgtttaatgttcctaaattcaaaaaagctgtgctgtgccttaacgttgaaaactcttagataagcttcattcaggcatggattatcgtgctgtcagctgtgagttcgatgttagttcatcagcaatatatattaaataaggtgtctttaaacacaaacacacataaaagaaggttacgtattgatctgttgataattacgttataaatagaaatttgctggaacataaccctgtatttcccatgggagcagtggtcagtattcactagttcagtgttacaacaactttgaagaccaaaactgctgcaaatgatacgacttgatgtgtgtgtgtgtgtgtgtgtgtgtgtgtataagtgcatatgtgcatttatatatatgcacacatatatatgtgtatacacacatatatgtatacacacgtgcacctatgtatgttaagtgtatctgcatatgtaattgttttttcatgtcttttttattatcatcttctattgtttttcttttttagtaaattatttgtataattaatgcacttaataaaaagcagtatgcttatcttgcctcaatgttcacaatatgaaaatgtatttttttttgtcagtattgatagtacatttacaagatgtgactgtaatactggctctgaaaattatatgtagtataaatgttatttctttatagtcacagtttattcactgaaattctttccatgctgggtaaatattgatctctcagttgaaacgtctgtaacaatcaaacagatgcattagaatttgaaataattcttcacttatattagctctgaatccacaacatacctgttagggaaaaaaaaatggacatagtatctttcctatttacatctcacttgtagttgtaatgcataaatttggtctgtattttttgctttaaataccttgaatatctgaagttcttctagaattacttcttccattgattccatttcttggttgtaaattgtgattactttcagcacaattccattatctgtaagaaaacaaaacaagaaataaactagaatctatgtcacagtacggttttcaaaaaaaccatgtagctggctgggtgcagtagctcatgcctgtaatcactttgggaggccaagatgggtgtatctcttgaggtcaggagttcaagactagcctggccaagaaggcaaaaccctgtctctactaaaaatacaaaaaaaattagccaggcatggtggtgggcacctgtaatcccagctacttgggaggctgaggaaggagaattgcttgaacctgggaagcagaggttgcagtgggcaagatcatgacactgcactacagcctgggggacagagaagccttcatctaagaaaaaaaaaaaaaagtagcgactataaattcaaataaaatttgaaatccagaggcatgaaacatgttaatcactgtcagtttaaaataatatgattacttataaactcatatttttaattagcaaaattaattttatatgcctggccaaaaatgagaggaaataatgattttttcaaatagtttgatccaaaaatccaatcatagattcaaaaatcaaaatgtcttttggaattaataaaacataagagagatgccaaattattctagctactttttctgtgatgcatgacgcaagaaaatttttttaccaaaagctacttttatggtacgaaactatacctttagtcttagggaatattccaagcaacacactgtgaaactcatcatatatataaaacatacacatacatgcaagcacacacagttttggcaagaaaaaaatccaagtatacaccattgagagaagtgtttgtaccagtcatttagtttccataattatcatttatttttaaagtttatactcatattttaaaattccatctaatttttatcatttctgatattctgaacttgttccttcctataaaaattttaacaacacattaatttgcctatacaaataatttagtataatgctggacataataatttagaaaaaaaagaacactttgaatttcttctctaagagtttctatgctatttcagcagtttgttgaaatattatcaagtcttatggatgagataataaaactggattataattaagctaataacagttacctgtattgtacactacccaaaggaaacaaaaattatcatcattttgaaaacaaagcacacatattaaatacttgacaattatatcaggcaaaaagcaaagataagactcaaatgattaattcgcaattagtgattttttaataaggaccatatatgtattgtattaaagccggtgtctagtaaatattggacaaaatattatttgtgggatttttcaatgttgtacccatttcattcattaaacatgttcttttttctgaaaatctgtggttcaatatgatgacacctttgacttaagcatggtgtatatggcagcacaaatatatgcttgatacttctgaaattctctggaattactttgatcaatatgacaagcaagtatttctaaaaacattcttggactgttatatgtggcttctgctttccagggcatttaaaaatcacatactaggttggtgcaaatttattgcagtttttgccattaaagtaacagaaaaaaaccgcaattacttttgcaccaaactaatactttaattacttttatcaaatattagtattgattatgcaacttttaaaaattttgttggaagtcactatgagtgaatttatggccaagtaatttcaagtttgctaaagaaatctgatgacaccgttaatcatgaacccacagtgctgagcatattattaacattaacttcctaaaatgaatgaataaaatacagcctgtaccagagatcaatttctaagaataagatagatgttttcttttttaaatctttgttttaaaaaacaaaaggatggctgggcatggtggcttacgccagtaataccagcactttgggaggctgaggcaggtggatcacctgaggtcaggagttcgagaccagcctcaccaaaatggagaaacccctgtctctactaaaaatacaaaattaggcgggcatggtggcacatgcctgtaatcccagctactcgggaggctgaagcaggagaatcgcttgagcccgggaggcagagtttgcagtgagccaagatcgtgccattgcactccagcctgggcaacagagcaggaccccagctcaggaaaaaacaaacaaaccaacaaaacaaaaaaagccacaaaaaacaaaacaaaaataaaaacaaagggtttattggagaagcccaagcaccaatattaatattaatattacatcctgtttcctgatctgggcttatgccaatatctcttgagaattatatatctataattaaagtcatgtatgttagaatgctcacttctctaaagatcaactactgtagcaattatactatgctgaataagaagaaagacaatgaaagaatcattttaaacactttaaaaatgactaggattttaaaacacttcaaagaatttgctacatactactttggaggctgaaagatctcaagtcctcttctacaagttagatctaatgtatgggttaattgaaattacaaatttatttgaaaatatcacttgtagcatatttatcatactttgttttattaatgcaggatattattggtaacatttggcctgcttggtacaaatggttgatcttgacgtgaactcataagaattgctgtgtttagagatttaggtgaaggtattgtcccaagttccaagttgttcacaaaatctccaggactcgctgagcaaagtcagtaatggagctgggaaactgacagaactattcttgctatgacactctacttccactatgagaacttctattggaaaccaactttgttcattaacgtctattattcatttctttacttattcatttattcttatgcatgaagtattgatcatgtataaggaattttgtgctatgcaagccccaaatcctctctttgtcagcttcaatatttctcacatctgaaaaaaaaccacatattttgttggtcaaaccatgacacttctgacaatgaaagtggtaatattcccagacaactggcctaaactcttactattgcagccacatgaggtctctatttcaatctttctcattttggattagcagtgtgaaattgtttaacagatggacagatttgtcgataggtgcttttagaaatattattaaaattattgaatttaagggtcaatttaaatatctctgagtactttctcgtctctttacctgtcccaataaacaagacgtcatattggccatcctcagcttccactcgatctactgctatttgtttcaggttatattttccatctgtttttaccaatattggttttttatgggcaggttttatggcctggtacattagtggatgacttcttgcaaatcggatggcatcatcaggatagtccttggtggttccgtatctccctccatttactttgctggcacactgaaaaacaagtggatcagataattctttttgctttacacccaaagagaaaatttataatcaattatgagaagaatcagaaaaattgaagttgtcaaattagtcaattgtgcatttagaaatatttagtaatcatatatttttctttttttttaacttttattttaggttcagaggtacatgtccaggtttgttatataggtaaactcatgttgttgtacagattattttgtcacccaggcactaagcctagttcccaatagttcttttttctgatcctctccctcctcccaccctctgacttcaagcaggcccctacatctgttattcccctctttatgtccatgtgagtaaccatatattttttgttacagaaatagaatcttcctcagaaattggaaaggctaaattatttcaaacatgcagcacaagatatacagagaaactggataaattctggaaaagtgaagtatagttactatcaagactttagggatggtaaaaatgtttaacatcatacatattcaaattattttctctgtttttgaaatttgttttttgtaatataagttaaattttgaagggaaacaatctattgttcacacaaagagaagaaatctcttcgttgtgttgaaacttctaactaaggatcacaactgtacaaaatagctttactactactgagtctatgataatatgatcagtgatggttctgattggctcactgactatagaattttagtggttcaacaaaaaaacctattcagatgttatcactgttaattatcaatggcaaaaagacactctctgtttgctgtaatctacgtgaatttgtatttttaatggatttgacaaaataaactgggaaaacaagaaatatgtgttatgtcaatttttaaactactgactaaaaaattaaatactcaacagtagcttaagttactcattggaaaacctttaaatgtgttgattcatgcttgttagtaactgctccctcgttttacatattttcctccagaactacaacaattgcaacgattaccttgataaaaattttccactttagagtataaatacagtagtttagtaatcagattccacaaagaggacatttataatggtgtggtttttaaaatcagaccatatttcctaatttggcatggatttttcacttgagtgtactttcatgatatataattggaaacattttggactagcttggaagcagttccataaccagtcgcttcctccaaatctcctttaagaccatgtggtttcaggaagcatttccagcaaagccacaggagtagggtttctccatttaaaattgtaatttcaatcaatagagtgaaataaaatatactttatgtcttactggaagtaataattttaagctagtgagagagagtgattgaaatggtaaagctttaacacttgttaatggaagtaaggtttgttttcactttgggtttttgctctacaaaaatggtttctatttgacttgcaagtaatcgtggaatcagtgtagtgatgggatttcaccagctgcttgtaaaagtatagatgttgacttgtgtgacaagttaaatctttgctctccatagctcacatagcacatacaatgatccaaagtttttccaacctagttgcacacaggatgaatgatacaaaatcatcatctcatcatcaccctcactatcatcatcagttttagccatgtgtgctaaaagcacaaaagacttcatgcctagctaagaagaatcttaatagtatagttcagagacaagtggtagaacctttgtactctagcaatacttttgtattggcatttctttcctaaggggccagcaaggatgttaaatgaggtgctaagtattctgaggagatagagaaaaaaacttcttatagatttcctacaatgagaagtaaggagacagtttggcctagggaaattagaggctaatttaaatgttagaacataaaaatttggtgacattgtcctgcttggaaattatatgtggtgctaactcctctgaagaggctgagaggaatacgatgttcatgttactgaatgtttctgttttcaccagtacttttaaaaataaaatttcaattggtgttacttagccaaaatatcaataatagtacatattttataatactgctgtgtccattatatattatattctttttattaaataacaaggataaaacttgagatttgaaggaatatttttttactacatatacttttcaccaagcatacttttaggtatagtattccttaattgtttatctgcaaagtcttatgaaacagtgaacaaaatattaccaaaagtatacttaaaaataagaattatttgttatataactaaacttacagaaccaggccttggataagggacttttccttcatagactgaccagtggtattcaggtccttccttatgtgcatatggtccgttgaaggctgcccgaatgctagacatgtgatagacacatatagcatgccctcgaaaaatattactgaaaaatacaaaaaagataattattcttctggaactaactgcaggtcatctagccaaataccccagcctacaaagataagagtcaagtcttttgggtaaagtggttgcaatttctttaagcaaagaatattctaggtatgttaattattgcaatatttccaattttgaaactctgaaacttaccattttcttaactgcctacttaatacacttgaagatgacattgttacaatgacaaaaataatgttacttcagttatttttaaaccttgtgtttttatatttttttattaaggatgatctggccttcatattaacaaaggcttattcccaagttgaattactcatttagatattatctccttttatgttgttctattttcaaagtagacagtgtcctcttactcactatgctgttaatattgctacaaattctattaagatgtattaagtttcttaatgtatatgacttaaagaaaaatttaaagtcttatgaaaatttaggcttttttccattttttagcgggggttcatgtaaactttaatatgcttgtatattccttcctccagtcaccacaaagtgtctttaaaattactttaaccatataaaacttagatccctcatctccagaactagcggaaagcaaaaaaattttcttgattaaaatttctacttgacagtataaaggcagtagttgactaactgtggcaagttttattgaagatatttgtaatcagattctacaaaaggacatttttaaagatttttttaaacattcttgccatattccttaatttagcatgaactgaatgaattataacattatcagaatctctgtattgtaagaatccaaataattaatgtttgtgaaagtgttttgcaaaattcaaagttctatataaataaagtttcctacatcctgagacacctgtaaaacagcagttatgttactgtcctacacccccaatttacacattttataacacaccttgaagcaattggaaatgcctgggatacagggaacacttgagatagtctcctaactaaagtggtagcacgcctttgatcaccattctacaaatatcaatccttatgtcaggtaacagctgggaagcttttgttctcagatttatataaattgaacagtcaaaatagaaattatagaagaaaataatgtcttatgcttgatttctcagaaagatccattacgctatcatttaggaaaatagcttataatctgatcatattaacccatagaaaaactaaaccgattattccatagctttaatttatcatataaattcactgaattatcatgcaacatatgaattattcacagcataagggaggagatgaagttaaaacgttaagtactctccatgcgctgtgataactaccaatctacattaactatttttctttgcatcaaggaataattgatagacaaattgtttccatgtttctctgttgaagaaaaggtctctttgcaacagcaggattcttgtctaaagagatgtattattttctctaagtgagcattagaaactacctactgaaaaataacaaactaaagctgtgtggaaagaccccacgtaagcacagtatacataattatatgacagtttatggcttatatgatgtaaaagaggaattcagtaatattattctagccctgtcaagagaattgaggtatattcttctttattttttatcctaatcattttacctgcactatgccttacctggaaagatactcaggaaattgtctatataaccttttaacaaatactgattctaatatttttatttgtgtgtcaaaatatatgaaataatattttatccatttttacagcactttactatgggttaaaaaaatacagaaacataaaggggaaaacaatagattatacatcttaaacttgagcagcaaatttaaaagatagagagcaaatgatgaacgtgttcactatgaatcaacgtaagagcaggaaaatcagaatgaaagagtgagaagagtgttctatgattatgaaatcgagaaatttttcttggatatggcaattggtaagtattggagaactgatttaaatcagtgttggaggagaaagttttttcaagcaaggtaagtgaataaataaaaatatagtaatgggaactagcaaagtagacactgattggcatctgtcaaggcattatcttgtcaaaatcagaccattagtgaactcacagggaaaatgtccaaaggcaagtgagtaacagttgagatagaaccttgaaagcctggcttggaaaattctatgtgatgaataaaggaattatcctagactttacaacatataataacacattgtaaggactgatatcttacaaactgtatgtgaaaaaaaaatcactgtgttctagattacagagtgaagatatcaggatactgagcacaggaggattctgggtactataaacagaaacaagatttggatttagattgagcttctgaaaatgaaagtacatttgcaaacgttggaaaataaagatcaattggtgattataaagtgtagaaaatgagaagagcaactgggtcaatagtctttcaacttatatacaccatgaagggagagtccggtgaggcatctcttgttctatattgtttttattgactgtataaatttctcacctggtagtgttaaagagtccaaatatcactggattcttatgatctctggtaggtagcaaaaaaacgtcctctgaaaaattaaaggccattccatcgcttagtatttttagctctctttgcatgcaaagaaaatttattcacctaaatttgtttagaactcattatagattttgagatgtgtattttcatatacaatcatacaaccatgaccaagtcataacagagctaatcattcagctattctgggtggccttgagctgaacaataggaaggaaccagacactgactctaagctaacaagatgagcctctttttgttcttgcaatcccttttcccccagcatgcgtgcctggccaaaatgaaaagaacagaaacttgctctatgttagatagaggtcaaatacacagaaagcaagtttctatgtgtcctagggataaagttataaagaagcatatacataaaagagcaaatttaattcacctaaaaacatttacctaattcatcaaaatatgtgtcaattccattcattcctggtactgagcaaacgagtctcgcttttaggaaagtgctccacttattcaccagtattctctgccctcctacatcattctgtgaaaaccaaaaaggaggtaaatagttacctaaagaatttcgaccaaccacagatttcatattattaaacatgcagttgccaagagttatgacttttttatttaactaggaaaatttggcataattctcaagtaatgtcataggtgcaactccccataatttggatttttatttttttttaggtttcttcattcggccttgtcagtgcactttcaccctgatacagtaaatatattttgcagatattaaacaatattaatactgcaaactctcctaaatagaatagtggagagatacagtaatcatgattattactttgttcataaataatttgcctctctcaggaatatagaaacacccatttcttttcttcctttaacaaaggaagaaagcttttcaagaaagtttgaaatacacacacaacacccatactatatatgtatataaatatatacatacaccacacacacaatatatatatgcacacatatttatatgtaaatttattttcgaacatcttcttaaatggcaaggtaactttacatttgtaattttatttgattctctcaatatatgttgctactcctattggttttaaatgttcccaaacaacctctctaaatattcagtaagttacagatggcttttttaaaaataattttaaccaaccgaattgttcaaacatagctatgtatattatttgtactgtgtactaaaggaataaaaaaggttttgatcaaattcattaagaaaaataaagttcaaatttctgcatgggaagaaggacagtctaatcatagacgatttcttcttggtatagcttcaaaaatggggaaaatcatgcaaaatacaaggtccttttaagatacacctttcactagatatgaaatgtagaggttggtatagtaaatatcaattgtaggcagtctaaagaatactagaaaatatttaaaagtagaaacttactataaacttaataaaggcctgaccataaattgtgagataagcaagcataatgagagagaaagcctcaccacacagagtcgcccgaccctggtgtaaattgcgtgagcattgttttctgcctccagtgccttctcagtaaaaaagaaatatactttgttgtcatctctgtcttcattgtcaggaatcatgtatgaacctacaaattttggttctataggagcaaaaaataggagaaaaagtgaaatagatattacaactaaatgctaacaagttattccaataaattgtatatcatctgaatccttaagtttaactttcaccatttcataaagaaatatttttcttgaatttttttaccaaacattaaaaactatgttgatatctccactttatttgcatattaacagcccttttagaaatattacaagaatatttaattggaaaataaaagaatccaggagagaagaagaatttcaaacaacatgcaatgcgaacttaaaatgcattcaggaaagagcagattgggagcacaatgaagacaaatctctacaaatttcctcccattgtaggtaaaaactaaatgtaagtataagtaacatattaaagtaaataaatctatcataatttatttttaattcataaatgatctaccagtatagcgcatagatcattttagtttcaaagtagaaaatttattttacgtttttgggattgtagtccaagagatttgaataaatgttctttgatatggtatgtaaaatatatgaatggtatcatcaatgactatgcattttaaagcttaataaaaatgtggaaagtaattaaaatgctcaccataaaacaatattctagcacctccatataccagtgtgccaaaatataaaacttacttcttacaaagaactctgtatcaatgaatgtctagtgactttcctagagttttgtctctaaagtctaatgcaatcctattaaaacaagcaaagcagggcaatcaattcatcaaagattatatcaattgataaaagtagacaaaacagcttattggatgatggacttttcacttttcatacatttgttttgttttccttattcaaatactgatttctaagcattgctcggaaggtatactgattttataattaagccaatcaattttgatagaaaatgatgtacatatattatatacaatattttaattcaagaatgttgctagtaaaacattctgaaatttgtaaaggaattgtatttatattcttattattatcaaaatggcaacattttccgtaagttttagagttgatttcaatcctaattcacatactcttttcctcatccttacctttcaacagacgctcatcgtcatgctcagtgcggatatgggccagtcgccccatgctgcggaagatcgcagcgtctctgctccagtagtcactgtagagtccagcaaacaattcactacctacacgggagcatcagtaaaaaagaagtcagtatttgttaatatgttaacaaattaaacacatccaaatttaatatgtgtatctataatatgtactttatgacattaatactattgctgttaggagcatggatggtatagtaagactcccagggtttgagtccagagtctgtcacttactaggtgtgaacttgggcaagttgctaagttccctgtgcctcagtttcctcatttagaaattagaaaagtaattgcattcagtaagatagttaagagcaaagcacttggaagatcagctggtaaatagtaagacctatatgagtttttggtaaataccttggcttcatttattttcctagacttcttttaacctccctatcatcagggctttatcattatgattgttattgtgatgattacaggttttatatgtcagtcagctaattcaaatccttcttgtaacaagatactgctatcatgaatatgattttagtgtgggaacaacaaagtctaacaaagatgatataatccaatcagttgtcattcaatttgtaaatttgtggctcagtcagataggaaggatataaaaagcgctcaaaatttaatcagacagtcaacaaaatgattgaaggaagttagttgcaacatgtggtggcagtcacagtcttaaaatcagactgagaaattacataatgtattcagggtctcaggaaataaccatgtgtcttttgagtaagaaaaaagacattaaaataacttaagggagagtataacttgaactccaggaagatcaatagctctgaagcatagggacttagaatcctttcccaaaactcacaagaggtaatcagtgtgcccatcagttttaccagaaggatgtcctggccatacccggctcagttgtcctgtctggagcaaaaatctctggccaagaaacaaatgataacagcagattgctggaaacagcaacctcaaagcaaagtggtaaaattgttttcttaatgagtggcatataacattggtctagttctaaaacagatatgattattatattacatagtactaatgcttttttgttaagtttgcaatgtgtatgcatacacatatttaaaatgctttaaaggttaagagatttcaaaattaattgtatttccaacttaatatatctaattatgtaattaattttataattaggattattaaagttgcaggtataagaatttgaccaaatatataaacagaatttaaaagatattgaatactttatttataaattttatttattagaactttaaaaattgtttaattatttatgaaggacttttttcccaaggtaaggtctttaaagctttggaaaacttcagaagtgtaagcatttttgtatgatttaacatttgagaaaatgatcaattaaattatatataagacaaattaaaaggaagtttattttcaacttgcattaactattaatattttaaaggtaaagatgattgcttttgttataccaaatttagaataatatgatataaattaaactcaaagattaaaaaaataagctttagaagtactactataatagtctttttcattttaaaaagataaataattctaattagtttttctctgttcacaaaatcctctatggatgcctaaaacactctatgagatacaaataaatacaatctatggtttccaaaaaagaattcattttaaaattatatattctaaatgagagaggaaaaagtaaatgtgtcagagtgttaacaattggtgaatcaaggtaaatggtatacaggtgttaattttagttttacttcaaatttctttgtatttgaaaattttcaagatcacagagtttttaaaaagatatatttgttgagttcttctagtatattcaacttacgctaagtgagaggtatgatgtaaggaaaataacaaaaactaaatgactatttaaatctggacttaacaatatataatttggtagagaaaagttatgttagaactcttaagcatatcatgttatttgataatagaaagggaaaagattaacataattttttatcaaagtcatttaattagtgctgtctttcccagaaattttatgtctatgtttgaagaagtagtattttgagaccaaatgcataaatgcattcagtggttaggaatatgacctgttacctggaattcagtctgcattatttgaacatggataaaagagagtcattaaaaggactttggaatcatcaactctatggcataaacaaccaagttgacacttaaaaaaattgactattaacacatgagtgaggatttctctgaaatatttttgtttttaattattatagttgagttatgtttaccacaccaaatataaagaccagcttgttaaatggttgaaaatataatttatttcgctactgtgggctggtctgaatctttaatgtataatgggaatgaagattagatttctttaaaatcatgagttttctattctttacatttttaatatttgattttatatcttaaagtattttagactttgataattgaaaatatttttatgggaaaataatatttatattagtacacttcgattttaatggatttatcctaatttggaacattgtttcaaaattatcgttttaaccaatgctataaaattaacaaacaagtattccttggagccactaggtggcagccctatgatgctagataataccatattcagagacaattctctgcacaagagaaaaaataatgtattctcaatgttacccagtttcccattttgcactcaggacagagaaaattgtgagcaattcccataacacaatatgaactgtatgacttgaatttcaaagacactatataggtgctaaaaactgtaagcaacgtaaatagaaacaaatgtgtttctgttggaaatgttaggttttcctcagaagggagagatattcctttcatatcttcatatcaatgcaaatttaaaaaaattcatagtaattgataataattatgtttagcaaaatactttcctaagaaaattagaaaagaaagacaacacattagtgaaaaataaataataatattaataaaaccttaggtaaaataatacctaatagtaattaagtaagcaaaaatactgggcattattaaaatttttaatacaatttgtaggaaatacatagtctctaattaaatttattataactatttggtatcagaaaagttgtgaatcaatacattgatcttttacagaatgcaaaaataacatctagataaatcatattttcatggattaaaataggaaaacattttataaaaagattaaaataccttttagggcttcagttataacagaagaactatctaaggatttagttttctatgtctatggagatgggcgagtttaacaacttctcacactcaacaatagtctttatatagagaagaaagaatagtagaaatagttctgcagtggaaatctggcaagccaagtctctagctcaaaatctgctgtttgaccaccacaaactgctcaaaatctcaaggtctcagttatctgcagaatcaaagagactgccatgtaattctcggaaactgccaagcttttatgttctctctgctctttggcctagaattccacacctctcttctcacttcaccttccttttgcctggttattgtccgctttttccatgacaccttgtctggccaaacttttttagtgtagtggttcctagtgccactgtagctctggtacctatttctatcctactgctcatccaactatatttttattgactccttgtgtgtttgaaatgatgcctcattaatgtctgaaatacaaaaaatgctcaataaatatctgttgaatcaaagaatggcttaatgagttcataattaaatatatcagaagttcctttcagggtttaaaaaaggttatgaaaggctgtgaagtgtcaacaatcagggccaggtgcagtgattctcgcctgtaatcccagcactttgtgcagcccaggccggaggatcgcttgagttcagatgttcaagatcagcctgggcaacataaagagacccccatctctacaaataataataataatgataaataataaagtagctgggcatgggggcctacacctgtggtcccagctactcaggaggctgaggtgggagaatctcttgagccaggcaggtagaggctgcagtgaactatgattgtgctactgcactccagccgagccagaccctgcctaaaaaaagataaaaaaaaaaaaaaaaacacacaggataagatcttaacttttaaaaactgtttcagagagaaaatatcaaacgaaagaaaaggctattgggaatttacgtggataacaaatttgaatttttgttccttgagggccttacgttattaattttaatagattaaaacaggaactctatttttttcaaaaattgatccccaagaatttcagcccaaaggacattatattgtgattaaaagagtgtgtcaacactaaattgcttatgtgaaagaaaataagacaatcatttgactctttgaaatagataaaaacacattctttatattaattctaaaatgtgtaactaaaatacttttctatataactccttttttttacaatgtgaactctagttgaagttttaattaaatccattgcattgccttaatattttatggaacgtatcaagagttttgttcatggactatatattatctgagtttttatttaccatgttggattttaattgtataacaagaaaaattcacagtagtgtttcatgaccttcttatcttgttaagttttactcaagcattgcttctgtttatgttataaatgtatgttatgcaaatctaaataatgtgaaacatatttgcctcatggaacagcatatggctaaagactgatttagctgcctcactttataactgaattttataattttgttagaacattattctattgtggatggactgttttgcagaatcactatgacatgcatagctacaaagagaaacaaaatgcacttgggaggatgaggatggatgaaaatgactcacatatttcaacatcccggttcacactcacattctgcttaggatgctgaaagaaaccaggaagaatgtgagattctgaatgtgtgattttattaggcatttagctgttgtttgggctttcggtttattttggtttgggaagatgattagcactagctctcaatgttaagaaggtggttttgaggcatgaaggaacaataaaaatatcttttgaatctgtttatttgtgtgtgccagcacccatggctgtactcttgagttttcttggtggcaaaccaatgatattgataccatgagggttaaaacagattctcaaaggagagaatataagtggggaattgaagagtggggcttttttcttagtcctttacctcttttcgttgtgacggaaccataagtaaagtattcaaatagctcctcagagactagcagtcatggccagaagctacaataagcatgtggataatgggcattctgccaagtgagagagagagcgagcagcagcattggataagaaattatagatattctttagggacaggaaagtggtaagggaataacctgaagtctatgtttctatatagttgaggtgaattcaaaacacgaggcaacacatttgcttattatgtttgtagaacttaccattataaagacaaatattctaacttcatttataattttttcatttatttttctaataaatgaccttactttgtgccagtttattccctgaatgcaaatatagttaattaaaaataaacaattatttatttaaaatgttttaatattattaacaacttgaaacaataacttaaattttctctgcatgcattctaactcccattcattcaattgacattgacttttaatttacaaaattcataataaggatatatattcacaaaggtattattattatggataaaagctcagtcaggaagaggatttcagtggctgtaaactttgtagttttatttgctgaaaaaagtaatagaaaaaaagtgtaggaaaaattcatggactataaaatgtcttattagtgattatttgttaaaataaaattcatggactataaaatatcttattagtgattatttgttaaaataaaatttagtgtgcatttactttgaaaagcatccctaaaaatactccaacaacaaagttaatcctttcaaagcaaagtttcaaaaggtacatgacaaatcagggtgtttttttccccaaactctagctacatgtgtcttatcataccttaggcatttcagtaatggtaggattaaattatacctggaattggtaatacaactatgggtcagaataaaatttaaaaataaaaatggctatagaattaaaaggagaaactatgggggactgtaacgttactgaagatattatcaacttaattagaatattgcaatagtatgtcaaatataactgataaaaagagtcagcaaaaatatttgcttcttggccaaaatgacacatgacataaagaacactgtttcctggatttttatttggccacttaccaaacttaataatttagtagcaagataattactaagtatatttggatgatttgaaaggcatggatacgcaatgcagcaattcattatactgaaaaatttattgtttcaacaagctgcttttaaaatcaagttgtaatgccttgtcttcctcagacagttacttaaaaccacttcaaatacagtaggagtaatcacactggaggaaaacttggccaaacatgcagaaatatggcacctgagatatgagctgatatgctaccaatataaattgtgttactacaaagacgcattggaagagcaagcctatttaatatatgatttcattttgattagtttctgaatatatatgacatagttcagttagaagcttgtttttactccttaaatcctttgtcgcatagaattattacaagctatcaagttttcatttctaagttagattataaatgaaataaaaatgtgctttataacttgtctttcatctatcaaataagctttaatatttattcaattttttattaacctcttcttcgtatgaacttaagtcaactgaatttaagttaactgaattaaaattgtatctaaaattaggaaattacatagaaaattctctaatttgcaagcaccatttttttttaggtcaagcagctttatgagtatgctaccagtttcagtgttttatcattaaatttgtcttcatgtgaacagacattaaacattgtgtgacatataattaaccatgaaactaagaagtagcaataatctaacgatagtcatctttttgctggaggcttgtcttaacccatcagcagagaacatgtgtggtcacaaaatacccattaatacattctttcacagtcagagtaagttctaccgagcttgccaaattccaactcaggtagcttcatttttccagcccacattcctgctgctttttcaattgggtgaattattttcacttcctctcttttaaagagtttctggctcacataggttatcaggtttccatccagtggctgctgcatttccacagtgagtgaatgatctctccaaggtactttgggatgaaagtgagtggataaatgtgaagaattatatttttatttcttctctttggagggattattctataacttttgtgtttagcttggagggctcctttgatttgatttctcttcgaaataagcgaaacagccacccagatggcaagcacttcagatttcagcatagtgtaatttgatttggaggttcaatgaaactcacttagaaatgtccctccagtaatatttcccctcttagaaatttaacttttaaattcttggcttcatgcagaaacaaactcctagggaggctgagtagtgagtggcaaggtggtcatagaaattattattaactctttaaatgaaatgttaaaaaataatttgccttctaatattctcaggatttcactatagaagcagcatatactgtgtaatttttaatttccaattccctttttatgattcttatgaataatattccaaaattaattttgcatttgtttaggaacctcagtaagaattacatttagtatttataggagacttagtctttgcaagatactatatggcacaagaaagataagaaagtctctttttttcaaacatattaaaatctttatgaagaaaaattcactaacaacttcagaaaaagatggtgtgagactatgagatacataaattttaatgtatattctgtcagttgcattggaatttcttgcatttatggacctggcatcccccaaaagtgttattcctaaggttttgattttaccaagtctaacctgacttaggcaacccttttctcatatttaaagtcttcctttttttaatactctgtttatacacacacacacacacacacacacacacacagggagagagagagagagagagaattggtagagaaactcaaaatatttcaaattaatattttctctttaatatttatttttctcaaatattgtacctctttattcaagcccctgaagaacttaattactatataattctcattttatagccttgtccaattatgaagctgaagtaaatcaaacttttcccattaattagagttaacatgaggtgtttgctctataaatacataggttttaaaaagctttacttttttacacctgagaaccagatgtagggaatagaatgcaagacccatcaaaataaactgacttgaatatgtttagggaacacagattctcaagaatatgcagtagcatctgtatcaactctaaatcaagtataatatggtttaatcatcaggagagagttttaagttttaatcgtttatttagaatgtgaagtctctacattttattctgtactcattttctgcaaagaagatgacctaatattagcatataactctaaacattataaatgtaataatgcaaccttgcacatctgcaccatacatgcatcagaatctctcaacgctgagggaagaaaatcacttccattagtacctatgtcagtgttggggattgctctttttaattgaaggcttaggagctcattcatcagtctttactgtcacagtgctgaaatagtttgccaagtttgcaatttttaaccccaaattgcaggaaaatattacttagttgtgtcttaagtgagattgtttggtactttgtctaattaaattaaatcgaattgaactccagatccaactttatcaactcatgtcattatttccgtatgtacatttagtgataggttgagcggatcaacttctatagtttacattctagattaacagaaatttagataaataaatttaagttctcaaaagagatgagtttctgctgaattctactaataacagagaaagataccataaagaatattaaaagttctctaaagtcacaaaataattgaaacatgaagaattaacacatatattaaaatagtttcatttctctggcaaaatttttataaagtcttcatataattgcattttataagcatcacatgacaccaaatacatgagatattaaacgacaatttgttttctcagagtgagacacacacactttatagcatctgcacttattttagagtcaaattgctcaggttaacatggcttgaaatttaatatcattgcttcgagcatcagaaaatagatatgacaaggcatagtatgtaaagaaatgctgaaagaatgtaactgaagttgaaatatatgttttaaaatccttatgactaccacctgatgtctgtggcaatgacaattaccaattaaagtggagatgaaggaggagctggggtcaaaaggacatctgccccttcctctctcagatctgggtgattccaggtgaaacagaggatccttgaaagaaaaccagaaaaatcattatgaatatgcctcctctaataatcatttaattccttaggtaaaacatatgaaacttcgattatttataaagcatgtattctaaatagagcaccagtagcatcaatttatttagagacaaactgggttttataaataagcacatgtgttttacagacccataagagttctctcactcctctgaaaaagtatgcaggtgatgaaagaaaatagcactttttaaatcattttatgagactgtattatttattctgagatgtgtcaatgaaatatttgaaaggaattgaaacttgctggaaaaaggttaatgaaaaggaggttcaatgttaaaaatgatagtgggcttttatcaagcatatcaagaatgctgttgttgatttttttataaattagatttttatttttgatataaggggtacatatgcaggtttgttatatggccttattgtgtgatgctgaagtttggggtataaattatcccattagccaggtagtgagcatagtgtccaacaggcattttgtcagcccctgcccccctacgtctcatccccctccagtggtctccagtctctattattgccatctttatgtctgcatgtacctaatatttagctctcacttataagtgagaacatgcagcattttgtttgctattcctgccttaattcacttaggataatgacctctacctacatcaattttgctgaaatggacatgatttcattcttttttatggctgtgtagtattccactgtgtataaataccacattttctttatccagtctagcattaatgagcacttaggttgaatttatgtctttgctattgtgaataattctgcaatgaacatatgagtgagttagtagaggagctcaaaatatttcaaacacacattgtctttttggtagaatgattcattttcctttggaaatttacccagtaattgggattgcagggtcaaatggtaattctgttttaagttatttgagaaatctctaaacttctttccacaatggctgaactaatgtatactccttctaagagtgtataagctttcccttttctccacagcctctctgacatctgttatttttgacttattataatagccttcctgactggtgtgagatgatacctcattgtggttttgattttcatttctatgatgattagtgatatggagcattttttaatgttttttggcttcctgtatgtcttctttttagaagtacctgtttatatccttcgtccactctttaatggggttatcatgattaaaactctcaacaaactaggcattgaaggaacatttgtcaaaataataagtcgtatatgacaaactcacaaacatcatactaaatggacacaagctggaagcattccccttaagaacaagaaaaagacaaggatgcttactctcaccactcctattccacatagcactggaagtcttagcaacagcaatcaggcatcaaaatagaaaaagaagtcaaacgatctctcttcactgattgattctatacctagaaaattctaaagactgctgaaagtctcctagaacagatagatgatttcaataaagtttcaagatacaaaatcaatgtctaaaaatcagcaaaatttctatacacatatagcattcaagctgagagccaaattaagaacacaatctaatttaaaatacccacacacaataaaaccagaatatctacaaatacatctaagcaaggaggtgaaaaatctctacaaggtgaaaggcctctataaggagatactgctgcagaaaatcatatagatgatacaaacaaatggaaacacattccattcagatggactggaagtatcaatatggttaaaatggccatactgcccaaagcaatctacagattcattgctatccctatcaaactatcaacatcatttttcacagaattagaagaaaactattctaaaattcataagaaaccaaaaaagagcctgaatagccaaagtaatgctaagcaaacaacaacaacaacaaaaacaaagaaaaactggaggcatcacattatgtaacttcaaactatagtacaagactacagtaagtataacagcttggtattggtacaagagcagacacatagaccaatggaatgaaatagaaaatccagaaataaagctgcatatctacagccatctgatctttgacaaagttgacaaaaataagcaatgaggaaaggactccctattcaataattggcactgggattgctggctagccatacgcagaagaatgaaatggggctcctacttttgccatatacaaaaattaactcaatatggattaaagatttaaatataagacctctaactataagaatcctagaagaaaacctaggatatactcttcttgatattagccttagcaaagagtttttgacttagtcctcaaaagcaattgcaacaaaaacaaaaactgacaagtgggacctaattaaagagcttctgcacagcaggaactatcaacagagtaaacagacaacttacagaatgtgagaaaatatttgccagctatcatccaacaaaggtttaatatccagagtgtataaggaacttaactcaaaaagtattactgatttttttaatagtttggaaaagaataacaaaatgtactctcaataatttggaatatttattttcaattttattcttcatcacatagtatttgtataaacattcaatgtttaataacatagaataatgcataagtactgtaaatatttatcaacaaatgccatattatgtacaatatttcaattttaatataaggcttcacacagataatgaaaattaatattttcatgaaaaactactttattggctcctatttcaagcatataaccatagaacttatcccttaatgtttccaggtttcaaaattctcattaaaggttgttttgtataattaatctccattaagtatactacaagtggtgtgggtaaaaaaagtagtttagaaaagtgacaataaaaatcaatattgaaaaacttgtataaaaaactaatttaaaatagaacatcatgatattgctcaatttggcaactatgtacaaccctgctcatctgtgaaccacaaacctataaacaatcttgaaagtccagagtaacctctgagagttgagggcacttctctcaaacttgatcttaactttgctagtcatctgatttacccacattatctgttctgtctttgtcttgctattcttatttagcacccttttctctttctctgtgatatcctaaaatcacatcctgatcctgccgttttgaaaacttttcagtaaatgctgagttcacccaaccactactaccatccagtcttatccttggatttaaaacatagcctagtgccgggcacggtggctcacgcctgtaatcccagcactttgggaggccgaggaaggcacatcacctgaggttgggagttcgagaccagcctgaccaaaatgaagaaatccagtctctactaaaaatacaaaattagccaggcattgtggcgcatgcctgtaatcccagctacttgggaggctgagacaggagaatcgcttgaacctgggaggtggaggttatggtgagctgagatcgtgccattgcactccagactgggcaacaagagtgaaactgtctcaaaaataaacaaattaaaaataatgataataaaacatagcctatagaacaaatgtggcctcctgacccaaaggtgtggctaaacttatattctaagccaaaaaagttttacctttatagctactatacaccaatttgaagaaagcatgaatggcagtagagagatgttttgtgtttacttcctgcagatggcagtttgcaatgacatgagaataagtttgtccaaatgagaaaaaattatagatctgcccagctaacactttcactgaagaagtttcaccaaaatttgcaaaacagacccacatcatttcatggaggaggaaatgaccaagtatatgaatataatacttgtttgcccctttagtcattgccactttatacaatatagatagtagatcagggatatacatattatatttgttttactatagtcaaacatcagcgtcatggaaagctgacagtgatactaggctgctttcaaaaatcaacgttttctgtagcttaattcagtttttgatgtctaatgactgatgaggttgttttatctaatgggtataattagacaccttatatagtaaaattgaaactgcaagagcaatacaagtacattgcgtatttattcaaataattttaatacattcgtttaaactgtcaaatgcgtgaagcaaatagaaaatgaaaactgaaagaattttaagatcaagagaaacccagagtttgtagaacctcaggcatagatgaataaaatgcagtcacaatttcatagaaaagttacaggttttcatgactagaaatcataatataggttcttgaggctatatttgactagtgaattttagcctgtgactgtggtattaagtatcttacataccagtgtgttcaactctcagaagaagttgattgagtcgacaagaaacaatatgcaccaagaaacctgccatgctaacattttgaaaacaatcaaatggcacccagaatcatcctgaaatttttagttatgtaggagacacaaatctgtgcaatacgtaaatctaccttagtctgtgaaaggatatattcttttataaaaatctcaagtttgacaatgagcatacttgagccttgaatattgaatgtgcatgcattctcagagatgtatgtatgtctaaggtcaaaactcagatgtaccttgactaaaccctcctttctcacttttctccagaagacttcaaatacctatctcacatttatttgattaatggctaaaactaagtcaacaagtaatcattttaaaataataaacaggttaaattaaactcttctggtttgctttctgcatcactatgaagaatttttttttttttttttgagacagagtctcgctctgtcgcccaggctggagtgcagtggcaccatctcggctcactgcaagctctgcctcccgggttcatgccattctcctgcctcagcctcccgagtagctgggactacagacgcccaccaccacgcccggctaattttttttttttttgtacttttagtagagacagagtttcaccatgttagccaggatggtcccgatctcctgacctcgtgatccccctgccttggcctcccaaagtgctgggattacaggcatgagccactgcacccagcctcgattttaaaaatagggtacagtgtatactgctcaggtgatgggtgcatcaaaatctcacagatcaccactaataacttactcatgtaaccaaataccacctgtactccaataacctgtggaaaaataaactaaaaatacaaaaaataaaatgtatgttttttgcagattataatttattagcccattaatttttttaataatgtaagctattggaacatcactgcagtagaaaagtaccattctctttatgtaaaaaggagaagaaaggtccacatctttggaggatacattcattttatcagtgcataacaatagatggttaataatgccccaggagtcaaataacacaaaaagggtagacaacgtcagattagattgtagtttgggatacttctcaagtttgaagaatattgtaatgtgtattttgaagactataatatttgtaacaaaataatgaagaggtgctttgaacacatgaaagcactataattcctctgtctaatcactttgcacaggtattcttcgaccctgtcctgaaacttgattgttagattaacatttaaattactacagtatgatgtcattacataccacagagagctccatttggaaaggtcattttaattagagataatatgaatactaaaactacatctccggcctactcacatctttccatcatgtcttctaaaatccttctttcttggtaattaaatccctaacaacaaactcaatttgcaagaagcttccaaaatctctttaccttaattgaataattgtttccacaacaggcataataacggagcctcaaagatgtcattgtcataatcctggaacctgtgaatatgttaccttacatggcaaaagggactttacacatgtgatcaagtgaaagaccttgaggaggggaaactaccctgacttatccaggtagatccaatataatcacatgggtctttaagagataagatgttttgataaaagcagaaagccaaccgggatgatgcagtgcgagaaaaactagatccagaaatgcttgctttgaagatggaggaatggggccctgacctacagagatgcctactcaggaggtgctgtcagcctctaccatgtgtgggagggtagctggatcccagtctccagtgacaatgtagctgatctacatgacaagtatagtggatctatcccttgaaggagggtggatgtgactgcttgcattttgggggtaactgtcattggtaatacggatcagtgctccatccaggtatagtggaggggtcttcaactgtatcagtacttttttaaagctctggaactttgacctctatgggttaccagttgttaatgagctattgcagaggtgtctgttttactttcttgaatgttaacattatactattcaatacttgaaaaaaaaaatgttttctgtatgccacaaactaagcctggaactagaaacacagcaataaacaaagccccaaactattgttctattttcttcataaaattaccccaaatatacttttctctcctatttttagtgttcctttcttcaatatttgacactgttacctgctttctggcacttacttattttgcttctttaccacttatcaccttgattttaacaccagcctcctgaacagtctctgagtcccagccatcaattctgtactctgctgcaaagagtcctttctgaattgtgaattttttctcatcctctggttaaaaatcattcattgactacccatagcctccagaataagttattaagtccctataattttatataagggattttatatgtacttaggtaattattcacatttttatctctaaaatgctgcttttatagcctgtgtgccagtcattctgaacttcttttgcctggatatcattctgaatatctctttctgggacctaaacaagtcggacctaaataaaatagtttctgcacagcaagagcaactatcaacagagtatggacaacctgcagaatgggagaaaatattcacaatctatgcatccaacaaaggtttaatatccagaatctataaggaacttaattcaaaagcaaaaaacaaccccattaaaaagtgggagaaagacatgaacaaattctttcatacatacaagtagccaacaaccatatgaaaaaaagctccacatcactaatcatcagagaaatgcaaatcaaaaccacaatgagataccatctcacaccagtcagaatggctattattaaaaagtcaataaataataggtgctggtgaggttgcagagaaaagggaacacatacactgccagtgggaatttgtttaaattagttcagccactgtagaaatcagtttagagatttctcaaaaaacttaaatcagaattatcattcaacccagcaatcccgttactaggtatatgcccaaaggaaaataaatcattctaccaataagacacatgcatttgtatgttcattgcagcattattcaccatagcaaagacatggaatcaacataggtgcccatcaacagtggattggataaagaaaatgtgatacatatacaccatggaataccacacagtcataaaaataaaataattccttagcagaaacattaatgcagctggaggccattatcctaagcaaattaatgtaagaacaggaaaccaaatgtcacatgttctcacttatagaacaatagacattgagaatcactagagggagtgagggaggcaagggttgaaaaactaacctttggggactattctcagtacctggcgatgggattaatcaagacccaaaaccccagtacatatacacatgtaacaaacctgcacatgtactcccgactctaaaacaaaagctgaaattattaaaaacatacaaaaacgttgttgcagataggtaggtttactctagagcatttgtaaaaattattatgctacgttgtacatgcttccttgggactgcctagatagtaaaatcatgcttctatttttttccatattttgattgccattggctttagtaaaactgattagattagtagaacaactaatctagttgttctagacacattcttaatttcttcagacacccaataaatacattattgtattaatctatacttttatgatttatgatggactcttgctaggattaatatattaaagtttctgtttaacataacatagtgtgacatgacacttattaaaaaagaaatcaaagattgaaatataaaaatgtttattttatccccaaagaccttgttagtgacagcatgtaatttgaaggtaacgtgaagatgcaacaaggaggtacaataatttgctaactaaggattcccttttcccatatgacttttctttcttccttccttcctttccttctttttttcttttttctttctttctttccttcctttctctttctttttcttcaatactgaatagaagcaaaacctgagcttttcatttttatcaaattactgactcgatggtagttttcaataatttcattgatcttttgttccatggttttagagctgaggctttctttcccttgtgaagctacacatgacaggaagatatattgatccaatttatcttaattcctcatgtctcagtacaatatttttgcaactttatgcaactgagatgtggaaattttttaaagcagaaaaaaggaagaaaatttaccatagactacatagtattgatattatgagggaaagcaggcagttttcaaacctttatttatttgctttgcatagatcaagctaacttcaatattagctatatattccagaaggaaacttctcacgttattttgagagttcattgtggtcttaaacgcagtgtttcatgtagtgcacaacccaataaaatactaaaaagccagtgataaaattctcttccataaagtagaattcagcaaccaaatcaaccagaaaacttgagccatgatgacattttcagtgaccccaaagcaatcgcctttatggttcaagcaatgtgtaatgttggtgtttaaccctattgagaatgttggtcacgacttacactggctttctattatctctgttttaacagctggaatttctgcctgagtagtgtgttttaaatttaaaaggcattcccagcattaacatgtgggctgcattttctgtttcaatgtgatatggagaaatttttcaatggcttctcttgtgcttgaaagtaaccactaatgtgggcagatacatgtgtctgtcagaaaaaagtgtctctaaaatataaatggtagatctctccaggggagttttcctctttgggccttgagggatgccctcagaacccagaatgtctgtggtaagctcttttcgacaggtgtgagtcattgcacagcaggtgccacatgtgatgccaactcaataaaatgagtttcccatttgtaaatcagcttcatgaactaatactcttttgcttgtcttcagtgccatagggatattctgaaatatgctagaagtcaactagaatattataagtactacaggacaaaacaaacaatcatttattttattagctatttctagtgattaggaaaaatagtaaaatacacaatgttcattacatatatttctgccaacaatggaaaataggtgaaagtgcagtattgttacacaatgtctcaaataaataaacataatatgcagtttaattctttaaataatagctacatgataatgtgtataacaaattaattctgaatgtgattcactctaccatatcttttttgtttctcctgccaagcaataaaaatatttattaaaggatatttgaaacctttcccaaagactaaataaacaagcagaaaaaatacaaaacaggagtaaaatagcaagtaaatattttgactgtaaggctaatagttttgcattttaattgcgttttaacatttttttctctaaaaaagtaatatatttgtatcatacattaaaatttaggaaatacttttgcatgtatttatcttgtttcatcctcacggtaaacctgtgaagtaaacagggtcaataatattttccacaaatattattttctttttagaggtgaggaatcagaggcagggtgaggcttggcaagtctcagtgtcttctaactaacaattccatattcatttgcagttttacccactttacttattgtagttggagaggagtatatgtgtttgcgttgttaggtgtggttgaatgtcatttataaggtacttaatgcataatcaaggcccaaaaatatatattaagatttttttcaaaaaaatcttattttatcaaattgcattttcaaacgtttgtaagtcctttaataccattggaatagctggcagatgttattagcattttttaataattcagcacataaatataatacatgtaagtaaactcaattgtcttattcctaaaacttttaataaatatttgcttgaagctatatttgaaggcaaaattctgttttcacttcccttgtgtatcctctaattattacgtcaggattccattctcttcctcaccctaagtgacctaactttatgccaatattacaactcccacactcaccctctcaaactctttaattccacattgacagctctgcctactggctaggtatgccacggtgtcctagagtatttgaagcaaatatccttcaaaccttatgtttttctgaagcctgcttttactggaaaaacatcatttgctgcctatgtcatcctcaccaacttttcaaatatgatcatgccagcctccttttcaaaaaccctgcagtgcttttgtttttgaaggaagtctaacctcaagaatgggcagctcaggcccttcactgtttgccctcaggctttgtccctcatagtttcccctcccctctccctcatccaatccacactcctgcacaagtgactttctttaaagttgcatgcatgataatactcatagctgtttgattattgggaaggggaattccattcggttttttgcttattcgtttgttttcctacaacattaactcctacttatccaaaagaaaatgctgtttaaaaatgactttgctggaaaaaaaaaatgacttcactgatattctctaagaaatctccaatcaaaatttctcccatggatgatgctgtatatctcttgtagcattatttacattgtattgtgattatgcactcatggataatttaacaaacacttaagaagcttatgttccaagcttactgtgtttcaggtattcaatcaatattgaatataggaagtatgatgcatgctagtcttttttaaaccccatgaaaattgagaaaatagactctaattgtcaatttaacatagaaaagccaaaatgggccgggtacggtggctcatgcttgtaatcccagcactttgggaagccgaggcgggtggatcacttgaggccaggagttcaggaccagcctagtcaacatggtgaaaacctgtctctacttaaaacacaaaaattagctgggcatagtggtgcacacctgtaatgccagctactcaggaggctgaggcatgagaatgacttgaacccaggagacagaggttacagtgagccaaaatcccgccactgcactccagcctgggtgacgttaaaaaaaaaagaaaagcccagatgaataccacggaatactatgcagccataaaaaataatgagttcatgtcatttgcagggacatgtatgaagctggaaaccattgcccttagcaacctaagacaggaacagaaaaccaaacaccacatgttctcactcgtaagtgggagttgaacaatgagaacacatggacacagggaggggaacatcacacaccggggcctgtcaggggctgggggagatgggagggagagcattaggacaaatacctaatggatgtggagcttaaaacatagatgacggactattaggtgaagcaaaccaccatggcacatgtatacctatgtagcaaacctgcacgttctgctcatgtatcccaggacttaaagtaaaataaaaatgaaagaaaaaattgatgtgaaatctttgaaaattaaaatgttatacgaaaccaaaagttactatggccaaggaagaaatttcaaagacaaatgggcaaagttcattacacaaaataactgagttgaacaaaatagaaaaggaagtggccacatagtcattgcatgaaaacattgattattaatggttgtctattggaactctgaaataaattttcactgcattgccaaaaaaaagaaaaaaaagaaaaaaaaaaaaagcccaagtgaacaggtttctgctattaatatataatatagtaggatatttttttcttcaatatattaactatattttaatagctaataacaacattttaatggttgaattatatttggtagataaataatttcaatggcagaaataaaataaagttttgagaaggaatgtctctctgtatctgaaatgtaaaaattaattaatgtagggttaaatttcttggaaagttaaatttttattagaaaaaaataaatataaattaaaaaatatatcttaatttgagttggaaacactaacgggtaagttaaaaaaataatataatatgattaagggttatcatatttgttctagaaaggtggcacaatctcagcttactacaacctccccctcccaggttcaagccattttcctgcctcagcctctcgtcactaggattacaggcacatgccaccatgcccggctagtttttgtacttgcagtagagacgagattttgccatgttggcctggctggtctcaaactcctgacctcaagtgatccacccacctcagcctcccaaaatgctggagttacaagcatgagtatgagtcattgtacccagcccaagcaagtggtattaatgggtaatttccaaatgacgtttttggcaattggtgttaataactatctataataaagaccatataggtggcaaatttgcgagaacatgttctagctcaataacatataagaaattaatgtggctgattgtattttccagcattggctataacaacaaggtcttttatccaatgtcctcttctgtgcaggtgccacctattcactccccaattaattggtgacttttttttttttttttggaatgctccctcttggaatccagctaccatgttaagaagctcaaagcacttggaggggccatgtgtaggttttctaattcaaagtctcagtgcagtgcagcctttgaatcatcacagcacaatttccagacatctaagtgaagatgtctccagacgattccagtctgcagccatttgaatattctcagctgaagccctaaaaattgtggatgagaaacaagccacctctaccaggctctgaataaatccctgacccacagaatccattactattaaaaaatagttttacacaattgcatttgagggtttttttttttgttgtgtggcaatagagcatggtttaaatagaagaaatattacttagaggtagttattactattaacataattactaataagtcaaatgaagcatttactatcaaaataagacaaataaaaagttataataacgtctgggagtgaaagaatgttaacagagatgttctcacactttgctaataaaagtgtgaaatggtataacctgtggaaaataatttagcaataactgtcaaaggtcttaagagaattatcacctaaatgaaacaatgcattgtcattttactggtaagagtcattgaaatgaaaacacatatatagagatatataggtagatacacaaaattgacataggtatcgaaagttaggcaatcatatatgctttttcagagcattaattagtgccatgattttgaagattaatttaggggtgcctattaatttcaaagagaacttgatcattttatcaagaaattctcctgattagaatctattctaaaccaagataaatgcataagtctttaccagccacatgtgtggaacagaaaaaaagatatccaacataaacattgatcaatacagaaaaaataatttatagtacagtcatatattgaatgcataaatcttattgtaatttttcaaatcacccaagaaaacaataatatatttcagcagggtttggtgctggggtccaggacagtagcttttgaaaacttttgctatgcatttgatatctttctgagtgtttggacttttgcaatttttgcattgtacatatattgaatttttaaacaaataattttaactacattaattttttcacttgaaagacaactctgtaaaggggctttgcactagtaccaaactcacacatttgttgcaaagattatatgatgtgatctgtgttaaaaatgtcttgttcaaagtaagtgatttaaaaaaatgattatcatttttggaaaagaaagaacgttaaaatgtaaatgtaatatatatatttggaggttgtttcaaactaatagttacaaagggaactgagtgtcttattgaggtttatatttcatagcatgttcccagtgaatcacctataaaagtcactcctggaccgactgtttacaacattgactcttgctcatatcccagatttactaaccgaaattcttatctttatttatgacaagctcctaactaaagtttctacagtcaagtcaaactacaacaaccttaacaatgcttcccaattagtttagaagcatcttttaaattaataattggagaagctttcacattctgaacactcacaaaaatatctattccataaaaatatatctctaaatacttgttgaaatattagtacattctgtgttctacaaaaaagctttcagatttttcaaaatctaaaattttgaagtatagatttacaaaatttctagaggtgttaaatgtgaatagttaattgtaaatgaggatacaagacaaagacgatacataccgagcaaataaggtgttgtatcattttatttgagggtgtagctcaaaagtttttatagctctatagcttatcaaagttagacataagaacagttaaacacctttcactgataaaatatacgatgatcccaatcaaacctcattattttgggaaagaataaaatttaatttaagaacatttcatagattttgtatttctatacttaataattttctttaaaataattatttatgaagaaattcattagaaactatatttttcatatattaggttggtgctaaataactgtagttttaccattacttttcatggcaaaacctgcaagttatgtttgcaccaacctactacatatatataaattttaaattctaacaacacatttgagaaactttccgtcaaatgaacacctaaataatctggaatcagcaattccagattgtttcatatattgctcttacttaataaaaacctgcaaattggctccctggaaaacaactttattaaactgatcaaaaatctttctcttacaaagaagacattataaaataatattgatagtattttgggttaaattcttttgctctggggactgccattttcaaatgcaacataaaatagaagatttaaatgcattaataagcagtatgcaatctcaaagcaaactttattaaattagaattcatccaatatgctttcaacttatcaatacattaacacagcaaaactgactagcgtcttagctgactttatttttaataataacaaacatgcttcttgctctaaaaaattaaactgtgttctatatactttcaagataaatgtgcacaataaaccaaatttacttttgttcttcctgatgccaattaccattttgtgccacactttggcagaattggctaatttgaggatagatttatttatcctcaactgtatttcttttttttttttttttttttttgagacggagtctcgctctgtcgcccaggctggagtgcagtggcgggatctcggctcactgcaagctccgcctcccgggttcacgccattctcctgcctcagcctcccaagtagctgggactacaggcgcccgccactacgcccggctaattttttgtatttttagtagagacggggtttcaccgttttagccgggatggtctcgatctcctgacctcgtgatccgcccgcctcggcctcccaaagtgctgggattacaggcgtgagccaccgcgcccggccaactgtatttcttatggatgtaattctaatagcattctcttacaaaaaatctttatctaaaaataagtgtccttttagtccatattgtgtccatttaacaaactaaatgttagaccttgaaaaagttctactctttttctcattgaggatgccacttttgttcatctgtgtgactcagttaatacatgattttgcacaataatatcctaattgacctgtaggcatttattatccaaaacatgtttgagttaacttgccataaactgttgcttacttaataaagaaattattgaatttttggcctggcacagtggctcacgcctgtaatcctggcactttgggaggccaaggcaggcagatcacctgaggtcaggagttcgagaccagcctggccaacatggtgaaatcctgtctttactaaaaaaatacaaaaactagctgggcatggtggcacaagcctgtaatcccagctgcccaggaggccgaggcaggagaattgctggaacccggcaggcagaggctgcagtgagacgagatcatgccactgcactccagcgtgggagacagagcgaacctccgtccaaaaaaaataaaataaataaagaaagaaagaaaagaaaaaagaaagacagaaactatttaatttttaatttattcttcaatatttatacaccaaacctcacctgtatattctaacaaaaatatcagatactctaagtgaatgtaacatcttcgtctatagttagttagcaatattatttatatcattggtctttcgtgatgtaaaattccatggttaatatacttaacttcatcttcatgtacattttaatttgtatcctaatattttttcaaaattattaaatgtttttctttccctctatatatgtaacatgtcattttctgtgtctatcataaagtcaatattcaactttaaagtagcaacaagttgagctcatgttggagcctttctttgtatagattacattgatgttaaattatttcatgatgtgtttatatcatatgatttaattgtttatgtggggaccataatatcaatactatatttggtaatgtgaaactttcagctgaaatattttttctcatgatacctgttactattcaaaagttaggcattatgttttatagtagttctctaacatatgtgtgtgtgtgtacacacacacgcatacatataaaacgtgtgttaaagatatacaacacaaataaatctaaaaggtcaggcataataagaaaataaaaatgttgtctgatctaataaactagtaagaagaaaatgtgggggaggaagaataagaagaggagaagaatagaaataagaatgagaataagaatcaagattttttataaagagagttaactcaagtggcagataagaaagatgaagtttctggtttgattttatagcctttcaacctcaatttcgttacttgttaaatatatatacatacatatatatacacacatatacatatatatatatttatgtttctgttactgctatcttctgtgactattatgagaatcagaggaaggaatgcaagtaaaagtcaacagagaaacttcaggaactagaaaatttaaatacatgatataagcaagtatacaaagaaaactgatgtcttaaaaatccaagggtttgcaagcagatattttatatcaaacccaatggtgcataatgctaattttactcagcattattttctttttgttgttattctacagttaattttaaaaccttgttcaatattggaagaagccaatatggtataagaatgtatatctatatgggtggttgtattagtccgtttttatgctgctgatgaagacatacctgagactgggcaatttacaaaataaagaggtttaattgcaacatggctgaggaagcctcacaatcatagcagaaggcaaggaggagcaagttatgtcttacatggatggcagcaagcaaagagagcttgtgcaggaaaactcacccttataataaccgtcagatctcgtgagacttactatcatgagaacagcatggaaaaggcctgctcccataattcaattacctcccactgggtcctggtggaattcaagatgagatttgggtcaggagacagccaaaccatatcagtagtatttcaaagcactatggataaatgatagattcttccataaatgttgtttggataactggattgtcatccaaaaaataataataataataaagtttgattatcacttcatgtcctacaaccttgtactaaaatttcagattgatcaacaatctaaacttaagatataggacaattaaagtaattaaaaaacattaaaagtttgtataaaacctttgtgggaaatgccatttataataaaataagacacaaaatccagaagacattaaaaaattgataaattttatgacttaaaattttaaagaaaaaaatcctacatgaataacataaactttttttcactcaaaaaacaaaggctttctttcttattttaaacataaaaatcagtgaaagttgaatttttaaaatgaacaaaggaaaagaacagtccagagagaaggaaactcaaatgactcttaaaatgtaaaaagatactatctcagccataaatatatgaaatggaaattaaaacaaactaagaagcagttatattcttagtcttctgactgtagtcccaaataacatttcccattaaaaggaacaagtgctccttggagaagtggctgacctcagaccttggtccataatgtaagatgggcttagaatcttttcattctagaaagcaaggaaactattaaaactattaggattatatcacaaagacttcgatatcaacttgaagagatacctactgggaaaagacaggacaacttgttcataataaggataataactgcaacagattgaaataagcctaaacaagcataagaatataaaaaattcaatgttggcaatatgtgctagaaatattctgtgaggccacatcagaaaatgtcatattataattaaatatcgagttctgagattaagaaaagaaattcagtattttaattctttgaaaaaatagcacaggcagtcttcgtatgaatgtaataatatctttggtattgatttttatttattcactctaaaatcacctgtgttttatttttttaagtcaaatttaatgtgatagaaaattcatcacatatggctagtcaatccctacctgggtcaccaaattaacctgactttaaatttataattcatgtagaaaatgatatagccttctataataaattacttaagtagcttacctggaatctctttacataaataaactacacactattcaaagcaggcccatacttaaaaagcagaataaaatgaagtttcgtagtaattgacatcatggtctagatatcataatttcaatcacttaataaaataccaagaactttaataaatgtaagtatgattggctattttttaacagttacacacatgccttcactattatagatattttaggacaaattttatagaaaacaatagtagtgataagcatttattcagtgtaaacagacaattaacttatgatatttactatgcactgcatgataaggcatagcatatccaatttgcatttgggttacaccataacggtctcttagaaaaaaaatatgctatatatattataatttaatatggctaaataattatatataataaaagtaggcatttatatattttaatatgtaagataaataggagaatgctagaaataaaatgagtaaacatttatgtatacacttttaaaaatttaactgaaggatggaggtaattatttagacgtttagacatggcaaggaaagaaccatcttgactccaagttaactttaagatatggattttctcttctgtgtctttcctgaccaccttctctgggtttgactgctctgctgttattctgaccacatagaatggagcaggaatcaaaattctttttttagaacaaagatgctttttataaaaccatgaatatctacttttcatgggaaggaagtcatagtctcgttttagtatgcagataggctttggaataattcttcagttctaaatcccttcttcccttttacttggatgcatttgaaaactcttcaatcctatgagtgttcctactgctgactgagtcatacttgatcacaaaggatcacagtcctgtgtggagaagaaagaaaggaattgctggtaaaagaaaacataaatccaccatctgcacagtaagaactggacagctgcgagggaaaggacgctttctctaacagccgatttgttattcagcccaggctgcagccatatagctctcttggagttaaaagtctcaacaaaggaaattttggaaaactaaggttaatgggcaaagtctttcatgatcatcagaggagtctaggctaagggctttttggttgtttctcagggagaggagaaaatgtacctatatcatagtgtactattcttatacagttaaagaagaattttattccaaaattattttcaaagctgataacaattaaataattatttctgattttatgatttcaacgccacagtctaacctgttctaatcagttacatacttgaaatgagaaaacttgctctatgagtcttgagtgtgagagcatattttgcacctttcttcttgcttctgattcctccttttatcaagacacaaaaattagcttatactacagaagcaaaagagacattataatatccttaacgtattttcttttcttgcatgatattatggtggcttatgcctctctatcaataacagaatagaatagaaatatgtaaaactcagacataggtaaccagcatgtggttctgcttcactggaaccacatgatcagtggtaaaagaatgtagaataaacacagtatctaacaccagcttttcaattcaatgtgcacttcaccactctgtgcacagcgtatgttaattctggtaggtcctgcaaacaatttctgcagagcactttacaagatacaaaatgttttttttctaaatattttcctttattgcttcatcacaaatatttaatagaagtatctaagttcatggtaatcctccaaagaacagcagagggtagaaactgtgttttctgggctcaacattgggaagtacaattagtataatgagtgcctcagtgtgaaaaatctctataatgaggtacatagtgttatgagaagaggagaacataggagcctatttcttgtcctggaggtggtagggtggtctggtttgggaaagggagtggtaatattctaggatgcttttcctaaggaagaaaagaacctaccaattggctaagagttcacattagggacattttctgtctgtggggtattgtgataagcatatttcttacttgtttattgtgttgttactacatcctcataggataattttatcctcattttataaataaactttcttagattcagagattttcagaaacttatgcaaatttgcaacctactaacaggcagatcttattccaaaatttttaaaccattcccctataatgggaagacattctagaaggagaacaaagcttctcattcaagacttagataaaaattagctgggcatagtggtacacatctgtaatcccagctactcaggaggctgaggcttgaacccaggaggtggaggttgcagtgagctgagattgtgccactgcactccagcctgagtgacagagcaagactccgtctcaaaaaaaaaaaaaaaaaagacagataaaagtctgtaggacagcagtgagtagcccagatggattgtaaccaaacacatataaggaaagtttaatgagcaagagggagagaagagactgagaagttatattagagccagactctgaaggacactagctatctgagatataccatttgaactcttcacttagtgtgcaatggtaaacctggttgttttgaagagacttactggatggcaagattaatttgacagcagagacatagtgagattaaaaagcatgtaaaaacagtaaggaagttagtgatagcagtcaaagataatgatagtcctggcaggaggaatagaaaaagaaatggattagaaaaacagtttatggatacagccaaaaggattctgctactgattcaacttggggaaaagttaggttacaaaaattaggtgttaagcatggatgaaaaggaaaaaagtagaagcatagtagaaatgaatgaaaggacgggtttttaagaaaacctgataacatttcatatggggaatgtgatttgccaatttgtatgtttttttaaataatggcagaaaataataaaaactcgatacagcatatcaaaatgtatgttagcactaagattcagatttgtgaaccaacatgcaatggcaatagttgatgccactgaagaatttagaaaataagtacaaaaaagaaagatatggtgatgctgctgctgcagctgggtctgccgttgatatgacaatgatagctatagtcatacaacatttactatttgccaagtagtattctaggtgctttatttacattaatttaatcatcacagcaaccctatatgtgaggtaagctccattttatggaggaggacactgagccaccatcagaaagagtaacctgccccatgttacacatccagcaagaaacagatttttaagcctacaggtatggatacacacacatatatacatgtgtgtatatatacaattaatatcaccactgtcatcagtttggattgcgtccttccagagaggaaaaggtctgcaagacaatgtaagctggtgagagtgttttttgttttatttttttccaaagaaaagactaagattggggtaatgttcaatcagtactttcaacttgtctctgttctttgaattctttacaaagaggaaggcaaaaacttgcataactataaatgaatgaagcaacatgattactttcaaattaaatctacatattatggagaaaaaatgtagaatgtacatacataaacctgtaattaatgattttttcataattcaaatatttggagataaccactattgaagatgtgttaaattcccctccagcctttacagaatctttcatatcttattccaaaaattcacattatatttgagttttacttagaagtcaaacaaataatattatgtcctatttccatttctttaattaataaatacttttcaatctcttttcaatatcctgtgctaccacattttggatgccgatcctttccttagccccaaggtttgctgatttttatttagacatcactggactgaagagatgtttaccagactcagttctgtttggaaacaaggcaggcaattttctgtttaactactcactgtccacttggctcctttacttttatactctcacatatttagccaatgtaaatttctattatctcaacagtgatttagccacttaaggaatgggaatcctatagaaagttcccaaagaaaaacaccatcagtgaagagtttacttgcttgttatttttctcttttcttttttctacgtttgctaaagctgctatactcggggtcaggtttttgtttgtgggttttgttttgttttgttttttatagcctttttccctacaactgtatgtttagaccatcctctacatcatgtagagttacgtgttttcactcagtccccttcctgatgttcctggccaggaaccctccaccctcctgagagtttaccagaacttctatgccccccatgaggaagcactgctctgtcaggtagaagtatttgaactttagcactttcctctaattctgcagcatagctaataaaacatccttggaatttccagtacattgtagcaactctccttcttagtagcttgtgtcgatgaagtagtccaagttgtgagggtgtagatatgagggactggggaaaccagaaggggaatacagagagaagagactgttggaactgagagccagaatttgagcagctctgtaatggtaaagccagaacaagtatgataagaatagaataaagctgacacagcaaagagacgtccagttactgcccatactaaccatcaaatcagaaagagacagggtagtggagtacctttgtacaggacctttctgacatggtgacggggtattggattgaagaagggacaaaaccaaaagtaggaccccaagggttggattagagctcctgaacaaaaatctgaacacttggaacatgaaagagcccattaggtatccacttctgacagaaaaagggtataaagtaaaagtgtcatcacaataacaaagcatcagttatatgaactggcttaggtcacagaagaattatagcaagacagactagatactgcctcccctgatgtattcaaccaaggctttgttaatttgagttaagcaaaggtttatttgcacagcctgatagatagcctatgattgattccaaatcagggttgaaataaaagcagttcactaaagacattatataagaaataaacatttaaattatgatttataaatgattagtatagaagaggaaacagtcaaagagtaattagtccagaaagctggaaagatcatcatatatatacttgcatatatgtgatcttgaattttcaatattgattttaaaaattcaaaaaaaatttaaagagtattcaaatatttgaacataccagttttaaatttaaaagtcaacataatactcaattctattcagaagcatcttttattgatttatattaatgcaacaactatttaagggtctagcaattaatagtttataaataactaggttaagttaaataacgttaagtaaaataatgacctgatatatatatatatatatatatatgtttattacatgttttcaatgaatgatttcaatgactgctgccagcattatgttgaagcatgaagatatagttagaaatgacagtctcttgagatactaattcaaaattaagttttgtcttaagtacaattaaaatccaaattaatcattgaagtaagtagcttcatctgatagaggttgagataagcttaatagaggagataatgtgtgatctcagtcttgatggatgagttaggatgttccaaacagagaataaggataagagttttccaagtaaaggaatcagcatagtgaatgcatggacaaattagagaatatagtctttgaaacatggcacaaaatctcgtgattgtctctttggtctcttttgttggagagtagagtcatgaaggaagcataggatctgtctcttcctcttgtcaagaggtcctccctcctttgtcaacctgaatgtgtagagttttatttgttaaaagaatggttatcttacattgtctctagggaattactttagggataaatgtccagtaagcatagaaaatgtgattatagatttctagataaagaccaattatgggaatatgattttggagccatccaacagagggtagatgtagctatgtaaagaaataagaataccaaggaaagcatgcaatgttggaaaacacggaccaagaaaagaattcctgcaatcatcaacatttaaaaggctaggaaggcagaatattcagcatttttttttttttttgagatggagtctcattttgtcacccatgccagagtgcagtggctcagtctcggctcactgcaaactccgcctccggggttcaagtgattctcctgcctcagcccccagagcagccgggactacaggcacacatcaccactcctggctaatttttgtatttttagtagagatgggattttgccacgttggccaggctggtctcaaactcctgacctcaggtgatgcgcccgttttggcctcccaaagtgctgggattacaggcgtgagccaccgtgaccagcctcagcatttcaaaactatggggaaaacatggtcctaaaaatgaaaggaagaaagcttctatttgaaaattactaacactgtcagatgcagcaaggaagcagtggaggaaaatgagttaaggaagacatttaccaactagaaggctgtaggtaacaataaccagtccgtttcaacaaagtgatagatgcaccttgagtggaagagtaaatggaagttgaggaagcaaagatagcaaatacagactattcgttcaagacattttagaaaatgctggagtcaataaatcagcttgtaggttaagtaagcttgaggcaaaatttttgtttgttttataatttttatttcagaatagagaactctaaaacatttttatattctggaaggtagaggtggatagaaaaaaaaggatatttggtggattaaagtaatgaagaaacaaagagatgtcatcaagagtataggtggggccgggcacggtggctcacgcctgtaatcccagcactctgggaggctgaggcgggtgtttggcctgaggtcaggagttcaagacaggcctggccaacatggtgaaaccccgtccctactaataatacaaaaattagctgggcgtcctggtgggtgcctgtaatcccagcaacttgggaggctgaggcaggagaatcgcttgaacccaggaggcagacgttgcagtgagccaagattgcgccattgcattccagcctgggcaacaagagtgagacttcatctcaaattaaaataaataaataaataaaaagagtataggtggaataaattatctgagaaagaagagtgagggcttcatctgagaaggggaaaggtagcaccaaatatttaaatttagaagtgaaagagagagggaagttatggacttttactttacggcctccatttgcctttttaaataggagatatttcaaatgctttgagttagaaaaaggtgaaggcagcattggagacttaacatgaacaaaagtagcatcttgtgtacacttactacattccagtccctaaggcagctgctttcccatttatgattcagaaaatccatgtaactttgacaagctactcattaaaatggagtcttaagtttataggtaaggaaactgaagctcaacgtggatattgactcagggttacacagttagtgtgtagcagactttggatttgaaatttcatgttagtcctaaagcctgtattctttccactacattaatctattcccatccaccctccagaatagtagcaacttggacaatgccaagagttaattaagggctaaaaaagattgaccacatgtatataggctcatctgaataacagtgaaggcatcttacaattgtctctaatgatattcagcagtttcaaacagcagtggagaaaacaaaagtttcaacagaaccaaggccaatgaattataaaggtgaatacacagatacacaaagaaccaagtagtttgtggtgacgttttgtgaataccactgcagtgaggtctcccctgtgtcagaaaaaagcaaaatctgggggcattgaaagactgaaaatgagatgtctgctgacagctgaggatgaagatcaaattgaaagagtggaaaagcagtggaaggtatagattcacacagcagatgctgcttagacacaattgttaccaacgttaaactctctacgtgacccttcatagttttacaaagtgcatcaatatagtatgtaatttgggaaagcaacacattataatgaaaataacttggcctttgaccatgaagctcaagttcttccagtactgtataatagcattaagaagtgacttcatttcttccttttttcatttgttaaatgagaataacatttaacactcccttgtgaagtgttatgagtatcaaaataaatgaacaaaaacaactggcacagggtatgtacttaatacacggtagctctatttattaatattcttattagaataatttcattcttacaataagattgtgagatagacaatgttacttcactatatactattttggatttagttgatgccctcttaactaactttgcaaatgagaaaaagaggattagagagaaaaacaaactgtcctgaggagattggactaggatgagagaacagcttgttaattttgttccaggattttattctataaataatgctgaatctatatactgatcaattaatcaatatagactacaaagtctgtcaagtggttcaaatatgagaatatgggtggacatataaaactctatgcaacattttggctgggactggtggctcacgcctgtaatcccagcaccttgggaggccgaggtgggtggatcacgaggtcaggagatggagaccatcctggccaatatggtgaaaccccgtctctactaaaaatacaaaagaaactagctgggcatggtggcgggcgcctgtagtcccagctactcaggaggccgaggcaggaaaatcgcttgaacccaggaggtggaggatgcagtgagccgagatcatgccactgcactccagcctgtgtgacagagtgagactctgtctcaaacaacaacaactacaaagtctatgcaacatttttcatcttagaagaaggaaggttatcgctggagaaaagtgaaagatgaacacggaagcttatttatttactccaactgcaaaatagaaaagatatttagcaagagagatagaaacattggaggcatatctctccagtgacattacagatacagttagaatggaaaatgctggagacgataggccagtaaacaaaggcacagtggccaaagtggtaagtgccgtgccaaatgatatttttccaacagtaggataacaaaaagatttatttctgtttgaggctcatatattgtttttttcaatttctaataggaaaataatgttaacacagtgagtcctctttttctactgaactcatccacttttctatctttctctgtccagctgtttaatccacacaaacactcaaaataaagtttctggacaaaatatctataacaatgtggaattttgaaagttaacacaataaatgagtaaaattagagttgacttatatttaaaataatttccatgtggaaagtaaaacctgacaaaattcatcttgccagtccggaaaaagcaagtcattttaatcaagccaatattttaattagcccaccaaatttaactctaggtacatctgttccatatcatgtccatgaattagcaatatagtgtgtgactgaatttataactaattcaacttgactacactaataaaattcaagttactgttaaggagtcgatgtattacttaatcacctaatattatccaaatatcttagtaaacatattcttaaaaacaaaaaaaattctggctgagtgtggtggctcatgtctataagcccagtgctttgggaggctgaagtgggaggatctcttgaggctaggagttcagggctacagtgagctatgattttgccactatattgaagtctgggcaacagagtgagaccctattctaaaacaaaaacaaaacaaaacaaaatccaagaaagtcctaccacgctagtatattttctccttagagtcattgtttcagcaaatgtgaaatatatctttagagttacataattttaatgtcttcaggtatactttttcaaaatttcttcagatcctttaaagaaaatttgaaaaccgaatctgataacatttccaaactaaagtagactaatgtagctgctacaaaacatccaccattactcagtagccacataaggaaaagaaatcatctggttgacacagtatcataaatgtgaaaagtgatgaactaggataacattaagtttttggtatgagagacaaaagttcatacatagaaagcctcagatttttctttgtaattgacttattatggacactgccccttatatcaagaattatgttacaattacgtctcaaagctcaaagatagaaaagttaataaaaatagctaccttatgttaagtacttaatttactactggccaaatacaaacatataacttacagtttaggtttgaatttttatacaattaaattttaagttttattttttaaattttatttatttatttatttatttatttatgagacaggttctggctctgtcgctcaggctggagtgcagtggcgtaatcttggctcactgcaacctccacctcctgggctcaagtgatcctgctacctcagcctcctgagtagctaggactacaggcatgcgccaccacgcctagctaacttttgtatttttggtagagacagggtttcaccatgttgtccaggctggtctcaaactcctgggctgaagtaatcctcctgccttggcctcccaaagtgctaggattacaggcatgagccacctcaactggcctaatttttattttggattttaaaaatattttatgcttaaaatattttatattcattttttatatttaatttcatatacatatataaatttaattttcactactgattttatgaagacaatattattaaaaaccttataacagatctaaactacagagacaaaataaaaacccaggtattcttgaatcaaaagcttatatcattaatctctactccctcacacactaatgagaactatacagcacatattttctttcggacttaacttgattgtcaataagttaaatatcataatcagaaaacgttggttttgttctctcttcctgtttctcttttctcaccccctaattacatacattatacacatataaatcaactactctctactgtttcctcccaattttattttggaccttgttttaaattttgttttaaacagcacagaagggggccataaaaagaattatctttcactgattattttctgtatgctgagtattgaattggatattttatacttgctccctcataaaatcccccaacaaacccatttggcaaatgtcaaacagctcttaaatggcaaactgaagacttcagctcaaaagtgactcaaagcctcaataagcatataaaaggcacacaattttcttgagcatcagaaagattggaaattaagaccacaatgtgatacaaccatgcagccattagaatcctaagaaaaagacagacaatgcttaatgtggggtaactagaaaacttatacaccacttgtgggcataaaataggtacaatgactcaaaaatggtttagcagtatttactaaagttgaacatatgtatcctctatggcacagcaattccactactaaaatatactaactaaaaacacacccataagttcaccaaaagatatggacaagaatgctcatagcagcacaattacagcacaattgctataaacaattagaatgatcagaaaaagtgggaaagtaaattgtgttatatccatgtaaataaattacagtaatgaaaacacatgaacgaaaactacacacaacatagatcaatctcagtataactgttgagcaaaataagctaaccacacaaaaaacacttgatgtatgattccattacataaaattctaaatgaggcaaaactaatctatgatgatagaaatcataatagtgtttattttgggggtagttattgaagggggacaacagattctggggcactggtgttctatttattgatctagatgctgcttaaattgatgtgttcaatttttgaaaaaaaatcataggttatctttttttgtctgtatacttttctttattcattttataagttaacaaaacaggtgtacttaacgaatgtctctgctgtttctgttatgcttaatttatgttttaaagaccagaaaagtaaaaacaaatacatattatcatgttaccactaaaccgttccaagagttggcagaatctatataattaaagaaaaaagttgtcaggagagggggcaataagctttggttgtgttccccaccctaatctcatcttgaattgtagctcccataatccccctggtcatgggaggaaccaggtagagataattgaatcatgggggtagtttcccccatcctgttagtgatagtaagttctcatgagatctgatgacatcataaggggctcttcaccctttgctcagcatgtctccttcctgccatcatgtgaagaaggacaggtttgcttccacttccaccatgattgtaagtttcctgaggcttcctcagccatatggaactgtgagtcaattaatcctctttcctttataaattacccagtttcaggcagttctttatagcagcatgggaacagactaatacagggggacttgcaaattccttttataaacactttaaccaacttaaccaaaaaagtgtttaaaaaaacaaaaattcaccaaatttaactaaatcttttacatattataatcaaggcctgaaattttttaatttagacttagaatcttggagttttacatcaaggcataaatgtaacaaacccattcatttatctacacattcattcattccatagttatttactactagattctaagcacttaagggttttgaggaggtgcatattccttctagtacttgagtagcaaatgcaaatgcctcttattgccaggtggagatggcaaactggcaaaaagcctgggtgcaagtgtgcattgtgtgcttgacagaaactgtggaatactgttaagcacatgtcccatgtggaaagtggggctccaactacttagcaccaactggttcttttcatgtgggtccattgaaaatcacaatttactatgtgaaaccaaccggtttttaaaagtatgctctttgcaagaaaacaaacaagaaacactgtctgtgacaaacaaagcacatctgtgagctgaattgggcgtattgctgccagtttctaacgtctgatcaaactaaagagacatgaatgcttgctgggtcacaattatgagaagctcatttgccctttaggtgccaaagcactcaaagcaccacactcgttctccttcttctggtttgctgtagcctcaggattaacagttgaaaaataaattgcttaattaaatacattatggtttattcttaccatgaaatactaggcgggcatttgaatgaatgagatagaattatatccatatgtgtatgtgtatgtatgtgtgtgtgtgtgtgtctgtgtgtgtgtgtatgaatgtccatgaaatattttgagtgagaatcaacaaaatcagaataaggactgcaaaatcagaattaggaatgccatggaagaggtgggcaaagatggctttggagcatttcacttttccttattttgacttcttccatgtatttatatttgttcaagtgggggaaaaaaaagccctcatagtggctccctgtgaattaagcctcctagttctttaattagttacagagttctggttcaacatatgcctctcccgctccctcattccctagaggccacctgcagggctgctcagcaacataagcatcacgctgtttctctcagggccttctctttgctcacaggcaaggtgagcagagtgaaggtgcaagagagtgaggtttcttactaactgcctcacacacaggaaggatgcaaaagagtgatccataagtgacatttgtcaagaagtctacctttctaatagctttcttataatcattttcagacaaaaactagcacaaggaatcctcttttccttcccatcagaaaatcatttaactagctttcactaataagattgacaggagaggaaggccagaaggaacaatccctctattctagaacatttttaaataaccttggatgttttaaaatcacaaaaataatagactgcaagcttctggagacagtgtcaggctcaccttttaatgccgtggggaacacagcactgccttttctattagctgcactgaaaagtatcttttgatttcagtaaagaaagcagaagaaacaatgtagaaaatggcatactccaatggataaaatgcataatttcttttaaagtattggtttccattgaattcttctaatgctaatttatatcatatatatatataatttgagatggagtcttactctgcaacccaggctagaatgcagtggcgcaatctcggctcactgtaacctctgcctcccaggttcaagcaattctcctgtctcagcctccagagtagctgggattacaggggcccaccaccacgcctggctaatttttttgtattcctagtagagacggggtttcaccacattggcgaggctggtcttgaactcctgacctcctgtgatctgcccaccttgacttcccaaagtgctgggattacaggcatgagctggatatttattgggtagctactatgttagtgtaaataattatctgtttcgcatttaactttcaatatcaactccaatgcgtaaaataatcccattctccctactgaaaaaaaaaaaaaaagtaccattgtcaggtaatctctatttttatggcccgtaatctccattacatttctagcaaaagacaaaacaaaagaaacaaacaaaaccatatacagtaattagtctgcagaatgaaaaactcatagactgagaccaaaacaaaacatattctgacttcataggggaatactcattaccttctaaccacttacttgaaatgaaaatattaaaaattaccataatttttaaatcagtaaaacatttctatatattattttcacataaatggatcaagaaattgcaggccagtcattcttcacatcatgtgaccaaaaagtttataaaagtatcttggtacaaattataatctggacatttttgttaactaaagtctagtttaatatataaaaattatctgaaagtataatgttataaaaatgtaaatattcatatatttattctattaaattggctattacccactctagatttttacaaattattttaaaatggttatctttaatatttttatttttacctactattaaagataattttgggccgggcgtgatggttcaagcctgtaatcccagcactttgggaggccgaggcgggtggatcacgaggtcaggagatggagaccatcctggctaacacggtgaaaacccgtctctactaaaaatacaaaaaattagcctggcgtggtggcgggctcttgtagtcccagctactcgggaggctgaggcaggagaattgcgtgaacccgggaggcggagcttgcagtgagccgagatggcgccactgcactccagcgtgggcgacagagcaagactccgactcaaaaaaaaaaaaaaaatatatatatatatatatatatataatgtgtgtatatatatttgataaacaagcaataataaataacagaaactttaaaataacagatttggaaatcttcagaatttcaggggtttagaattgggtgcaggaagagttgatattaaagaaagtggtttgtaaaattaagatatgcatatttatttgtgaaaggacaaagaatattaaatgcatggctataatgatctcagttgtgaaagagaaaaggcacatttcagtcacataatgggtgactttttgaacctcaaaaacttacaagttttgttgaatatcccaatgagtttactttgtactataagcagaaaaaaaagttaagaaacaaatatttataaaatacttttgaggaaaacatctgattttaaaattcatgtatttgtagcatgtatgctttatttggaataataatcatggcctaaaaatatattttcaatatttacttaaaatatggtgttcaagctctcagggatcgatgagataacgtgtaacacatatgactttaaaaggcaagaacattatgtctaaatagtaatctcctgctgtcacattacaaaatatttaactacagaatacaagcaactggaagacatcatttccagtctataacatttaactgtgggctaccttttaaaaacattatttgtgtaaagtatctacatattttcagagagatttgtactctcagaggtatatgtataacccttatgattttgaagccaatactatccaaatagctgtgctgctactttctgcactagaggaaacttttatcaaaaccatacactgaaaatcacagagtacattgttgattatctttgaggcaaaatatatttgcatgactaatttagcctgcatacttaaaacttaatataaatatgctctaaataaatatagactgagaaaatatactgtaccctgttaaaatatggcagcagtctatattcaaatgcttatgccctcaaggacaatcaaattttccgaggtttgagcagaaaaattctgcagatggcccacacattcatcccttaatctttgcaaggagaaatgcagttttcttttaagaggagcactacaaagttctaaaaaagaacagcttcatttctcatctttcattctgggcctatgccttgcctctcccagaaacattttctaaaaatacctgtattaatgcaacctttctttaacatgtaagatatggaaagaatactgtggtgggtagaatgcttatgatgttcaagaatcccactctcaaatatagctgtacgacacgatccccttcctctggtgtaggcacacctgcgaatacggtaagaaatcactccttatactactttatatggcaaacgtgatgggatagtcattgtcatgatgaagctgtgctgtatgattccctcttagtaaactgaacagaaagatttgcctgctggtctagaagaagtatgcagccatgttatgacagggccgcatggcaaggaactgcatgtgacccctaggagttgacagcagcccctggctgatagccatctagaaaatgaggaccttggtcttacaactgcaaggaagtgaattctgccaataacctcatgaacccggaatatgaccctgagctccagaaagattgcaacaccttgatttcagccttgggagacctttagcagaggagccaactaaacagtgcctggactctcacgtcccacagaaactgtgagataataagtgtgtgaagctgtgttttaatcagctacatttttggtaatttgtttgcaagaaagaaaatacaaatagtaacgtgctaatattcttgtgctaaagtcgtctcattcttaagagaaatgttggctgttaagtaatgaaaaccattttaattttgcaagagttcaaggtctttgccaattctctagaaatatgtgctttatacctaaaactctgtttcttattgtctgagcatctacattcaacacataatttccattttctttgagatgtgagtaaaatcagaggtagacataaacttgtagtagtttatatttgtatcacttgttactgtttaaaaagtgctctgagacttttgagagaatagcagcagggacactcattttattctccatgaaatccccccataaaaacagagggattaagtaggatgcaaaatcaaaacctcatcaacaacgcctgtagcaaaaaataaataatttaagttttctctacctgctattctaagaaaaatcttctttcagcattcttagactttttatgtttttctccatatttctttaacgactctattttatttatttatttatttatttatttattatttttgagttggagtctcattcttgttgcccaggccggagtgcaatagtgagattttggctcactgcaacctccacctcctggggtcaagcgattctcctgcctcagcctcctgagtagtcaggattacagatgccggccaccatgcctggctaatttttatatttttagtagagatagggtttcaccatgttggccaggctggtcttgaactcctgacctcaggtgatctgtcagccttggcctcccaaagtgctgggattacaggcaagcgccactgtgcctagccacgactctatttcttgattaaattaatgatattattacatttattatgtcactattcagtaatctcctttctaattacttatccccttactaaaactgtaccattgatactattaactatcattttaaaacttttctttttcaaatgtaattcggattttgcactaacctgatttgccttatatccaatttttctctgagtgctcatgacactccctagacattctaccaccacctaaataatggcacttttcaagttattttgggaaagtgagagtgagaaaagaaaagtgagagcagaatgacagagacagacagagagagagagagaagactctcagaggaaactattaactactcccccagggtttaataattcagtctattctgagaacaccctctcctagctccagattcattctttcaaataaccataagtgaaaatgaaaaaattaaaacagaaataaatactggacatctgttagattcttacaaaaacctaccctgcttccatagctctctcttgcttgtaagaactttgtatttcttcccaatcagcaagaaataaaattagaattgctttttaattccctttcatgtttgacatcagacaaaatgctaagttacagaaactctcctgctgagcagcttctcacttgagttcaacacttccttttctttcctattgcaacaacagtgttaaataccttcatgatctctcataacgatcatgtaatagcctccttaaatttctctgcttttcatctctccctgcttgaatcaatcttaaatattatgaatgtcttgtcaatcaaatactctgttcaaaactccatcgtctccgtgctgtctttacaataacacaaaatgccaatgtgtagtattaaaatcttccaccaacttatcccagttttatctcctgctgttctctaaccaacataaatttctgcaaaccgattccataaatccctgcctcttagctgcttaatcaaagtattctccttgcctaaatgatttgtaacttttaattccctcatgtaaaattgcatcaagcctttaaatggtgttttggggataaatctcatactgcttttattatcggatggtcaccagtttctcttgtgacatatatatatataattttttcaaaatatattatatctgatatttagataattatgtgggatattatttcaatcatataaacattcaactattggaatttgaaataatattcaatcatatttaaagattctaatatgactcaaatatttcaatcatatttaatatttaggtaattatgtgatataaagttattcaatatcatgtgtatgaagtggaagtacaccaagttccagttctgctaatgataatgcatcttacattggacaaatctttcaaagaaaatgatgataaactatatatatgtatatatatttatttatttttaaaaacttctagaaggcactggagatcaattaagaatagacaaagactaaagagatttttcacttgaggaaaccccttaattcatgtggaaatgaatggctagaactcaagcagaaaaatgagtggtgaaatctagaagctgtggtatgtacccttataaattatcttcaacatccctgtccaacatctgaaccgtatgtgcaagcaaatgaaaggtagtgcctggaaagttgaaaaaggtaactactgcccattgcaagtttacatgggctaatatacctttcaagtaaactatgctgtgtatggtacatccaacggggtgagcttagtagcacattggagatatcaggagaaatagtacatgaatttgaatataaatcaatagaatttttccaatctgaaaagcagaggaaaagaaggttgaataaaaatgaactgtgtgtcttagatcaatgcctagaagtctaataaatatatatatttttcttttttgttatatatatgattatatgttatatataataatatatatagttatatataacaaatataaatatatatgtatatatgtatatatatacacatatgtatatgtgtgtgtgtgtgtgtgtgtatatatatatatacacacactgaaggaaaggagtgggtaaatgaagaaatattatttgaagaaataatgaccaaaatttaccaaattagatggaaagaataacgttaagtatccaagaatctcagtatcctaagaaatacagatactgatccctcccactcctgcaaacataaagtcacactattgaaactgttgaaaaccaatgataaagacaaaatcttaaaagataaagcaattttaaaagggaaacatcaataggaataaagctttacattagaaagagattagaagacaaagcagtttgagatactgaaaggagaaaacaaaacaaaaccacaaagcaactattaacgcagaattctataaccaaggaaaattcctttgaaaataaaggtgaaacaaaagcattttcaaataaatgaaactgaatttgtttctagcagatttgcatcacaagaggtaaatattctgactgtgtatatacatacacacgtatatacataggtatactttgttgtacacatctatatattctgaccttacagtggcctgatttgccttccatatctctaaagttctacttttatatcctctgcattgtttctttaaaatgaatcaataaatacactatgatgtattttggatgttagttaatctacaactaggagtggttaacatttaaaatatgctaattgtcaggcctctgagcccaagccaagccatcgcatcccctgtgacttgcacgtattcgcccagatggcctgaagtaactgaagaatcacaaaagaagtgaatatgccctgccccaccttaactgatgacattccaccacaaaagaagtgtaaatggctggtccttgccttaagtgatgacattaccttgtgaaagtccttctcctggctcatcctggctcaaaaagcacccctactgagcaccttgcgacccccactcctgcccgccagagaacaaaccccttttgactggaattttcctttacctacccaaatcctataaaacggccccacccttatctcccttcgctgactctcttttcggactcagcccgcctgcacccaggtgaaataaacagccatgttgctcacacaaagcctgtttggtggtctcttcacacggacgtgcatgaaatttggtgccgtgattcagatcgggggacctcccttgggagatcaattccctgtcctcctgttctttgctccatgagaaagatccacctacgacctcaggtcctcagactgaccagcccaaggaacatctcaccaattttaaatcaggtaagcagcctcttcttactctcttctccaacctctctcactgtccctcaaccactttctcctttccactcttcaatctctcccttaatttcaattcctttcattttctgggagagacaaaggagacacattttatccgtggacccaaaactccggcacgggtcatggactgggaaggcagccttcccttggtgtttaatcattgcagggacgccgctctgattatttacccacgtttcaaaggtgtcagaccacgcagggatgcctgccttggtccttcacctttagcggcaagtcctgcctttctgggaaaggggcaagtaccccaaccccttctctccttgtctctaccccttctctgcttttctgggggaggggcaagcaccccaacctcatatctctgcgccccaatcccttatttctgcaccccaatcccttatttctgcgccccgacctcttgtatctctgtgccccggccccttatctccgtgccccggccccttatttctgcgccccatcccttatttccgcaccccgacctcttatctctgtgccccaaccccttttcccacttttctggaaggtaagaacccccaaacccattccctccatttctctactctctcttttctctaggcttgcttccttcactataggcaagcttccaccctccattcctccttctactcccttggcctgtgttctcaaaaacttaaaagctcttcaactcacacctgacctaaaacctaaatgccttattttcttctgccatgccgcttgaccccaatacaaactggacagtagttccaaatagccagaaaatggcactctgaatttttccatcctgccagatctaaataattcttgtcgtaaaataggcaaacggtctgaggtgcctgatgtccagacattcttttacacatcagtcccttcctagtctctgtgcccagtgcaactcgtcccaaatcttccttctttccctcccgcctgtaccctcagtaccaaccccaagcattgctgagtctttctaatcttccttttctacagaccaatctgacctctcccttcctccccaggctgctcctcgccaggctgagctaggtcccaattctacctcagcctctgctcctccaccctataatctttttgtcacctcccctcctcacacctggtccggcttacagtttcgttcagtgactatccctccccatcctgcccaacaatttactcttaaaaaggtggctggagctaaaggcatagtcaaggttaatgctctttttctttatcccaaatcagatagcgtttaggctctttttcatcaaatataaaaatccagcccagttcatggctcgtttggcagcaaccctgagacactttacagccctagaccctaaaaggtcaaaaggccgtcttattctcaaaatacattttattacccaatctgctcccgacattaaataaaactccaaaaattaaattccggccctcaaaccccacaacaggatttaattaacctcgccttcaaggtgtacaatagaaaaaagttacaattccttgcctccactgtgagacaaaccccagccacatctccaacacacaagaacttccaaacgcctgaaccgcagcagccaggcgttcctccagaacctcctcccccaggagcttgctacatgtgccggaaatctggccactgggccaaggaatgcccgcaggccgggattcctcctaagctgtgtcccatctgtgtgggaccccactgaaaatcggactgttcaactcacgtggcagccattcccagagcccctggaactctggcccaaggctctctgactccttcccagatcttctcggcttagcggctgaagaccgacactgcccgatcacctcggaagccccctagaccattatggacgccaagctttgggtaactctcacagtggaaggtaggcccgtccccttcttaatcaatatggaggctacccactccacattaccttcttttcaagggcctgtttcccttgcctccataactgttgtgggtattgacagctaggcttctaaacttcttaaaactccccaactctggtgccaacttagacaatactcttttaagcactcctttttagttacccccacctgcccagttcccttattaggctgagacactttaactaaattatctgcttccctgactattcctgggctacagccacacctcattgctgccttttcccccagttcaaagcctccttcacatcctccccttgtatctccccaccttaacccacaagtataagatacctctactccctccttggcgaccgaccatgcaccccttaccatctcattaaaacctaatcacctttaccccactcaacgccaatatcccatcccgcagcacgctttaaaaagattaaagcctgttatcactcgcctgctacagcatgtccttttaaagcctataaactctccttacaattcccccattttacctgtcctaaaaccagacaagccttacaagttagttcaggatctgcaccttatcaaccaaattgttttgcctgtccaccccgtggtgccaaacccatatactctcctatcctcaatacctgcctctacaacccactattctgttctagatctcaaacatgctttctttactattcctttgcacccttaatcccagcctctcttcactttcacttggactgaccctgacacccatcaagcttagcaaattacctaggctgtactgccgcaaagcttcacagacagcccccgttacttcaatcaagcccaaatttcttcctcatctgttacctatctcggcataattctcataaaaacacacgtgctctccctgcaatcgtgtccgactgatctctcaaacccaagcaccttctacaaaacaacaactcctttccttcctaggcatggttagcgcggtcagaattcttacacaagagccaggaccacaccctgtagcctttatgtccaaacaacttgaccttactgttttagcctagccatcatgtctgggtgcagcggctgccgctgctttaatacttttagaggccctcaaaatcacaaactatgctcaactcactctctacagttctcataacttccaaaatctattttcttcctcatacctgacgcatatactttctgctccccggctccttcagctgtactcactctttgttgagtctcccacaattaccgttgttgctggcccagacttcaatccggcctcccacattattcctgataccacacctgacccccatgactgtatctctctgatccacctgacattcaccccatttccccaaatttccttctttcctgttcctcaccctgatcatgcttgatttattgatggcggttccaccaggcctaatcaccacacaccagcaaaggcaggttatactatagtacaagccactagcccgcctcttagaacctctcatttcctttccatcgtggaaatctatcctcaaggaaataacttctcagtgttccatctgctattccactactcctcagggattattcaggccccctcccttccctacacatcaagctcgaggatttgccccacccaggactggcaaattagctttactaaacatgccctgagtcagataactaaaatacctcttagtctaggtagatactttcactggataggtagaggccttttctacagggtctgagaaggccacggcagtcatttcttccattctgtcagacataattcctcagttaagccttcccacctcaatacagtctgataacagatgagcctttattagtcaaatcagccaagcagtttttcaggctcttagtattcagtgaaacctttatatcccttacggtcctccgtcttcaagaaaagtagaatggactaaaggtcttttaaaaacacacctcaccaagttcagccaccaaaaaggactggacaatacttttaccactttcccttctcagaattcaggcctgtcctcggaatgctacagggtacagcccatttaagctcctgtatagacgctcctttttattaggccccagtctcattccagacaccagaccaacttagactgtgcccccaaaaacttgtcatccctactatcttgtcaagtcatactcctattcaccgttctcaactactcatacatgccctgctcttgtttacactgtttttccaagccatcacagctgatatctcctggtgctatccccaaactgccactcttaacccttgaagtaaataaataatctttgctggcaggactatgctgaatctccttaggcactctctaatcagatatcctgagtagtcccaattcttagaccttttatacctgtttttctccttctgttattccatttagtttttcaattcatccaaaaccgtatccaggccatcaccaatcattctatacgacaaatgtttcttctaacaaccccacaatatcaccccttaccacaagacctgcctccagcttaatctctcccactctaggttcccacgccgcccctaatcctgcttgaagcagccctgagaaacatcgcccattctctctccataccaccccccaaaaattttcgccgccccaacacttcaacactattttatttttcttattaatataagaaggcaggaatgtcaggcctctgagcccaagccaagccatcgcatcccgtgacttgcacgtatacacccagatggcctgaagtaactgaagaatcaaaagaagtgaatatgccctgccccaccttaactgatgacattccgccacaaaagaagtgtaaatggctggtctttgccttaagtgatgacattaccttgtgaaagtccttctcctggctcatcctggctcaaaaaacacctccattgagcaccttgcgacccccactcctgcccaccagagaacaaaccccctttgactgtaattttcttttacctacccaaatcctgtaaaacggccccacccttatctcccttcgctgactctcttttcagactcagcccgcctgcacccaggtgaaataaacagccatgttgctcacacaaagcctgtttggtggtctcttcacacggatgcacatgaaactaatgataaaatctccctatatagatagttaacagctgaagtagttaaagcacgggctctctccaggggcagctattaagcacttcaaatacttcgaattatatttgcacctgagggttaactaatataaggaatatcagaaataatattttagtggtgaaatggtgttctttgtatgtggtggcttaaaatattaatattttatggccactgctgcactttcataaatggaatataagaatcatgagtctagctgcttaacaacagaatatctagaactcgattttatctgtgccttgtcttaatgtaggactctgccttccaatgtagatgaaaaataacagattctacatgagtatattgtttcatatgcttcagggtaaaattgtgatatagagtgcttcaaaatatacttaaaagtaacgagagttgcgattcacccagcttacaggaataggttatatgactgatctttgagcctgcttgctagtaaatattatatgtgtggcaggattcagttgggatttgcttttattatgcagtatcacctagtggcaaagtcttagcggaagagatgtataactggcaccaagtaatatttatcttaactcagtttgaaatcttccctcctcctgcattccctacctcacctgaccatgagaaagtaattacagaatcaaaaagtctttgcatgtcccttgtaaaatattatattttatttatgtaaattatatatgtacacacacatacacacccacctatatacatattccagtttggtggttaaattaatgaaaatattaatataacacaatagagaacacagtttgatgttaagagatgttcttagtgggcaaattaagcaaataaaattattaagtgaattgagtgcatagcaaattaattggttcacagattttgtacttgacaagaattttaaaggcccagaaagataatttctctgtctcaagcaaactgattcagtacatcgcaaatgcttttatctttcttgggaagaaatgctgtagtctttctttgagaacaaggttgttttaagcattgtttttattgacagcaatgaatgaaacatcttacctccaaatgatatccaactctgatgaaggcacaaactggatcaaaagctccagtaccacaggtcagaaggtgtgtcctgttatagtgatgcaaaacccgaacataatttgcacattcaccctaaagcaggaaaaaaagggaaggaatctatcagtataataaacatgtttcgtcctttttgatttttgtttttcctagccctagaaagctcatgttttaccgtaaatctctgttgggtgaaggaggcaagaggggtagaagaaaagaggacaagaacttggagaagaaactggggtgattgaaacacattttggttagcagtgatgtgtaaattacattttataatgagactgcatcatttttcatgtattctagtttacaactgaggaataaaaaaagcactattcagaaatttcttcaagtgtaaaaattctcatgacaatatgttccactaagtaattaagttattcccaatgctgttagttttttaagtacagtataaacaatgaatcagcataaagtcattaaaaccaaaaatttgaaaaagcatagttattcatatggaaatatgcagtcttttttttttttttttttttttcccaagacagggtctcactctgttgcccaggctggaacacagtggtgtaatttcagctcactgcagcctcgcattcccaggctcaagtgatcctcccacctcagcctctggagtagctgcaactacaggcatgtgccaccatgcccagctaatctttttgtatcttttgcagaaatggggtttccccatgttgcccaggctagtctcaaactcctgggctcaagcgatctgcctgcctcagcctctcaaaatatgtagtctttagggcaaacagaattttaatgttttggaaagtaagtcttatattctcacactcacaaattcacataaagcaccttcagagagaattgttaagtaaatatggaaaactaaccaacaaaaataacattttgttgcaggactatgataagattactatattgctgtaagaaatagtagtagactggggatcagcaaactttttctgtaaaggacgagaatgtaaatgtatttagtttgatgagctatctggtctctgttgcaactattcacctttgcagctatagcatgaaaggagccataaacaatacaaaactaaatgtgtggggctgtgttcaaataaaactttatttacaaaaataggcaaaaagccaccttcggcctagaagctctagtttgtcaacactggtattcaactctaagcttcttgagggcagaatctattttacgcatctcggcatttcccagttaattgagcacagcacctaatacataacatgcttaacaaagttttaatatattcatcagtaaatgaattttatgatcagtatactgaatttaaaaaaatagtttacaatagctttcaaaatcaacttggctaaattaattttagcaagcattcttttgacaaattaggtgttgccattccattaaaaataaattatgaaataaatactaaactcttttagtgcccagtattacttgaaatcaatacatgcaatcatcagttactgtcacgttttataaggacctgttgtgatttcagcactttaaagtctatcctataacagtattaggaggaaaaggccagtggaatcacttggctagaatgaggagtgcactatcgaattgattatccagagcacacaggtacacttatttcttcaagtttgcattcacatgatattttattctttgggtgacccatatatttggtagaatcttttcattcaggcatggtgaaaatatgtgttgtttatttccataagcacctgcacttcctctcttgacacaccgtcacatctgagagggaacctattagaccacattttggctcagctgagctagattgacatggcctaagaatatgttcaattagtcagcatcatgctgtgggctaaggcaacaggaatgtgctgactcactccttggctgtgacccagctgctacagagaatgaggagttggtataatgtgtgttagtcatttatatagtttttttttttttaactgaaaaaaaggttaagttcactttcacaggcagatgtctaggacttcctccagggtgcatttgtgtcacaaaatcagctagccactgctcgcatgtgaaagttctatcactgatgtcttagtgtgttagggactgtgtctgggtgctgatacacagcattctgccactcacacccagcagggaaactacagaaagagagaataatgcttcttaaagtagaagagaccctaaaaatatttaggaataggtaaaatgtgtttattgcctctctcaaactttttgtttcttcattcatttctaatttactaaacaatgtaaagtgaaatctcacaaagaatgtgcttaactgttcctagaaaaaaaaaattacctgcaattatttttctgccaaatacatgagaaataagcattagtataaggaatgtataaacccaagttgattaagatattagaaaacaaaataaaaaccaagatctcaatggcatctctgcttcaactctacattgaaattaattttacataattatgttttatatgcctatatattttttcttcatgaaccaaattgcatacatacttttataagagcaaataaaaatttcagtgattcagttctttgtggttaactagggatataattgatgatttgtttaatttacaatgaatcatacttaccgcatcttttcccttcattatgcattcttccatttttagagctgtactcggccagtgtatctaaaataaaagataatgtactattatgacaactgcatataaaaataaaccacactgaaaaccatttcactttcttctacagttcaaaacatttccttttttttttttttctgttttctgataagatacagtgggtctttgtgttattcacagaattatttgcataattaagaaacgtatcgctgggcttttactttatgataaatccttttttttcttgaatatttttgaaagctcacttcaagtcttggcccttcagaggacagccatgccttaactagccctttcccatgttaaacctgagtggtgctccaactcaggcacctcctgcagtttcttgtgtttttactacttaacacagaacctgctgtgtggtgggctctcctaatgtttgctgcatacaatgattaaaggatgaatgactctttaaatgctgacttataatgtatcatccagtaatacaccatactgtctctttgattatttatttatttattatcttttatttttttgaggtggattctggctctgtcacccaggctggagtgcagcggtgtgatctcggctcattgcagcctccgcctcctgggttcaagcaattctcctgccccagcctcccgagtagctgggactatggcccacccagctaatttttttgtatttttagtagagacagggtttcacagtgttagccaggatggtctcgatctcctggcctcgtgatctgcctgcctcggcctcccaaagtgattattttttaaaaaacattgtttaactctaccagtttccaactgggtatccaaaagttttaattgtattttaagattgttggtttcttcctttatacattccttaaaacttatattttaagtttgttggtttattctctgataagaagaatatatcgaatttttctttttcacctctaatagtatctagcactttcctgagaccacaagcagaaatcagttatacttgttaactggttccacaaatttctaattgcaaaacttaatttatttttggaagaaattttttactttatcactttctttccttttcttttctcagactccttttggtcccctttttgcttaatctatagaattgattgtactatgtgccaggcattgtgttttgaactttattttattttttccttcttttgctttatcaacttacgtgcagaggtttgagtttgttatattactcaattcataattcattttcatcaacactcttaaaaggtccctcttttattttagttaattatttatttccttcttcccattccatgttttatttccatcccccaggaggcaactattgtatcctgttaccaggtgccttctttgtatgtattcttagaaagtgtatactattgctttttgtgcatatatttctaatttatgtaaatagtattgaagttaaatctcatctctttcttatctttttcactaagaactgggtttttgagttccctcaatagtcctatgcacacatatagtctgctgtttctgagtgttttgtaatgttaaggtgtggttcccccacattttcttttttttttttttttggatcttaaagtggaaaacatgtttattaacattcaaactcccctcatacaaggccatataaaaatccttagcattttgattatacattagtctacattttctacatagttacaatgatgtataatttagcttttcataatacagtgtttcaatacatcattagttctgttaaacataagtcacttactttcaaatccaatacttgaacagttttctctgtacatagtttagcagggctaattagcataagatgctatttgttaagaggtatatgatctgagtattaacagttgctgaagtttggtatttttatgcagcattttctttttgctttgataacaacactacagaacccttaaggacactgaaaattagtaagtaaagttcagaaacattagctgctcaatcaaatctctacataacactatagtaattaaaacattaaaaaaaaagtgttgaaatctgcactagtatagaccgctcctgtcaggataagactgctttggaacagaaagggaaaaaacagctttgagtttcttcgtgctgataggaggaaaggctgaattaccttgttgcctctccctaatgattggcaggtcgggtaaatgccagaacatattccaactcaacaactctaggtaactttatggaggtggaagctgggttagttcatgctaggtggctgtagcactgacctcatgtacaaaactcaaaacacttaaatactgtgatctaagtcttaattgcaagctatactgaggatttttttgtttgtttgttttggctatactttcattccaaaagaagagctgaattgatgtttgagttacagcaccagtctattattagtgaatgaagtatactcttgcagataaataccagatcaaaaatcccatttcagtaatttgattaaactgtagaatactaaaaaataaggtatttctacagaaatctttgaagggagcaaaaaatcaaattacagtatatacctaaatattttaaagtgaaataaaccaatcatcttctgaaagtcaaacagtatttgctatgttgtaatcccattcaccattaggctgcaactggaccacgacatcatgtttattaatttcattttctgcatcactactgtcagtatcttcattgtcgtcttcctattttcttatcaactctcccagcgatggatacccagattgcttccaagtctctatcacatcaaacaaattgttacctttttgtacatgccctttttggatctgtgtaagaaaatcgttggtatatatacacaacagaagaattactgctctccgaaatggctacatgtctataccagcaatccatgcccccataccctcacttagcatgatcaacttttccaattttggtgtcaggtgctttaaatacaatatctaatttaatccttaccacaactttatcaaagagatgctattattttgggagtttcttttaaaaattcatatttatctgtggaaacccacactgcaataaatatatgggtggaaacaaaggaatatgatccatttgagtaactaactgtagcaactggtcagttcccaaatgtttttgtggctcaagagcttaagtctcctacttaatattgtttatccccacatctgctgaatcaatcaccttccctcaccagaatgaaaaagctcagtccacctcctttcttaagttccctcggaatttcaagggagcaccatctgatgtatcaatttcatgggcttggctggtcaggtgatttatcttggagggatggtgtttctcaccgaaacactctacagtttttacttaattgcctccattgaagccagatgatatggttaggctatgtgtccccactcaaatctcatcttgaattgtaattcccataatccccatttttcaagggagaaaccaggtggaggtaattgaatcatggaggccgtttcccccatgctgttctcgtgatagtgagtgagttctcacaagatctgatagtttcataaggggctgttcccccttggcttggcactgctccttcctgctaccttgtgaaaaaggtgctttgtttccccttcagcttccaccatgattgcaagtttcctgaggcctccctggcaatgctgaactgtgagtcaattaaacctctttcctttaaaaattatccaatcttggtagttgtttatagcagtatgaaaacggactaataccacaagctacctaagaatttttctgattcccttttgtaggaagtcacttttcattgtcaagttaacattttgatgaaggagtgaaaataacacagccaagtagcatgggcctctcaagatatcattaacatttttacaaacagcttctttctcctcaggatgcttaagagtcctcagagaccttagttaagaaggattcaggtacagccttttccagtccagtgtcaatgtgtactgttgttagactgtattgctaggcctgtgacagtaagacagactcttctcctgtctacagcagtttgtttgttcccttaaagtctctattatcttctgcctccccttcctctatccatcaccatcccagcttatgctctgtcagcctggaaagatattctgattatcaaacaaaatattagatgttgctgattggcggtattttttatttagtggcaaattgtaattatttttaggctaggagccagcatttaaaaatttaaaaatcttgcataaaaatccatatttctgatttccctaaaaatatgatgaaatgcaacactaggcatgcattcctgtgcggaaatattcctctggagttgaaatggaacagatattctgatttgtttcagacttttcttttacacgaatgattcctataggtattttagtttctaaaatctcatatttgtttgaatcctaaatatgttcaagattcagcttttttaggacaggtgaggtggctcatgcctgtaatcccagcactttgggaggccgaggcgggtggaccacctgaggtcaggagtttgagaccagcctggcaaacatggtgaaatcttgtctctatgaaaaatacaaaactagccaggcgtggtggtgtgcacctgtagtcccagctgctccaagggtgaggcaggagaattgcttgaacctgggagatgaagcttgcagtgagccaggatcctgccactacactccagcctgggcaacagagtgagactctatctcaattaaaaaaaaaaaaaaaaaaaaagaaaaataagacgtatgctttttctttttcttaaagccatgccccataaaatatcagataaggcatgtaaatcccagaagtgaaagaggcttgtcacttaacttatacattatgtagccaaatccatttcctgatacatgagtaataatgggaatttatcaaagtgatgatagtagcattttatagtgataaatgctatctgatttaatttattatcatagaaacaagcactctatgttttgaattataggtataaaatattacttcgatgttgttattcattggtgcaatgagccccaagcagttttttactaacaatattcagcatcatgtgttctttaattttcatagtgcaatgtataaacttttaaaggaaaacacagttttggcatataaactttaagtgaaaacacagttttgtttttgatgttgcaacacaagaaaagataaacagagaaaaatggtgatataaaagaaaaccaaccctaaagcaaaaagcacacacataaaatcctagaaaagatgttgatgttagcaatgaatccatcagtgggtcatgcatgatttaggaaagatatcagtcaatatctggttacaatgcagctttgcatacacctgagaggagtcactgaccccactataggtcgaatcctagaagtgaagctgcagagtttataagctttacctgatctattattttggaaaatcattctcaaactgacagatagattttaagaaataatttgtaagacccattctaatttgacattcaatttgatttgggaattattattttactgtggatgtataaattattcaaatgtatatgctagagcatgtgcatgtatatatagactatacaaatatgtatacatatttattatatatatataataaaatacaaattcatttaggatcatctatcaggaaagattttcatgactaattcccttatcaatatgactagaatagataatccctcatccataattcagaataatgcattacggttattacataacttacgagatataggctgggcttctttttacaatattagcatcccttcttactcatttttcattattatgtaaaatgaaggcttctttaaactttagttttactgcatattattctgtattcccctaaatactggcttcaaaatgatcatttccagttaaacacactgtttaggggttaattctccatagcgtttttatacatcttttgacggcttttgttccagaatatcttttcaaatagcctgaaaagatagagacagaatctccctccagggcaaatggaagatttgtttcctgaccaggatagtaaagattcgatctccccctagacaaagtttagacagttttgctaacagcccccttataagattgggagtttcctaagcttggagtccctcaggtgtgacacgtatccactgagtgcggtgtctacctaggctgccacgcatcaccccctgcaggaccggaggggcaaggacactgatggaaacaagaagctcttgctgcctgctgtgtgccatgagtaatagtctttcgtctctgacccaagagtctaatgttttctgacagcatctatgtaactgtgacaggctaacctgtcttgagagcaagataaaatctcagacccttcacagtttttgtcacaaagataagatattatgtgatggtgaagacaataatggcttttctaggattgccagaacatgcattgttcctagcagcaaaactaataatggcaattgctgtaagaataacaaaactattctttcaggtgcatttcccaaagagtttcacaacaaaatctttgctgatattttttcaacggacagtatttctcactcctttgatccctcatagtgttcttattttctctatctaggatagcgatgatttgtgtacttaattttagctctcttattagactataaattacagagggcaaggcagtgacttatttctgtctcactaccagtgcctatctggcacagtgtcttaagcacagtctctgcttttcaacgtccattgattggcttgtatcagtcaatatgccttttatcacattcttagtgaagtcagtctgtcaaaggagattacagtaaagtttgagaaatcaggttcattgacatgaaaatgctgtaacatgttaaatgaataaaacaagtaaaattttccagtttaatcggaaggaaatactgtaggattttagcaataaccccggctctgaaagacttgtaggatttctgaggaaaggtagatggatgtttaacagatcactcttgagtagatggaagaaagacagaaaagtatgaacactctctacagtaaagttcaacacatggggaccctccaaaggaataacagaaatataggtttaccaaagtttttttcttgttattttggtttgtttggtattttaaaacagtttaataggctcaggactgcaaccaaacgttaactcaggtgacaatatatggcaaagaaagacctcactggaaatggaaagttatttttaaagccatcacgtaaaaatgttctgccaagctagtaagggaaatgatttccttcatttgttttggcagtcaggatgccttttggttctgctccagagtttagcatcaacaaaaccccataaaattaagctatttgttctgcacaaaacatttttaaaggcagttaaacaacagggtataatgtgatttccaaaatctctgtaccaaaaaagatacaaaagcaaaaggttaaatacacatcatttcatcacaatacccctacaatataatttaatcattccgctgcacattaacaagccatttactattcttgcatatttcaacggagaaaaataaaataaagtataaattaaattacaaggtaatttttttctggactccctactgagtcacataattataccaggattaaggatctaacagcttattgttacaagacgttatgacactcagagatttaggagagtgcaaacaaactaacgaatatgaaataattttttaattgtctaaaaattagattatctttttatttaaagagtaaataaaacaattcagttaatataagtctatcttcatagaatatattttaagtgactaagcctctataattttatcttatattctcttcctatttctattattctaatgaaaagtgtttgcctatatttggggttttctttctgtatttacatctatgtgtggcaccagtgtccatcaatgtacatcttaattatagatcctataaatattattaaaaacaagaaaatatattttgaatagaacacattaaaatagtcttaatggtttataaatgataatctttaacctgacacacattatctgtcattatgtttatgcctttatacttaattataataactgtcattactcaagcagtttatgtgccagaattataatattttgaactatagacaaaatttgtattttaaaaagcttattctcctaagcatttgaactagaaaaatatgataactacacacaaacatttgtagcctgatgcatggccttttgtatggataaaatttactcaattggtataattaatgtgaaatgccatctgacatttatgtacaaattgtacataaatgcctttcttctactcgataaaaaattaaattctaaaatacaagaactttttacacctttgatacaataaagttgaataaatgagaaaggcataaatatttttataaacagaattatctaacagaactataatatatatagatatacaaattaagtaatgtaattttggctttttttttttgagacggagtttcactcttattgctcaggctggagtgcaatggcacaatctcggctcactgcaacctccacctcccaggttcaagtgattctcctgcctcagcctcccaactagctgggattacaggcacctgccaccacgccctgctaatttttttgtatttttagtagagatagggtttctccatgttggcaaggctggtcttgaactcctgacctcaggtgatctgcccgccttggtcccccaaagtggtggaattacaggcgtgagccaccgtgccgggcccaattttagctttaaattatagtagtgagaataattttagaaaaacaagctgaaatttagaaagataaaaactatagatcaaagtttctgaaactgaaagtttattaccaaatatgaaatattctatgagttccccaaaatatggcttaaatataaacattttcattttttattttttcatgaaatgaaaaaaagaaaataaaattttatacattaaacaagtattcatatcttccagagaataattttgacttattttttaggaagtcttagtaattttcaaatgtgtacagattgcaaggggctattcatacagaacatagacaggataatctgttacctgtggttgaatactggcgtcttctggggctctcagcccttattataagtaaacaaagggtgtacagttacatctaataccagtcggtggttcttctctactactgtcactagcaactaattgttctactagttcataactattactagggtaaaatgcagccatgcaaagggaataagagccaaggagaaagaaacacctcataacaaaagcagaactagcaaaactaatggcacactgaagaccaatatgggagacaggaagttgatctcaaagcaataacctggttctcagtgatggcttctaatacagatgtacctggttttaaattctaactgctacttactggcctcatggctctattctcattttccatccatttattcatcatgctgctgccaaagtaatcactaaactacaattctaattatttatgcccatattgagaatccaccagtgactcctgcattgcctagaagattccgtttcaacagcattgcagtcagtattcttcacgaactagtctgtggtttccatccttaacccttactgcataccctcttcccacccacatgtcgccaacccatctatttacttcagccgaaaacatcagtcattattctatactgctctaaaatttctgtccttcctacccctgctttctctgttctcactctcaatcaaaattctattattcaaagcccaatttaaagtatatctcctccaggaaccactcctccgaaactttcttagcattttatttgaacctttattgtctattcaaattgtgccacctatggcacatgtatatctatctatcttgtctactgtattataaatattttagggtaggcactgttttattcatttttgcttacttcatatccccatatatgtttctagaacttagttaagtaacacctaaaaatatgtaatacttctatccctcactttctatggtagcacattagaatcatctagcttcagttataacaatgaagatagtaaatattaaggcggtgcttactatgttccaggcactgttctgggcacttaataactcacctaatcttctcacaaaagctaagagaaagatactatggatatctgttcttacagttaagagaactgagaaacagagctgtggactaatttgcctggaatctctcatttaataagaggtagtgttcagatgggagccctaacaatgtggctatagaatccgtgttctttgctgttacactctggtctctgctctcttcaaaaagtcctctaatataattgaattaaaataagttaaaatgaaaactaaaattaacatgttggcttcaattgttaaacacaataaggaaacacaaatacataagatctagtgcttctttttggtaaatataaataaatatgatgaatatgaataactaaaaaagtttttctcatagaaaagagaaaatggcagaaaaatgctttcaacactttcaggtgcaatgtggaaaatcttaccatgcataatattcagaggaattttatttttggttaatactaattttagctgactaaacaatattatcacaaccactattttaaaatgccattataggctgggcacagtggctcacgcctgtaatcctagcactttgagagacctaggcaggtagattacctgaggtcaggagttcgagaccagcctggccaacatggtgaaactgtctccaccaaaattacaaaacaaaattagctgggtgtggtggcacacacttgtaggggccaaggcaggagaatcaattgaaccctagaggcagagggtgcagtgagccgagttcgtgccactgtactccagcctgggtgacagagtgagactctgtctaaaataaataaataaataaaacgctattagtattaagatgttttaaagtcacagggaatgttttttctatactttttttttcttcaaagaattgtttgaattacagctaacagaatagttgtgtaaatagtgggttggctgtaacaaaatagcaagatattttgtagttattatttttgtttttggatttccctaaatatatttttgatatagctaaaatattcaattttctatgaattgcttttttagctatttaaaacttaacaattttactgaatctatttaagtcttcttagacttaagttcaattaaattttaccagcaactgaagtttaaataactatgcattatgtagaaataaaatttaattctgcttaatgaaagctcctaaccagaaaatctagtcataacataataaaatatcattatctcttctggtcgcatcttgaaattacaagttataaataaattgcagggaatgggtgtgggaagaaacatatacatttattttcaaattatctattaatagattagatgttcttcctcaatataaaactatatttaataattgaatagtaagtgaaagaaaacttaatgaggactcttttaataaaagaaaaatgaacggcaatttaaacatgaatagccatgaatgccaatggttagagccccatcccaatttagagactttgaagcttataaacacttttttttaagagacaaatgcagatgtgggttgaatctatggtcaatcaagcgaaaaatgtctacgaggatgttttgtttttccctttccaagtattctatccatacaagatcctgatattgtcacattatgatcagaaagtctcagatgctttaattttttacttagacaatagttttctttagttcagcccaaggtctttttgcactaaaggacactagagaaagcaaaataaataaataaataaataaaacaaaaacacgttttttttcaatttcttaaaacgttaaatcagaatttgattgaaatcaaaattctcatctaagaagtcttacattatctggggattttagagacttttacatagagtaaaatgcaaaaactattctctttgaggaggtgggagattctcacattagataacgcaaatggagttactaaattggaagttttagagtgaagagtatgctttagcatcagcactgagttttgcaatttatagtgagggtttagggtctttaatgaatgttatatacgtgcaacagagcagaagttcattgggaaagagtatgatcacatggtctgggaaatgcagtgagttaaataatttagaaagcaaagccattatctaaaaacactaatacaatacaataagtttattaaattacagattcttatctatttcaaagttgtatggaaaaattattcttataagtgtgcatattcatataagttctggttattatttagaaaataattatttagtaccacatataggactggtatttccaagaccagcaaggatagttaataccccagcatttcacaaccctcatgcacattacaatcacctgggagagtttcaaaaagtaccactatttagtcctcacatcagtttagaggtagagcctaaacacagatattatttacacaatccttaggtgtttactaatgtgcagccaaggttgcaattactgccacactgtgaaacaggattcttaccctgtttgccagaggagaagtgggtaggtggtggataggtggcttgggatgtaagggtaagaagaagggagacaaaattaacctaaacgaaattcaacaataactagtctgaaagtggctgtgataataagcacagtaagatttgcaagaggccaggcgcagtggcccacgtctgtaatcccggcactttgggaggccgaggcgggtggatcacgaggtcaggagattgagaccatcccagctaacagggtgaaatcccgtctctactaaaaatacaaaaaattagccgggtgtggtggcgggtgcctgtagtcccagctactcaggggctgaggcagaagaatggcgtgaacccaggaggcggagcttgtagtgagccgagattgcaccactgcactccagcctgcgcgacagagccacactccgtctcaaaaaaaaaaaaaaaaaaaaaaaatttgcaagaaagcagacagtgaagagaacagatttactggtggaagatgttaggattagcaacagacacactttcactctttcattacatcttcaaagatgaacataacacaatgcctactcttagggacccatcttataagtaaactgacagccgaacagccaatgttaatacaatatgggaataaaaatcagatcttggaataaggaaggacaaggagaaccttctccaaatctaggttaaaagagaaagaaaatagattttaaaaaattggatatgtttgaaggttattccagggaaggggagttgtaaggatacagaggtatgaaaaagagaaatggtctgactagcaatgtgttactggtggacaagtagagattaggctaagaaggtagaggagagtaagtcatgaagaactatatttgctcagctcaaaaaatttagaatgctttctaaagtgaaaattatggatcaggagttaactggggcctgaaaaaagaattcagggaatgtcccaactcagaaatcagaaaaaaaaaaaagtcattattgcattaatcattaacttctaactgaaatttagcatttctatcagataatatataaatgtagaaggcaaactatagtagtagtagtagtatctgcggtttcattaccaagagaaaatatatttcaatgttactttagagttgttgcaattatctcaaaacatcattaacactcattattaattggaaatgtgggttattatgagtgagacctgttgctaggttttatcacttaatatgttaataaataaggtatgtgtcatcatatcataaattaccattttaatatcataatagctgtattaaaaatatttatagtttgataactttaatattttactttgtaattctacatatttactttatgcatttaaggatccctaggttttgccagactgccaaatgaatccatgtctcacaaggaaattaagcacccctagacaaactacatttgtggttgatttttatagacagaaaaagaagaaataataatgtagaaaagacagaaaataacccttaagaaaggtcaacaagctgggacccagagcatgggcttaaggagtgacatttcataaaaggagggagtactgacaatataacaaggaaggaggtgggaaacatcatgtggaaacaatagatttggtgatgggagggtgaggatcaacatgttcaatggctcccattttctaaatgaagttaaaattgaaggttatttatcttccctgaagagatcatcaggactaatccatcatgacgtaccgctgttgaccatagtcaccatgggaagtattgacccgacccacttccaggtcaacagtgaatacttggactcatacatcacatggctctgtaccacccccaatctgaccccacctttccaagacctcaaacccatctgtgaaatcctttggaatgtcatggacaaaatccctgcaacttcaatctttctctccccattttcctttaccttcttgctctggttaaaatcaggctgtcccttgagaacactgtttctctatcagatatggtggtggcttttttactctaaacccacatgtgaggaaaatattttcactgaccactctcgccttctcactaattttttcctctctaaattcacctactcaataaagatttaaaataataaaaccctagctgctttaaacttcatatggtcacaatcataccacctgctaccttcctccttgtcatctaccatcatccattgctactttctcctcattaattgaatatgttttcacctagcttactatccttctcttcacatagatgattcatcaaccatcacaattgcaagtcaatgcctgtccatctgtttcaatgacctcgtccttcaaatcagcctgaggtacatgctctgatgttactttaccagttctgcagtgtaactagtcaaaactggtcattgagccttgaaaaatggatagtgggcatttaattttgctatcttcttaaatatcacctccctagaaaatattttcttgaccaccctactctcctcaccaacctctactgtcttacctccactaagttgttttattttctttataacatgtatcatatctggcattataatattattttatttttccagtgtatttcctaattctatactcaatgtgttctgaaataattctagggttattaaaattatgatcaaataaagctaagaataattaaaaataatattatagttgctaagatagagaggtattggtgcagagctaaataaatgaatcaagggaagagtgttgaggaatgtggggattgagcagaacaacagagtaagtgtgagagagtgtgtgagttcattgggaattcatgcagtgatggaagtggaactctgtataaccacattggaaagctatttggcattatcttgacattaacatattctatcactggcaactctactcctgaatatatgtgccctggatgcttttccacatgcatgtctcagaagaagtttactaaaatgatcatagcaacatcgataaaatgaaatactggaaaccacccaaatgtcctttgacatggaatggataaataaattgtgctatattcatatgatggaacatattacacagaatacagagtaaataatagcttatacatactgctatgtgccaagcactgctcttggtgctttacataaattaattcataattaatttttatcttcaaagaggaataatatttatccttttacaaataaagaaatagggacacaaagggatttaggaacttgcccaatattatacatgcatagccaggatttaaacaccaaaatcccagttgagtgctcccaattcactatggtacttctacagcaaataaggcatgggtacaggtacataattaaatataagaaatcatattaaataaaagaaaacaaaacaaaaggcaatcccggaagaatgcaacacaccatcgtatatgatttttacatagcccaaaagtagtgacactacataatatactgtgtaggaaaacagtatatacagaatatatactgtatgggaaaatatataataaaataatttttaaaaatgaaaacaagaaagggtagtaggtagtaattgctcctgggcagcagggtgcatgtggagggaaatagggagaagacgaaggtagctgcccctgcaatgggattggtgatattcagatgttgggagctgggttcagaagtatttattttattatatgttctaatgaatgtatgttatgtatatccttttctgtatgaaatgttatgttttaaaagatactaaagaaataaatagaaagtgagaaagtgaaaaaataaaaggctttggctacattttcaaggtgtttgatctgaaggaaagatgtatcaccgggtagatccatggttaatggtgtgtgtgtgtgtgtcttttctgttttttaagagagtgtctcactgtgctgcccaggctgatcttaaactcctgggctcaagcaatcctcctgcctcagccttcagagtagctgggactacaggcatgtatcatatgtttgtcttcatttagagggtctgaatcttgtttatagataggtaagctaaattaagtgtggagacttttcctgattatcatgactgtggagagggtgctactggcattttgtaggtacaagccaggaatgcagctaaacatcctgcaatgaacatggcactcccatccttaactatgcattatccaagatgtcagcagtaccaagtttgagaagctcagagatagagaaagcacaacgggagagatttaaaaaaaatgttatatcaggaaaaaattgagacagtaaagtccagacaagacaggaggagagctgggccccaaagcagacatattacatcttcagagcctggtgagcaccgaagaactgaccattttcttaagctcactcttttaagcagaatgtcataaagtagaccttactcctactccgctgctactaaaagcagcctcagagggcatattgagaatttattgcttatcattctgaagaaacgggaagaacaagtacaaaataagaaatgcaggtggggctgatgttacatcagagctaatgaagcataacaagcctcaggactccttcctggcacctgcccagactggtacctgcccagactggcacctgagaggagtctttgcaattttgaaatttttaaagtttgtgttaattatattagttaaaagtctcccactcccccaagttgtatacattttgggctcagcaaaataaggatttaccctggagtatggggtactcaaataggttttatagctactttccttgacatcctggctagatggcaccctgaagctcaatggccacatatcactctatttagttccctaagatgcagttcataaagcctcatcactctccgggtctcctacccttatatagttttcacaggtcatttcctcattgaaagcccagcttcctagttttaaagtgctgagggtataattaggccaaaacagtacatgagagtgagtaggtgattcaatttcccctgctctgaaggggaatcacattacaatgagaagctgctatctcttggtcttatggtccacataggaaacaacagctcaggaaaattgttattaaattttgtgtacatgagtcacctatttgttataaacgtggattccagggaaccactccataagagtcacataatattttggtccaaggatgataatttgagaactaattcttcaatgaaaaggttgttaattttctgaaatgacagatcttttataggttattctaatattcacatattaacaattttaatatggggatcaatctatgacagccttgtttatgatccctagattagatactccttcacagaaaatcagagtaagtagatggtatcagagagagagagagagaagaaaaagagagagaagaaaaagaaagagatagtggcaaagccagttaggattgaagctggaaagagatcaaccaagaagtgagagaaaaacccattgaatttgactggcaggaggtcgtgtgtgtgtgtgtgtgtgtgtgtgtgtgtgtgtattttatatatatggagagagaggaagagtgaaagagagcaattagtatacatatgtttgaagtcaaaagagaactacatagaaaataaagacattagaaagaaaggaaagatagggtgaaatgcaatatttgcttctactttaacctgtaatcatgaaaatgatagaaaaaggattaaaaagacataatccaaaaaggataagtaaaactggagtgtagatgccaaagaaatatcagcaacattttaaaaactctaaaacatatgggcaagtgttggcactttgcacgctaggaaaagcggaaatctaactgcttgcaaggtgacaggagccaatatgcaagctgattcataaaaaagactccagaaattcttggaaattagaagcctagagagtgagaagaggggtgggtgtggatgaaatcagaagtgtttcaaagtatgcataataagcagtaatgccagacaataaagggggaacaatctgacttagaggagtcccaggaagaaagtgaagaggagaatgaagagaagaaaagatacaacagaaataatgagcattctctagagctgaaggccatggggtccctggtagaaagttccactgtgtctcagtgcaaggggtataaaaagagagatgctaagagaaacaggagaaggttttaaaacacagagattaattaaagaagggattccaaacacatgggtgagagacaggttacaaccaaaactttgaaattagaaagaatcagacttctcagcagctctactagaagtttggaaacaatggagcggtatcctcaaaattctgaagcaagtggtttcaacctagaattttatatccatctatcagtaatgtgtgaagttggaataatacaattttcaaacatgcaagactcaacactggactctgtatccttcttccagaagctaggagaggatatgcttccgcaacatggcagactataggtggtgggcctgagaaactgaagttctatataagtcaggggctgagagaatgctccaggtgatggtgaagctaagctccagccagacaagtggagcatggaggataccttcaattaaaaaccaaaacattgtaaactgatgaaaactggtaaattgtactacattgagaggagtataaaaacttttgtagagaggctggcgaaaaattagtgaaactaatacaaaaatcttatcaaatggaaaaaatggggtaatgtttaatttcaagaggaacaagaaaattgtagaagtaaaggaaagaaggaaggaaacaagggcagaagaaagggagggaaaagtgtgataaaattccagcatgtggctcagtggtgaatactatcttcctaataggtaaagacactggtatttaaccaaaagttttggtataattattttgggaagatggagggcaagtgattggagggttgctgatgaagtatggtacacagaatattttaactgtggtattgcaaaagaaggatgctaaaattctcatcttccttaaagatgtatttcttaacagatattgcctaaaatgaaacatatcaataaacagtatgcaaatgttattttgaaatatgtagggaagaaccagaagaaacaacaagaagtttaaaattattacctctagggatagggaactggcagaaaccaaggaatgatgctttgtcataattaaaaaaaaaatgactttagaaaatatggacatggctcataaacataaaaatcaattataaagaaagtgtattacataatacatgcacttatgccaaaaatattgtgttctaaatatttatgtatgttttgtgtaagatttatatgagtctaagaaaatttggctcaattatttgtataattatagactataattacagattatttttctcttttccaaaagatgttggtagtttcttgttttaaatgtataagttactccacccaccaagttaaaggagcatccacctgaagtagtgatattaccaacagaactatatgaggtagttatatcgaggccacatatttaacatttcttcaagcttgcgctttggaataataaagcccagaggaactggtggtgattcatcatgctccaaacctaggtctcaggacattgggtgtggtgacaagggccaccatgcaagaggaatgtcaaatgcaccaggcaagagtgtctggaaatccaggtatcagtgttgtactagaaaagttcatacaacatgatttagaaatcatttcctcaaaatgatttcagttttaactaatattttatttaaaaagtaatcactcaaaattttaaagtggtcaatacaattaaaaaaaagacaagtaacattcttgaaatttccccccttttctatctctactgaaatgcagtttgatatttctatacctctttatagccgtcactgattctctccaagctgagggaatatacaaggtccctgcctcccacgaagagcctctcttgatattcatccagcagcattgtatggagatcaagaaatccaaaagggctatgaaatattgatgttctgttcagattcaagagctctgaaatgcaaagtgatacatacactaagcacacgagaaaatgtaaatacctttatcacccttttctcatagctctgttttcatccctattggaactgagtcattaacattcattttatcatacatatactggcaaagaattttaatgtgcacaagttaaaatatttcataaatttatgaatctaaaaacttcaacaatttaatatgtaagaaaaatattctatatttttaaacacagaaaaatagtcatccttcacaatctttaacataaagtgctaggtgaaagtcattttacagctcctctaatgtataatggttccaaatctacattaaacccaccagagtgtgtttattaaattccagataaatgccactcagaaaaataatgtttctacttgaaattggttttgatagtcacatccaaaatcaaattttcccagtctgcaaactctcagtgtcatcaatacaatgaggcattaatgtggtaacagttacagtagggatcactgataaaactggtgggaatatattttcaatcattgcaatttttgctaatactcttgcattcgtgcctatgccagaaatgttgagctatgttttacctatatacatgtaagaagtcagaatctggcaaacctctcatgtgtgtgcatttgtttgttgaacgtatttaattgcatatggcagtttagtacttaaggttggtaaaacgatatatgagagcctttggtgatgagagagaataaaaaccccaggcctagactctggatgctaaagaattcctgaagaggccctttggcaaatgctgacaagttagaagataactttttttacaaagatcaatgcctaatgcatctaacagagaatgtgaattcttagtgacgaggactctaaaatctaaacaaatgataatataaagtaggacaaatctacagcactgtgcccactcttacactttttgtttctgagaaagaagagctgaagtatatgcctctgtattaataatatattccttatctatgtctctaccctcaaactgttgatgcccaaaactttgtggagttaactttaaatctttagtttaaaatgaacaatactgctaaaagtatctgttcctctgtattaataatatattccttatctatatctctaccctcaaactgttgatgcccaaaactttgtggagttaaatttaaatcttttaaaatgaacaatactgctaaaatcaatgtatcccttataaaggtaaaactttctcttattgagttagctttgagatattgagtcttttgactattcacctaaataaataatctgagaataagttttgagggtggggaaaaaaggaataataggtataacacataagaggtttgccagattctgacattttaaaattaaatatgtataggtaaaacatatagcttgaaacttctgacataggcatgaatgaagagtattagcaaaaatttcaatggtagaaaatctattccctaatattccttcttttcccaccctcaaaacttacttgggaaggaaaagaaaatagtatgaaaaattagaggttcttgaatcctggaagacaatttttttccatttaataaaaagtagaatcatactgctttcctttgcatacagcaagagaagcacaggttgggatccactagcataacaaaaatatagctcaaaactgtctgctatcattataatttgtctttatacataagcatttacgtttatatcagggctgccaagtggatttttagaaaagttttctcagttattccaatagtttgcaacatttctcagttttaatgcacagtgaaataatctgaatgtgtacaactgatgaaaggatggttacgcactagcttgaataggttcctagactacagagctacccaaaacactccggtgtagagcttaggggactaagttgggaaataagagaaagtcatgaaaggattcaattatgagggattttagtaagaggcagcccatccagtaaaggaggtactccatgagtgaatccatctagggatgaccttgcctgctacccagtgaggtgattaatacctcattatccctgcacgcacatggcaagatagacaccaacttttacttgcttttatgacttaccaatttgcctactttctaagtatattacagttctaatagtctaaagatagtagttcttatttctttgtaaataatagtagaaactaattattgaatcatcaatcttattttattctggtgtatcaccttctcttgtaacctattcttcctctctatggccaaatctatcctatgaaatcacaaagatgtgcacgtttctgtgggtacatactttggagaaagcagagggaaagaacggaagtgtgcatacaacaaatgcaaatttagtgaatcttcatttttaatgatctttatgtttatttatatatatatgtacacacacacacacacatatacttttacaaaacagcaaacaaccactgtgtgacagtttaaattaccaatgtattttattttactggagaaacctgggtgctcaaaaatttaatgactatcttatggtcatacactattacaatgaaaatcactcaatttacctctaaaaacatgagaattaaagtataacaggtgcgtatattataaccaaaggtctttgtagactgagaatctggaaggccaggttttagtcttggctttgacaataattgcgtaggtaaacttgaacaacctcttaacctctttagactggattcttcacctgttaatcaccctttcacctttaaaattcttaattatttgactaaattgcatttttaaaatgaagctgataaaacagtgcaaaaaaagaagcaaatcgacacttagatgttttatggagtcctttaaagtacagtgctgagcttttatttttgtttttcatactgttggaagcttatcaaagggagggagtggtgaatagcaagtctaactatcacatgtcccatgtttaagcttgcctaaagtgaagtagctagaaaattcatttacaacttttgctctgactctaaatgattataatgtcagtgaaaaaaaatataataaggaatttcagagattacttttcctgattcattcatattgcctcagagaaaattattgccaaaatatgtctggatacataaaactgaatatcattacataccataggtaataaattgagaaatatcattttatttatgaagatacttcttagaaacatttctaaggtcattttttaaatttataaacctaataaacagactatagttttctttaaacatttcataatataaaaaaagaaaaatgcattgaatgcttcggctactctctaccctgaccaatgccattcaacaaaacagtgacaacaattgaattcctaagacattaagacttgtcagtaggtagacattattttaaaatcatagcactaactagagtttatgaatgccatggtttatatttttcatgtctactttcactggcataaatcctatcttgatccttaattttctctaaggcctggactgcttttcctaactggttacaattttgtaacatccttgactttattcaagaaaggttagaagtatccattataggtgaatatttgtgctttagacatatatctgcaataatggacatggagccattctaaaatagaaactatttttgaaaagatgtgaatgtttattatatatttactcttatttattcaatattaactcaatttttctactttatttgattaatttgcctctttccaaaaaggatctgagatgacttatacaaatatatccgatcaaataaacaaatatatttctagggagtaagggtaagagaaaaacagttaagatgagtgggttgtaataaatttaactggaagtcatccgctaatatctgttacattattaaaatgaatcccaaatttgacctcagccttcccaaaatccaaagtagaggaagtcattgtaacacaagaaaaaaaaaactgtatcaattgcttaggagcattatctagtattaagaactaagagaaatttcttctaaggttttaataggtataccgaaaaatactatggtggacattcaacatcactaagaattaaggtgtaaagttctacacctgtgcttataactacatcccttaataaaagacaactaaactaacatcaaaattcactccaccaaaagtcactttatggccttaggtagccatgttatttggaatattaatgactgcaatgaacagagattaaattaaagtaatgtaaaggtgaggacagaaatcctggcttcatggtaatcggaaaacaaacagaagccaaggtaatttatctcttagaagatgctgcatctttgcttcttgcttctcttaatgccaccgcttcactgtactgattctaaagggcttattatttagtttgttcatggccaaatatgtctgttagctcccaattatatataaatttccagctcccacatcaccacagtgtgacaatagctcctgcatttcccaattcaaattctcaagggaaataatgaaattgtgtcagctagtgttcataattcatagattgctggcttcatctagattgaatgtgttgtgaacaattatccatctgcggttaaaatgtggaagccacatggtaaaaagggtggtttctataattaatgtgtatggggtcagagcagtcaacatgaagcatgtttcaattccatagcaaacttagccagtctgtctttatccatgaacaaatttataataccataaatttgttacaatctgtatttctgctagactaaataagttggcctgctgtcgatagcttttcatgattatataatcatgtttagatgttcatgatgtttagatgttcattcatatatagatgtttatgattatataattatattgcatgttggagagtatctgccaaatatgaaaatttgagtcttcattaattgatcttaagtcatttttcccgataataactggattgtgaaagtgactcacatgactggataataaatttcatatctgcatagagaagaatgcttctatttccaatctattttataatgagattttcatctatctcatccataagaaattcatagaaattgcagtatgctttatttgtaaaaagagcattataaacataaaacaattaatgagatcaaagcagtaaactttgataaatcatggaattctgaagtttaagaaagaagcagaaacataattattaggggaaacatggggaaaaacatacatatagcacgtatggaaacaaattgtttttaatatgttcttttaatatgttgaaaaaaactattttaaagaagtaaaaatatcaacactgttctgtgaataggacatcaaagacgcaaaaagtgaatttgcataaaaagaattcaacttcattaaatgttcaaaggaatgaggataaaatatcattttaagaggtatttttaaaaattacaataactagtgaaaataagaattcaggctcttctagagacctatgtaaaatttctatattacacaaattttctccagtgaacatgtgttactttatcaaaaatgaaattatataagtaaaaggggaagatgtacgagacgtctcattttttatgcaaccaaatttcctcctatatccaggtactggtcctccccaccctaactctcaaggtgataataacagttaataaatatttattgagcagttacatggcatgtactatctaagggctagacaattttatgtcatgtaatcattgtgacatctcctcagaaatactattatccccattttctgtatgcaaaaagagaatttattagagattcagtacagagctaaggttatttggtcagtgttggtgacaaaatttgaacgacagaagttgactggagagctttgttacaatgcactgagatttctaaatattattttaaaaataccctagtaattaaaagtctagtctattaagggattataatgtgtcagaaatgaatgcattttttgcagagcctgatataaataataagatagaaggttttcaaaatatttaataggttgtattgagataattcaaaattatttaatggcaacaagataaatagaaaaattcaggttaatatcaattcaactttaatcacctttattgtgtattttataaactatccgaaataattacaaattttttttgctttgacttattgattcatgacatttttagttttacatatctcatatttgagaaaactgaaatatttctatctaatttgctatggagtttcaaaatgtattgaatattttttgcatatactgaaggcaatataaaggcaagcaaggctttcttccctccttaagaatttttcctttcttagttttagagtcactcctttaagtcatattaattatctgaactccaaatcatggtccctggacttggcatatttaccaagtaatggctgactcctttaaatcccttcatgctgcttcaagctgcctggatgaaagaaacagaaaatatacaggaagatggggacagaagaaactctaatctcaggtaatctcaagaaaacacagtgaaataatggacagtgctgactccgttaaatgaagcaagctcatcttgagttcctcctactctaaaaataacatgaattgcttggggatggaatggacaaagaaataagatgaaactgaaatgcaccaactcagagttcatccggaaattttctaaagagggaactaattattattgctaagctgcatgctagttatcagctgtcaatgaagatatactctgaggatttagtcatttcctctcgtggcctttccttttaacctgcaagagacacagttttaaaactcactgacatcactatattacaaagacagttctctacactttgtcaaaatatatttaaatgctatagttccttgtgtacgatgaaggagaggagaacacacatttttcagctctcaaacaaaaatagatttcaggggagaggtgtttctttcttgaatgcacatttcttgttccaccgtcacctgccaagtaaagacttcctaagactcaagactttaactaaacttgtcatggttttctgagttaattacgttattcaatattgtcctaaggttaattcaacaaaaaaaattgaatttcagtcagtaagcattgttaatgaaaatgaaatatggaaatagccattagaaattttctttaactttgtaatggttcaaaaggaaaaggtttctcacaacatgctttgatgattttgacagatttgactgatgatcactagtggcttatgatgttgaaacagattcgtaaagaaataagcaattaactttttaaaaactataaacacagactagctcattgatttgctaattgctctttttagcaatggacaatcagcttgtctttcatgcagtctttgaacttttaggttctattattttcacaagtcaaaggtgtacaataggcattgttgtactaaaagttgctcagtcataaaccactttccaaagaaagcaggagttcagatatacataggaatagcctagacattaattctccagttaaaagaaaataatataatttataattttcagattccttgtgttcttatcatatgtaaattattatttaatgttatatggaaaagtaaatatgtaagtgaagatgtatttaatgattaagatgaagacattcatgataaactacttctacttaataaatagtaaatatattttctcttatggttttcttaacattttcttttctttagcttatttgattgtaacaatacagtatataatacatataaaaatatgtgttactcaactgtttatgttatcagtaaggtttctggtcaacagtaggctattagtaatgttttcggggattcaaaggttatatatactccagctttagactgcactggggtttagcatccctaactcccaagttgttcaagcatcagctgtatattgaacatccactgtgttaggaattatatctggagtttcagaggaatactaaagatcaatataattctataaatataacacaaatccgattttagtatccattttatttatgaaatttagagataatttttttcaaacttgtgtacttaataaaatcaggcacattcacttttttttttttgaaacagagtcactctgttgcccccgctggagtgcagtggtgcgatctcggctcactgcagcctccacctcctgggttcaagcgattctcttgcctcaggcccctgagtagctgggattacaggtatgtgccactatgccctgcaaatttttgtattttttagtagagacggggtctcaccatgttggccaggctggtctcaaactcctgacctcaaattatctgcccaccttggcctcccaaagtcgtgggattacaggtgtgagccactgtgcccagccttttataagagaataaattttatggttcaaaagccaaaagatataaaggtttagagtgataaagataaacttccttccatctggactttccctctatttagttcttacttctttgccctcaatggattaatcctgtctaaaatcttgggcattccttcaagttttttatgcatatgcaacaaattagatgtataaatctttattaattctcaacttttttacagtcaaaaggaatcataatataaacctttttctttacctttcttttcttcactcaaaatatcttagaagtatttctgtatcaaaacttagagaggttatagttgcaaataacattttgttgtatggatcacctgcggtgggcatttgaaatcttttaaatttttactactaatacagcactgcaatgtatatatatgaatatatgtccattcacagatgtgcaaatatattggtaagataaattttaaagtggaattaccgggtcaaaagcatttgtaattttaacaaatactgccaactttgcttccatagggattatatcactttaaaattccctgactatatgcaagagtgcctgtatccccataacctcataaaccatatgtaattaaagtttagggtgttttgctaatttgatggagaaaatatagtttgaatttctcttattataaggtgaggttaagcatctttcatatatcttagggtacttttgtgattgttcttactacattcattgtctatttttctgttggattaaagttgcttgcccatatttgaatttaaggaatttttaaactgttaagttttaagttttgaaggtcatggctgagagatgaaggaaactgggcctttaaatgtagaaattcgtgtatcacttatgttggaaagatattttaaaggtgttttattttaaaaaatagagttaattccctttttatctcatgcagcctcctctttcataaacttaattcttgattatctggagtaattaaccaatttaacaattaacagcttatataaaatgcttataattttaaatacacatatgcacatatacgcgcatgcacacacacacaatgttactcatcagaagtgggcaaggggcattctcagtcttccagaggctgaatttggacatcaacaaagtcctatgcactcctattcaactggcgaattatgtggggataagaaatgtgtggctttacccaaaatagagcacttatttgtgagaattccagaattttgactaatgaatattttataataagatgttatagatattcagtcaaagcagaagttaaggaagccaagaatatatatgaactactgtggtatttttctgcaacattagccacttaaaacttacttaaaagaggccgggcgtggcggctcgcacctgtaatcccaatactttgggaggccaaggcgggtggatcacaaggtcaggagttcaagaccagtctggccaatacagtgaaaccccatctctactaaaaatacaaaaattagccagggatcgtggcaggcacctgcagtcccagctactagggaggctgaggcaggagaattgcttgaacccgagaggtggaggttgcagtgagctgagatcaggccactacactgcagcctgggcgacagagcgagactccgtctcaaaaaaacaaaaaacaaaacaacaaaaaaacttacttaaaggaggggagagaatgaaaacagatttctaggaatcctaccaaatgctttcagtagtacaatagcccatattttataggtatgatcatcatctatacatctatctaactttcttcctttttttttttttttttttgagataaagtttagctcttgttgcccagactggagtgcaatggcatgatctcggctcactgcaacctccgcctcccaggttcaagcgattctcctgcctcagcctcccaagtagctgggattataggcatacgccaccatacccggctgatgtttgtatttggtagagatggggtttcaccatgttggtcaggctggtctcgaactcctaacctcaagtgatccacctgcctcgccctcccaaagtcctgggagtacaggcatgagccaccatgcccggcctcttcctttcaaaatactttcatgtattctatgaaattgtctgtggtaacaaagctttgattttatttaggtacttattttttaatgttaagcatgtttagataggattcattttacagcaatattttaaaagtcagcttttctggattatgccattttacagagaattagctcttatacaatatttaaaacttaataagatactattattttatacatttacatcatattctttcttaggattaggtctgaaataaatggatgatatctggttacttcatcattaattcacattaaaatacatatttaacaatttttatttcattcgttcaatctgcaccaccataaaacaaaatgcattttgctagatgccttctgatttatgaacaaagttagctaatgtgtacaaaagtgtaatgttataattacatattatttaaatcataaatacatttcggttttatctcaactcaaaaatatcctgttatagaactaatgtattctctacgatctgtatttttaactgaagtcatgctaagaagttgaataggtctatcatctacttttttttgttctttttgagatggagtctttctctgtcacccatgctggagtgcagtggcacgatcttggcttactgcaacctccacctcccgggttcaagcaatttttgtgcctcagcctcccaagtagctgtgattacaggtggatgccaccacacccagctaatttttgtatttttagcagaaacagggtattattgccaggctggtctattatctacttcttcgtctgatcattttaatgacaggtctaatgtaacttgttaatacatatataactttttatgtttttgttgaaattgtatacttttctctagcaaaaactttattgatctttggcctataacatgttttctctagttaataatccatcttataacaacaaagaagcaaattaactaaaactggaatcacattttttcttcatatactgaattgaatatttgataatttaagtttttcaaatatgactcccaaatttttgtcttctatcttgacccccaaatccatacttgagcagccaagtcctaatagctatcttctcttagagtctaaaagtcttctgaaatttagcaaattaacaatatggtcttgattaccagagacaaaccaactcctttcccaggcttccactcagtaaatggttctttggctcttggcaaaaacctagaatttgtcctgattcttctttcttgagtgccacactatctatccttagcatctcctctaccacctctcatctggaccactgaatgttcttcctattattctgtcttctatgctccgtgcctccctcgaccaccaccaatcagttcacctcacagtagccagagtgatcatttctttccttaaaaatataaattgggctgtgatgttcctaccgttgtttcccaactcctttagattaaaatctggctcaaagtctgtcattacctcttggttgcctacctcagccctggtgttgctccactttctccttttctcacagagctctagggcttgggctttagagtttggcctggactctccttctgtctgccacccacctccttctgacctccatgctgttggctcctcctctcatctggatcttcactctgtcttcccagtcttaagaaataagccctcccagtcttaagaaataaataagccttcccagtgttaagaaatctaaagattccaaccaggcattctaagttgcaccattatcttttcatatcctgtattgcatgaatgctactaggttttgtgttttttaaaatttgtttggttggtttttcttatatatgttttctctcttctgacaaggaacatgttccataagaaattgtaagcctttccatcttggtcactatgatatccccaggacctagaccagttcctatggtttatttcgtaagcactagataacaatatgttaaatgaatgaacttttctgtgtctcactgtcctcattgtgaaatagggataataataactaactggtaggactgccgtaagaatcaaatgattcatagtacctaatggacagcaaatatatatgagtttctttctctctcttttttttttttttgatgtcaataagttatgggtcaagggcagtgaatgcaaatttcccttgttgaaatagggctttcttaattacgttctgtcaagtgggcatagttactctcagggctcataatataggctcaaaatgaaataggaaatttcacaattacatgattactgtgatcagtgtaaacagctactgcgtatttttagggaaaaacctcaattttctaccaatagtaatttgagtcaattttatatttcttctttttatccattcccatctcagattgcaacagaaaatttgtctttatttcctaggaagtttgtttttttctttatttattaatttataagctcagcctgaaataaactatacaaagcatctctagtttacccttgaaatttgaattctaagtgccaaactggcaggcaaaaattatttaaatattttattcttactattactattaaagtttaaatttctaggagttttctagtacagtcatttgtcatttaatgatgggaatacattctgagtaatacataattaaggaatttcatttttgtgcaaacatcatggagtgtacttacaccaacctagatggtatagcctactgcaaacctaggctatatatggcctatgtatcctaggctacaaacctgttcagcatgttactgtgatgaaaactataagcaattgtaatttgataagtatttgtgtatttgaatatatctaaacacagaaaaggtaaaataaaaatactgcattataatcttatgagaccaccctcatataagttgtctgccactgacctaaatgttgctacgtggcacaagactgtacttaatttggtggctgacttgtaaggacagaaacagaattgtcaattttcctacagatgtatggttgaagtgatgttacaggatcacagcaaaatagcctctacattttccccacttgacctctaataaagaccgtcagtcttatctttataaaaataaggccttccctcaactcacaaatttaatcctataaaatattctaaaaacacacggtttccagatacaccaggagtttgcaatctgacatctgaaatggttgcacctttaaaaatctgtagttttcagactgacatattaccaaagcaatgactattgtataatttgaatactttatcaatatcacatttttctcataattactaaaatgatagaataataactgaatttcaaatccaggcagaatgaagtgcaactttataatcttttatatcctgttaatttcatagaaattgaacctactcatctacattataataacaaagaaaataacactgttggtagatgctatgtggatgtagagatgaggctgtgtgttatttaccattacttcataggtttggaactgtcagacaatcaccaaaatcttatttgctgttaaattacgtgcctcaattactgtagtggctacaatgtgagctggatgcttcttactaggtaataggccccctgggtacgtgggttctctttagatgtggctaagagaaacatgaagacagaagacaaaccaatgctgtgtgtacagttcactgatgactttctttcacaaaaagttgccttagtgactaagctgctaaccaaattcttcttctgttttccttttctggcaattatcagttagtattgatttactatccagaaatccctgttgtttataacctgtcgtgaggcaaatagtacctaagaagaccacccatgttttctctggaagctatgaagggagggcaactcacattcacagaaaggctcttatgtgttaggtactgtgtgaaatatccaatatacataatttcacttacccttcactccaccagtaggtgcatatggcttctattttacaaattagaaaaacagaagctcaccgagaaagttaaaaaacttcctattgtcacttatcatttgaatattgacatttctggatcttattcattttgcttattacaagttacaataacaaaagaagttgtataaattatatagtggtttcttcatggattaagattagtcataagttttcagtaataggcattacagatatttcccatattttatgcacatatcaaataatatttacttttaataaaaggtcatagataacctttgggggtatacatttttaaaattgtatttcagccttttttcataaaacctgattttcagcctcaatcatccaaaattctatctcattgcagcttatgttacaaacccaatcaaaacaaataaatgaataaaaattaacacagaggatcagacaatataaagatcagaagcaaataaaattaatttaaaaatctaagtctattaacctcaaacaaataaaaggagatcatatccctaaaaataaaaggtaattaaaagaaatcaagatacctgttttgttcccaaaattaccactgaatataccatttataggaaaactattttttaaatttaaacttccccatttgtggaagtataggagtggatgggatgagcaccaaggtttctctcacttcataaactattgtcatctctagttgggaaaagaataaactgaaattgtccagaggatgctttctagaaattttttatttgttaatttttggaaaccataagaattacagaattagttctatcattatggaaagataagaatttatgctgaagatacaattatatatatttgtggccgggcacagtggctcatgcctgtaatcccagcactttgggatgccaaggggggcagatcacaaggtcaggagatcgagaacatcctggctaacatggtgaaacctcgtctctattaaaaatacaaaaaattagccgggtgtggtgccacatgcctgcagtcccagctactcgggaggctgaggcaggagaatggcgtgaacctgggaagcggagcttgcaatgagctgagatggcaccactgcactccagcctgggcaacagtgctagactccgtctccaaaaaaaaaaaaaaaaaatatatatatatatatatatatttgctcagttcttgtgaagctgtcagaaaaaaagtatattgccttgggtacaaaaaaagtaaccaatttattcttattgatctgttttcctgtaatttttgataggcttcaaacataagtggcaagcactgttcacaatagctaattttggaagcaacctaagcttccatcaacagatgcatggataaagaaaacgtatagcgcatatacacaatacagtattattcagacttaaaaaataataagatccagtcatttgcaacaatatggatggaactagagatcattacgttaaatgaaataagccaggcacaggaagtcaaatatcacatctcacttatttgtgggatctaaaaatcaaaataattgatctgagggacatagcagaaggatagttcccagaggctggaaaagggaatcgggggcttatggtgtggatgtgaggatggttaatggataaaaaaaaatagaataaataagatctagtatttgatagcacagcatggttaaaaaaacataaggggcaagaaatatattgataattgtatacctgtatcacacactttttaagaaaatgagaaaatataacttaggtcatgctaaaattagaagaactgaaagatttacaaaacccatataaatcataatgtaatctcctatgccaaaacattattactcagaaaacaagtaagttggcaaatgtgaacacctttccacacacactgagaacaagagaatggatgataatttttttaaagtatggaaaacttggaagacacttttatacgataagttaaaatgtctattatagaactcactgggtaaacttcaaggtataaaattagttctagacgagcaatttattagtagagcaagtttcaagaatgaaactgaagttgtgtcacaaaattgaagatcaggttcttacattctatattttattttagactgccaatcatctcctttgagaatcaactaaatttctgagaatatcattcctgccagctggaggcaagagcaaaattcattaccatgtagctgccctatccctagaccccaactttatcagaacagatgctagtgcccaggtaactggccatccatcatctagtcaaatatgatctttaaaatagttggatcctctggcaaggtcactacccctatctggaaggaaaaaatccatgtaaaattgagaacaggaggtcaattttctttttctgccatgattaagaagagggagcctccaccactggaagggagcaaatgcattaacctccctgactggcaggtacccattaaagtgatgatataattcttcacagtgcttgcagtgaatgactgctgggatttatcacttcaaaacagaactctgtgtgtgtgtgtgtgtgtgtgtgtgtgtgtgtgtgtgtgtgtgtgtgtgaaagggagagacagacagagatggagacagagagacacaaagagacagagacaaatgaagaacctgaatgttgggagagcagcaagcaggggcaagcaggtggtggaaaaacttttacttcaacaataattctttcactttgcaatagggaaaagaaacatgacaattaaaactgatgcaggccaggtcgcggtggctcacacgtgtaatcccagcattttagaaggccaaggtgggaggatcatttgagcccaggagttccagaccagcttgggcaacatagtgagacctcatctcatctctccaaaaaaaataaaaaataaaaaaaatgccaggcatggtggtgtgcacctgtggtcctggctacttgggaggctgaggtgggaggatagtttaaacctgcaaggttgaggctgcagtgagcatggccacaccactgcactccagcctgggtgacaaagcaaaaccctgtctcacaaaaaacaaaaaactgatgcaaataatatcaagaaatgagcatatcagttatagttcatagtactaaaaataatataaattaacagatatgatattgaggcatttaaaactatcaagtctcagcctgcttttgtaaaacttgtcaattacagccctcagagagcctccttattttccttgtaaagattaaaacaatattattatacctgaattgttaaatgccttcaaactgctaaaatctttttagtgtgaacattcctgaatataaaaatattaactaaatgattgattgatgacataattttctttttctttttttttttttttgaagatggagttttgcttttgttgcccaggctggagtgcaatggtgcgatctcaactcactgcaacctctgcctcctgggttcaagtgattctcctgcctcagcctcccgagtagctgggattacaggcgtgcgccaccacacccggctaattttgtgtttttagtagagacagagtttctccatgttggtcaggctggtctcgaactcccaacctcaggtgatctgcccacctcggcctcccaaagtgctaggattacaggcgtgagccactgcgcctggcttataattttatttttcaaaggcaaaattactggcagaagttgtaactccttctataaaatcaattatatttgcaatatttatacttcatatctttaatattcaatgacatagcatagtacatctgacattttaaattatattttattataaattatctatggggaatttaggttgtaggatgacaagtatttagcacatttctcttagtaaataaagataaattttatgcacagtggcaaattgccatgggtaaaataataattaatttccaatgtaattgactaccctactatatgaccaaaaagactccttatgtccaccaaaaagacaaaaacatactttttgatctgataatagcaaattcgttaagtacattataaacagaagcttaatgttttcagtagggtttaatctaatgggcaagtttgcacacctggtgtaatttgaagggggaacatgtaaagggccccttgagcccaattatttaatcctcccctagttactcgtgtcattaaagttttacaacttttatatttttgactttcaagagactctattaaaattttgggacccctgggatgtattatacttaaacctttattaactaaaaactttgctttgtcttaacacttgaactagatctagcataaatataacactagataaacctaggagagggatgattttcaagggagaaaatgaggataatattaggtgagggctacgtgtttaggggtagggggaaaacatgaaggttgatccaaatgcagttttcatagtgttgccctgaagggccctggcacacagatttgctattttgctgcaataaggaggccagagccaattacactgttcacttctgtctcagtttcctggaggcaacgagacacactctgtgacatatgagggtatgtcccaaaagtctaggtaatttggtcaaaaatttaccttacccttccccatgacagaaaacaaaacaaaacaaaacaaaaacaaacaaaaaaaccaacttatatctatggtaaattcagtgttcagtgtgggggattttcttcatttccaattttgactctgcttccgtatcttctagattctctacctgggttgcacattggaatctcctggaagctcttaaaatgttgatgcctgggacccttgccaagagagtatggcctatttgatctgtcactggaattttaaaaaaatttccccaggtaattctaatgtgacaaagattgagaacttctgctgtagaatgtttctgctaatgctcagctattagataaggtacatacatagtatttacttagtccctgggttcacaagcttgtagatcagtcacaaagaattgccaagacatcaaacttgccagaatgttccagccattacttaatcccaagtcaataatagtaggaaaataaaactgaccactactacttgacattgtagacaagatcaagaaggggagtgagaaaaaaatcttgcttgactattacatcaacatattaataatggatgtaaaaatgttgatcctcacattcttgagtattattgtctgttttttggaatggccatcaaaccatctaataaaaatacaaattgatcattgatgagatttaatcctgtcaaatccactccatttttaattaagcaagtgtttattttagaggaattagaaaatactcatagaccctttttatagataataaggcattgtcttcaatttgtacaggaataaaaattcagctctgatgagaatatgcaatatctaccaatttcttttggtctatatcttttcacaagaggattttaactgtattgtgtattgtaagcttctcatatttctagaggtttcacacatttatatgattttaacacatcatctttacagtaagaggtggagtaatacaatattgcatatcccagtagatatatactaatatagtgtacttgcgtgcttccaaactttttccttcaaacattgaaccatgaagaaatgccacagatttccaaggttatcaatactttcctcttctagtagagaaaatgtatctctctcctctccacagagaaaaaggatttttcgatagaatattccttatcaattgttatgatttttacctggcaaaagttgagatagaaactcactctatttattaaaaccacaaaatctggtagttgtgtaaaactgccctaaaagctacaaagcaaatgtggtttctcctaaatatttatatacatattccatgatgtggctagttgacatttggtgaaatgtcccttgtctggccaatgagataaccctcgtggtgaatctaatttgatgaatctaatgctcaagaaaataattatatgtataatatcacactttttttgtaatggctaatcttgaatatctcattggcagaaagttatttttaaaagatggtgtttcatcactcagatttattataattaaaaggggactaaacttaaaaaaataagtctgtgttgaaatctacaagtttgattttagcagctgtcaactttccaaattttttggtaaacttcttgtggttcctgtagtctgtagggtttttaagaccctaaggtaagaaatctagctatctaaaagacttccagccatatttaactcatgcagttataaatggtggcaggacaattgtactaagtgcttgccaatgttacaaatgaatgccttctttgggttagtcttaaatatgtttttttttttttttaatgagaaaacagacattttaggatgaaaagattcaaagaaatgtcaaaggattctaatgcttcattttctactaaaaccagaattaaacagcatttatagttgccccaatgattacagtcctctattcagtagatgagcttttcagaaggtctgaggtgatctacttcttaactacctgcagctaaacatttctaagtgggtaagggtctagagcaatcaaatctccattcagaatttgaggttggagtcatagtgaaggttcccctctattctccaatagcaacattaaatgaaagaagagtcctagtgcggtggctcatgcctgtaatcccagcactttggaagggcgagacaggtggatcacctgagttcaggggttcgagaccagcctggccaacatggtgaaactctgtctctactaaaaatacaaaaaagaaaaaaaattgcccaggcatggtggtgggtgcctgtaatcccagctacttgggaggctgaggcacgagaatcgcttgaactccgcgaggcagaggtagcagtgagccgagaccgcgccattacactccagcctggcaacaaaagtgaaactgcgtctcaaaataaataagtaaagtaattaaaataaataaataaaagagactgttgcatgttccaattgttgcaacatatgaaaagtattttctaagaaagaagcatacaatgtctgttatttcggtacaagagattaaaagttacgattcattagttttattttttttaccccaaagaaataaaaaaattatcatttcatgaatgctaagaatggttttaggcccctaaagacaaatttgtccaaaaatggttttatttcactgaaaaggtaatccaggtggctgatttcctccaccctctgaattgatctttgtctagaaagtgtgcttgcttgttaaaaaacagtacccccttgaaattttatgcatagaagaagcaaacacacttcctagacaaagaaagaaagtctttggagaggagcagctctcaagctagcaaccccacgtaagctgtatgtacactgttaaattacttacggctgaaacttttgatgagtctacctagagggactcacaaaatagagaactcttgaaatacatgccgtggattagctacattcatcttactgtgtgcatacatgctgagtaagataaggcaaagagatgggcattacattcaaaaaagatattacgttttgttctgatgctctgtaacttctaaaggaagaaacagaaaaaaaagtcagataatgatatttcagagatagttgtgtttaacattaatttgcacttaaaaagaaagcctaaaatacgtcaagtttctttacaactataaaggcaattatactaaatcaggtaaataagatgttttaaatatcacaacatagctattatatttctgtactttgaatatgatgatacaacgtatatacattgtgcctgtcttaattttgatgtattattgcaataaaaataatacaatgtgttaatactatcaatgtaattttaaaactttatttaatatttaaaaccaaatactctgaattcaaagcttttccaccattaatggaaagcattttactcaggtttttacataaaggctaaagtaatgccatacattactaaaggctaaactaatgacatacatattctttgaaacacggatagtaaagaatttatatttttgcaatgtaaaagagcgagtatcacatcaattataatatgaaagtttctatttatcgcaatattgattttaacgaattaccattcatatttggttgttccagttctttgtttttggagtcattaagaaccatgctcactcatttccaattagttagatgtgtcttcccaagtaataggtggctaccagctttctagttttcaggctcaatgaagcagtggtagtcagttttggctcaaaatcaaggctgtggcctctgcaaccatcacatctactttaatctcctccagggctattccttgacaaatttcctggacagcataattaacctcttcccatagcacttccaaatgctccacacacagttcccagggaatcagccagcagtgccataaatgttttaagttagaaacaacaaaaaatatgcatttctaaaagtagagtattaatgaatacaattagcccaatgttgattgcacaaacatattttaaaatgttgtatattaattacatcctttataagtgaaggggacattgccacaaaattaaaagtctgggagactatatttaggttatcttttagctttaaaggcaacattatcactgggtcttcttgaagaatacacacatacaaacatatgcacatgcacattcacatacaagagaaatgattttgctgggtaatttccgtatgtaattttagacaataattataaaacatgtctagaatttacaaaatcaggttttcaaatattaataaattatatatgcttcaaataaatgccgtgctatattgatcgagctggtaaaatctcttcaaggcttttaatataaatgtaccattgtcagaggcatgtgatccagagcaactccatcttgaataggagctaggtaagatgaggctgaaacctactgggctgcattcccagatggttaaggcattctaaatcacaggatgagataggaggtcagcataaattacagttcataaagaccttgctgataaaacagattgcagtaaagaagccacctaaatcctaccaaaaccaagatcgccacgagagtgacctctggtggtcctcactactacactcccttcagcaccatgacagtttactaatgccatggcaatgtcaagaagttaccctatatagtctaaaaaggggggtggaggcgcatgaataatccaccccttgtttagcatatcatcatgaaataaccataaaaatgggcaaccagcagccctcagggctgctgtctgtggagtagccattctttcattcctttacattcttaataaacttgccttcactttgcactgcagactcgccctaaattttttcttgcgtgagatccaagagcaaaggggtcccgatacagtcctctcttggggtctggatcgagacccctttcctgtaacatatttctctgtcctgtaatgtcatgagttcaaattcaggatcattttaaaaagctttcaatattgctgtaatttttaaaaaagatcttgtgttgttgttgttggtttttaaaaaaagataaaatctttgttgtttagtgtaactgcataccaaacattaaatatattgtatatattttataagctagtagaatatcataattaatgcatagcccagattcttttccctttttaattggaaagtatccaaattgcagaaggagaaaaacatccctattcttattctaaaggggaaaaaaagcaaatgaagttagaggtacatggccattattaactagacattctgtaacaaattataattaaatggaaatatattgctttcacctgcatccatcaggatttttttttaagaatcaggagagctaggaatggtaaaaatatgaattctactttggataataatttgatatcatatttacttatatattttagctacctacaggtgtgtacttacatgtatatacacagaaaataaaaaatgaggaaaactattttttccacatactattttctcctcctccttgaaatagcaacctctgttgccagtagaaactttactaattgaaatatttattttccttgccggagcaaataagacgttaaactaagcaacagtattggttagagtgaggagacaggaaattcagctcacacccagctacccttgcccagcgcccctcctctcctccttttccttctcactgctccaggcactgcagaggcctctcagggaagttcctgtgctgcaggtgctttactttgtgtagcactttttaaactcaataaatgacttttcttatgaaaaaaaaaaaaaaaagaaatgtcctaggttctgagtaagtgttgttacaaattacttgagttaagatgagttgttctcctttgttttaaagtctatctaaaatattagtgcaaattattaggaaaattagcagaaaatgatactgattttcttaacctgttgccttctcatccatccttcccatgctgcttagaggagtggagagtatgagatattcctaatgtacaccatattcccattacagggtacttccaaaagtccacagattgcctataccataattaattcatttgcttaatccttagagtttactacagaaataattattatccggaatcttccagatagactgctcacctcagcaatggggaagatccctagactgtaaaaaattgtatgtaatatttctttctcccaaatgttgagtctctacacaaaacagctggttgttcgaggggagtggtggctcatgcctgtaatctcagcactttgggaggccgaggcagatggatcacctgcggtcaggagttcgagaccagcctggccaacatggtgaaaccacgtctccactaaaaataaaaaactagctcagtgtggtggcgggtgcctgtagtcccagctacttgggaggctgaggcaggagaatcacttgaacatgggaggcggaggttgcagtgagccaagattgcctcactggccttgagcctgggcgacagagtaagactccgtgtcaaaacaaataacaacaacaacaataacaatacacaaaaacccaaagaaaggaaaacaactgtttgtcagtgatcctctcagatcattaaattgacatttttgtatagcatcataaatcaaccatataagtaatccttttctacttagttttattcattaatttaatatgtatttttatatactggactaatttctgggcacactaatacatgcaatagtcatggactctggcttcacagtttccctcctttaaagtgaaacatatatttctttctaaacaggcatttagacaatcacataagtttaaaatataatttgacaaaggtacaaagacaatgtaaaaatattttcctctactttttcaggttactgattttacttagaagataatttatggtaagggtaaagtatttaggaaaaaacatatttccattacaaaaacataatgaaagtataaactcttccagaatgtaaataatacttagcaaatcttaacacagggaggagtttctattatttgattttgacattgctgagggattctatttggttaagtaactgaagaaatgtcaatattatgtaaactcttacttacaaatcatctaaattgcttagaacagagagaatacattaactataaccactgaagccaacgtattctgatattttcagcacatgttaatattcaacattagtggagacaaaatagtgtgttgaagtagtagcagaaaattaatattttcttcttcccctgctacgttatgtttttaactatatcataaaagtcaaaaatgcttgagagcatttgcttttaccagtaccttccagggaaactacaataataaattttagtaataacagtaataatgtacactcataaacacatacatgcatttattgagtatatatagcatatatttatatatatatatgtatataaaatatagaaagggaatttgctactgtcagagaaaggcatgcattccatagagtgttttacttactggatacaatctacccttgtgactaccaaaatgaaagaaacaccatgcatctttagtattcctataccaagtcgaccttactcctttcagggtctataagcacatgcatttaaattgagcatctgcattaacaggaaagtcttcagcaatagccttgatgctccaaatcatgtgtttttgcagctgctttatgctagacggagcatgaaagactttgctctatggcctttacacactccattctccaaataacaaattggctttgcagaagcagaggaagagtaagcaatgaagtactgtcacttggagagatttgtactaaaatcatcaacaacgttgaaagctttacccaaacacttaggagaagaaaaggtattcacattttggaatttaattgcaattatactctaggaaatgctgcttttgctactcctccaacttttgacagggataaaagaaaaagattaatcactaagtaaagaatttgcaatgcattagctactagattccattgttataactacacccacttctgtagagatagaataattttctttcttagctattcctttacctttattatgtagaatggagtgagaattagggagagaggtagcagaagcctagagctgccaaactgctgtaaatagaagaaaggaaaaagaaaaatagggaatgaggaaaagacaatcaatgtgtatggaaaagtacctccagagatcaaactttaggcattaatcataacaagtaccccatatacttgttatgcaaaggaaaatgaaatttcctggtttgtaaccactattgggatctgagcaagagtaatttgaaagacaagagagatctgaggtagatgataatgtgtctacacagtggtagcaaatgaggaccatggtggagaagactggtttggggcctctgggtgagaaaagtaattaacagagttaattccattaagggcttagaaatcccaaaactgttatttccatcagagacaggtaaacatgtctgtgtgtggagggtgcaaaaatggcacagaaatgtgaacaaatccatgtgaagtccctgcttttcttcatgaaagaaaagtatggcagcttagagttgggatttatttgtagttagtacataaggaccatagtctcaatttgagaggtatttatggggaacaggtcatagaatggacaagatgcacacagaaaattgtctggggaacactaagaactcgactgaggttgcagaacatgaattaacgtgttcatttgccaaatgtgttcattagctcagaaaaaaaaagatagcagatgagtgagtacttacaagtcataggtgaggaaaggaaaaaaaaaatacaaggaaatctataggttggagaaaggtggcgggacatataaccaggaaagaggctgatagattggaaaagttgtatagaaatgggctttggtttcagtctaatgtgggttcatatctaatctcatcttcttactaattatttgatcctaggcaaatcacttaaacttatttcagtttcctcatccatacaataaagatgatagtatttgcctgataggatttttgtgaggattaaattaaatgataatagttgactattacattcattattaaaaagagaggtaaaggtgcgacagacctcagaacgttaatggaggccttttctctgtcctgctgcattccttcttttgcttggtgatgcccaaagcacctatcggaccagagtctagctcacgccttcctctcaggaaagctccctacttctcctttctactatttcacagctctgaaatttaacccttgtttccatcagagggtctgtttccccacttcatagcataatgaaactccttactgcagttctttgttttctcaggaatttcttttcttttttacttgtataatcattagatttcctttctttctttttattttattattattatactttaagttttagggtacatgtgcacaatgtgcaggttagttacatatgtatacatgtgccatgctggtgtgctgcacccattaactcgtcatttagcattaggtatatctcctaaagctatccctccccgctacccccaccccacaacaggccccagagtgtgatgttccccttcctgtgtccatgtgttctcattgttcaattcccaactatgagtgagaatatgcggtgtttggttttttgttcttgcgatagtttactgagaatgatgatttccaatttcatccatgtccctacaaaggacatgaacttgtcttggaaataccaactcaaatacatcttcttcactaaacctagaaccatctttccagaatctgtcttgtctaaaaccctacaaaaaagtttacattgttttagcatgactcaagcctatcacccagcttcattctctagcatactgccagagtcttttctaacagtagatatactaaattttttaagattcctagaaatcaccatgtttatcatatctctgtgtcttttctggagtccttgttttcttctcgtctccctagtaaagccttcaagattcataccaaactctaaaactttcttcagactgagtaactgctgctatgagtatcatagctccgggatgtatctcctattatagcatttatcatactgagttttaatcactgtttttcttatctttagcccctactaaaccatgaaaatcgtggaagctttgtcttatttctgtacgcatagaacctggcataaacaatgatacaattaacctcataacaaccacatgggatatgtatctttcttatctttgctattttgcagaagaggaaaccatgagatgaagaggttaagttacttgcccaaggacacagactttcaaggtgtagaactaagacatgactagattaccttatctgtccagtcctccccaaaacttttactagcttctcaatctaaagcttgtcacatcatagatgccctataaatatatgaacaattaaataatgtgtacattacaaataaggcttacgataaaatcatccctgatattcatttgtcattggccctgctagggtggtatcttctttcatgcaatttttgatatctctgttctctgtaaactttaaaacgattctgcaccacagatcttgcattcattcacttaaatatttattactcaatgaatttacatcccttctttcaagttatgcctaagagagtacagttgaaaaattccattcattaggagattggggaatctcaagaatgggcttcactagacagctgctctggtcttagttactgagctccttccaaggaccaaggaaagtaccttggagagaaagacttggcaacagaatcaacattcattttctccctttctccattcctttctccgtataatctagcacaaaagttaacccagtttttccaacaccctctgcctctactaccactgctacttcaccagtgggaaattgaacaaaaagagaagtgctggtagagaagagaaaaagtctgggtagaatcaatgagaacaagctcaagactgggtctgcagcagtagaaggtcaaaaactgcctaaaaaacaaaacccacctctatcatcagttactagagtgccaacatacaccgtatttaagatacttaatagatgcaagtttagcatttccaatatggaaactattcacagggatagataggatagaagttattttgagtcctaaagacacagctattcacaaacaattttaagtcatacttggggctagattgttgatcacactgaatggacaagttaattttttttgtaactggtcagttaaagatacctgccctagagaataagctggaatattgccagcattgctggctggctcccaatagcaatctgccttggctctgtttacttctctacacgtatggggcattaggttgtggggtgactgagatgtcagccacatggctaactcccttttctgcagtgtgcctgtaaatagattgttttcattgcagttagtggatactttggtccctgttcgagaaggacctcaacttttaagatttttttttttttttagattctgtgtatagatgcacaaaatgttggtagaagttttatggggacctctgtaggagttcttgcccataagaattttcttttcaaatcacagtctttcctgcagtgtcttagagaccagactctcccaggatgcaaggaaatcatggaaagaacacttttaccaagacaaacaggcagcattgaggttcaacctggaaagtcatgacagcaaatcagggcagaagtctattccaatcttgcacaatttataacaatgaatacgagaaaattacatataggatggctcagaaattgcattattgttcattagctagggcatagttggtattacaaggaaaaacagtctttctggaattttgttttaagtttcatttttttcctgaagaaaataaaccatgtttaaacatgagcactggcatatggtactgttttagtctgcttaggcagctataacaaaataccataaactgggtggctaaaacaacagaaatgtattgtttgcagttgtggagcctgggaagttcaagatcaaggtgcaacccaatttggttcctggtgtgggttttcttcccggcttgaatatggctgtcttctggtgttgtcctcatggggaacagagaaagtgtctggtgttgtcctcacaggcaatagagaaagaaggagtgccctcctgtctcttcatataaggacactaatcctatgagggccccaccttatgactttaattatctccttactccaaatatagtggcttcaggggtttagggctttcatatatgaattttaagaagactcaactcagttcattgtaggcacttttacaaaaattaagccacgtgatatctaaagtcatgatgccaagatggcactcagggcagagacaaaaatttgacagatatgttctattatagagattagctctatatctattataaagatatttatacagaagcattataaagatgtgctacttagaagtgtcctatagatgtatcataaatgtgtctcatggttgattcttcagaaattatcagttttctcctaaatttcaatgctaccttaagcaataattttatacaaaggtactctatctacaaattactttttgctttcctttgtttctttctatatgtttatttctaacttggtgggcttttattcctgacatttttttatttgtggttatcatcagattactgtcattagctaatggagctatttcatcaacacaacagagaaccagatgtgcctgggaacttatttcttcagatagccattgaccaatatttgacaggtacaaggatataaaagcccaggtccctcgactctatcagggtacatctaggggttaatttataatctaaagttcactgtaggatcaggctgaagctaccctctaggggattttgcctgagattgcatccttatttgtcttttcccctccttccttgtcctgatccccccaactttaccagtgtttcctgagatcacttccttaacaaatcatttgcacacctcattttagggtctttttgggaacacaacctaagacagcatgtgagataagatccatgacattattaagaagatacaatggagaagaatagaaaaatagcaattgttaaatgttaccattttttagtatgatatctttctagctgtctttctgttcctacctcaatgccttctgttccttccatccttatttggttcagtgtctcatccaagactttttccctcacactttgctcagtctgcctgagagacttagtctcacttgaattcccacttttttctaacaatcctgttactctcgtaagcccctaagcacaattctcaggattggtgagaatacgttaggaaggtgaggaagtataaagctgtagcatttaaacaactatgcacagagacttgaacagcacaggctaatggcaacaccagcataagaacggggtgaatccgaggaaataggaagttggcagatggcaggagcaaaaagagctagagggagtataccagagcaaatgagcatcagagattcatgttcagtgcaggcacacactatgcactcagcggtgattctgccccttattataattatggtattaaggactgagaggtttgccttccatcttcctgaacttgacctttgttgagttggagactgaacagtttttactcgtgtttgtcccagatgaaagagtgatctcaagagagtaccagcttttagttttgtcaagaaggagaaagtattcaggaaagaggtcaggggatggagagggaggaagtcagaggcatgttttaaaaaatgtaacaaatttcatttttaatggataaaatatggtttttcagtctcaccaatccatgatagttacatccaggaaggtaatcaaacagccctatcctgtcaaattgactgctaactctcctgtcattatcgcttttctctctcagtggcatgtgcttctcttagccattctgccatcttcaattctgtctgctttggatttcctgacactttcttgtgtgttctccctctctggccaatcaccctgtctccttggtggatttatcttcctccgctttatgagaaacaataaatattgttaaggccttttcctatctatgtattttcctttggtgtccatacattgtatctatgatttccactgtattttataaaattacagtaaataatatacacgtatttttcttttttaagattaaatgctgcattattagggcaagaacatgttttgtccttgcattcacactgcctaggacatagaaagcctggtaacagatatttttaagaaataaacatttaataaaatatttcacgtttcttttgagaaaatgcttcaaaaatcacattttaaaatctcataacagagaaacattatatttgctcaatcaaatgcttatgtattaatttaaatattgttatctactacttcataaacaatataaaccaacaagattaccttagtaaaaatagaacacagctttgagcaaaaattacattttgatttatacttagataagcttgcctcatagaccttgtaagatagttttctttctcccttaataaggaagtcatatcagtagaaaagtttataaatcactaatgtgctaatattctgtgagtccacctgaggtaccttagaggaaagaatattctccagtcttcttcagcagataaataaaagaaatatttttgtaaataaaaaggccaaacctgtctttacaagccttggaccaaaaattttgaaatctgagacctatcttatatcaatttggacatttagtcaaaggaaaaagaaattccaaatagtttcattactcactaagttagcaattctaggaatttagagagcacatttgtgcaggggccacacaacattcctagaagcaggtggtgtgttttatgaatttaacacgtcattcattgtacatagtatagaattgtgagctctcgtgctattaaaatattgtgacattttaaaagcttatccctgaaaaaaagttatacatgatataaatatggctttttccttctttctgatctacttttaattctgagatttaatgttctctttctgtctctctttttaaaatctgcttagttttctaagtttaaattaggaattcaacccgtaactctctactggttgtctaaatacctctcaatgctgtgggatgcatcaggtagtccatcagtttcatcaccttaaagaaatctctcctggagcctctgcttggcagcacagtggactagccaccctctgttggtgcagctctcatcctgagatctcacatcactcttactctggggattccttttgcttcttcctgacctgaatcccttctttctggattggctactctttcttggctaatcatcctgttttactgaagtacatcatctaagagttttctaagaaacggtgcatcaagcttaactttttgagaacttgcatgtctgaaccgtgtttattcaatgccctaagttaattgacactttgtctgaatacagaattctatattggaaaacattttcctctgaaattagatggcattttctgttgcctcctggattttagagttgaagctatgaagaacaaagcaatattaatccctgaaaattacgtaacctgttttttcattttaattttttttccctggaacctcacagagccttttatatttctccagtgttctaaaatgttatgatgacctgctttggtatgagtttgttttcatccattgtactgggctctctcaatctaaaaatacatttatttaattactaaaaaaagtattcaattactttattgatgacttctctcacatatgttctgttttctctttctgcaatgcttattttttgaacttctggggtgacctcagattttcttgttttctcatgtatttttttcatcatttccccctacttctggaatatttcctcaactttaatttttacaacttcctctgagatttttattcttcttcgcatacttttaaattcaaagagctgttttattttctgctcatttttaaagtagcaatttgatcttgtttcatggatgcaatattttctctgatctttatgaagatctttattttcttccagaatagtttgtttcttctaagttccttcatttttgtttgtttgggtttttttttttttttttcgtctctatatttcattttagatgatttccttagctatccagtgatcttgggttgtatacttgtgtttaaaagcagctcaagaatggaatctctaagcccatgggtagagcttgtcaactgtaagctttgctatagaaagggttggtaggttatttttttttttttaggaagtccagcatcaatatatttctttagactagtcagattcctctgaggagaatatttcaactgtgtctctggagagctgccagcattctgaagccttaggaaaagaaggctaggtggctctcaatagaactggcatgaattcaatgataatgacagcctatacacatttcttcccaagttgacattctaggatatcatgttgactgttagaaattggatgtggtggtacaatttacaccatggaggtcggaaaatcctacaaatcaaggctctttcttcccagagagatggtttttaaacacatagcagcacagcatctgtcttgatatttaatatttattgtttcacttgtttccctgatttcagtccagtacttcagtgcaaagatactctgttctacctacttcaaagaaaaaaaaattatttcattattttcagggatattggagaggaagtagaaaggttatattggataaggtagaagatctggggttccaactgcttattaaacagactttttaaccaaagttttgaatccaacctctgccctcactgatataggtgcttggcactttcaattcctgaagctttggaggagattccatggaacaaatcaagttttttcttgatttgtgcctttgtgggattaagatttggccacctcggttctgccaaatcaattacactcatccatgtgctatccacttgccaagattaagttgctattgttttctatccccttcttatagttcagtggtttgtgctttaaaagttctttttgttttagaaggaataggagaatatttttaaaatgtgtatatgttgtcatctatctttattcaactgaatttttaatcaaccagttaaaccgtgggagggtcccaagtagtctcatattgtggctgcacgtggatcagctctgactacctccatgtccctgttggaggttaattgtgacctcataatgatatgttcaagccccaacccccagctttgcgagtgtgaccttctttgcaaatagagtcttataaggtaatatgaggtcatactggattagttcttaaccaatcactagtgtgcttgtaagggaaggggaatttggatatagaggtgtggggaagaccatgtgacagtggtggcaaagaatggagcaatgcatctgcaagccacagaatgcccaggactggcagcaaccaccatgagctaagaagtgggggggaaaaaaaggtttttttctctagatccttcagagggaacatggttctatggacatattaattttggacttccagcctcaaggactgtgagaaattaaatttctgttgcttaaggcaattccacttgtggtactttgttatggcagccctagaaaactaatacaaccaccagtgatcttctcccaaggctttactcattccttggagtaggtggacaaataaggagaaaggaagtctaggccatcggcagcactatgaccatttaagcattaaaccctgctcctatggagtatatgacagttaggtccctgcttctgccaactcctgctcaattatcttaggtattcaagaatttaggttacaactacaccctagttgtaaagcctcagatatatatattcaaagatatttatacttaaacattggaagctgtaagtgcagatcagctttggggtttcaatatttcatccttgagattggcaattttcaatcataattggtagcaaagacttcttgagctaagatagcattttcatgaagtattttcccagaatcatatatattgtcaatatttacgtagaatttttgtgattttttttttgtttgttgtcattagtgatattttgggaaacaacttatatcatttgtggcaattaatataaaaatatttacacagtgattatatttaaaacctgttttctgcctaaagtaattgagtacttaaacatctaaggttaagaaaaccaagaaaaagaataagttagttataataagacagatgaccttttaaacaaaaacgttataacccatgtctatacatataatgaaaatgattatttgatttacactgaattactgaacctataaaatatattcttacatataatttttgtcagaattcttactataatgccctttttggtaggaaaaagtaactgtcatctaagttagcctactgacaatactgaatataaataaaatttaaagtctctacataatatacattataaaaactaatctttagcaaatgagctatgaagcatttctaacttgggaaactcaaacaaaaataaatcttgaaaaataatttaaaacttgaaatatcaaaaatcacaagtgtagcaaccgatattttcatctatttctttgaagttagaatagaaatacaatattatcagggattgaataggagctttgttggaactgatgataaggactgtttaagactagctgggatttatgagagatcagaccatgaaaatcgttcaagtagtaaactgtcaattataaggtgtggttaacaagagcacgaagcttggcatagataagtaatattgccaaaatttctttataagttcaatttactattgattttaatattaaatactcattcaattatctatacaggcaagaaaagactggaaaagtaaaacctaagtcttcattataaaagctattcttatccaaatctttaatgttttcaacattttaacttaccaactccacttgcaaactatgaccaataaaataaaatataatctagttaacataattagggtctcaaatttttaataaatctttgaaacaaatacattttcagaaagagaatattatcagaacaaaaaggatgcaataacatttaaatgaaaaaatgatttattagtgttctctaccttcagatagtcttttagattttttaatgaattatactataaagggtttaaatacgtgaaaaatatgctcaagtggagaggtaaatactttttagatgatgaaagtgtcatatctctacaaaaatcttccagacaaggtctgagcttaaaagagtattcaagttgcccatttaccctcattataagttaacattctggtagagtatttgaaatcattcacatagtaatcattggaatgcaacataagtgtttaaaatagtaattaaagaatttacaactaccaggagaagcagctcttcagatgactagaaaattacatgcttgataaaggggatgaaaggtcatttctaccacggagcactctaacttggcatgcacgttatgaatagcatcatggcctaaaactgtacttcagttattgtgttaatacatttgtcctagtttgcccatgaccttgctttctttctaagagtgactgattcatgaagacattaaccaaggtatagaggagttaatagctgtttctgtatactcttggtaattatggtaatttgagctgcccgtcaaaaactagcaaatatgttttataaaataaacataaaagcatattgtaaggagattcaattccttatgaagattagatcttgacttccaaaaaatttacaaacattttgtgaacccaggtaatctatgcatacgaagagactttaatcttaaaatagccaagagttagatcattcatacttgactttagctagtctatccaggatatactgttatctggaaagatgtcagaaaaaagctgagcagagtgatagagaccctaaccaagtggctggaatccattgaactgaaatgctaggtagggatactaagcaaaaatcaagtattagtattctctcaatagtgcaaactcaactctaattgggtcaagcatttagaaaaggaaaatttgggcattcgtatgcccttgatttctccctttccctccatctctccttctctccccttcccaaatctttatatcggattatactttcttctctccatctgtagtaaagcccacttaatatttatttataatctaaaaattattacataaattattaaatatagtcatttttctgtatgtataaacacatcatatttgagttcaaattttactcaatcatattttctatgtgctgtcaacttttctaggccgtgggcataatgcagtgatcaaaagagaatcattgatgagaaggaaacttacattcagtgggcacagatctagatttaatgttgttgattgtttactataaggttcctgctactactctaaggcctttaaccttgcttattattcattacaataaccctgtgagtaggtaatatgattttctccattttatagattagaaaactgaagaacaaaaaaattaatttttaaaacgtcttaaataaccagtagcagaacataaatcaagtattctgcctaaaaatatgtcttcagaaccactttgtaatactgcctctcactataaacaaatatcagaaaaaacttttattaatgttatcataaaaagtcttcagtgctaaagttgatactacatatataggtattggttaaacaaatcactgaagaattttacaatggaacagtatatagccattaaaaggcaggagtaaattttattcattctacgtgaaacaatttccaatatatattctttttaaaaatattcaaggtttggccaggcgtggtggctcatgcctgtaatcccaacactttgggaggctgaggcgggtggatcccctgaggtcaggagttcgagaccagcctgaccaaaatggtgaaaccccatctctactaaaaatacaaaaaatcagtcaggtgtggtggtgcatgcctgtaatcccagctactagggaggctgaggcaggagaatcacttgaacccgggaggcggaggctgcagtgagccaagattgcgccactgtactccagcctgggcaacaaaagtgaaactccgtcgggggaaaaaaaaaattcaaggttctagatagtcagcagacatgaatttgatgtagtttgtattttataaagtaattaatattttataatttattttatacatcacacacaaaaacacatacgtacattttcacatacacacagacattttccaataaaattaccaaggattatttttaagaaacagaatgtagtatttgcaatagcatgaaaagttttatcttagtacacattatcaataaaacatatttataaaataaaatcatcttgccctaatatgtgcttaccattaaaatgactctataattaagcatctaaagttaatattttatttgttcaagtataaatatttatttctactttgtaagaaaatcaaacaaggagtaaacaagttgggaaaattcatagtttttttttttttaacaagttatttgtgtgcatgtgtgcttcttgattggaatattctttttttttttttttttttttccgagatggagttttgctctgtcacccaggctggagtgcagtgatgcaatcttgactcactgcaacctctgcttcctgggttcaagtgattctcctgcctcagcctctggttccagagtagctgggattacaggtgcgtgccaccatgcccagtgaatttttgtatttttagtagtgatggggtttcactacgttggccaggctggtctcgaactcctgacctcaagcgatctgcccactttggcctcccaaagtgctgggattacaggcgtgagccaccgttcccagccaattggaatattcttaatagagacatcttcaaatatccatatttttctttcatgtttgcatgacattaacttatctaaagtttattttccaagttagagcagatactgagcgtaaaaatgaataaattttaagatagcaaaatattttacttaaatagttcacttcttttgtactgtaaaaattatggagtgaagatttgtatgttttctctgattaatttgaaccacattaagacataagattggcacctatgaaaataattttaatataaatatttgcattcaactattccatatgggaatcatcgggagacaggacatttggcttttggctctgaaaacaacatgtgataaacgtgactttttaaagttagcatgcattgctgactgttatttctgggtaaaacatgtataaattagggaaacttgaaggagatagttcaatgcaaaaatttaagacaacattaaaaaaattaggaatctttttagattttaaggtttcttcatttcaacacctctttatttttcttgttatatttttcttgattccttattttcttgggatttgagaacataaaatggagttaaaatgctcttctcacattctggagagataattggcagataagactttaggaaatccatactccactgtctttcctgtccagaactgaatattctcaaagtgatttaatatttatttcccttactacagtatggaagtgatgaggacacacaccaagatgactcattctacttttagagagaagcacttagtagtgactggcacatcacaggaatttaatcaatagtctctgaaagaattaatgaataaatgtgtgactggactgcattacactgtacagtacagcgggatgtaaccctttccttaagaagaacgtaaagacaaatgtattgccctggtaaaaacactccataatcaggaatcttgaaacctgggatcaagtttcttctctgtgcttactctttctgacttattctctcaatacttcaatttaataagcaactgaaacaaaccaaccaaaaaaaaagggcagataattttatatgatcttgaagtcttttccagttttgagatataatctgactgaaattatttcctgttttttttttaaaaaaagaaagaaaacagcaacaaaaaacaaatatgaggctttatcttgcttcaaccatttgtgtgtgtttgttaattaattaacacgtgatgtgatctgtaatgtaagaaattctcaccacgggaactctcatcactaaagatgttctacatctttaataaagatgaagactaagtccaaaagataaaatgattaatgtttacatggtttcctcattcacctccctccaccccacaaatctctaggattcctttatccccaaaacactgtgtcatcacaagtcactctgtaacccttcttctgtatctttctctcctcctccttctcctccacctgtacaactgacattacctaaatttccttagggtatcatgtgcagtcccagaagttacaacctaaaaggggaagttcccttttctcatcttaatttctgtttgaaacatacttggaattaaaacaagcaaaacagggggccaggtgcagtggctcatgcctgtaatcccaacactttgggaggccaaggtgggcagatcacttgaggttaggagtacgagaccagtctggccaacatggcaaaaccccatctctaccgaaaaaatacaaaaattagccagtcatggtggcaggtgcctgtaatcccaactactaggtagactgaggcaggagaatggcttgaacccgggaggcggagattgcagctagccaagattgtgccattgcactacggcctgggcgacagagtgagaccgtttctcaataaaatacgataaaataaaataaaataaaataaaataaaataaaataaaataaatgaaacaagcaaaatcatgaggcagtagaatagaggaaatcagaattaaatgccacagaagtccttcacctgagacaagacagggaggtgaggagattcaggtccctactgtgcctccatctgaaacttccttacgttttattattgtgcttacctgagatctgaatgattgcaaataaggaggaggaggaaaagtagaaagatatttggaattgtggctggctggctggcccaggcacagctgactgggaaggtccttccctgcctgccttcccagctgtggtttaggctattgtcctaaagaggaactcagccatgattgcatttcagggagggcttcttgcctctaggactctcctctttatcccaagttctagtcaaaattcaagtattgttctaaatagcatatcatatgggaagaaaatgaagtttccatttttaagcttctgccaattctatttaatttggagcagttttcaaactttttagaccatgcccagaggtaacaaatagatttcacttagcaatcagtatacacatatatgtgtaatataaatctgaaaacaatgcttcccaaaacaagagttacaacacaaaataaatactgatattttctgatttattctatctcatttttaaaaaaatactggctgggccaattacgtctgttgggagcaaggctcaggcattaggatttttttgaagttctcgcctttgattcccatgtgtagataactttgggaagcaccactctagaggtttttcaggtgaattctcttgggtttctaaggactatggctttaccatttataaataacagtactttttatcttttcatttacaatcattatatattatatttttgtctcttattgtatcttagaattttaagaatgatattaatagaaataaaagtaaaaatctgtttttagaagctggtctataaaattgatttcacaccccattaaatggtcacaattcacagtttgtaaataagctggtctacaggaagagtcagtaaactatggcccatgggacaaagcaggtctgtcacttgtttctataaataaagttgtattgatcacaaacagccacatccattccttaatgtattatctatgaccactttcctgtaacaatggcagaaatgagtagctgtgacagtgactggtccacaaagcctataagctctttattatttgtctttacagaaagcctgccaattctttgtttaatgtaagttttttgcattggaggtgaagtaaagaggttggaaaaggaatgaggatctaaatcatgaatggtattccaatctagtgataggattttatcctcggggcaataataagccattcctctgcaggaatcaagctcccttctaatcaacggtctcccactgtgttctgaaaccctgaaaatggcactcttaggcaggaataaaattgttttgtttcttgtgcatttccaggctccaatggttggtgttctctgtaaatatgctaaatgtgaaatcagcctttgcctaattttgagtgtgaatctgctggaatttttaacttcctatctatttttagataaagactcttactgagtctcatcaaagagtttcatagcttgggactaggttcactggaccatttgactccacataaatttggcttttccttgctttctaaggaggggtggtattgggcatcaaccatgcttcctgcctgaatcatttgctgtgcttttgtcagtacataaagtaagcaacaaacccatgcaattaaacatgaccaagagaccagttttaaaaagttacttttttttcaagcaggtaatatttcattcattcactaaggagacagggcaaacatttatacaatctatcaaatatgttttgcttaggtaatcacagcagtcacagaattcttaatggtaatttagagtctattcacacttgcctcaaagacagcattaaagaacctatcaatgaccctgagaatcattactaaagtcattattgttctgatattacaatccaaagctgcatgtttatacctttttataatctaagaagtatggccaaaagaaaatgcttgaggtaaaagatctcaattactttaatattttattttctttaccaggtggattttgttaacaagaggttagaaaattagaaagatcttcaccacatgcttagaaataaagatcttgtaaatagtttataaaaaaatgcagtgggaaaaatttcaaacctaaattattattaaagctgcactaaatgtgaagaaaataaaggtgatttccaaaaagaatggttaggtgtcaagagtgagaagtgaagaatgtggaaagattaataaaaccaagcaggatctcgttaatcaaacttccccaagtggcacaaatgatttgatttgaatttgcctctatatacaccaatgatggaatctgctgtttttgtgaagcagccaaaatgtctacttgataaatggggtaattctttcaaaagtacctattctgttgtttcttttatatgttgatgatgtacacagtaaaactaagattaattatttgctaaaaatataaataaagctttgatcacttttaccagcttttgattttttttaatgaattgaccaaataacatctttaaactgaatctccgtttaaagggttgaacatgcagagaaatacctctgcatggaatgaatttagttggccaggagaatgtcttagaccaatgaaaataatatgtttctcatgtcaaatgttaaggctttgaataataacaattttttaaaatagtacaattacctatacattttaggtctaatataaatgtacctgaggaaaaattaggttaatatttctcctaaatggcaccttttctcatcattctcttgaaaaatatgacaaagatttgtgttcaagtctacctaaagcaaaacaagtaaaacaataaaagaatcaagcctacaaacaggctggttggactttttaaaaatcagatatattgagatagttgttaaaaaacacatcacaaaaggtacaataaaactttgggaagattagctaaatgaatataaatattaaaaaaacaaaaccagacaacaacataaaacagcattcttaatattgttaataatatcctcagtgacagtgacctcattggcatcttggcgaagaaataatttttgtggccaattttatcacagattttctgtagaaatatccagtatttagtttccattttattcaaagttatgtattggtatggactgaattgtgtccccacaaattttgtatgttgacaccctaaccccaaatatcactatatttggagaaagggcttttagaaagtaattaaggtcattaaggtgggactttaatccaataggattggcaaccttatgaaaaaaatctttctctgtctctctctctcttctccccccttctctctctctctcactctctctctttcttctcttcccctctctcttcctctcttccctatgaggatacagtaagtaggcagtcatctgcaagcaggaagacagccctttccagaaacagaatcacctggaaacttgatcttggacttagcctccagaactataagaaatacatatctgttgtttgaggcatccattctgtggtagcttgagctaagatatacacattcacagtttaaatagacaaatatttaaacaattttttaatatttgttataaaaatatccatacctacatattgcagctttcttcccctccaattcacaatccctagagcagtggtcttaacttgggaaatccccgctcccttgggagccctttggtaatgtctagagacatttttagttgtcacaaacggtgaagggagagagaattgctactggcatctggtgggcagaaatcaggcatgcttttatacattctataatgcactgtatagctctggacagcaaagaatgaatgtcagtagggtgaggaattctgccccagaagcaacaaattttaatgctgtaactttttagtgtttaccttcaatctctaaacaatatggtttctttcctgcttctcaatctttcttttttataaacagctttataattcacatagcacacaattcacccatttaaagtgcacaattaaatagttttcagtaaagtcacagatatgtgcaaccatcacaacagtcaatattgggacatttccatcacctctaaaagaaatcatgtattctttagcaatcacttgttctgcctccaccaccactgtcttttcccagccttaaacaactattaatctaccttaatctacttgctacttttttcactagtctctatcaatttccttattctggaatttcttctcaatagaatcatatggtatgtgaacttttataacttgttttttttacttggcatgttttcaaggtacatccaagtagtagcatatatcagcatgtactcatttcattgtatggatataccatggtttgtttatccattcatccgctgatggatatttgggatgtttccaccttttggctagtatgaataatgctactataaacatttgtatacaagtttctgtgtgaacatgttttcatttctcttgggtatatacctagtggagtttctgggtcatagggcaactaatcatttgaggacctgccagactatttttcaaaagcagctgcatcattttacattcccaccagcagtgtatgagttctgatttcccacatcctcccaacactttttatctgactttttgattctaatgattatagcaggcatgaggtgtatcttattatagttttgatttgcatttttctgatgcctagttatgttgagcatcttttcatgtgcttactgaccatttgcatatcttccctggaggagtgtctactgagaattctatctgcctcatccttcctcaccaacctccagtaggcatatgcacacatccccttctcccaatatactgaaattgttaaatcattattttttacatgattataaaaatgattaagatataaaatgtatcaataattttgatagctgaaacatattttatgatttcataagtttttccctctggaaaaattatgttatattgttgttgtttgcttagttatctttgtacttctcacaactatatcccagaactctattttagttgtatcagtctcctctcaatatattttaaaaatttcatcttcttgaataaaccttttcaggagccatctcatctgctgaaggtcagctacacaaatattattttgggatctttcttctcaattgtctagggattcccgtcgctctctcttatgttggagacttaatttcctggatcccatgactttaagtctttcctcaaatactttgtaagactcatagctgtctgctcatctataaaactgggccactaaaaagttgattagaagctctgagtgggtaggtggggcttttcagtttacagacccacagaatggttttgtttggaaacattctaaggatgtgtaggatcttattttggggctgtgtgcatttatcacaaatgatacatttaatccttttatgttagataaagcctagtaccaggctctgggagcccagggggaagctggaatttcaacatgctctagtaaaaattcccttaatctccagatttttagaagttatcccccatcaacggtgcttggtatccccgagtcagtcagcttctgctttatcttctacagttaagaaacctaacttttccagtgataaagcaacagacatttggttgtaggcaagggagaggctgatgctccaattactttttaaatagactttcagcaaatcttcctatgtagagcgccaatttgtcccaatttttgataatctcgtacttccaactcctaaacttttgtggtgttccctggtagactgaattggctctaagcctcctttattccagtttggttccagctttcttggtttgctaaatcagttactacttaccagtttctttcagctttccaaaccgtttttgctgcgaaatcctttcttatgctttttcctaatgtcatcactgccatgtttcctatcccattctcttttcctaatatttctgctaagttatccttcattgggattattttcatctgatgagttttggagaaaatgtgaaggctaatttgcatgttcaatctgtcaaacataagacaaagccttctttttgtgttttaagttaacttttttgttttgttttgttgtttctgtgtgtgtgtgtgtgtgtgtgtgtgtgtgtgtgtgtgtgtttgaagtggagtctcactcagttgcccaggttggagtgtagtggctcaatcttggctcactgcaacctctgcctccctggttcaagcgattctcctgcctcagtctcccaagtagctgggactacaggcactcaccaccactatgcctgggtaatttttgtatttttagtagagacggcgtttgccatgttggccaggctggtcccgaactcctgacctcagttgatccaccctcgtcggccttgcaaactgctgggattacaggcatgagccactgctcctggcctaattttatttttgaacggtgttgtagaacaaatacaattagctagtctactaacactttctttgcacacaagaatatgtatattattctagatcagaaatagccagtaggcataatctttatacaaacattaatctactaaaccacattattttgatgtattatatcagtggggaaattaaacagtactactggtctttgaattagaaatgatccaatatatattaagctaagacattgctctaagaacatatatgattaaaatatgctttgataatatttttcccttagactcagccatatattatgtccctagaatgcatgtacctattctaaatagatcactctaaaaatatggaataatttagtaactagatatgaatattaatgtcctatcagatattctacatctgcaactaagttatgtattacttaaagtagtacttctcaagggttgatccacagactgttttcaacacaaatgcaaaatttaaaaataaagatgtaggttccttaatcctgcttaagaactgctgtgtatgtatctctgagtgtgaaggcagaaggtctgcattttgattcaactttccaggtaaatctgaaacaattaaatgtgagaataatactgaaataaaaagaatgcatttaatgaggttatgaaattagttttatctgtgagctttaatgactttgtttttatgtagcccaaatggcataaaacacagggtgtttgtttaaatatagctattttctggaataaaaattttgacaaagtggtatccagatgacttagatgtcacaaaaaataattaaaagaaagagatgagttgccaagatcctcaataaagggacaactgagtactttcagatgcacacacccttaggggaaggcttaaacaatgactgtgatcaagttaggtgagagtctggggagggaagttctggcctgtgctccaccttatcagttttaggagaaaaagtactaagaatatagatgacttttcacatatcgtactgacttccttgctagagggactgggtaggtaggactcaactattcgaaaattctttgaagtgatgtgaagtttctatatattatgaaagcagggatcatgtctatcaaaatccttattttatctatagcattcaacacagtgcctaccacacacagtagaggtcagtaaacatttggtgaatcaataaacaaataaaagacacttgaccatgagaggccacaatactgagaaattggagatgtttcgcagggtggatgctgctggattcaacagagtttggtactgggagcctcactctctgtcagtttctctcctctgctcaagaaaagggcagaaatagaagtcactgttagctcatctgagaaccatcctcaaaggccaacgaagcagcaacaagataataacgggagattatggaaggggtgtcattttggcttaactttgccctctttaagcagatagaagaactttggacaacaaatgcagtattgccagcaaatgcaagaaaacagcagtcatgatgctacctttcagagaaagtgaaagaggatagcatgactctgatgtaagttcttgagcgtcagacctcaagggatgctggctgaaacacacagaatgataaagtgagatttcgtatgttggaaggagtgtatatcctctcatgtttccaagaagagaactgcataggagaacatactctagaagaggccctggaatgagaagttttaaggaaatagaatctgcaaagagaaggtgggaagagtctgacataatgttgcttggtgctacagtcagccacatccttataggatttagctcttgaatactcctactgtgtagtgactcagtgacagtcaagaatggccagacgctatggctgactcctataatctcagtattttgggaggcctaggcaggcagattatttaatgtcagaagttcaagatcagcctgggcaacatagtgagaatctgtctctataaaaaagttaaaaaaaaaaaaaattagccaggcatggtggcacactcctgtactcttgcagtcatagctactgatgagactgaggtgggagtatcactggagctcaagaatttgaggttacagtgagctatgattgtgccacagcatgagactctgtctcaaaataataataataaggtcaaactcttgataactagaattagaaaaatcaacagaaaaccctgaggagcattagtgagtttgtattcattgaaagtgaatattttctttattaaatcttgtttcatatttgcaaagtcttacaatttaaaatattttaacatagaagacaatttcattttatttcctatatgactttgttcattagaattttgcagtatttgaatagttgactaaataaaataaacaaaatccataaaaaaaaaactgaccttttcaaaagtaaaacttgaaataacatgtaatatttcaccctagaaagcagaaggaaggtaggggaattttgtggctaacacagattgtgttcttcccttttccttccagttacttggtcttataatcagctaaaatgccatctcttgctagactgtaaactcctgaatagcagggtttaggtagtaatttatctgctttcatgataaatttctgcctctaattcactataactgttacatggtagatcttgaaaaactttttaacacatcttaaagttataaattcatactgtaatcagggaagatagtagagaattttaaacaaaagtctttttgtggcttgtgagtccacaaaagtgtgatgctttatatatgtacagactaaaaaaagtttactagtcttaaggctttagggaagttacttactatgttaatatgggcctcagtttttcctaattatacctacctgtaggactggtatagtgttaagttctttttattatagtgtatgctcagtaagtgatggttattattattgatagtcttgcactgataaaacacatggattgacaaaatgtttgttctggggaagcagaaaaaacagatgtaaagttatttggataagtcagtcaaaaagaaaataaaagctcacaaacttcagtcttaaggcagttaattgccatgaatacccttaaatgtttaacatgttgttccaaaagcagcaataaaataaaactgaatgaactttttttttattaaacaagacaaaaagccaaatttgcaagggttgcaagtaccaaaatacttctctgattccagagagactgcctatgtgtccagactcatataaactcaaagttgtgttttgatttctcaatatggtaaagttccatctaatgtcattctcttaacaagctcttttgtaatgggaagtttgtgatttaatagctttagaaatataatgtgatacatgactgtaaaaatgcttgttgattccctacaagctaagacagctctattgtaactaaaacggtaaagtgaattcctcctggcagaagatgatatagatggaaagaggtgaggaaattgattaaatatggctcttttcctaagcagatgaataactctatattgctcgttctgcatgcctataaaataatacaatgaacaatgttgacttcataattgagaacatactcccattttgctaggtataggcaaaagagaaaacacaagctaaaacctcaatatcaaggtaatgtttatagcactatattttcacacttcttgatcagtttaccttaacgtttaatctttagttaggtcaaacattctttattcattatatttttgatgtaaccttccctcccacaaatgctttctaaattgtcactttctcttttctctttcacagagcaagttcccttagaataaagacattaacaaaaaaattatataaagtaccaattaaattatttcctgagatttcctgaaacatgttggaaataggcacctgtatcattgcccagtagaaaataactaactatttgtgggtttttaatggcaggcttgttaaaatacatttaagagaagtatataaatttcttttattgtgttcttccttacttcgccatttatttaaaaccttaattacagataattgagaagtacagtgcttgaacaaatccattatatattatatcaaataataatgttgtttagaagtggtgttaattcttcattcgagcagctatgcctataaataataatcagttctaagccccaagttaatgactatttactcatatgatttgtagaagcctagagagatccaactggggaggcatgaaagcttcactgatgagaaaggtttctgctgtattgtgttccaaaatcccggttagcacagtgccagacactaagtgctcacatgtatgctttttcctaagtaatttatatgcattatcttatttaactattgtgacaactcaatgttgtagatatgaataatattttcattttatttatgggaaaaactgaaggtcatgatttacatcgtttccctaaagacatgttgcctataaacaggtagaggtgggattccaagtatctctgaatctaagccttgaagttggcattcttaacataggccagtaggattcttaggctgtagtttcatattgtttccatctcatctaggtgggaccctttatgccactgcttcatatctccttggattagtcatgtgtatttaaagccatgatttaatggtttccttgacttgaacgaaatatatttgctgaaaaaattgaatgtttaatatttttcccaattcacagggataattaaactactagatgaaagcattttcaatcataaacatttggtgccagctaataaatgctacaatttaacaaaattaatgaaccagcaacagaaatacattaataggaaacttaggatatgatggccttgctaaatcagaaagttagctattacttgttgattccaaaatgaatatttgaagatgtgattttattgtgcatttatacctcattcagtgctaggaatgtttagaaacgggagccataattgaataagctacatgggggcatagcccatctagaactatgttcatttgctaagatggcaaatgttcttcctttgtcttccaagcctcttaaatcaactaaactcctggggccatgccttcccccagtcccattcctatccattttgagtcagtccttccaggccacagtgatttttatcatgcacttcataattacaaaattcttcccccaatccccaaatacctactatgatttgtcttgaaagcttttcaaggctttattaaacttgtagttttatatccagtgtgatacccttccttggcataattccccagctatttaggtcaaaactgttgaagagaaatgaaaaaaaaaaaaaaaaagaaatagtggagaaaacaaacagatgtgccagtcaaaactagggaaatgctgtgcagtttgaacttttaactgttaaggacatttgacagggctctcttgcctctactggggataagtcagaagaaaattatatgttagcaccattttccagtagtatactgtatggatgtatatgtatgtgtgtgtgtgtttatgtgtgtatccagtagaatgtgtgtatatatatacaaatatatatccagtattatatatatatataatatatatctccagtagtatgacggatatctatataacattatatattatatatcatatatgataaaaatattatatattatatatattttattgtgcatttatacttcatttagtgctaggaatgtttagaaatgggagccataattgaataagctacatgggggcatattatataaaaatattatatattatatttttatattttatatataattatatatgtacacatattatcccacgatgacaagtattataatgtatcagtattagataagattggataaagaaaaactgcaggcttttatttgggaaaaaaatttcatgtttgatagaattatctataccagtatcttataatgttccactaaaacaccaatatttacaaatcttattaccctgaataactataggcttactagatgactggataacttaactagttgaatactaggtgcttaatgaaacatgttaagatgcattataataaggggtgtgtgtgtgtgtgtgtgtgtgtgtgtgtgtgtgtgtgtgtgttgagaaaggaggggaatatagtgaatgtgggaccactagctctagggctagtggggaggaggaggctgccaaaggcacagagtccagtcttttggtagcatgggagtaagaactggcaaggatggagaagacaaagacaaaacataaccagcatttcctacgttaacaattttactcaagacaaatcttacattcatttgtttttcttccattagctgatatagatttcactttaggatcaacattagatttgtatcaataccccattatgtactttgaaataacttcttattagtgtcttaaactttttcatgctatccactgagtctagacaaaagatttcatgttcattgtatcactatgtctcatattccaatggaaaataaattaatgatgagtaacacagtgcacgttcaagttatgagtgtacgtatctatttagcaataaagatatggctgatttgtgtcaaaaggcagagcaaactggttgaagtaaatgttaccaaatcctacatcaaaattttattgatgaagataccttactcaaacttgtttaaacaaaaagtgcatgacaaatttaagatgaaattaagcaagcctaatgtctgattataaagcaagaatggtgacatttgaaaatgataagcaatgataagcaaggctgagaatgaactaataagctgtctttcctaaaatgtcaaccaattgcctatgtgatacatcctgagagttttgaaaaaccaccaaatgttaactggagccaaattttcttagaatactgatttaacatcgtaagtgtattttaataaacattataattttatttctgaataacaccttttggtaatctttatgaagtaatattttaagttattattaattagcatttaggcagagtcagacatcacagttgatgggacttcatattattcacccataaataccacacaagtctaacaatctgagactagttcatcgagatgctgtcagtagaatcattgctctataaacttttctaatttttctccagttggcaaaattgcagctagaattttaacacgaagcccaaatctatgtaagaaaaccatcaactctgattttctttatgggtgtgatttcccttaacaatggaatcacttattctgccacatttcacagcctaaataaggaaggtaactcgtggtagtttagttgagctggtccgctgtggtcagacatactttggtataactgccaccaaaatgatgaatgcatggtattattattttcttatcaaatcatgtctaaagatttatgtttaaccttaggaaattggctgcttgccaaaacctcttggttgctgctagagatgttggttagcaggtttgtctaaagcaaacacaggccaaggcaaattttcttccacccacagagtttcagaggggtatatcctgccttttaactgccaggtgaggcaagcagccagactccagtaggcttactaaagcagacatatgaaaaagttcacccactctgaggctagagtaatcattaatctttcaacagaaaataaatacacaagatgaggaactggtagcatttcccagtctggatgaggctgccagatccagaggggtgaacttggctaccctcagtagaatatcctcttccatatctggctccagtgagaccaaggtgggcacatgaaccagagatttagtctcctctatttcctgtctttgttccaggattaatctctctctacttccttttaaacacactgtatctatcctgaggcctttcctttctccattttcacatctatgtttaagagattttagagaaacagagaactgagatgaacttgatcacttctgacacccacattgatgctataattttggaagcaattaaaaatatttaatgactaagttttctccaccttacagctctacttcaagtttttcatggcttgctagaaacaagtcaaggtataaagatctgtgatttactacttccccagggcctgtcttctttatagaagtatgactattacaatattctagttaagtccaaaaactatctctttatctaaattaaattatacatgactctgagactccactaaacagaaaggaggagtttcagtcgtgtgcattattgagatttttttccctctctagagagtctagagatctttagagtcttttatatctagaaagagtatttggtaagtggatcctttggtctttggtccacctggtcacctctgttaatatttgtagtcccaggctgcataatcccttaagaagttgtcaattctctgccgtttctaaaacttgagcactgagattcttactgaggctgacagccttagtgcctagcacactaatatgttgttcctaaatacaccacgcagccttttcctcttaggtatgactgcatgcctgaagcaaggaaaataagagtcctcactactcccagatgctccaactctgacctgggtccaataaggacctatcttattcacaaattctattcctccctctcctcctctgggcataaactctcaacatttaggatttagagaacaaaatccaggaagaagtcgagcaactttctctttcagcctatcacaacatatgctccaaagacaaagaagcccaaaggcctggctaccatctgggaatttgcaagtatgcaaataagaaggacaaaacagaaactaatatctcatattaaacaatatttcatctccaaccaaatagaaacttttgatactggaattctacataatgaaaactcaatttttgagttatatggaaacattcatatcaacattttataccaatttatatttgtatagctctttaattgacattatactttaacatgttatctcatttaacgtctcaacaaactagcactactcttatctctattcaagcacaacttttacatatcataaaggctatttgctaattataaatggaacagcccatccatcagatggacctgagttagagtcctggttttaccatctattagtctgattatcaaatccaattatgcttttcctgtctttgacatttgtcactattttcctttacacacaaacatggcttctttaatgatttatttttcattttaaatatacttttatcccattcgtatcattaaaattgaatggaacctgtgctcatatttaggtatttcatcaatttccattgaatcattattgtctctgtatctaatgtctaactcaccttttcttaattctatatccataggacattttcaccaatattactattaaagataaacagtaaaatgtaaacatgtaaaaatgactttatccacttattttcatcttctgctagatcccagacaagtatactaaaagttctaggcttcctcatgagtgtcagcaacatgagtgctttttcatttttccataatctaatcattatgaggttaaacccattctttcttcccttttcttctgtgcatttatggccgtaacagtttcagctcagcaatgaatggcaaataatcatatttaggagtttcatttccaaaatcaatctttttctaggttaaagcatccacattattaacattggcatgtcaaaataccctcgtctatcctgcagtaaatttctttagtccataatttttgcaatgtaaaaaccacagttttatttacgccatttgaggttacacaaatcaatccacaaaaaaatatgttaaagaaacatcgtaagccaagaaaatcaactgtcttcattcatctaatctgcttcgatattaaacacatatggtattgactatataggtcgcctatcatttagagaacggataacacccacattcacaattgctttagacagatggtattttgtgttgatccaaatccttgttttgaagaactaatcaaattgttatgatcttacaatggttattctatccatttccagtaagctaacttctgaattcctgtgcatgtgtgtggcacccagtgatatcagtggaatgctgacatatatagtaaggcatgaacaggcattacttcatttcaacattttatatgagtctgctccaattaggggaaattagggttgttgctcttccttcttcaccattgttgatttttaaaaaattgtggcatatctttttcaaaaggtaaacaaaataatacattctaaatgtaaatgagaagctattatctgacattcatttattgagaaaacacatgccatttaaagagaatttttgttttgttttgtttatattacagaatatccaccagttttagcatcttactctattattgtatccattattttatcatctactcatcagaaaattcatttctatatcaagaagttctgataagatgaccaagagaaactccaaccatttcctggaatcattaatctgtgacactgtacaagagagttggtaaatatatgagaagtcccacacatcaacaagaaaaatgcaaacatcccactagaaaaaataggcaagaaatatgattagactttcacaaaagaggacatacatttcaatacacatataaaaagttttcaacctcattagtaataaaagtataacataattaaaacctcaatgagttattttagatgcatcagattggaaaaaaattaaaaatcaaagtactaagtgttggtaaacatgtggatgaaggggaatactcacattgtctgttggtagaactataagttgtaatagcctttggaaaagtgtggcattatctaaacattcatccatataccctatgacctaccaattcacttctaagtatacacactaaagaaatggttttacatgtttctaataccaaaaaaaatactgaaaacagcctaaatgttcatcgaaagaaaagtggctttatggacttacgaatctggcatataatcaccatgttggaaaaataacaaaatatagctactctcaacagtgtgaaagagtcttcaaaacttcatattgattgcaataaaaacacatagctgaaaaacacttagatgataatactgctattataaagtaccaaaccaagcaaaatcaaactatttaagaacaattttttaaacaaaacaataagagtgataaatataaaattcaagatagtgataccccttgaaaggaatgaggaggatgagacagagagagaacacacaggtagatgtcacagaacagtgaaggttttagatctttaagtgtgaaataggctcacaggtatatatgttttatgatttatagtataatttactcatactaaaacatttgaatacatgaacaataacagaactcagagcatcattttccttagactttttataaaatatgatcaataataatcttggagcagactttcccaggctcaacactattgacattttggctcagataattttttggggtgtggggctatcttgtgctttgcaggacatgtagcagcatccctagcctctacctgctagttgccaatagaaagctcccagatgtgacaatcaaaaatgtctccaaatatagaacataaaaaacctcagtgttgccactattagacgcactctaacatctacacattatattttatattagacatatttttaattgtcacaatgtctttgtattatacatgaaaaatgactcaaaagtctgcaaataccatgcacttttaatgccctaccatagttctgaccctgaaaaacatatatactccctcactctttcataaacttgcacagattattttatcaggaatagcttctgtctctgcttaggttactgccgtcctacattgttgcaggaagtcagggaccctgaacagagggaccggctggagccacggcagaggaacataaattgtgaagatttcatggacatttatcagttcccaaataatacttttataatttcttatgcctgtctttacttttatctcttaatcctgttatcttgatatgctgaggatgtacatcacctcaagaccactgtgataattgtgttaactgtacaaattgattgtaaagcatgtgtgtttgaacaatatgaaatcagtgcaccttgaaaaagaacagaataacagcaatttttagggaacaagagaagataaccacaaggtctgactaaccgcggggttgggcaaaaagagccatatttttcttcttgcagagagcctataaacagatgtgcaagtagggaagatattgctaaattcttttcctagcaagaaatattattattaataccctgggaaaggaatgcattcctggtgggaggtctataaatggctgctctgggaatatctgtcttatgcggttgagataaggactgagatacacgccctggtatcctgcagtaccctcaggcttactagggtggcgaaaaactccaccctggcaaatttgtggtcagactggttctctgctcttgaaccctgttttctgttatttaagatatttatcaagacaatacatgcactgctgaacatagaaccttatcagtagttctgcttttgccctttgccttgtgatctttgttggacccttatcagtagttctgcttttgccctttgtcctgttccctcagaagcatgtgatctttgttagactcttattagtagttctgctttttgccctttgaagcatgtgatctttgtacctactcctgttcttataccctctccccttttgaaaaccttaataaaaacttgctggcttggggctcaggtgggcatcacagtcctaccgataggtgatgtcacccctggcggcccatcggtaaaattcctctctttatactgtctctctttatttctcggccagccgacacttatggaaaatagaaagaacctacgttgaaatattgggggtgggttcccccaatactgcatagtctctttcctcctccatacatccatgtataactccctacagtcctccacttagcagtcatccacactcacaattttagtctctttcctcctctatgcacccacacataactccctacagtcctccactttgtactcatccacatgcttacaattttatacatatatacaaacagatatagatacatatatacacatacatttgcacactcatccatctggtttcttccagttaatttcctcagggctagtaccatgctttcttcaattttatattaccaaaccttagcttaatatctggcctcggtgagtaatcaatacatgcttgttgaatatatacggatgaataaatgaatgaattaactttggggcttttagggacctcaaaacaactaactagggttaactaaaaggttttggcattatttttgttcaaaaattaacattttgtttaagattttctttttatatttttgtaagtttattttcacatagacaaagttgtcaatcctagttcataagtcaaataaaaaaatcttcagtgactcattgaagagctatgtgtctctgttaggtcaaaatgtttatatttttattatgtaaatttccaaaaatatgcaagagttgagaggctagtactatgaatctatactcacctatcattcaaatctaaatgttatcaagattttgctctaattgctttccctatcctttttaactttttaaaaaatttgctgaattattaattcaaaagcccatttatctgaagtatttcattgctgcatacttaagtatgtaatgctaaaataatttaatatgttaagaatatattctcatagttacatatttaaaataagaaatatgtataatgagttgtttacagcatgtgtttaccctaaattcatgtacattgtacatggattttcacctttttatatttttacatttcatgaccaaagtaacaattactgattttctatttaaaaattggtatacaaaatccatactatcttctaaaatttcaacagtaatcttaaatcaggattttcaaacttcaaatagtaagcaatggaaaaatgagtcctcatagaaaagttgaaaccaaatgacttgaaatgaggtagcactcgtattcctccaggcctttgggtaaagatacgtgcacgcaatactgctttcgatttctacatagagctaagacaatctttctgaccgttctagagatgtagacacattcaacaaaattggagaggaaaagatgataggggcagttttttttaacccagtgtacaaaagagtatgtcaacagtttccaaatgtagtaatgtaatatcaaaagaagaaaaagtctcctttgaatttttcttttcaattacagaacatttactttataacaagattactaacactttaaagacatgtgcttctctctgggtgcggtggctcactactgtaatcccagcactttgggaggccgaggtgggcagatcacgaggtcaggagatggagaccatcttggctaacacggtgaaaccccgtctctactaaaaataggaaaaaattagcctggcgtggtggcgggcgcctgtagtcccagctactagggaggtagaggcaggagaatggcgtgaacccgggaggcggagcttgcagtgagccaagatcagaccactgtactccagcctgggtgacagagcgagactccgtctcaaaataaataaataaataaataaaaatggaaaaaaaaaagacttgtgcttttcatagaaacaattccatttaatagaaacaatttaactataagtgcaggaattattcattatagagaataggtgcagtcttgaatttcattaagtactgcttttcttactattatttattgtagaccaaaaatgcattttacccaaaaataaaaaataaaaattcgccctgacctgagatatagaagtaaatccatctaatgctagcttgctttctgcatcaaaaagttgaagtgtcccagacgtcaccagtacataatatatgcatgtaacacaactgcacttgtgccgctaaatctattttttaaatgttgaagtgaattgatgtgttacttttttcttttttctctctcccatttaaataggcttaaaaaataaagcacatggtagaagtcacagcatttaattgtctcaccataaagataaaagcatgtgttttattagataaaattgtcacatcctggattattcctactctctatgctattcatctacgactttctcccactagaggcaaacgtattttccatgtctacaatgaggcttaaagaagttgaggtaaagtgtgattgcgatttgcccatctcttgttacaaatcagcaaatcaatagactcctaatatttggagaaaaaaggtacctagaaatgctccagcttaattctttctaacaattggatctgtctggcatcttcatgatgccttctaatttttttctctgaacatactaatttattttatactttagcaaattctatttgctgttccttgattcaaattcatgctcggtagcatgggtcagctcattattatcctctcatccatggacatttaagaactaagaatgtggagaccttactaaggaatttccacacagagagggtctatgtcatacctccagcattttctctgacaacctctttttcaaactgtatactttttaacttctgtttttgctccatataattgcccttaatccaaattctaataaatgagaaagcactaactgcattttctctgttctctttccagtataacaggaaatgttcataaacatttatatgtttacattatatgtttatgaacatgttatacgtttttatatgttcagaaacttactgattttcatgtaggtaacatgaaattgttttttaaaaaggacattctccctccactgcctgcacttaccttcgctttttgagataactattgataatactttagcatatatctttggaaaatatgctttccaggttgccaacgactttgcatagatattacatatgtccatgcaaataacctgtattatcaacactaaatgcctactgctagtattagtcattcattcaatagctatatatggagccccttattaaatgccaggtcgttttaagagtcataatacattagtgaacaaaacagacaatgattcatgctatcatgtatgttacatttcgtgagaaaattgtgtttagaaaaagacctagacattgaggggccagggaacaagttgtcaattttaatgactatatcttgtttaatatagtataaacagtggaagcatttgtaggtacaagtagcaggcatgccataatggtgtagattgccatctggggatctcaagtaaattattataagatgcaaatttataatctgacttaggaattagtttactgctacagcttgaatgtttgtgtcctctccaaaacttacgttgaaacttaatccccagtgaaacagtattaagaggtctggtcattgggaggtcattaggtcatgagggttctgccctcatgaaaggattcgagccttacaaaagggctggaggagacaagtcaggccctttctggcccttttacctttccatcctcaccttggacttgtgaggacacagtgttcaaggcaccatctcagaagcaaagactaggatcttaccagacaccaaacctgccagagtttgatctttgacttccagcctccagaactaagaaacaaattcatgttctttataaattacccagtctcaggtattttgttatagcagcataaaccaattaagacatttacagagtttataaattactgaataaatgtaaggaatataatatattgaagatcaaaagtcttatgtcaaagtattttatttgaaaatgaatattctttttattactaaatttatgtaacaagtatgtttataatatttcttcaattaaatgctttggcattaaaatgaaccttactaatttttactgtacagataaaaggaatttatatgaatctataaaaatatataaaataaaaattattactattatgcttattaaaaataagtatcaacataaatattgatcaataattcaaactaattaacaaagcacatcaaaataggattttattttaatcaatgctcttattatggtaaaacaactaaaattaatttataaacgtttcagtgttcattatttccaatgtaaaaatattaaaggaaaaccagttgccaaagatcttttcattaatattttaaactaatattagttatttgaaacaaagcattagttaatatttgacaaggtattcaaaaaatcatttcacaggtttttataaattaaaacaatgaatttaactctatattatgtcagtaaagatgctaacaattacacaaagaaaatatattcctccttcctaccgattctttagaagaatgagattactattatcagcagcttatgtctcgacttcagcctaacagcaagctagctcaatgtgcatccctctaagaattgctctaagaattatacttggaagaaggtaggaagcaaacttcagttttattcctaggtataggacattagcactttgtccaaaatgtacacaataggcttccaaaatatttagcttctcatttgcacatatgcccaagaaaggctgtaaaacccagtacaatggcttttctatttgaacatgatccagaaggataaatgttccttctgtgtacccaggttataggaaacatttgaggaccttttccaattaagttatccattgatttgttgtgtaacatatattcctaataatagctttcataatatttgtaatttaacaatctgggagaggagatacaatgtagtaaacaatttcagtaaatggtggggcaaagccttgagataactagagatgtatatatattttttaaagacaaagattggaagaaatcaccaaagatgccatgttctgccacattgctgtgagcaatgattcaaataattatgtatgtgaaaaacataccagccttgatttttcaaaatgcacatttttcatattgtttgaatttacaggaactggcaccaaggttttactgaataattttgtggtctactgtgctactggtatttggtttcaaaagacaaatacaggggtgcttaaagagcatttatttagtaatttctctttaaaatttaaactgtgtcatttcaggaggaaaacagaaataaacatccatttttcaaaaagtacagttgtcaaattatgaaggaagaagaaaataatagacctattaatatcagtaaagatgtattccagatgcatttttaaaattatggttacatttcagatatgaaccaactattttagtatattttaataaaaatatggctaagaagcaatgctacaatgacaaaccacaataaaatgagataataaaactactttaacaacctaatattgaaagattaaaactcctaccttaagtgttattaggaataactaatagtgtgtcatgtcactacaaaaatcaaatttttaacaaatacaaatattttagtgaaaaaagaaatacaatataaatcaaatataagatttaaatttggctcccctttttgctttccctaaatggctaactctagctaactcatcaattgaaaatgatgttttttgacctttttcagtccatacatttcaaatagagtataattttaaccagctacattgttggctgaagattaaaaaccattttggtgttgtgttaattataaataaagcaccaataattggtgctcatctttgactggatcaattttgatgtagcaggaacagtattggacttggagctgagaacaagtccaaatctttgctaggacagttgctaactgcaggagttcaacaaagctacctgcttgagccttggtttcttctcccatagaaggatagctttaacaaatggtatttgacaagattgaaaggtgatatatacaaggctccagcattgtgcaaccataaaaagtcatggaatggaagtcatcttaaatgttttgttatatccatatttgttttaatattctaagtattattactgtcaggaaataacacttttaaaacaggagaaaaaatagtagtgtcagacatctcacagaagaaggtattcagatgacaaatgagcaaacgaaaagatgctcaatatcatctgtcactagggaaatgcaaactgaagcaataggatactgctacacacctcttagaatggccaaaatccagagtactgacaatatcaaatgctggtgaggatgtgaagcaacaggaactctaattcattgtcggtgggaaggcaaaatgagacagccactttggatgacaatttggcagttccttacaaaactaaacacattcttaccgtacaatccagcaattgcactccttggtatttacacaaaggaactgaaaatgtatatccacacaaaaccctgcacactgatgtttataggtgtattcagaattgctaaaacttggaaacaatcaaaatatccttcagtagatgagtggataaaataactatgctgcatcctgacaatagaatgttaccaaacaacagcaacaacaacaaacctatcaaggcatgaaaacacatggaggaatcttaagtgcatgtgaaagaagccaatctgaaaaggctacacactgtatgattccaactatatggcattttgggaaaggcaaaacaaagaacacaataaaaagatctatagttgccagggactagtggtgggcgggctggggatgaataaatggacaaaagaggacgtttagggaagtgaaaatactctatatgacactaacacaatggatatatgtcatcatgcatttgtccaaactcaccgaatatacaccagcaagagtaaaccctaatgtaaactatgaactttgggtgtcattgatgtgtcaatgtaggttcatcagttttaacaaatgtacaactctggtgaagaatattgataagacgggaggctacgcatgtgtaggggcggggagtatatgagaaatctccatatcttcctcttaattttgctgtgaacctaaaactgctcaaaacaaaacagttgttttataaaaacatagtggtgtcttgtccagctcatttaactgcttttcatgatgaaaactgataatgctaattattcttatccatagaaattcagagaaattttgtgtgattatatagaatttattattgccttgtggatagatatgttttgcatctatttgtaaattcatttcaaaattccttatttcctatgcatgtgtggttcttagaattctcctttgaactgattatatcatcttactagctttctctttagtaagctaaataaattttgataaatgtttacttaatatttatatgagatgatattttagtcttaaaaatcctttaaaaatagtctccatttttaataaactgtgtgatctaggtgccaatgaactttgccatcagaaaataatttttcagaagattgctttgagtataggttatcatacttatcatactttttaaactttcatgctaaatatctttataaagtacgtaacagattttcaaacatatggattggggtaaacttattttgtcaattatataacactgctttccaaagcatagtttaaaaaaatcataaactatgattcaatttcctggaatttactaatttagaaatcctgaagacattataatatgtgatcatggaaatgttagtgccctttttttgcatccattaatagtgctaagaaagtacaaatgttctaacaggatttaaaaaaccaacaggttttcaggaatttgtatttatcaaattgtgcacaatattgccaatgtgaaaataagttaatgagttgagaattagtcacggtttttcaacatgaaggatatgaaaacgcaccttgatctctataatcatctgttttaagtgagatttaattttccacaaaataatacttgagtttattcaagtaaaaaattattcatctttctattctccatgtgcgataaaatgtttcccatagggttctcctgattgccttagaaatctgactacctatcttccttccaaaataatttcactgtagacttttcaggtttttgcaaacacttcaattttctctttcctgttttttgcctgcctcctaatccctaatcatattctttcctctggcagaaaactttgttcttaacaccctgccctcaaggaatcaatggctgctttgagttaagctgctttttttaagcatctgcccttttcaggagtgccctattacataatctcatgcgctctcatagtaaccagctgatagcattttcaattcactttgaaaattgtatgtcaatcttacctgtagctgcatgatgacaaactgactttaaaagttagtctattcatttgaagtaagtatttcaacaatatgctaatgaaaatgatattttaagatatccttttactcacatcaatagcatcactaattttatagttaacacatagaaatcttgaaaatcagactttttagcttagatgagtgtgaaagtatactacataatatctaaagattgagttttcaaagagtttttggccacagaagcccttttgaaagaaaatcagacacgaaatccccactaaattcactattgatttggagggcgcatgtattcaatggcttatatcagattcttatgtacacaatatgtaaaatacaatgccaaaagataacccagcatattcataagtctgacattttagttcaattggatacgtatatttgaaatgaaaacctttcaaaggaaacatttgaaaaggatttctatttttttaaatctaaaagcacagagttttcttaaccttaatttaaaatggaaaactttaccttgaaggatgatttttggttacagagatacttttgcatttttttgtgatttttttcagttgagagtttcaacttgaaaatagaaaaaggcctgatattttccaaaactgactataaactgcatttgtataatgtaattgagagtcaatatcttttcccaccttgctctggctcctgccaagaggcactcagaatcccagatatactttcagggctacaggtagtggcagccataggaaggctttctgaacttcctttttatttatttatttatttatttatttatttatttatttattttcagttgtatgtgtgatggaaccactatatcaagagcgctatcttctaaagtaatatcctcccctagctattccctgaaattggcagacatggacagttaaagcaggatatctttatcccagagaaactttcttagacagcctgttcctctgtggcagaggaaatttggttttaactgaacctggcttctaagacctttacaagtggctgtttgcaaattattccagggaaataagtctttaagtcctagcctgggctttttagtagcgcgaagaagaatcatatccaatctatctccaaaaaaggagagagaggtaagagttattgtgcagatactgaaaaatctcatcagaatcccaagaggaaacaaaataaagctaccttcagtggcacagggaagtcatctgaaacagaccagttgccttcaaggatgttgttgtatcctctcagctctattctcctttctactaccgactcccttgtttactcataattttcactgtctcataattttggctgaatccatttactcattcacttcattgttccagtgtctactgtagacaggcatgctctgtttctgcctctcagttcagattcctgagactcaggatctgatcattggccagcctgtggattgagtaaactatgcaatcaagaaggttatcacagatacagcgttgatcaacacagacaaactctctggcctcatgcagcttatggtgtcatgattatcacctgtaatagaacatggtcacttaaaggcagaaggactgtggctatgaatcagctagagaaatagcattcaacaaaatacatttctctgtagcttattattttgccattgctttacctctgccactactgttagtattattgcttttattgttctgatgaccttttatactcaaatgctgctacttttaaccagacatactccatgttaatgcctctcacaggtggtctctggaccagcaacagcagcagcagcagcagcagctagggatttattagaaatgcaagttttagagttttatcccagacctacttaatcagaaactttggagtggggcccagcatgctgggttgtatcaatattctgatgcatgccaaaggtgagagcccctgctcttatgccttcaatccaaatatgttagtctgcctttattccacctgcctcctagaaacttaaatgagttattttttaaatttttcataaatattgagtcatatgaaaatatatggctgttaaaaatgattctctcctctccatttagccttcctttctctaaacttagactctttccattaatcttcctcctgcccataggagtcaaagctgttgatccactccaatttaatacctgtctgaaatggtgcctacaattcacttcaccaaaaaataaatataattaatcaattttaaattttatatgaaaacatttcaactaaattgaccatttctccatttctcagccagttcaactgattgtgcatgcagatagttgccaaataagagctgtcaaacttcctagaattccatatagaagccgataatggaaatgtaataaaatagaggattaaaatattgtatccaaatgggcagtgaactcactttctctaaaaagccattattttacatagtctttagaaatatattttgcaaataaaatcattttttaatattaagcataatttgcaggacaactgttctgcaagaaattaaaaacatgaaaccctgtccctattaaaaacacaaaaattagccaggcttggtagcacgtgcctgttagcccagctactcaggaggctgagacaggagaatcacttgaacttgggaggttgaaggttgcagtgaactgagatcatgtcattgcactccagccaaggtgacagagtgagagtctgtatcaaaaaagaaaaaaaaaatcttgaaaacacattccttgaatgccatggccaagttttactgtgtcagtgttctctattttgtactgttgttagtatattttaaaaagttttccatcaatacataaccctaatctttactaaaatattttagtaaacattttgctctttagtcactgttgttgctaacagttaaattaatcatttacacaatcactctttctcccaattagctgtcagatacatgggagtagaaacttatctgtttttttaacttctataactttaacacctgacttggtatctgacttacatttgttgttcaaaatatgtgttcaggaatgttgtaataggaaagatgacaattacatggttggctaaaaaaaggatacaaataattttttaaagaagaaagtaatgatgggttttaaaagttttatggaaggagatagagacatgaaaaaccctccaaaaaatcagtgaatccaggtgctggttttttgaaaaaattaacaaaataggtagaccactagccagactaataaagaagaaaagagagaagaatcaaacagacacaataaaaaatgataaaggggatatcaccactgatcccacagaaatacaaactaccatcagagaatactataaacacctctatgcaaataaactagaaaatctagaataaatggataaattcctagacacatacaccgtcccaagactaaaccaagaagaagttgaagataaagaaagataaagaaaatgcggtacatatacaccatggaatactatgcagccataaaaaacaatgagatcatgttctttgcagggacacggatgaagctagaagccatcatcctagcaaactaacacagaaacagaaaaccaaacactgcatgttctcactcataagtaggagttgaacaatgagaacacgtggacacagggaggggaacaacacacaccagggcctattgagggatggggaacaaggggagggaacttggaggatgggtcaataggtgcaagaaaccaccatggcacacgtatacctatggaacaaacctgcacattctgcacatatatcctggaacttaaaaaccagaacttaaaaagaaaataaaaagtattatgcattcagaatatatccttgaattaatagcaaatgtatgaagatttaatgtgctttctgatcttttatcaatttgtagatggagtattcagaacatatatttaatatacaaacttaaaaattgttttttagaagggacttgagggtgtttctgctacagcttccttgaccaaaggctacagaataactacattgtccagaaaaaacagctatacgtgttttttccagtttctaagggtgaaaattttatgaccttctttggaattcttgcattttatcttattggcaaaggagttcctacttttgccatcacaagacagcttcttaatttatttcttttaaaaagtccttttaatagaattgtaaatcttaccatcattcaattttacaacacatataaaaattgtatataatttatacacttccttacttaccaatgtttccactctttttttttttttttttttgagatggagtctcactctgttgcccaggctggagtgcagtggcactatgtgggctcactgccaatctccgcctcctgggttcatgccattctcctgcctcagcctcctgagtagctgtgactacaggcggccgtcaccacacctggctattttttttttttttttgtacttttagtagagacggggttttaccgtgctggtcaggattgtctcgatctcctgaccttgtgatctgcctgcttcggcctcccagagtgctgggattacaggcgtgagccactgcacccagcccaatgtttccattcttttgcactaaacatatcaaactcttttaaccctttctcgtatgctgttattgcaaccttataatcaatgattgactcttggatttgctcatgttttctattttcatatgtgagattactatttcagagtagttcacatattttaactcttggccccattatcatatacaatttttaatatgacctaatatggtatttggctttttttccctccaagagtagtgaaatacttgtttactttcagcctgtaggtccaaaacaatctcatgccatgaaacctaaacggtaatctcctagtctatgttgttggtgttatttgtcccaacatacttacgttttctaaattttaacatgttttgaaaaattacttttccccttaagaacataatctggaagctaaagaatgatatccaccaacatgaaaccacatgaaagtttaaaacccactgccagagcaaacacacaaataagaaatagaaaggactcaaatattaccactacatgaaaccaccaaaccgcaatgataagaagagagaaagaaggaacaaaggacatataaatcaaccaaaaatcaattcataaaatgacaagaataaaccctcacatatcagtaataagctttaatgtaaacatacaagttttccacctaaaatatataaattgtatgagtgaaagaagaacgactgccttcaagcaatttacttcatctctccagatacacatagacaaaaagcaaaaggatagaaacagaaattccatacaaacagaaacaagaagcaaacaagggtagctttgcttactcagataaagcagactttacgtcagaaacagtaaaaatagatgaagaaagccattatatagtgacaaaggaatcaattcagctagaggatgtaacaatcctaaacgtatatgtgcccaacggtagaacacctagatatataaaacaaatattagatgaagggagagatagactctaatacaataaactttggggacttcaacacctcactctcaaccttagacagactatttagacagaaaattaacaattaactttggattaaaactgtacttttaaccaaatgaaccaaaccgacattcacagatatttcatccaacagctacaaaatatacattcttcctatcagcacatgaaacattccacaggataggccatatgttagaacacagagcaagtttcaacaaattttcttaaaattggaatcatatcaagtatcttctgagatcaaaatggaataacaccagaagtcagtaacaagaagaactttgcaagttttacaaatacatggaaattaaacgacatgctcctgaatgaccattgagtcaaagaaaaaacttaaaaaatttttttaaatattattgaagcaaatggatcctgaaacataatatacaaaaacctgtgggataaagcaaaaccagtgctgagagcagtttataacaataaaagtctacatcaaaaaagtacaacgattttgaataaacaatctaacaatgcacctcaaagaactaaaaaagcaatattaaaccaaacctcaaattagaaggaaagaaataataaagatcagagcagaactaaacaaaatagagagtaaaatatacaaagaaaataaaaagttgttttttgaaaggataaacaaaattgataaactgctagtctaatcaagaaaaaaaaactccaataaataaaatagacaacaataaagttacactgcaacttatacaactgaaatacagaagatcataagggattattatgagcaactatatactaacaaactggaaacctagaagaaatagataaattcctggatacatacaatctaccaagattgaatcaggatgaaacagtaaatctgaaaagaccaataaagagcagtaagactgaataagtaataaaacatctgccaacaaagaaaagttgaggacttaatggctccactgccaaattctatcaaatgggtaaagaactaacccatatttccctaaactattctgaaacattgaagaggaaggtattctccctaactcattctaagaggccaacatcaccctgataacaaaaccagcaaagagtcgacaacaacaaaaatccgtaggccaatattcctgatgaacgtagatacaaaaactctcaacaaaacactagaaaaatgaatccagcagcaaataaaaaatatagtacaccatgatcaaacatgatttatcccaaggatgcaaggatggattaacatatgcaaaccaataatcataatacataacatcggtagaatgaagcacaaaagccatgctcatctcagtagacacagcagaagcatttaataagattcaacatttctttgtgataaatactctcaaaaactaagcaaagaagaaatatgcctcaacataataaagtcacatcatgacaaatccacagctaatatcttacagaatgagaaaaaagctgaaaacctttttctctaagaactggaacaaggcaaggatgccctcttttactcttcctagtcaacatagtactaaaagtcctagtcagagcaatagacaagaggacaaaaagaacaacaaaagggatctagattggaaaaaaggaagtcacgttattcttctttgctgttgatatgatcttatatctagaataacctaatatttcaccaaaaaacctcctagatctgaaaaatgaattcagtaaaattgcaagatatgaaattaacaaactattattaaagtagtagcatttctatataccaataatgagctaactgtgggagaaatcaagaaggcaatccaatttgcaatagctacaaaaaaaaaaaaatcttataaataaatttaacctaaggggtaaaagatctctacaaggaaaattacaaaacactgatgaaagaaattgaagaggatacaaacaaatggaaagatatcccaagctcattgataacacactcaagaacatactcatcccatagacaagacaatataaagcaattacataattaagtccacaaaacaaccagctaacaacaaaatgacaggatcaaaatttcacatatcaatactaaaatattaaatggtctaaaagctccacttaaaaggtatagagtggcaaactggattaaaaaacaagacccaactctctactatcttcaagagacccatctcacatgtaacaatacccacaagctcaaagtaaagggacagagaaagatataccagataaacagaaaacaaaagagagcaagagtcattattcttataacagataaagtagatgttaaccaacaacaataagaaataacaaaaaaggtcattgcataacaattaaggattcaataaacacgaatacataactcttctaaacgtatatccacccacgatcggagcactgagattcataaaacaagttctccttgactatgacagccacacaataatagtgggagacttcaacaccccagtgacagcgttaaacagatcatagagacagaaaactaacaaagacattctggacttaaactcaatgcttgacacactggacctaaaagacatctacagaatactccacctaacaaccacagagtataaattattctcacccatacatggaacatattctaagatcaaccacattcttggtcaagaagcaagtcttaataaaatcaaaaaatcaaaaccatagcaagcatactcttggacaacagtgcaataaaaatagaaaacaatacaaaaagatttttcacaactacacaaaaacatggaaacttaaaaatttactcctgaataaatcttgggtcaacaagaaaactaaggcagaaatcaaaaaattctttgaaattaataaaaataaagacacagcttaccaatatatttgggatgcagctaacgcagcgttaagaagaaagttcatagtgcaaaataccttcatcaagaagttagaggccgggcgcggtggctcacgcctgtaatcccagcactttgggaggccgaggcgggcggatcacgaggtcaggagatcgagaccatcccggctaaaacggtgaaaccccgtctctactaaaaatacaaaaaattagccgggcgtagtggcgggcgcctgtagtcccagctacttgggaggctgaggcaggagaatggcgtgaacccaggaggcggagcttgcagtgagccgagatcccgccactgcactccagcctgggcgacagagcgagactccgtctcaaaaaaaaaaaaaaaaaaaagaagttagaaaggtctcagactaatgatctaacatcacacctagaggaactaggaaaaaaattagaaaccaagcccgaagttagcagaagaaaataaataactaaaatcagaggagaactggaaaaaaatgagatgcagaagtccatacaaaagaccaatgaaaccaataattagttcttttaattggttctttgaaagaattaacaatattgatagactggtggctagattatcaaagacaaaaaaaaaagaagatccaaataagtgcaatcagaaatgataaaaagccattacaactgagcccacagaaatttaaaaaaagatcctcagagactattataaatacctctatgcacacaaattagaaaatctagaggaaatgaataaattcctggaaacacacaacctcctggttgtgtgaaccagggatggaccaagaagaaagtggaaacctgaaaagaccaataacaagttgaaatggaatctgtaataaaatcccaccaaaaaaaaaaaaggaaagaaagaaaagaaaaaatcctggtcagatggatttgcagccaaattctaacagatatacaaacaacttataccaattctactgaaactattccaaaaagttgagcaggggctcctctctaactcattccacaaagccagcatcattctgatgccaaaatctgccagagagacaatgaaaaaagaaaacttcaggcccatatccctgatgagcatatagatataaaaacttcaacaaaatactagcaaaccaaatccagcagcacatcaaaaagttaattcataatgatcaagtaggctttattcctgggatacaagtttggttaaatgtacacaaatcagtaaatattattcaccacccaaacagagttggtaacaaaaccatatgatcatcttcacaggtgtgaaaaaagtctttgataaaatccaacattcttgcatgataaaaaccctcaacaaaccaggcagcaagaaaacatacctcaaaaataataagagcaatctatgacaaacccacagccaacatcatactgaatgagcaaaggctggaactattccccttgaaaactggaacaagacaaggatgcccactctcaccactcctattcaacatagtactggaagtgctagccagaggaatcaggcaagagaaagaaataaaaggcgtccaaagaggaaaagaagaattcaaattatctctctttgctgacagtatgaatctttacatagaaaaccctgaagactccaccaaaaggctcctagaactagtaaatgacttcagtaaagtttcagggtacaaaatcaatgtataaacatcagtagcatttttatgcaccaaaaacattctagatgagagccaatcaagaacacaatcccacttacagtatccacaaaaaaaatgaaatacttaggaatacatctaactaaggaggtgaaagatctttattatgagaattataaaacacctctcaaagaagttagagacaacataagtaaatggaaaaatattctatgttcatagataggaagaatcaatattgttaaaatggccaaactgcccaaagcaatttacagaatcaatgttatcctgatcaaaataccaacataatttttttttgcagaagtaggaaaaaattctaaaattcatattgaaccaaaaaaagtgtatgagtagccaaagcaatccaaagcaaaaagaagaaagctgtaggcatcacattaccagacttcaaactgtaccataaggctacagtaaccaaaacatcatggtcctggtacaaaaacggatacactgtaatcccagcactttgggaggccaaggcgggtggatcaggaggtcaagagatcgagaccatcctggccaacatggtgaaaccccgtctctactaaaaatacaaaaattagccaggcatggtggcagccgcttgtagtcccagctacttgggagtctgagacaggagaatcgcttgaacccaggaggcagaggttgcagtgagctgagatcacgccactgcactccagcctggagatggagcgagactccatctcaaaacaaacaaaacaaaacaaaaaaacaaaaaaaacagatacatagactaatggaacagaataaagaacccagaaaaaatgctgaacagctacaaccatctggtctttgacaaagttgacaaaaataagcaacggggaaaggatttcctattcaataaatagtgctagaataactggctagcacacgcagaataaaactggacatctattttttatcatatacaagaattaactcaagatagattaaagatttaaatgtaagacctcaaagtattaaattactagaaaaaacaaaaaaaacaaaacacggaaatacccttcttgatatcaggtttggtaaagaatttatggctaggtactcaaaagtgatttcaagagaaacaaaaattgacaagcgagactgaatcaaactaaagaacttctgctctgcaaaataaattatccatagagtaaacatacagcctacagcctacagacagcctacagacagaaaatattcacaagctatgcatccaacaaaggtctgatatccagaatctataaggaacttaaatcaacaagcaaaaaacaaataatccaattaaaaatagataaaatacataaacagtgtcattgtcatttttattgtcatttttattttattattttatttattatgattttgtcatttttattgtcttcagtattttttcaactatcctaatattgaaattcatattttcatacactatcatatttaataaaattgaaatttataccctatgacaaagtgtatgtaaatatatacaaatgtataatttgtcttaaaaattttcataggaaatattgatattgtccagcaaagtttgcaattccggaaatggaggaaaagaatcttgtttgtttctatcactattctgaaattatctggtcagttataaaaataacaggaggataaaggcatttttattgaagcataaataataaacatctttgtaattttcttcattatttgcaattaaatcttcaaaattagggcatttcagattacttaatatctattgtgtaagtttccttgccttacctttttagggtaactactaatcataaatagagaaaggtctacatgtagacgattcatggtattctttatagtgataataaaaataactgcttattatatatcagatactatactcttcttggatattcatttttatcagaaaaatatttaattctttataatactattttctttagcattttatataataaaataattttttaaagctctaattaatttattactagctactgaaaatcatttataaaaatattaatattttgagaaaggcattaaaaatggactaaaatgtaaatttcaaaaatatgctctctttaatctgtgtaagtgcttaattttttatatgcaaatattaacactgcaatttgatcttcaaatactatccttgactttttctcccaattcttcactaaatatgaatgcaaaccaaatcctgaaggatttgcattaaaaaatcttaatgcagaattttcatcactcagggctaattctgtctgaaggacatctcaagtttgtttccagcacatttaaaattgaagaacaaagtgatagatagtcaaatgccattactagagtttggaaaatattgaatttgaattttttccttgtagtataaatgagaatgggtaaaagaaaatgatatggcatagagccaggagagagaaatctttgttatgaagaagagattccaaagacaaaaatatacacaatgagtgaggccatacactgagaaaaagagaggaggagaagtaaagtttaaaaaaaaaaaaagagagagagagactaaggtagattgtttgcaaaatagccacaataattcagttcctggtatctgtacttttgggtactctttacccacataaacttgggtttagccatgtgattttctttgctcaatgagacaaaagcaaacactagaggaagagattttaaccatgtctgctcttggggtccccctttctttctgtgattataatccttagtgaccactaagtgaacaagactgtgctaatctgagggagaatgaggggccatgtggagaactgaggtgcttcagccaataatccccaattatctgccaacagctagacacatatgtgaggccattctagattgtccaacagccagctgaccacagtcacatgggagaggccagcagagatcacccaccagaagtactgcctgttcaaccacagaaccacgaactaaagtgactgaggtgttttcaatcactaagttttgggatagtttgatatagaacataaattaatggatacaatgaacaataaatggaaatgagagactgtctcttttgatgagaaatcaaacaagttaagcttatttatttttctacttgctggtttagtttagatgttggcttcagaattggtgactatttcactacactttgaaatatgcattagtttaataagttcaattcatcataagtttgtttttaccctgaaaattatatttgttgaaaattctaaaaataacagcacactcccaccacctacccccagttgaaggagggtagcaggatggacggagaaacatcttgaaattgctctttagatagaaatagatcacagtgttattacctgcatacaagatagagtcaaattaaagattaggcattatattctatgactatgagattctcagtacaaggtatcttttagagacaaaagatgaggtaatttttatcatgtaaatattatttaatagttttacttacatgttattggatatactttatttgattctacattaaattcaacaggtatttattaaagtcattttaatgtgcttgacattttactaacatttacgttttctacccattttgagttttaatatacaaagctctcacaaaaaaactatttgtttatttttatgtcagccccgggcctcataattatctggaacagctgtaacagatctgctttcactggtcattaaatcgtattgtaagctgtggatcccttctttctgaacaccaaaggtctgtaccatctcttttctttggtttttctagcttttgattaattgaaaaagaaaatatatcttaacatttttattgtgtttataaggaaaaataccaattcataactcctttttggaaggacagagatatatatactgtgaccgtcagagtataattgcatcaaacctataagcaactagttaagttggcaatttaaaacacagtaaaggtttgttaatgtagcactcaggtggtgaagcatttattgaattgcatagttttaagttttcaaacgatgtattgttacattagtttacaaagaaaacagaaattcaagtgaatgatgtcatatgactatcaaattatatgtattggcatatatacagaggcatataaatctattagaaagtataaaagttattttaattgtaagaattatacaaatgacaactatccaaaggtttgtttctcatagccggcatcttgttaaaataatttgaaatgtttgttggcatatgtgcaataccttgctcaattatttttcaaatttagcagtactctttggaagcttatctatcaacggagttaagacagttaatatttatcaaccttttattggaaaatttcaaacatgtaaatattgagtaactcatatgctagttacaatgaaggatacggaatgtaggctttaaagtgggcagcaataagccaagcgaaaattggattttctgtttctaaaaagacttcatgcttatatatcacaggatatataagcatggaatgactacaacttaccaagaattttctaattcttgatctttttctataagtcagtttgccatgcaaatgtatgtttttttcaatatccaagatgaatgtgtaaaataggctatgtcgaaagagcatgattcatctatcgatctatctctctatatataatttttattttattttttgagacggagtctcactctgttgtccaggctggagtgcagtggtgcagtcttggctcactgcaacccccacctcctggattcaagcgattctcgtgcctcagcctcccgagtagctgggattacagtcacgtgccaccacgccaggctaattttttgcatttttagtagagatggggtttcgccatgttgggcaggctggtctcaaaactcctgagtgatccacttgccttggcctcccaaagtgctgagattacaggtgcaagctaccatgcccagccaactcatctatatttaatagtaattatcaataactaaaattccaaataatttccatcgtggtaataagtttgctttatatcatttcaatatttgtaaattggattcaacattttctcccttatgcaatgtaagatttatgttcacttcacttatatatattgtccacctaatcactattcaaaacaccagagttagatattgatttagatataaatatgataactaaaatttttatgtaaacatttgtatcatcagataatgatagatatacctgtatgacagattagagataaacagatagatagatagacagatcgaccaattgatctatactgctccttttgtccaaggagaccaaaaatttggacagttttgaaaagcgtatgttgcatgttttcccttcgttttgaaagtttatgctttcaataatcattactcttttaactgaagttagaatttgaaaaataggatgtaagtaacttaccaagactcaaaatgctaccagagggcataatgtaatctccaaggcaagttctagtggtcataaaagtcacaaaagtcttgcgagtagccatttcatcaatagtgcatttatttattttacaggtaggagaaatcgttgtaatattatattttgtctgtatattttgtaatgttttgcttaaatcaattatattctaataatcctctaatataccaaactggatgcaattgatattgacaataaagtgttggcaaattctccattcatttttcaaacacagatgaaatgtgagatagatgttagaggttttaaagcattaataaaggagaattggctctaggagagagaatgtaaagtgattttttattattattacaaagtcataggaatatttctcaattcagaatattgaaagtaatttaatatattatttttcatagttatcataaatataaataatctcataacatttatatttaacaatagcaaaaatgtcttcatttacaattttatcttgactttgatatgactcttttttacctttaaataaagtcatctaaaacacattcattttgaggaaacgtgtaatctaaatagcttccagaatttaaaaagtagctaaacattaactcgtattgttagcatatgtaagaaaaaatattaccttagaatttctaccttcctaggatttggtgagagaatatatttacatccagtaatgactgtgagagttttctcattaaaaaaaaacaggattaaatgataaaatagtttcatttaccaccagggagttttcttagatttctgatatttaatttggcttaatggctatattgtgttaacattgctatgccaatgaatttttatactattgtagttaataaaagatagaatcctcccagcactttgggaggccgtggtgggtggatcacttgatatcaggagttcgagaccagcctggctaacatggcgaaacccacctctaataaaaatacaaaaattagccaggtatggtggcagatgcctgtaatcccagctaatcgggaggctgaggtaggagaatagcttgaactcaggaggcggaggttgcagtgagctaagatcgtgcttctacactccagcctaggcaacagagtgagactccgtctcaacaaaaaagatagaatccgtaatttggtctattaaaaggcactgaccaacacagaaaattgttttatctgttcttaaaaattcataaaacaaatggtagaaaaactggttataaaaaaaagaaggtagaaaatatttattttcttatactgcacaactactcccaaacaaactccctctcttagtagaatcagttgtaactaagaagagaaaaccaagaaatcaaggacttactataataaaaatctgatgacttcaaaatagaaatgattatgcctaaatttgattaaatatagacataacaaaagagcttattcaaatattggccctttagacttggagctttgcaagtctttgaataataaaaattacagaagttctggaatcagttagtaccatgatttgaatcaatcagaaatatatagaaattaaattaataactatcgatattatagtatttaatataagaagagcaaagtgtggccatgctttattaagatgtatagatttcaaaagagagaacatgttatcctattataaagtttaactatttgcagatacatgttgaattgagtagttatgttaggtttcaaaaatgacacattatttaattaattgcatttaaatctatcagggcagaaaacttttttaaaataaaaatgattggttatttattatgcataaactaggtgttatgtaataaaccatgtaagtgcaatctattagtacaattaagatgccttagtgtgacaatctcattttggattgattagcagaacagcttcaggtattcttttttaaaaatttcaatctatttcaaattcaaaagtgcttaaatttaaaaaagtcttagagaaatttgttttaaaggaatcattgtctatcaaataagtagaatttagggttgtatagctgttcagtatattctgaaataaactaagtcaaattatgaataaaattggcccactgacattggcacatatttctgcatttcacttgtagcaagacaaccattggtacatggtaaaaagtaaggaaaaagtaaatgttattagcaatgctaggtcaatgcaaaatggcttgtaccaggtcccagttaattgacataatgtagatttgaatgaaaactctagaaacaaatttttaatttgacaattattctttttctttcttcattcacttttactatagcaaggttaaaatctcagaaatctcagaagtcactactaaataatttatacgtgtaacccaaaaccacctgtacctcaaaaactactgaatttttttaattggctagctagaaaagtagttaatactagcccataaatctggcttcttgatgtttgtttttggaaaattagcaatgaatgaacttcctgagagaatgagtcattcttgggaacatggcaaatgttcttgcttttgctcagtttagtcaacgaaagcatactctactctgtgcctaaagcagcaatcaatttaattttatgtgtcaattccattagaaaagcgaacaaaacaaaaataaaaaacatgtacaccgacaactatctgaactttgataagataatgaagtcgatgacatcttaaatctctttatccaaaatgatttgtaaaacttgataggaatacttacaaatagaaagaatattctaatgtttctattgcttacttttaaaatgtttggattgcctgtaagttattaatttctctcaaatttaccttccttgaattactctcttctactacaaactaagtaatatagtcaaaactgacctcatcttctccatcaccttcaccttacctaaaatgctagaacctatagaatcattctagatggcttcctttcaatcatttccttcatttctattctctcaacaaatgctgtatgctctggtcatttactgtctatcatgtgcatccctacctctttactttcactgcctattcctaaattcagaattcagactatgatctttgcttggttgtaacttagtgattattttccacttgtctagaatgcactttccaactctccttcatatagctaattccaactcatcaagcatggttcataaaacatctccaagaagtcctccttgacttttccacgtgataaatttcttttccatgcttccttaatcctctatatcatagtacttatgccattgaaccgtaactgtcaatttatataaccctctcctatttgccttgaaggtagatagggtctatattattttaattttaacttcttttccaaacaaatataaggcactaaatgctgtgaatatttgttcaataaatacagttaccaaaaaatttatttaagattatcatagctattaatatgttgaattctgtgtcaaaaatgatattagatctttattattgcagttcattatattccctagatgatgaactaggactttaaaaacaagggtaaattaattttcagtagtctaaagtttcataaattaagcctcataaatgtctactttgaaatgggcttattatcctaggctgtcaaaagtaacatcagaacacaaaagtcattctatatggtaagtgaaattaagacataacttcacaagattcagcatctgtctagggatacatatcatagctaatatccttaactcctcataggtctttaaaaataaaactcaacacgtatttaccaaatacctgccctttgtgtatcattccatcagtaaaaattacaaaccattttttaaatggtccacacacaattgcagcagatcgctgcactgcccatagtaatatttacagccatggatctttaattatttttcttgtaatttaaacttctgtgttgcaagaacaaggaagtgaactctatcaattttcccgtttgaaggaccagtcctaatgaagaataatactactgggtttttaattacacatactttttaaacattttaatggtaggtttatttaactggtatatagcattttaaacagtgtacatttttaaactactatttgttggtgtttccaatttaataaattgaattttgcaccatggaaaagcaattttgcaaacatcagtagcttaaatcaaaaataaatatggtataaaacgacatcacataacttcaaaatcgctgcaagtgataatttcaatctggaatttgatcaaagctattagctaataaattgatcattaaactgctactggagtcagagtatcagaaaatggactaaaactccctgtgaaacaatctgtcagagtgtacagtcaatgttttcatttcattcagaagcagaattttttctgccaatcaaggataatggttggagggctttttggagcaataggaaatcctgtcaccattttcacaagtggaaagtaattgaattaacctcaaaatactaacattattcttcctcatgtgctgctgaaagaaatagaattacacttctaaagaatactgaagtgtttaaggcaggcttaatgagggatcataactctacactaacccttaactcccaagtcacggggagaatattgcattctattgcagtctcaaatgcaagcatttttcccatatataaaaggaagaaagactataataaactagtaattttatttatatttaaataaaatttaaatgtaaaaataaaattacattaaaacaaatacatctaaataaaaataaatagtaatatatacatataaataataaactaataaaagcttcatttatgattaatgaactaataaaatagcagaaaattaaaatttaatttttatttttaaaataacatttagattaaaagcccatactcctaataaacaatggaatttgaaacttgtcacgtgagtggccctaagacacaaattacagctctgttttagactcctcaagacaataagatggtaaaccactcttttcctctgtttgaatgaagttctgagaatcaggagccattccattctgtagacagttgcacctctaatcaagtgttcaaggtggaaagctaaaatccctgggataaatggctgatgaaagcaaaacttcccaacagcacagaccaggaaaataatgaccaatattttatcaaaataatttaatatctatttggattggcagatgccggaggaattaaattgtccagttataggaattatggctaatctctcctttgaatttttttagataaattttcttctttacataacaataaaacaaatatttcaaatattcatttatatgttatatatacatatatacacatatacaaacacaaatacacatataaatatgaaaacataagtaatgaaaaatatttcatccactttttgtgtatatgtatgtaaatattttgtgtatatgtatgtatatagacatatgtttatacaaacaaaatttaaaatgtgctttactttttgtggctgtttccttgtctggattaaccagttatattattatagtaacattacttttctgaatttgatataaaaattctgataacactaaaattacttattgacaggtattctcacaagtctctgcccatttattagtgaattgtttaatcaagtgatatagaccttttgtgtaatatttatgtaggtctaacatctttctaagactacatggagttaaactgatgtacctttagaaacctttgactagtattttttaagttgatacataatgattgtacatatttatggggtacagtgtgatattttgatacatatatgcattgtgtaatgatcaaattaggataattagcattttcatcatttgaaacacttatcatgtctttccattggggactggtatctttcaagatgtgagtggatgttgagaaagggcttgtctttgaaggaggagaagcagtatcaaaattaactgtgaatccatccctgtgcaagagcaaacatagctgggggcattctcctgtagcagattctgctttttatctgcttaccattcgttcacttctttcttcttgtccttccccatatttatttggctagccactcgattccatccccatctcaggagctaaatatctactgttctcacccaattataacaaccccattttcttgtcagtaactggttagatgttgacatgtgacacaattctgaactggttagatgttgacatgtgaaattttgtctttcatgtgatatgttaaagaaatttggctggaggattccttgaaaatttccctcattattaaaaagatacattcaagaagagataatttctactttcaaaaatgttcattatgcctgcgtggttgagttgtgatgcttgatgctgccacagccgacctgtgactaggaggagtctgaggagtgagcttaggataggcattgggaaatcagaaagaacttgagtcctcattgacgttgttgagcctacacagctatgtgtacaaagagggactagactcttgtactctggagcctcctatatgtggatttgtgtgaaattaggtaataaatgttcttgttttatccagttgaggtagtgttttattatttgcatgttacagcattctaagttctactccaggtaagaaggggattacaatcaaagaaaattactatatattaaccataaaaaacaatgttactaatatacatgtaataaaactttttttcatatgttctttctcacagctataataataaacattttacaaatagggggagtgagtatctcggaaggaagttacttgcccaagttacgcagctaatgaatgccaaagaccagactcaaaagttgtgcactctgtctattgtctaacatccataagctgaccttgtgggatctgtagaacccaatctttgataaatttatttccaaattaatgattcattgacagatttataaaatgagtaggactcgaacactaatttctaaaaaataccactggtagaaaattaaaatgtgtattatttctcagtcagtttgtatactggaaaattttaataggtggtgttggatgctgtctcaggaagcagttgaagcaccagctcagaacgttccaaacagttcaggcatataacacaaagcaagctgctctacgccttccccacttttctcctgccaatgtcactccccagagtagctacaggtagcagttcctgtaatattgacaatagatgtaaactttaaaaaaatagtgtaagtgtaatctttagatatatgagtcaagccattatttaaatgaagtttaaatattgacagataatttgatgttctcaaagccctttcactggtcccttctcctccactcttgtcacctccaatctattcttcctagaacagcaaacacaatcttcccccaaaaaactcagttatattgtttccctgtttacatcttgcagcgttttccccttactactgggaaaaattctcactccttaccgtgagcaagagtcgacatcctctggcccctgcctaggtcatagtaggtgacattcctaatactaattcctatcagttctttgaagacactaagcattctctggccttaggttatttgcatgtgctgttccctccatctgcacagctgtttctttgctcttctcaggactaagtccttgtctgtgcttctacctctgcaacagtatcccatttacagagaagccttccctgaccactctcaccatcccacctaaacaaagattccttcacttttctctaccagagcctcccattgttttcataacactcactaaaattagcaatcattttatatatttgccttcttgtttctttgttgcctgtctctcccaccagtatgtacgttccatgaagaagggccagcattttcttgttttgttttatcagtatatcctgagtttgaagcacaattatctgatactccatcaatggtgaataagtgaatgattgaatgccgtttatgccagaatgtggagatttgtatttatgagtattaaagagataaaatattacatgaagaatttatagtcagcctcattgtattaggatattaagacaccatagactgctaaatggctggataaatcagctccttctgaattctcttaacaatttatatacatttctcttcactgtatgtgctttctattttgtatctcagctatttgtgttaatatattttctattttattaaatcacaaagcccaagaggactttaaggacatcattggttttgttttctttgggaaacaaattgagcttttcctattaagccctgagtggtgagaatacagggcaagcaaaaactccaacactgactaagctgtgtgaagtctagaatgttgcttaacctctatgcatcttagtgccctcatttgtagtgggacctgccttgctacctacttcatgaaatgttggtaaattcagaagaaatactacattcaatggcctgcacctaacaaatgatcaataaatggtaactttgggtagtgggtttaatggtgtcccctcaaacatatatgcacatcccagaatgtgttaatgtgattttaactggaaaaagtctttgcaaacaaattatggatctctagatgacatcattctggtgtagcctaaagtcaatgacaaatgttttcttttaagagacacactgagagaagaaatccttatgacaaaggaggcacagactgaattacttgagctcaaattgtatatattacagaaagcaaacgtatcactgcatgtgtatatgcaaatagaaagagaaacgcatttacaagataatttggacatacaaccccatgtcataatcttgctgaatcatttttattatctatgaaacagttacattggctggattaggagttgtgaatttggcattactaaaccatgtgggacacctgggggttcctgaatctctgccaatccagtaaaatgttcctttttctagggagaatgtgcatagctttcatcagatctcagatgggtctgggactgccaagagagtaataaagtttggaaactcttgaaagttctttctagttgttgtattaatataatatgttaggtttatatcactttaaagcagccaaagggatttggcacgctattttaatcagtaagactctctctttgaagaccaagacaagcagaagaagggattataatagaggtttctttaagtaaacttatctttctcaacattataataaaaatctgcaggttttcctatccttgtgtacagtctatcattacccagcatgctccagcaaaggaaacaatctctatcgtcaacaatgtaagtacagactccaggtttccttgaactccgaaattgctatattcaagttaaagggtcataggtgcatgaagatagagaaaagacagtaaatgacaagtacacagtttccttgtttctttcagcataggagatttcatgcttactggaatagctgtgattctgcattttgtacattgaaggctgtaaaataaaggttagaatagatatatatctgagaattagtcactatgaagttcttagaatccagtttgtcttttattcctttctaaagtttaccaaagagaaacttaaagattttccacacaatatcatcacctaaagcaaatgtcaaccgtacaaatatataataaatcatatgccaaacattctttaaagatttatatatatatgttcacaaactcaagttagaattttaaccaatttgaggcttgtaagaaattaggtagtgcctctagaaagtgaaagcaaacttagttttcagtttattcaccaggaatacatatgaagaatatagggaatataaataaaattattagattataacaaggtgctgtaggtttggcataccagttcattttacagagcatatggataagcgtccctcattatttgcaaagcataaaaaaagttacgtggatgaaagtcttccacttagaagtcatcaagttggtcttagaagttgtacatttaaagagagattgctttcctctaaaaataaaccttgctttggcttttaaaaataacttgcattagacaaggcatggtggctcgggcctgtaatctcagcacttagaaaaaatagtagaaaaaaactaaaaaccatttgtatatatataaaaagttgtggatatatggttgtgtaaatacattatagatacccataattatacacagtatatttgtaaatatataatattgttcagaaaaatgacagtataaatataaatatttaataatcatgattatatgaaaggaatgaagatgaatttcagtggcaagatatgcaactatgttgtgtaattttttcaacccaataaagtattcaagaatgatttatataattaaaatatttaaatgctattcttaagcaggaataaattctatatttttataaccttttatacttcagttatcactagattaatttgcttattatgtatttaaattaattatattttgtgtaaaaactgacaatatttatactaataatcttttacttgatgatttttaaagtttctctgtttttatgctggatataatacttgattatcacaagtttaaagaagctgaggccggcgcggtggctcatgcctgtaatcccagcactttgggagcctgaggcaggcggatcatgaggtcaggagattgagaccatccttgccaacatggtgaaaccctgtctgcactaaaaatacaaaaattagctgggcatggtggcgggcacctgtaatcccagctactcggaggctgaggcaggataattgcatgaatcccagagacggagtttgcaatgagctgagaccgtgccactgcactccagcctggtggcagagcaagactctgtctaaaaaaaaaaagaagaagaagaagaattgtaaaaatctctgtagttgaaaacctgggcaggtgaacattaagaactggcattctaaagcagtactgagtgatctaagcatggcttggtcagagaaagagggaatacccagttaatgtgaagaatctccagtgtataattagaatattaaagcaatgccatctgttaatacttcaaagtagtaaagcacatcacagaagtcactcattactatagatgcatttccaaatagcttaaaatttaagtgtttgaacctttttcctctatcctactcaccttaaaatgatttaattttgatcctaaatgttttaaattgtagtacatatttaccttgaatcacagtagcatgaaaagtaaatgagtcataacaataaaaagcaagaaaacacaaaagcttacccagagcgcaactgtataatctgaaaacctcatccccaaatccctagggctacttcttgaagctcctgggggatctttcagctatagcatgctgctccttagatgcccccaagaaaggctgaaaagctcttgagtctctgtggtgacatcttttgaaacttcctaaggaggtgatgttgtcacttccctcatctggactgctcactaagctgaagcgcaggaattggaaaggagagctctccttcacatctgtgttcaattaactattagattagcatcaagcgccgcctcagctctgagtacttcattggctcagccaattatcattttcttaagttaattataatttgactccatctttattataatggctaggccagaaggtaatcagattggcagggtttcctgctactctcaacactttctttcttcagatttctgacaaataattattccttttttttacactcctctcttgtttcttcagagtgagtttctttcctacctgagattattatttatccagatatctatccagagtataattatctatgagattaaaaattaatcttattcctgagagacttaaagatttgagtttcatagatataacttcaaaccaagcacatccagtcactgattttcacatggggttgctcagcgcttatggagactgcaatctaaccttccccactcacgagacatctaggcctgagccataaagtagacatagaatgtgaatcacagatttaaaccacatataaaactttacatcgtttgtgagcaacattaacaataaataaataagaatcagatgaaaattattttaaatatattttaacccaatatatccaaaatattatttcaatatgtaactaatatcaaaacttattaataagatatttttatttattgaaatggagtatgtattttacactctatggcacatctcactttgactaaagttacacttcaagtgcccaatagccacatgtggctagtagttattgtattggatcattcaaatatgaatgatccagaaatacctggtttcaaagtggctcaacaatgcatgcttggtctaaaaaccttaatgcttttattaagtatcaaatttctgtataccctgtccagggatagacttctcacaccttgagaaatggcttcctcagatcaatatatcatagcatactatctgaaattatatgctttgttcttcttttttggattgcagaaattgtatttctttttactgtaatcatttttgttgtatactacattgctaggaaaaacaattttcttttgttcttaagatacaagattagtaacacattttcactgtaaaatgtcaaacacctagaaacatgaattaaaaagtgaaagtgctctcccttcatagtccctattctgttttctagagttaactttagatttactgtgtatcattctaggcaactttctatatcagagatatttagaaaagggtattaaaaacccagatttatttacaacatttaatgtaggttttcttcacctaaacaaaaatgcatagattcactggcaaaatctggagcgtaaatatatttgatgactattggaaatattaggttgcctaaagcaaggcattgccctgtcctttcttgatgacagaacccctattttgtctgagtgttcacgctcaccattgttaggtgtacagagaagcactaaaaagtagaatattgatcatttaaagcaaattaggtaattccatttcctagcccatgactgatttgctggacatatgtgatgtaattctgcccaattaaaatgagggataaggggaagggattttcttgttcaaaaaacttagctgcatggaaagaaacagtcttccatttcttctggaccttgctgtctagctatgatgcctgtagacatattgggcttctgaaaggtttcagcctaagagtacaagttaacatacagagaatcagagggtgaaatcatggacagtgcctggatctttaatatgatcgcaaaactgctgctttactagaatgtgagattataataaccttcccatatgttaactcattgttagctgtgatttctgtgttacttgaagtttaaagcatcttaactgacacaaaacatgaaggaaaatgtttcatatactttagtaaaaatgaaataggaattatttccattagtaaaatgaaattttaagctacttgttcttgagcaggaagttttaattttctgttaatttatttcttaatgttatccatacattataaactttatcttagagttatttgcaaaaaaaaaaaaaaaacaagaggaattctttaaggaatagataagtaaatgtttagttttactgccgatagaaatacaatttacaaaatttagataagcaaaatataaacacactctcagaattatttatttttaaagtattttgagtgcatgcaaatctttattggattataggatatcatgggacctgctgccagtaacaaattaaaattatttttatagtatggtaattttgttactgttaaaatgctacattctgtacattgcttaatgagtttttccagcgttccaactccaagtttgaataaaaggtaacataaaatttattatatttatgaataaataaatatatttaccatagatgatacaatattaacaaaaaataattttagctacaatttggtaaagctgaattcaaatgttctttgaacatttctatctattttatggtttttacacatataaattaagaaaatagtttttgtaaatttaatagaataggagaaaattatataagaaccatataaaactgccattttttgtaggcaaaatattcacagatgggcaatctcacaaggtttgaacaaaataaacacataaaacttttgcaaaaagtacaaaaataaatatctttgcatttcaagggtttttgaaaatcatcaaataagtgtagacttcttatgccacttgccctaagaaacaaatctagagctctacttgatacaacaactggaatatagcaaatgagacagggtgagtgaggattgcattttttaaatgtattcacatcaatttttctatataattttaaatcaagcattttgatccagttataacatgaaacctagcttgcatatatagtcatgcaaaaaatacaaccataacattgccttataagtgtaatgttttgttccaattgtgagaatagcaatattcagaagtatttgtatattaaaatagcatggtgcttatatattaatgaatattttaacagtttatggagagtataatgaaaaaattctttaccataagctttagaaatactgcatatagtaacggttttattttttaaatgttatttacatataaaataatgaaattcggacatctttttttgctgtgagaattactattcaatatcaaacatacttcatgctaaaatctggactgaagctagataaaatgaataaatatatacttaaagttatgctaataggtatgttggtggtaataatttgcttgctgtacttgcaaagtgtaaattatttccaggtttaaagtactgttgagtctattctgtgttttagtagtctttttggtttatgtaattttaaaataacagatctaagtttaaattgtttttccacctacctctaccaatggccattacttagattaagctaaaagacctgaaacattttcaaacaccacagtaatatttaggagttgaaattatcaatatttgatgattgagtattgagggacaaattaaatggagagaagaaagcaataggttcaatttgctatgcaagaggacatatcaagtaataggcagttaatacgttggtttggtatgtagaaaaatgtctcaactgaaggtaccaaatttgcgagtaattgccataaaggtgcaaactaagataaaaggagtgaataaaacaactgaagtaaagcctggtcccagaggaaagagaaataggagagaaaggtgtcttggaggatgacagaagcaggtgttttaaaaaggaggacatgaataaaatcaattaagctgagatctaaaaggtattcattgtagcaggctgctaaggtagtttgtggcccaatcatgaaagactttgtttaataaacattttttttcttttagacaaggccttgctctgttgcccaggctggagtgcagtgccacaattacagctcactgcagcctcaaactcctgggcttaagcaatcctctcacctcagcctccaaaaatgcttggattacaagtgggatccaccacaactggacaataaactttagttactagctagtagtggagcatcaaatcatttgaagtggggaggggcaagatcataaaatcaaatttatatatttgtaattatctctgaaacctctctctctctctctttcgctctttctctctctctctgtctctctctctctctctctctctctgtgtgtgtgtgtgtgtgtgtgtgtgtgtgtgtgtgtgtgtgtgtgtgtgttggggagggggaaagagttttggagttgagatcagctagaaatacataatctgctctaacacagtcattgtaggattggaaagtaaagcacatagatgatacaatattaacaaaaaataattatagctacaatttaaaacaataaacaatcttaaaacaatatttagatatacaatcaagaatacttagtacctgtgagtagaggctgagaagcagtgagaaagaataagagattctttctataaaccctgggctttatagactgaggccaccacaaggacagtggtgcccttaactgaaagtaaagatggaagagagaaacaggtttgggttttgttgtgatgaatttcattttaaacagactgaatttgggcagtcaaggtttatccatatggagaaatccaacaagcagtaagatgcccgggtctagagataaaagagagttcggatgtacagatatgtatccaatcggccctcagtgcaagagcagtgtatccatatatttttcaattttactgtggaaatacatagcataacatgtactgtgtaactggaagttggcttcttttgatggcatttggataactataattaccttcatataataattgttaaactatattcaaaccagacatataaaaatatttcatttcacatttgttaaagagtgtttgtatttggaggtacatgaaccagctctgtacttttttacaatactatcaccagcatctttagtattgaggctgttccatatggtgaattatgccaatatggagaactttgccaactcattccaattacagattgtttttctctagacagcatggagtatttttatgctgtctgtcaaaatacacttttttgtttgcttttcatataacattcagtgtgtaagaaggtgaagtgcttacgtgagaacaatttaaatttgtgcagccggcaggaagtttatttagcgctttgttccataagagggcacctgaattttcaaatgaaattaccaggattttccaggtgcaggtgatcagattagggatgggaaatatgccaaatatatgtaaacaaacgaaccatttccaagaatgctgaaggaaacaagtggaaaaggatcagactaatcagtgctggaatttaaaggactgataagttaacctactgggtctcccccagattgccaaaataattatagcgctgtgctgtagagaggatgagcgcaaaccttcctaggtttttctggaagggtatgaattttggagtctgtctttgctcccatattagaatatttattagtaccagatcacatgtatgatttttattttgaaaatatgttatagtggatagtggctcattactttctagtatccgtttcccctttctaagaacctgattttagtctgtatatttaaaccatctccacatagctcagcaccccatcctcagctcttgggtgggtatagtatccagaatttgctggccagtgattgcttttagaaaccaagactaaaataaatggtctgaatgattcactttgcatctgcaatttgtttagtaatgagtatccaacccaatttattccagttatgtttggggagggctgagttttccagagaacttctgggaaaaaaaaaaaaaagctccctgtttttaaagacagaaattagtaggcctctttccctggacattagtgatagacctggagattgtgtagttatctcatcaccaggttgagggtaaagcagcttgtgaaggaaggctaaactaaagagaatctaagtgaaaagaagctagagtcatgtttgaatgacatcttgattgagcatcgcctactttcaagatttcttcttttaaataagtcattaagacaaaaaaattggtttatctattacttgctatcaaaagcatcctcatactaatgcttaaacagccgtttttcacaattccatgacatataaaatggcttctctttttctttatgtaacacatttctttttactttattttcagattagtttatatttacagaagatttgcagaaacagtacagagtttacatatatctttcctctggctttccctaacattaaaatttgactatgatacacatatcaaaactaggaaattaatactgccataatgttattaactaaactacaggctttattcagatttcactgatttttccactaatgtccttttattttctcaggatccaattcagcatcccagattgcatttagttgtcatatcttcttagtctcttctattctgcagtatatattcatcctttccatgcctttcatgatcttgatacttataaagtacaagtcagttattttgtacaatgttactcagtttgggtttctctggtgttttctcataattagattgatgtagtgcattattgggaaggataccacagagaggaatcacatctcggtacatcacggtaggaagtttatgatttgataagttacccagatcacttggttaaggtggtgtctgccaggtttctccactgaaaaggtttttttctttgtaattaatatattttagggagaaataatttatgactatgaaaatattccatttatctttaaacttttgcccactaattttagcacccttccttgtgtcttgcctgcagcagttagtactgtgacattctaatgaggatttcttattttcctcatttcttctacatttttaattgtaattattctgtaaggaagagttgtctcttctctcatttacttctttattcagttacttatttatattagtatgactcagatatttatattattatttgggttatgatccagtaatatcataactgattttattgcccaaattgttccagcttcagccattgtgaggtttttcaggttggtccctatgttcttttgacatccatcttttcttttctgtctttttccttctttttgagcacattaatgctctagattcatcttatatttttcctgctccagatcaaccatttcaaccacttctccaaggaaccctggcttcttttaacggagaacgatatccactggatatgctcattactaacgtcactgctcctaggctctcagtggctaaagaaaggagacatatgtatgtatagtaacacattcatacatatagttgtagtttaactatataataaatatataactgaatacagaatatttgcttttatagctagttctgtgtgtacagacatatacatatatgaaaaattcataaaaataatctaggaatcctggctctccaccctacttcctccacctgcttttccaataccttagcagatgttgcttaccagtctctccgtacccagttccccattcttattcatcattctactagacataggatctctttttattgaagccccaatctcttttcttgctctccctgtgatctctgatctcatgatggcatcttagaccttcctatatttatctgtgtaaatcttttagctgcttattaaagttgtcataggcacagaaaagtaatatcgccagggtcaaataatctaaccgaaataacttcctaagggcaaggttttaggaaactcttcatcctacagttcctcttccatcagtcatttgagttgttccaattacagtatgcccatttaacactcaaatctatgactacagtgtctcatcaaaactgtggattgacagttagaccaacggaaccggtgactgcctaacactactagaaagaacactaatacttagcttatagaaccaccagtgctatctattttatggatatcacccacatatctatactcctggaaagggacatatccacataagtacctcctctgataccaacaatgtggttcaaaaagtctatagccacagtgtgccagactagacaaagaccaaagacatttaaaattatgatttaagtcccaccaaattcttggtcatgaaagtctctggttattgtagttctcaggccttatgtcaaaaaatcttgatactcttttatgataattatttttgctaaatgaaatgtgtctcagccaagaagggccttagtgatactcattctgtaatcttctgtatctgtggactttctagtaaggcttcaatcaaatcaatgctctgtattagcactcggttctttatattcatccattttactatcttaactgtgtctttctcaacacaagttcctttattaccagctttcactcattaagttgtcctacttagccttagcaagatttctaattatcttgctcattttcagtcagcaattgatgctacattttattggacttatattcactttgtccaaacatagattcagcgtgtataaataatatagcacaactatacttgtcttggttattgctatggtaaactaatatgaattcatcaaaaatgttctatgtaggcagtctggagccaagtcattgcaatctaacatcaaacccaattctaatactcacagtactacccctgatgttcctatagaacttttatatttcatactcttgtataaagagagaattatcctattagctaaaatattatatgtataggtatacaagaatgtatataagagacaaggagtttgaaataatttagattagaaaaatgatcaggttcactttgtggtgcatttctggaagttaaaaggaagagaaatatttcgaaggcattgcaactaactttgtactgttgtaacaaagcttcatatcaatatatgagttaggtttccaaaggttctcacataaactagatttattctcatcaatatggagagttgtggtagttggctccactgggctgagaatgctgaagcaggggtaagctagatctacctttagtggcaggccttatggtagatggcacagatgggcaccaggactgtgccaaaacctaaatgcagtaagatcttggagctagcattattctagtatttctctgcagatgtgaaatgttcattatatcaaaatgtaattgttttagagatcctttaaaagactctaagaatgccaccatgataaatgatgccattttattctgtcggtcaattttagtcaatgagttagtgaggaaaagcattgaaataattaaataatataaagaattgaatatagtggcttttataaagtgaccttgggttttattcaactattctttgcttgcccatatagataactaagtcagtgtttatgtctgaaatatcaatggtgagtcgatgctattgtacaggctagagtcctccctttggaagcatgctgtgttaataatgctagcggtttgctgctgcaagcatttgcagagagagttgaaactgggagaagtccaatcttgtcttaaagggaccaaacgttcatagtcaattaagcttctccccactaagatatttaccacaagaaaatctattgtgacaccccttggtgtttctgaatcatttgtatatgtctttgtcatcacttatctcattacatgctatacacctaagtgtatataaatttactctttaaaacaaaatctatatgttatatatctttatacctctttgacataaaatatgtggcactcattaaatgtcagttaaataaatgaataagcagtaaatattgtggaatttttttataaacacagtcactgggaaaactttcatcggcaaaacagttaaatttgcctaaatatttaaacttatcttttgtcatacttcagaaaatgcatatcaaatataaaaattgtaagaactctcatttttaaggtaaaaaataaaattagataaagctctatgattttgaaagccttggtaaagtagtaaggacacattttattaaatacagaatgatgtcattgcaagtcactagtgcttaatactttccatttctaaccttttctaaaatagtaaatctagaggaaacattaagttacacagaacacaatgtccctttcattagctatggaattactttcttttccccttctagaggggtaaagtattctgtggttaagcaaaagtacaaaacttcctatgtgaatataagacacaggagagaagtaatttgatcattttaatctcatggatgccaaaatagttcatttagactgtgagctcaaattcaaggaacccgcttttgctccaaagttgacttgtagccattaaatactttcatagctggtttttaataacagtaaaattaagtttatttttgttaacataagtatgaatagttatactcaagatgaatacaatggaaatgagtatatatttttcccattagataactattacctaacactttacatacaaataactacattcagaaaaccagttaatactattaaaaatcattagaactacagaatggtatgagcagaataaacaagcctttgtttaagagtatatgtctatggtgttccaaccatgttttacacccagccttgcatgaggtcttgctaatgtgttgatgatggtgtccgtgtatgtttgtgtgtctgtttcaaaacaataaatagtacaattatttttaaaagaccgtgtttgaaatgttagaggcggaacccatgtgtacataaagaatggcaaacatttttgaatgggccttttctacacaaaaatacatttaaaagtaacagatttgtaaaatacttaattttgagtaattatcatattcccatcaatcatactacataaatgcatcacagatcagtttgaaaaaatttatgatatggctcccaatctacttttactctctcatccttccattaaataatccctacagactcgataacagacttttctattcttattccatgtatacattgctctggcagctttgttcataaaaatccttccaatttaatggctcctttgctctcatctttgtcaaaattagaactctgcttcaaagtccatctcaaataatgaatgagttacactagaaaggaagcatctgggaattatcaggaccaagaaatattaattctttttttttttttccttgaggcggagtctcgctctgtcacccagactggagtgcaatggtgctatctcggctcactgcaagctccgcctccagggttcatgccattctcctgcctcaacctcccgagtagctgggactacaggcgcccgccaccacgcccagctaattttttttttttttttttttttttttttttttttgtatttttagtagagacggggtttcaccgtgttagccaggatggtctggatctcctgacctcgtgatccgccctcctcggcctcccaaagtgctgggattacaggtgtcagccacggcgcctggccgaaatattaattcttataagcacggcagaatctcaagaaactttaagatgaaacagaaaaaaatagtactttttgtcaaacaaagtcatcatcacagataaataaaaataataagaaatgggtggaacgtgatgttgtaaaaagactaaaatgtaaatcccaaagtgcagtactaagtggcaattacttagactagactctagagagtcatggtacttggaataatggcatcctcaaagatgtctacaccccaatctcagaaacttatgaatatgttatggcaaaagagaccttaaagacttgattaaatgaagaattttgagatggggagtttattctgcattatctgggtgaaaccaatgcaatcacaagagttgttttaagagaggagcaggagaatgcgagggagggaaagagatgtgatgacgaaagcagaggtcagaatggtgcaaggaaggggccccaggccagggaaagcaagtggcctctagaggaaaggaaatggattatccctagatcttctagaagggacacagacctaacaacccacttaaggcttctaacctccagaaccatcagataaatttatgtttaaagagactatgtttatggcaacttgttacttgatcatttcctaccagcagtaggaaactaatacaagagtcaacagacttcagtgagagctacttgggtagcagtcaatgaaaaccactcagacaaaaatctacattttaaatcacattttgccatttatttgctgggtgaacttgggcaaattacttactctttttttttttatcattcttacactggagaatgcacacaagttttctttctctgagcactcttcctccgtatgtgttctaagtgaatctgatatataagctaatttttttggctcagttttgcatatctgacccaagctcttatagtcatatattctttcctgaaattttagaatggggcttgagagatagcaattaatgttggttagcctcctgaagctgtaaagtgactacctttctctcgtcatgtgtacaaagaaatagagaaaatcaagctacagatatagagagaaaagcaaaggtaagagactgagggagtctccttcctgagatcttaatgtactgtcaggtcctgatgcttctgccttcttgaggcccagttacgttgaatatctctggttcgtgaaacatccccttatctaataataaatttgtcctgtatgtttaatctagcagaagttactttctttcacttataaatgatttgacataaaacataccctgatggggagatgtaaagacaaataatgatgtaatcaatgtgagcatattcctgggcatatactaagagttcaataaatggcagctgtgcttatttgtatactctcattactactagtactactacttctgttactactgccattacgagtcactctaagtagtggagacgattcctgtatgctctgggttacctggggaatgagatgggtgaggattttgtctccctaattcagtttcaggataggagtaatgtagtttttgtttccatccctgtctaatcatagggagtcacaataaagtagataacaccaataagacaaagctaggaaatgtgagaaaaacaagtcatattctctgtcagtttgaaagtgtcacaaattacaaatcataattcatcagcatatgaatgccactgccttcacaaacttcttttgatactctacctgaaattttcacataagcatgcctatctccacggccctcccctatccagacagatatgccctcatcttacctagagaggtctaaaatacctggcatttagaagcactttttttttttttgagacagtcttcctctgtcgccaggctggagtgcagtggcttgatctcagctcactgcaacctccgcctcctgggttcaagtgattctcctgcctcagcctcccaagtagctgggactacaggcatgcgccatcacacccagctaattatcgtatttttagtagaaacggggtttcaccatgttggccaggatggtctccatctcttgaccttgtgatctgcccgcctcagcctcccaaagtgctgggattacaggtgtgagcccccgcgcccagcctagaagcactcttaaatattagtttcattttctttttatggctctcatcaccttttgtttgtaatgatcctatactgtagtaatacaatttgcccatgtgattcatactttaacatgtattgttattattttacatcataattgtcttaatagataaaattacacttgactcatttgaatattatagatagcatatagtaagtgtgcaataaatatttgttaaattgaattgagattaaaacttaacctatcagaaatgtgtaatttttattgctttatgcgtaggtccaagaaaaagaagctatattgtataaggtttcttcgataagactccaacccaatattgtatttctttatgatataccactaacccagtggtccaagtcttctactcctgggagtaataaagcatttagaaaggtactgtgaatgtgtacatcaatagctctcacccaaataccacccaagaaaaccctgaagttcatgtaaataaacatgaacataatctaatgagtattagattgttttcagttctttctggccatattagggaggtgaaacacaagacataaaagagagtaaaaaagcctgaaactttgtgacaggtcctttttgaaaaaatttatgctatgaataggaatatctgtaaattaataccaggtagaagggatgagaggaggaagctttgtattcttatgattaacaaagctaatactacttaaataattcataactttaaatatagaaaaatgacatatcttttcagaaaaaactagatgctactgtaaacattttattaagaagatgagaaagtactccatctgtagtattagtttcagtttagttgtttagcaaattgattctattaacagcagtgagatagatatagttttatttaaagtgtaaagaagaaagaccaaaagcttaagaactttttcacagaagcaaatacattctaacctttaagccatattgtttcatctactgtagagctttgcattcttctaaaatattgtttcaaatctatctttggagcagtctattgcaacacaacagtacttgtaacaagtgcttatacaagcatttgcatacttttcattggacttggctactccccttacatgcgtgagtgttttttaaaggctataagaagaaaattaggtgctaagaaactgaatagaaaattaaatttgtatagaaattatcctgccaagttatcttctatcagaaatttcttcatgtagagagaatgaagagattcatatccctaattgcatggttctcttaatgaacttgactataaccacagtttctggaaagctaaaacttctaacaattgataagaagactctttgtttaacagttacaataaagtacattagcaaagcaaataggttgaaggaggacagagaaattttactctctccctttaaagtgaagcaaaattagtttaataagtaaaacgcatatacagagaaaggaaacttctttcttcagatgttttattccatttacattctatgtctatgctctgaatcaagttgtctataatttggaaaaagtacttgaatgttaaaagtctctgactaaatttaggtagaaatgacacagttttttgaatttggttttaaacttaagtggttttctctctctatatatatatgtatatatatcttgaaattttaaaattaacaattttaaaaatgaaaaattttgacacatttatgtgtgtgtacatatatatacatatatatgtatatatatatatgtacatacacatacatacaactggtatataacccaacatatatatatatacacacacacatatatatatgtacacacacatatatatatttactttaagttcagggatacatgcacagaacatgcaggtttgttacataggtatacgtgtgccatggtggtttgctgcatctatcaacccgtcacctaggttttaagccccacatgcattaattatttgtaatgatgctctcactcccctcgccccccacccgctgataggccctggtgtgtgtcgttcccctccctgtgtccatgagttctcattattcaactcccacttatgagtgagaacacgtggtgtttggttttctgttcctgtgtttgtctgctgaggatgatggctttcagtttcatccacgtccctgaaaaggacatgatctcattctttttggctgcataggattccatggtgtatatgtatctcattatctgtattcagtctatcattgtttggcatttgggttgattccatgtctttgctcttgtaaatactgctgcaataagcatatgtgtgcatgtgtctttatactagaatgatttaaaatcctttgggtacatacccagtaatgggattgatgggtcaaatggtatttctggttctaggttcttgaggaatcaccacaatgtcttccacaatggatgaactaatttacattcccacccacagtgtaaaagcattcctatttctccacagacttgccggtatctattgtttcctgactttttaataatcaccattctgactggcatgagatggtatctcgttgtggtttttatttgcatttccctaatgaccagtgatgctgagcttttattcacatgtttcttggccgcataaatgtcctctctttttttttttttattgagatggagtcttgctctgttgcccaggctggagcacagtggtgcgatctcaattcactgcaaactccacctcccaggatcaagcgattatcctgcctcagcctcctgagtagctgggattacaggcacccaccaccacccccagctatttttgtatttttagtagagttggggtttcaccatgttggttaggctggtctcgaactcctgacctcaggtggtccaccctccttggcctcccaaagtgctgggattacaggtacgtgagccactgtgcctggccataaatgtcttcttttgagaagtgtctgttcatattctttgcccaccttttgatagggttgtttggtctttttcttgtaaatttgtttaagttccttgtagattctggatattagacctttctcaggtggctagattgcaaacatttttctcccgttctgtaggttgcctgttcattctgatggtagtttcttttgctgtgcagaagatctttatcttaattagattccatttgtcaattttagttttggttgcaattgcttttggtattttcgtcatgagatctttgcccacatctcaaatattttaacattttgaaatccagaatcccaattacccttccgtaagcagcaatcattacatgttttgtcagcattcagcatcctgctggtaactgtacttgacgacaaaattgaaaattgactgctgtctgggatgcatttcaagctgcaaaatctttgtaagtcttggtttacagaaggaagagaacaaagtagttaatggttctttctgtcatggtgacctagaaaaagctattgaattgctgattcattggccttaatattttagcaacttgcccatttttggcaatctaatgagatttttttaaaatcagatttgggaaccaacccaaatgtccaacaatgatagactggattaagaaaatgtggcacatatacaccatggaatactatgcagccataaaaaatgatgagttcatgtcctttgtagggacatggatgaaattggaaaccatcattctcagtaaactatcgcaagaacaaaaaaccaaacaccgcatattctcacgcataggtgggaattgaacaatgagatcacatggacacaggaaggggaatatcacactctggggactgtggtggggtcgggggaggggggagggatagcattgggagatatacctaatgctagatgacacgttagtgggtgcagcacaccagcatggcacatgtatacatatgtaactaacctgcacaatgtgcacatgtaccctaaaacttaaagtataataaaaaaaaaaaaattaaaaaaaaaaatcagatttgaaattattgtttttaactaatgtatgtattttctacttgcatattatattgtggccaatattaaattacaaaatgagatttgctaaagtgaagcttccaaaaaatatctgatgttaaagctaaaaatactatcatttcacaatctttctgttatatgtaggctacttaaagtataatgtagggaatgacaaatattcctattttttaactgttaagtccacacaaatgcttctatgtataattgtaccaacacttcctgtttggtgcaactggaaatagttcctatttcaaccatttgggtgatgctgaagagctcccactgagcgaatttgtgtgtccatttgaaacccctagtgtgaaatgacctaaagctgtacttacataacttttaaaaagtacagattcaaccagtcagttattgtgtccacatgacaacagataatgtgtttaaattattctttttacaacttgattgactttctctttttgaatatatgaaaatcactggaggtttaggggtcgtgttatcagcctaactaaaattcttctccactcactcactgagcatgttctttactcttgtaatttcattgccatactgtcttgtagaggctttgctttgcctatgttaatcataaggggagaaggctgccaatattgattaagttagccagagtatggcagtgcttcatcctcatttttacctatgtagagaaaacttaatatttttaatatttataagattctatacaaatataaactgggtcattggcttattcttgatttattcacttgaaaaatgctataaaataaaaatttggaatactataagtatgatcaagctaaaggatcaataggagcttccccaaagaagaagtaaatgtggagctgaagtgtaaaggatgagtaaggtttagaagagaaggaaggaagacaaaagaatgaatgcataaagtcatatataaaggcagagagcctttttctaggaaaggctggtgaactggaggaaacagtgggaggaggagccttggagacccattcaggatttttattctgagaggaattagaaactattgaggagttttaattagaggtgtggtataaccagattggaattttttaaagattattttagctggttgggtgtggtggctcccacctataatcctagcactttgggaagccaaggcgggcagatcaccaggtcaggagtttgagacctggccaacatggtgaaaccgcgtctctactaaagacgcaaaaaattagctgggcatggtgacatgcacctgtcaatcctagacactcgggaggctgaggcaggagaagtacttgaacccaggaggcagaggttacagtaagccaagatcatgccattgcacttcagcctgggtgacagggcaagactcagtctcaaaaaaaagaaaaaaaaagattattttagcttcattcaacagaatgaaaagaaagggagcaagagtggatactcagagaatagataagagattattgcatttgtccagttgtctcttttgtaggtttctcctattactgtattattttttaatacaaaataatagagccttaataggaattttttaaaggaaaaatttattcataatcctactactctttcagaactacttttctttttttcatgattttttaaagtttttgtccagagcatgcacattttatatcattgaatttatagtacatatataattctgagcttcacatttttcatacttttagtatggtgagctttcagttcatcataaacaacccctctcttgttctcactgtatattacattccatcaagatgataagtcaaaattgttataactaggcttctttgtgggtctagaagcactataatttgaattccataaatattcatggattgtcttttggggatccatgaattgtttgaattcgtatgcaagatttttagtgtatgtaagttttgtatttttctggaaaattcattagattttcaactggtatataacccaacatggttatgggcatattaaaacactcgaagttggtaaaatcccaagtctcattgtttgagagatgtgagaaaaaaagtagactgtggtataacttgcagcatagaatttcattcatttgaaagattcaagggagtcctgccaagaagtaaaagtaaagccatctgacaaatctctacgtaacaagaaattgtagagaaacttctgagaaattactaagtattgagaaagataatttaaatagtgttatataaagtgtatttcctacacatacatttcacatctcttaaaaacattttaaataatgttttaacctctactgtatattttatcatatagcataaccatgaagttcaaaaaatactcaatagtacaaaaaaaggttatgttgaaacagtgtatgtcagtcccctacttcataaaatgatgatatttaaatagaaaaactctacttaacaacaacaaaggtttacatttactagaaaaaaattatgatacggatcaggcacactgtctactttaaacacatgtttaaaagtacatgtatgtactttctcaaacttttgcttagaatctatgttttcagagacaaagtgattgagttggctagcatctaaattttgtgaatattttaggtacatttctgcttaacttattttaatattgtattgagataggctcttccaaatataaataaatattttaggccttaggaaattatcaatattgtactttgtgtagctaacaaaattatgctaccctattaatcaataccactctcattcaaacaaccatcatctcctacctaaactatatattgtgatcaacggtgattaatttaacaataaaacaacagatttttacttaccaaatcaactatatctcatataaattaaaacttggtttatttaaaactcattaaaaacaatcttgcataaaacttgtttatcactttcttatctgaaacaaatatcctaagttaactaaacaaattatttttcaaaatcatagttaaattatgtactgaatgcttactttattttctaatgtattttaaaccttacatttataaaattaaatattgtatattgaataattatggacaataggatttctaaaaagccaaagagactcccctctatttggaaaggaaattaaacgaaatacagtacaatgaactgcaaaataaaatcaaaatatttctggaaaatattatctatcaatttaaagataaactacaaagaaattgtgaaaacaatgttttaaatacctgagacaaataaagcacaagactttattaagaatataagaatgtattacagattggcagactggattttagtctgaagttcctagaatgaaaaagatgtagaaagctcactctaccaatctatcctgtctttctagttttctaattttcaccctctgtaggcataatttctgatataatgaatatacagcacttgatgaatatactttgaatgtgtgtgcatactgagtaaatctagagccattcctcttattttctattttattttctggactacttagaatacagagtatatgttcagaaaaaagaattatttaatttaattcatatagttattaaaatttaaacttaattgtcccttgaattttttaatcttatagatattataaatgttacaactatgaatggtctactacattaatctaaatgctgctctgcaattttacattttcctagcccattctagaaaatatgatactttccttgaattttaaataccttgttaggggctaatgtatgtccctcttaatattaatataaaacccatatgttgaagtcctaaagcccaatacctcagaatgtgactatatttggagatagagactttaaagaagtgattaagctaaaatgagatggggagggacacagacagggaagaccacatgaagaatgaaatcacagggagaaggtcatccacaagcaaaggtgagaagcttcagaagacactaaccctgctggtaactagatctcaggcttacagcctccaaaattgtgagaaaatcaaattcagttgtttcaatcaacccctctgtggtacttggttatggcagacctagcaaactgataaacaccttctctcttcctccactccttcagtggagaaacttgctttatatttaagagaaattccgagttcccccaccaccatcaaatctattaggttggggcaaaagtaattgcggatttgccattgctttcaatggcaaattttaggcaaattcctaactacctgtgtcagctacctccaccctgctgtctctctgcatctctatggcagcccagccactgctctgctttaagaaatcccgtctcttacctactcaaggaaatcagctccccttttgcatcatcaaatttttccgtaccccagatcactccatatatatttatatatattatatataaatttatatattatatattaaatttatatattatatatataaatttatgtataatatataaatttatatattatatataatatatgtgtaaatttatatattatatatataaatttatatattatatatatatatatatctcacatccagattggtgatatatattatgctataggtcactcatcttcaaccattatcccccttgaccttaggtcctcatctagctaccactcatttctcttcatatttatacttgctcctttccagcagccttccccatcaggaaatgacagcttcaatcttccagctgttcaggccaaaacacttggaatcatccttggtacctctctacctcccatatcctacaagaatctactggcaaagcccatcagttctacctttaatatccataatatcttttctttcttccttcatcaatatcactcattcaagcaaccatcatgtcctacataaactattaaaatcccctacagatttatttccctgtttcaagccttgcccataaaatctatcatctgccagccaggattccggccttttcagtctgagagtcagaccaagtcattcctcacttcaaaactctttaatggctttccatcatacagcttatgtcttacctttagcatggcagcagaggcccacatgatcagctccccaattgccttgctgctttcatctcccactgtcctccctgctccctccactgttagaattcacagaaggtattctaatgtcaatgcctttgcaccagtcagtctctctgtccacaatgctttccttccaggtttccaaattcctgtaattctctactcacatatatcaccttatcagagactccttgatcatcctatgtaaaaaagaatccctggaacactctaatcctcttaatctgttttacttattatttatttatattcagagtactactcaaccaatagaatatataatatcttcccctaccagactataagtttaattagggcaggaaatttgtctgttttattctctgttatatccttggaatctataacggtaataatacaattcctttcctaaatgtatactctcatgctctcagtaaatacaattttaaggtcatactatggcaggcactgtgatagaaactttaaatatgatacttaaataaatccaaagatcaatcctatggaaaaaataggtatatcttacaaatgaagaactgaaacttaggtagcaaaatacccaaggtcacacagccagaatttgactgtgttttcaattgattagaaaaataagcaaataaaaatacctgctgagtcctgactgccttcttaatgctaagaggagattttgataattgtaggttcgtccagtttgaacattccttgcttaatttagccctggattttaaagaacagagtgttctactgtcactaggggtgggtaaaacatatacatgtctatttctaggacaagcccacacttgcccttgggaaaaagccctttggaaactttgctttggagtttatatagtaattccccaataagatctcttcatctttaacacatatgttttataacagttaatatttcattcagaaaactaacctgtataccattagaaaagagtttgatatataaagtgggaatgatctttcaaaactcatatccatgattcagccagtacagacactgaatttgaattcagttttgtcatttgctagctacatggctttaaatttaaatacatttaaataatttaaattttttagcttgtatgtgatatatgaacaaggatatgaagacatttgggagattggagatggtacaacaaaagcattgagatatagtagatattttatgaaaataatttctattcgtatttgaaaaagcatcctatcacaactactctatagtccgaaaacaatggagaccctgcctttttgagtattctaatgaatccatttaacccatcctgcctttctcctcatcctcctgtcagtaagaaaatgacatacagaaaagaaaatctaaaaatatacagaagtaaaacatggaaggaattatcaattcttccctgtgaatcagactgtatgactgcctaaaataggcctaacaatgtcatgtgtttttaatggaacactgtaaaccacaaaacaatgtgaaatgactactgttttcagaaagtgctctttctttactcatttcatctaaaattgaactaacaaagagccctatttaccatttgcataaagaaatgggcctactctaatataatctaaaaccagatttcaggcctaaaaataattcatattagtatgattaacaaagcttttgaattaagattgtcagtatttttgatgcacatttcaattgtttggatcatatcttattcctaagatcaagatagtaaaattaatttaaaaaataataaacttaaaacagcactttggggatgatacaaacacattttgaggcagttctttaaaataaaatacttttcatgtatctctcttattttccactgaaactacatatttcgtcttagtttcctagtcatccctattaaagagtaaaaaatgtacatttccttatatttatttaacaaaaaattacaaaataatgacttctaaagatgtagcatctcttgaagcacttaaaacacaaaacaatattcatacataaaagcaggaaaataaaatttcaaaaatatcactgagtctctaattggagcatcaagtacgtgaggttgaaaaatggaagtgagaattattttctctacccttcagtctttcttgatgttactaagagagaagattttctgtttgtccctgaaagtctcaagtaattaataattgcacctgttgcaagataagccattgcactgcatactttttaatacctaagatgggagaagaaggaattttggacacaatattataggtaaattgagcttttcacattctttctcagtgccaaaattcaggacgtaaacagccagacagattttattccccgttcagcactatggacagccagccagaagtagttttcccgttcaaatataacagatgctgtgtttcttccttgtaaggaaaggatttcaccacatgtactttagagaaagttggcatggcacaatcagttatgtggagtgacacctgaacataatttatttgtgtgcagagaaaatagtttgcttagtcatgtctagtagcaaaaatattttcttcacaaataagtgtgttgccagttatcagtcaagagagggcaagttatgccacaataaaaaagaaacccccaaaatcttagtggcttaaaacaacagacttttatttctaacccagtttacatatccaaagtaggtgttcaaatgagatcctgcttagcaagcaaccttgggacccagggtgacagaagttccatcttgggaagtacattcatgactactgaggcaggaaaagaaaatgtgacaaattacactctcagtctcaaagctcacagtttctgtgcacaaatgtcatttatcaattctggctttatttcattggccaaaacaagccaaaaagtcaagctaacttccaaaggatgacagggatgtgcaatgatgaatgcccaaggaagaattaaaagattaataaatagtttgaatgactagttcaccaacaatcaaatttaaataacatcctatccattgctcttaaataaaatattgtgttattaatacacactcactgatcatccactttaaatagagcagagcactatactccaggagaaagacagcaaataagatacaactcctgctctaacatatttaaacaataccaccaccaacacaatcttcatcataactaataacaatagctaatagaatagggcattttctctgtgtccagcactgttcaaagggtttctggggcaactttataccttatctctcaacaggtaacctgaaatgactaccattgttatccttagttggagatttgattcctccaaataattctaaaatgtaaatatacaaattgtacagtttacactacaggtgacgttcaattcatatgagatttttttttaaaccccttacttagcagacagtgtgggactgagggccctgaaaacagaataatataatgatgatgaagggaataatttagggaaaatgtaagagcttggactatgacccagaggaaaaaataggctctaccaaaatgtgatcaaccataggtgagtatgggtcccctagaagctggctggggaagaaagatgtttttatttttaaggaaagatttataggttaaaaaatacatgaaacttttgggggtcaaaaagaataacattaataatgtcactctttatacacgccccatcattttttactacagttggaagggatttgcacctatcacccatactttcccacctaaatgcagattatagcaacgataaagtaatacttctattgctgtaagtgaaacacacaagactagagagcattgtcttcagtggaagaagcgtgggggagttaccttagatatcctgaagaaatgttttcagcaagcattgttaaacacaagccaaagcaaaataccaagggctgttgtggaatctctctctctctctccagaggggtttatttactacacagaattttttcatcaggagaggttttaaacaatcctgcttaaagtaagaaaaatggactaacttgattaagaaaaggaaaaaaaaaaaacattggtaaattgtggtgggttaaatgtatgcccttgaagagattagaccatgagctagataacccgttggggtccctttcaaatctgtgctcctgtgatttcaataattatgttcagttgggggtaaatagctcctgataattatgtgtgagtctattctcttaaccttttggcaaagagagtatatgtattacaaaaccatttcaaactgtggtagtaattatggtacacaatatagaaatatttggattattacaaaatttgaggtagctagggcaattgtcattcatgctatgtcctattttgcataagaaaagtaaatgttttgcatttcctacttttgtatatgtgtgttatagaccaaacagaaatgccaaacatcttagagataactagctttgagatgaaacatcttaccagaataggaaggggaactatatttgacttttcataaaaattgctttaatacattttaataagattctaataaaaaaaaatagcgggcaaactggctccagtctacttattcaatgatattccctgctgtttttcaaaagtgcaactttcccctgaaactccactaaaacttctactttattcttgcctttttacttgagcctgcagtttcctcctccatgtcttttcttcattcaagttgtgaaggcccagatgagatcccacctctgacaagaaacactcttcattcttcttctttctttcttttttttttttttgagacgaagttttgctcttgttgcccaggctgcagtgcaaaggcgtgatctcctctcactacaacctccacctcccgagttcaagtgattctcctgcctcagcctcctgagtagctgggattacaggagcctgccaccacacctggctagtttttgtatttttggtagagacggggtttcaccacgttggccaggctggtctcgaactcctgaactcaggtgatccacccaccttggcctcccaaagtgctgggattacaggcgtaagccaccgtgcttaaatattccaatttatgctctttattttcttcatttttaataatcaatttggttacaataccaaactatacattaagaattattgttttaaatagaaaacacaaagtgaaaaatgtattttggaataatttaaaatgttttgtagcccacaaatttctttctattatttttgtctttttaatgttttatgttcctatataatcttcattttgcaaggtttatatataatcctcctctgagaatgactaatttctatttcatatgtgacagataataaatgccctaaggttaagtataaaggggtgaaactaaccccaccaaatatttttccttaatcatgtcacagagtatgaaaggtttccatttcacttactggaatttattattagaataaattattaatttatattaataattttatataaattttatataaataatatataattttatataaattttatataaataatatataattttatataaataatatataattttatataaattttatataagtaatatataattttatataaattttatataagtaatatataattttatataaattttatataagtaatatataattttatataaattttatataaataatataatttattaattaataaattattatagataactaagtcattttatgaaggaggaaattgtaaatcactgtttgatgggctttttcaaggtcgactcatgtgccagatgctgatctggaattctgacaaagtaaagtagtgtttaaaaagcattctttcacaacaattaaaaaagtaatatcaatataaaacatgattaaaaataaggagtcgaatgactatgtcaccaacaatctaaaatttaaataatgccctgtccattgctcctaaataaaatattgtcttatcaatacacattcactgatcatctgctataaatagaaaagaacactatagtccataaggaagataacaaataagacatagccctttgtgcattttgctttactcatcacctaccttttatggtcaaagtgggatggtagatgacagaagagatggcaccagcattgggagtggtgagaagtcagagaagaaagaagtcagagtaagaaaggtaatgagaaactggtaaagtgaacattgtcagtacctattatgattcagagttttaacaatgaagtagctactgttttacttgtagttgaaaaaattgatgttgatgaaggttaagtaattaacccaaaatcacacggtctgaaaaattagaacagctgaggtttaaactcaggtttctcagataccgtggaatctttatcttctctctgatctcattatacagctagttgcctttgtgtaagtgacaagtaagtttttttattttagtacttcattttatagctactacttcattctggtaaagcttataagagtttgtatttaatagtatcagccaccatgtcctcaggatgcttattataactagagtggctttatcaataaaacaggaatatacaaagtctgttgcctcaaggttattctcatttggacagtaattgatcaagtattggtaaaatttacctcaatgactttattttttctattatttgagtagctagtatttttgttgctgttgttaaaataaaatagctttacaggcattctaattataaatgtcaatataaaagacagttcaactaggtattcaagagaaagtgaacataattcatatgctgctgcccaaagataaatacaataaaatacaataaaattggggctatctttcatacacatgcatgcatatatattttctcaaacatgagattgttatacataatggtttatcaaatatcttatattttcatcacatatgatactgcaggcatacacacatgcacacacatgtatatgtgtactgtatacacacatagaaaaacatacccatcatacattcttatatagtggctcaaaaatggtccaaaacattatattctgatggatattagaaaactgtcttttagaaaactataactccttctgttaaaatcattcttttatttttacattgtaataccttatttaacaagtcttgcagaacttcgggtcatttaatctcttctggatgcttatttttgttcttattatgtattaaatttatggaacaacttttagtagttattataattttatattttccggccatttttctaacatacagaaaaaaaattctttgatttgccaaacttagccaagaaattgaaataaaaaattttagataaatacaaataattttaggataagtatgtccactaacaatatttggaacacacttgaacaaagcaaaatataaaaacccagaaacaaaaacaaaaaacatcgtgttgcttatctggagtttacttaattgacttttatattgtatcaagcaaccataaatgtgatcccttgagctacaacaacctattattaacacatttttgttattttaaatggtccatcaattctatttgttttcagtagaaaaagagaaatgaagaaaatgttggtggtgttcactgaagccctgtactaagaatcttgatgctatctctggtcttaaaaggaaaaaaatgacacaacttattaataatacctgctatggatatactaagaaggagttatcacacttgccttgaatttgtcacatttgagataatactatgtccttccctcactacatattttaaaaggagagacaaaatgaaagtacataaattagaaaaaaaaatgagtgctactgttggaaaagaagatataatatcattaactgtgggtaatataaatatatacctgtgtacctgtggacagagatagatagatagatgatagatagatagatagacagatagatagatagatagacagatagatagatagatagatgcaaaaccatgtttgctcttttattaaaacctctaaaaataatatcctgacatttagtaggtaatcaataattatgctcactgaaagtagttaaataaatgatctattctttatttaataagtcctgggagaaaagagggagtttctcattttatatggcctccatagctcagaatgaataaagtgataggaatgagggattttaaaatattcaataaggtcttctgcagacttccatactaaaaaaaaatacaaatgatgaaaggaacacataattttgtgagataaatttgttcactgactttggtgtatttctgatttgtatttactaatcaaaagtcagaactgacatatacctaatattgagaataaaaatctgaataaacctagcttaaagaaagtaagcatgtttaacctaccaaccaaaaacagcctaggaccagatggatttacagctgaatgctaccagacgtacaaagaggagctggtaccatttctcctgaaactattccaaacaattgaaaaggagggaatctttcctaattcattttatgaagccagcatcatcctgataccaaaatctggcagagatacaacaaaaaaagaaaacttcaggcaaatatccctgatgaatatggatacaaaaatcctcaataaaatactggcaaactgaatccagcagtccatcaaaaagcttatccactatgataaacttggcttcatcagggggatgcaaggttggttcaacatatacaaatcaaatgtaattcatcacgtaaacagaagtaaaaataaaaactatatgattttctcaatagacacagaaaaggcctttgataaaattcaacatctcttcacgttaaaaattctctataaactagatattgaagtaacatacctcaaaattataagagccacatatgataagcccacaaccaatatcatattgaatgggcaaaaactggaaacattccccttgaaaaccagcacaaggcaagaatgccttctctcaccactcttagtcaacatagcattggaagttctggccagggaaatcagggaacataaagaaataacaggtttttaaataagaagagaggaagtcaaattgtctttttttgcagatgacatgattctatatctagacaatcctaccatctcagctgtaaagtttcttaagctgataagcaacttcagcaaagtttcaggatacaaaattaatatgcaaaatttgctagcattcctgcacacaaacaacaggcatgcagagagccaaatcatgaatgaactcccattcacaattgctaagaagagaataatatacctaagaatacagctaacaaggtatgtgaaggactttttcaaggagaactacaagccagtgctcaatgaaatcagagaggacacaaccaaatggaaaaacattccacgctcaaggataggaagaatcaatattgtgaaaatggccatactgcccaaagtaatttgtagtttcaatgccattcccattaaactaccactgacattcttcacagaattagaaaaaaactattttaaaaatcatatggaactaaaaaagagcccataaaaccaagacaatcctaagtgaaaagaacaaagctggaggcatcacactacccgacttcaatgctacaaggctacagtatccaaaacaccatggtactggtacaaaaacagacacattgaccgatggaacagaatagagaactcagaaataagactgaacacctacaacgatctgatctttgacaaactgacaaaaacaagcaatggagaaaggattccctgtttaataaatggtgctgggagaattggctagccatatgcagaaaactgaaactggaccccttccttacacgttatacaaagattaaatcaagatggattaaagatttaaatgtaaaacccataactataaaaaccctagaagaaaatctaaacaataccattcaggatatatgcatggcaaagaattcatgatgaaaacaccaaaagcaattgcaacaaatgcaaatcttgataaatgagatctaaataaactaaagatcttctgcacagcaaaagaagctatcatcagagtgaacagacaacatacagaatgggagaaaatttttacaatctagccatctgacaagggtctaatatccagtcgacgaggaacttaaacaaatttacaagaaaaaaaaaacacttaaaagtgggcaaaggacatgaatagacacttctcaaaagaagacatacatgcagccaataaacatatgagaagctcaacatcactgatcattagagaaatgcaaataaaaaccataatgagataccatctcctgcccgtcagaatggtgattattaaaaagtcaagaaacaacagatgctggtgaggttgtggagaaaaacaaatgcttatacactgttagtggaaatgtaaattagtttattcattgtggaacacagtgtggcacttcctcaaagatttagaaccagaaataccatttggcccagcaattccattactggatatatacccaaaggaatataaatccttctattataaagatacatgcacacatatgttcattgcagcaatattcacaatagcaaagacatggaatcaacccaaatgcccatcaacgatagactggataaagaaaatgtggtacatatacaccatggaatactatgcagccgtaaaaaggaatgagatcatgtcctttgcagggacatggatggagctggaagccattatcctcggcaaactaacacaggaacagaaaaccaagcacagcgtgttctcacttataagtgggaactgaaagatgagaacacatggatacatagagtaaaacaacacacactggggcctgtcagggtggggaagagttgcgaagggcatcaggaagaacaactaatgggtgctgggcttaatacttaggtgatgtgttgatcagtgcagcaaaccactatggcacacatttaccacataacaaacctgcacatcccgcacatgtaccttggaacttaaaataaaagttgataaataaataaaaaaataagcattttaaagtgcattgatgtcagggtgatgcttggataagaagatggtggaataacatggaaaaacaacattattctaaatctatgtgaggaggttaccaaaatatcttctcatttgccaggcaattttattttaggaattcatacatgggaaataatcaaacaagtgcataaagacatatgtatactaatgatgacaacaatataatttataaaaagaaaataaaactagaaacaaccaaaattgcctgcaataataaaattgggtacatgaattatggtacattcaaataaaggaatatgatgagataaaatggaggaagcatatctctaatccgaggcataaaaagcacttcatagcagatgaataagcaacatgtacaacatgaacccattcttataaaaataacctgtgtgttcaaatatattgctacatatccgaaagaaaatttacacaccaacatattaataacttgtagtgagattcataagtatacgttatgattttaggcactttttgtactttcttctaatttatatttttcttaactgtcaataaaagcaataacatttctgctttataaatctctacctgaaaaaaaaaaatgctacttcacatttaacatgaatttaggtttagaaattatatttgctaccatatttttagaacacaattattccttacttacctgagatagattaaatttaaaaattgtttcatttcttttttttccttttttattttacatgtgcataatgtgcagtttattacataagtatatatgtgccatagtggtttgctgcacccatcaacccatcatctacattaggtatttttcctatggctatccctccccttgccccccacccccaacaggccccagtgtgtgatgatcccctccctgtgcccatgtgttctcattgttcaactcccacttatgagtgagaatatacaatgtttggttttctgttcctgtgttagtttgctgagaatgatagtttctagcttcatccatgtccctgcaaagggcatgaactcattcttttttatggcttcataatactcagtggtgtgtatgtgccacattttctttatccagtctctccatgatggacatttgtgttagttccaagtctttgctattgtgaacagtgctgcaataaacatacatgtgcatgtgtctttatagtagaatgatttaaaatcatttgggtatatactcagtaatgagatcactgggtcaaatggtatttctagttgtaggtccttgaggaatcgtcacactgtcttcaacaatggttgaagtaatttacactccaaccaacagtgtaaaagcattcctattactccacatcctctctagcatctgttgtttcctgactttttaatgatcatcattttaatggcatgagttggtatgtcattgtggtttttatttgcatttctctaatgatcagtgatgataagcttttttcctatgtttgttggccacttaagtgtcttcttttgagaaatgtctgttcacatccttcgcccactttttgatggggttgtttttttattttcttgcaaatttgtttaagttccttctagattctggatgttagccctttgtcagatggaaagtttgcaaaaattttctcccattatgtaggttgcctgttcactctgatgatagtttattttgctgtgcagaagctctttagtttcattagttcacatttgtcaatttcagcttttgttgccattgcttttggtgatttagtcatgaagtctttgcccatgcctgtgtcctgaatggtattgcctaggttttcgcctagggtttttatggttttaggtcttacatttaaatctttaatctatcttgagctaatttttgtataaggtaaaaggaaaggatccagtttcagttctctgcatatagctagccagttttcccaacaccatttattaaatagggaatcctttccccattgcttgtttttgtcaggtttgtcaaatatcagatggttgtagatgtgtggtgttatttctgaggcctctgttctgttccattggcctacatatctgttttggtaccagtaccatgctgttttggttactgtagccttgcagtatagtttgaagtcaggtagcgtgatgcctccagctttgttctttttgcttaggattgtcttggctatatgggctctttttggttccataacaaatttaaaatagctttttctaattctgtgaagaaagtccatgataccttgatggggatagcattgaatctacaaattaatttgcacagtatggccattatcatgatattgattcctcctatccatgagcatggaatgtttttccatttgtttgtgtcctctcttatttccttgagcagtggtttgtagttctccttgaagtggtccttcacattgcttgtaagctgtattcctatgtattctattctctatgtagcaatcactcatgatttggctctctgtctagtactggtgtataggaatgtttgtgatttttgcacattattttgtatcctgagactttgctgacgttgcttatcagcttaaggagtttttgagctgagacgatggggttttctaaatatacaatcatgtcatctgcaagcagagacaatctgacttcctctcttcctatttgaataccctttatttctttctctggcatgattgccctggccagaacttccaatattatgttaaataggagtggggagagaggtcatctttgtcttgtgccgattttcaaagggaatgcttccagcttttgcccatccatgatgatactggctgtgggtttgtcataaacagctcttattattttgagatacattccatcaatacctcgtctattgagtgtttttagcatgaaggggtgttgaattttatcaaaggccttttctgcatctattgagataatcatgtggttgttgtaattggttctgtttatgcgatagatcacatttattgatttgcatatgttgaaccagccttgcatcccagggatgaagctgacttgattgtggtgtataagctttttaatgtgctgctggatttggtttgacgaattttgttgaagattttcacatcaatgttcatcagggatattggactgaaattttctttttgtgtgtgtgtctcttccaggttttgctatcagaatgatgttggcctcataaaaagagttagggaggagtccctctttttctattgtttggaatagttttagaaggaatagtagcagctcctctttgtacctctgtttaattcaactgtgaatccatctggtcctgggctttttttggatggtaggctattaattactgccttaatttcagaatttgttattgatctattcagggattcaacttcctcctggtttaatcttgggagagtgcatgtgtccaggaatttatccatttttttctagattttctggttcatttgcatagaggtgtttatagtattttctgatgatagtttgtatttctgtaagatcagcagtgatatcccctttatcgttttttatcgtgtcaatttgattcttctctcttttcttctttattagtctggctagcagattatctattttgttagtattttcaaaaaaacagttcttagattcattgattttttgaagagtttttcatatctctatcttcttcagttctgctctgaattagttatttcttgtcctctgctagcttttgaatttgtttgctcttgcttctccaagtcttttaattgtgatgttagggtgtcaattttagatctttcccactttctcctgtagggatttagtgccataaatttccctctaaacactgctttagctgtgtcccaaagattctggtaagttttgtctttcttctcattggtttcaaagaacttatttatttctgccttaatttcgttatttacccactagtcattcaggagcagattgttcagtttccatgtagttgtgcagttttgagtgattttcttaatcctgagttctaatttgattgcactgtggtctgagagaccgtttgttacaatttgtgttcttttgcatttgctgaggagtgttttacttccaattatgtggtcaattttagaataagtgtgatgtgctgagaagaatgtatattctgttgatttggagtggagtgttctgtagatgtctatcaggtccacttggtccagagctaagttcaagtcctgaatatccttgttaattttctgtctcattgatctgtctaatattgacagtggggtgttaaagtctcccactattattgtgtgggagtctaagtctctttgtaagtctctaagaacttgctttaagaatctgggaactcctctattaggtgcatatatatttaggatagttagtgaatctgggtgctcctctattagatgcagatatatttaggatagttagcgaatctgggtgttcctctattaggtgcatatatatttaggatagttagctcttcttgttgcattgatccctttaccattatgtaatgcccttctttgtcttttttctgtttgttggtttaaaggctgttttatcagagatgaagatcgcaacccctgcttttttttttttttttttttttttgctttccatttgcttggtaaatcttcctacaaccctttattttgagcctatgtatgtctttgtatgtgagataggtctcctgaatacagcacactgataggtcttgactctttattcaatttgccagtctgtgtcttttaattggggcatttacccaaattgcatttaaggttaatattgttacatgtgaatttgatcctgtcgttatgatgctagctggttattttgcccgttagttgatgcggttacttcatagtgttgatggtctttacattttcatatgtttttgcagttgctggtagtggtttttcctttccatatttagtgcttccttcaggagctcttgtaaggcaggcctggtagtgacaaaatccctcagcatttgcttgtctgtaaagggttttatttctccttcacttatgaagcttagtttggctggatatgaaattctgggttgaaagttcttttctttaagaatgttgaatgttgacctccactctcttctggcttgtagggcttctgcagagatctgctgttagtctgatgggcttccctttgtgggtaacctgacctttctctctggctgcccttaacatttttccttcatttaaaacttggggttgctcttctcaaggttatcttcatggtgttatctgtatttcctgaatttgaatgttggcctgtcttactaggttggggaagttctcctggataatatcctgatgtgtgttttccaacttggttgcattctccccatcactttcaggtacaccaatgaaacatagtttggtttctacacacagtcccatgtttcttggaggcttttttcattcttttctttcttttttctctaatcttgtcttcatgctttatttaattaagttgatcttcaatctctgatatcctttcttctgcttgatttggccattgatacttgtgtatgtttcacaaagttctcatgctgtgtttttcagctccatcagatcatttatgttcttctctaaactggttattctagttagtagttcctgtaaccttttatcaaggttcttagcttccttgcattgagttagaacatactcctttaactcagaggagtttgttattacccaccttctgaagcctacttctgtcaattaatcaaactcattctccatccatttttcttcccttgctggcgaggagttgtgatcctttggaggagaaggggcattctagtttttggaattttcagcttttttgtgctggtttttcctcatcctcatgtgtttgtctaccttttgtctttgaggttggtgaccttcagatggagtttttgagtagtcatcctttcagttgatgttgatgctattgcttcctgcttgggagttttctttctaacagtcaggctcctcttctccaggtctgctggagtttgctggagttcactggagttcactggagttccactccagaccctgtttgcctgggtatcaccagtggaggctgcaaaacagcaaagattactgcctgctccttcctctggaagcttcatctgagaggggcacctgccagttgctagccggagctctcccgtatgaggtgtctgttggcccctgttgggaggtatcttcccatcaggaggcctggggatcagggacccacttgaggaggcagtctatcccttagcagagctcaagcgctgtgctggtagagccactgctctcttcagagccagcaggcaggaacgtttaagtacagccaccccttcccccaggtcctctgtcccagggagatgggagttttatccataagcccctgcctggggctgctgcctttctttcagaaatgccctgcccagagaggaggaatctagagaggcagtctggctacagtggctttgccgagctacgatgggctctgccctatctgaatttcccggtggctgtgtttatactgtgaagggaaaaccgcctactcaagcctcagtaatggcagacgcccctccccccaagcttgagtgtcccaggtcaccttcagactgctgtgctggcagcaagaatttcaagccagtgtgtcttagcttgttgggctctgtgggggtgggatccactgagcaagactacttggctccctggcttcactttcctttccaggggagcgaacggatctgcctcactggcgttccaggcaccactggggtatgaaaaaaacttcctgcagctagctcattgtctgcccacacagccacccagctttgtgcttgaaacccagggctctggtagtgcaggcacccgagggaatctcctggtctgtgggttgcaaagactgtgggaaaagcatagtatctgggcctgagctccatccctcacagcacagtctctcatggcttcctttggctaggggagggtgttccccaaccccttgcacttccctgtgaggcaacaccccaccctgcttcggctcaccctctgtgggctgcacccactgtctaaccagtcccaatgagatgagccaggcacctcagttggaaatgcagaaatcacttgccttctgtgttcgtctcactgggagctgcagatgggagctgttcctatttggccatcttgcccgggaataaaaattgtttcatttcttaaagaaaaatggactttgacaatctctataataatgtaaaggaatgtatcttttatttctccatttcctcatattgatgagattgtcatattaaataaaataggatagcaaagtttggccctatcactttaattaatgtctataagttagaggattaatattatattcagatgtactagaaagcatctgaaggcaatatactgatagcaaatggaaaaacatcccaaagatatctgacagggtacacaaattcatttatgtagatttatggtagagcagtgagtctgtcatgtgttatcttctgagatcagacatccttgtttatcacagtgtgatattttgaaatattatcaattcattattgctacaagaactgtaatatggataggtgcatatgatcattagtgatattccttatactgatgatgttttactcttcttaaaatagttcttcctgtatactcaaaattccaagacagtataagcagctcataaactggtaatgtaggaaaagagcatttggtgaagttaatcttataacaaaaacaaaatagaggctgcaaagagatttggcaaaaatatagggttattttaaattttgaggaaattatgaatatttttaacgcataaagtcttttgtaaaattattttttacagattaccatttgacttacaaggagttaattaaaaattattctgaaaaattatgtgcctttttttaagaacatgggactttctacaagagagactggcaaatctacaagatttcaagcaaattcaagttataaaattaagcagtcacagctatgatggtattttaattcttccattctgttgtgaccattccagattctttttaaataaaaaattaagacatttaaaaagcttctgtttattttagccatgaagaaagacggttttgtttcttcatattaaaaaatggttatgtttagctcatttatccagaccttgaaattgatctttcatttactataagtctgtaaataattttataatatttataaagaaaactggcagtgacatttattggtctacatcatccagggaagccagaaaagcatacattttatatactttaattaaaatttacttcaactgtatgttaaactccttccaaatactgacattttagataaagcccatgaaatgtgtattttaaatttaaaaagaaaaacaaaacgactttataagaatttcgacaatgaatgcaacttttaccattttaactagccagtttcctgaagacattaaatgtggaaaatgatgctaagcaaattaagcaaagacacaatagcagaaccatatagtctttgaatataggaatgtctcactccaaagtgcatgtctttttcagggcaccacacactgttactacacatatgatctacattctagactggagagagaagagggttttccttaacttcagcaaacaaaccacgtgcatgaaataaaggaaaaagttggttcaacagagtccatgagaaaatccttagaagggctgacagcaatcaaataaaatggcatatttgcccataagctgctgtcaactcgggtggctttaataaataaaagtcactggttggccgggcacagtggcttatgcctgtaatcccagtactttgggaggccgaggcaggcagatcacctgaggtcaggagttcgagaccagcctgaacaacatggagaaaccccatctctactaaaaatacaaaattagccgggcatggtggtacgtgcctgtaatcctggctagtcaggaggttgaggcaggagaatcgcttgaacctgggaggcagaggttgcagtgagccgagagcacaccattgcactccagcctgggcaacaaaggtggaactccatctcaaaaaaaaaaaaaaaagtcattggttaacagcaccaccactattctgtaaacaaagcaagcatctctggagtataaattctggtgctccattttaagaggggcattagcaaacaggagaataaccaaaatactgaaagaatagtcaagatattgaggaatattcacctatgacaaaagagcatgataactatctgatatggctttgttgtgccccacccaaatctcagctttaattcccacgggttgtgggagggacccagtgggaggtaattgaatcatgggggcagtcttccccatgctgttcttgtgatagtgaataagtctcatgagatctgatgcttttaaaaacaagtctccctgcacaaactctgtctttgcctgctgtcatccatgtaagatgtgacttgctcctccttgccttccgccatgatagtgaggcttccccaaccatgtggaactgtaagtacattataaacctctttcgtaaattgcccagtctcaggtatgagtttatcagcaggatgaaaatgaactaatatactatctttatgtatttggaggtccatcatgacttatgtccttcctgctggcattaaagaaaaaaaactaagactaaaatatggaaaatgatttgagattaggtaggtaagtacttgctcttcactggactattacaaaatgaaatggaattccttgtcaggcagtaatctctctctcaatgaaaatgcacaaattcaaaatgataaacatgtgaccacctatctggaagccatggacatgatgacttcacagagtgggcagtagtcactaaaattcctaccctcaataaaattatccaatttgggtaaaattatacaattttcctaaactatagtctttttttaatgaacgattttgttgttgttgttgttgaaataagacgtaaaatgctaaatccataggttgattttaattccctaattccagttattagcttttctacttagcaattattccttcctccttttccttcctcctctctacttctcctcttccctctcccatgcccccttctttacctcttcttcttctctctgactttctaacaaacaccttcttagcaattactatgtgccaggcactactctaaatacatttaaaagctctttcatttaatccttactataaccaatgagaaggtgatatttattatacacctcctttagtcagagaaaggttaagtaacatgtccaagatcacaccaataaatttgcttctaccacatttgatttctaaatagtgcttaacattggaaaaaaattagcaatgtgcaaaaggaaccaatttgtttatcttgagcagccaggtataagagagtcgcagccagacgaggaaaacattttagggaaacataatttatatgtttttttaaacttcagcagaaggaaagattataaaattaaatggaataataaagttaggaaaggacccacccaaaattatttagatgccaaagtaagccaatctcagctgttcttctctactctgcctgccatcctcagcaaaagcagtatgggagagagtgtgggcaaccggctgcagtagcagctgggcctatttgttaagaggaaaaaaaaaatagtcattgaggataaagggagattttgggtgtctagcagtgtgagtggaaacttggagcttggctggggagtcccagaagtgaaaagcagcagtgctgtcatcaacaaaattgcaatattacacacaccattcacagggagatcactccctgaagtagttccttaactggcaagaattcttttccacccatagcaaaacaaccaatggcaattttgtatttgttttctcacattaacagtattctagacattcaaaaatgaagcactaccaactctgctaactatccaatagatataaattagctgactaaaaggacaaatggcatttctaacttaaaacaatatattactattactatttgttgactaatataaaaacttaagtgtctaatacgcataatattatattctaaacataaccacatacaataaaatccttgaattgtattttatgtcccttgagaccagtactatagaaggcatctaacgtgtttctgagtgataactgctttattagtgtgtaagctatctcattggtaatggttttttagttttctcatttttattcttgtttaactttattaatttttaaattagagataattcagttttttttctccagataggaaaaatccttctgcaatcctaaaatatatcagacttcagtttgggcatacacattttggagcaagcaaaaaacatttggcaaaaaaatctgtcaaaaacagtgcccagtacataacttttgtcttacttctgagcagtataatgacaaaatgctatttcattcttttgattgtttttttaattgtatagttgacttacctataatattttccttcttattatggttatttaaatattattacaagcgaattttgctttggggaattacaaggaaattaaaccatatgaatgtgttacaggagtttaaacacattaacttcttatgactgtaacaatataataataaaatcaatattttgggtggctcattaaagccattctagtattttatagtcctatcttctccatctactttcttctttctggacaaaataagaaaaaattattttctttctcatattaatggaaataaacaatgatttggataattgaatgtcccaacaactaaaattataacatttgactttgaaaaaagttctttctctttataatttacgttttgattatgggtgatatggttattctaagaatataccatatggttagctcaagtttatccagaccttaaactgatggcaagctcaatattctagtactcattctaaccaattataaagtatttgtggttaccattcatctgaccagaaatatgtgtaacacttatgctttgtgacaatgtcaagcttaaaattactttttcctttctttattttctgtttgcttttattatattatttattttgcttaggatcaggaaaaataagttatgtcagtttcatcaataatacgctgttttcaaaagaaattattttttccttaccattatttttcctaaccctttctttaaacatatatcatttttgctttgctcaggattatagaagtgatcctaatttctatagacttctttttatagattatctttagtttctaaaaataaaataatccagtgcttcccatttctatttttatttactctttataataataaggtatggtgacaaatgtgtgctttcttcttaatatgacatttctatttatgcccattagtttacagtttgtgttaagtgcattgtatttaattaattatagtatagtaccaaaaaaaaacaaacttaaggatatagcatttcaaaatatattatcaattgattttgataaattaagtacatgaaaaaacattttttcttggcttatagatatagtaaaatcttagtaaaatgaaattttcataagttctttctcaaataacctgggttgagaaagtcaaatagctttcataaactaagtagaatgataaaacatagccattgcttttccttctcactatgttactaccaatagctgtgcttttaaaatgataaatgaaagacaaatggccaaattattcataaaacttttgcacagagacagactgacaaaaaaaaaaaaaatcttgctttggtcaattgggcctttctgaaaaaaaacaaagatgggtaaattatcactctttcccagttctgactttcttttctttctgctttgtcatggtattcttgtattcattctttttctctgtttcttcataatttgtcactgtagaaatgaatgaaattggaaattgggagatcatgattggagcaagtgggaagaaaagttgagtcaaatgtgacaataatcatttgaatggcccagatgaattcatactgtcctctgccacagcctcaaactatatcttttaataatttacagatattttctgaataattttaaagcagtcctggatttctcttcagaacttttgtaatggaagagttgaagccaaactagtgcctaatatgttgcaaaaggggcagaagagaaatagtctcatcatatctcctgtattctcaatgctctcccaacactatcatttcattttctgccatctctgttaggaattgtatgtggtattcagcaaaagaattaagattggtaacactagtgtgaatagatatagatatgtatctatatagatagaattaaattctgtatattaaatgcaatacataaagtatattcagtacctaaagtttattagattctaagatttgagcaataaaatgcaatataactgccctcagtattttcagactctaattgtgaatttgtagtaatcatatttctcatacaaaaaatctgaaaattcctcaaagccatttagaaatgggggaaattaaatttagcaaggacaaagaacgtgtgatactagtgtgtgtggtagagtcatgttcccagtggaattaagttaatttctgggagaatacagtgcattatatgcagtgggatgattgtgggcacatggcaggatggtgcaaggcaaggtatgacatagctaatttgttcataacatcttgcccaagctcctcctgttcatgttcaagactgagctttgggtctcttttcagccccaacttcatgctttcatagcatcccttgatatataaaaaaagcaccctactttattacgacctgtctccttttacaactggatcttaagcttcttgagaactgggtttgactaaaagctatgtgtgagagtgtgtgtgtgtgtgtatgtgtgtgtgtgtgtgtgtgtgaaacttcttattttaaaatagttttaaatttacagaacagttatggtgagtacagagagttcccctatacctatacctagcttcccttgtttacaatatacattgtatggtacatttatcagagttaataaaccaatattgatacattattattaattaaaattcatactttatttagatttccttagtttttatctaataatcctttactatcccaggattccaaacagtataccacattatgtttataaaactggattttttattcttaaaatcctagcatgatgctcagtacctaaagcattgaagaagctgaacaaatacttataaatgatttaataataagccaaatctacttaaaaattataggctcttttaattctctgaaggcaatgatatggtttggctctgtgtccccacccaaatctcaccttgaattgtaataatccccatgtgtcaagggtgggaccagatggaggtaatgaattatgaaggcagtttcccccatgctcttcttctgacagtgtgtgagttctcgggagatctgatggttttataaggggcttttcaccttttgctctgcacttcttctgctgccatatgaggaaggatgtgtttgcttccccttctgccatgattgtaagtttcctgaggcctcctcagccctgtggaactgtgagtcaattaaacctctttcctttataaattatccagtctctggcagttctttttttttttttttttcattcaaaatattctgctaatttaacgtatattttagaaagaggagatccttacaaggcggtaggacagtggtttctgggctggtgtccaagatcaaggaggaaattgttgtattctgtcccttgaaaagattatgatagttaacaaatgcacatggtcactttacctattattaatgtgattaaaattaaagtgtttaaagcaataaactttgttaattactcattatatatagctatccactatttcccaaagctatatccattgattttaccccaaaagaatttaagggaaaaaactttagaaagcctttctctatgataacatagcatcctgtgcactctgaaatgaattatgtgttttaatatgtatattgtgtggaaacaacacagctttatcgtgcatggtgagcaatgaggtcattcataacaatattaatggaatgtcttaattttatcacactgttgggcagttctttatagcaacatcagagcagattaatacaggccatgaccaagatgtataacaaaggggatgaagtggtaagcgacatctaatttcatttctccaggaaaacttctctttgagacatggaagaatttttgaattttataaaatgcttttccatgatcgatccatattagatgttttctcatcagaactcaatcatagctacatcatgctacaatttacaccatcaataatctttaaaaatatttaaattatgtgctaaattgtcatcaatgaataggcacactttatatttaatacaaaaatatgcagataatggtaatatagttagatatctatgaatctaagtatatttatcaagatcaaggctgtgatttggacattcaacaacacccttaacctaggggatgaagctaaaggaggaataaatgaaaaaggtaatatgagcttgaggcttttttgtagcatccttccacacacacagcccagtgtttctcatagctgagtcttcactaagaatcacacacaggacttgttaaaacagagattcctggccgggcgcggtggctcacgcctgtaatcccagcactttgggaggccgaggcgggcggatcacgaggtcaggagatcgagaccatcccggctaaaatggtgaaaccctgtctctactaaaaatacaaaaaattagccgggcgtagtggcgggcgcctgtagtcccagctacttgggaggctgaggcaggagaatggcgtgaacccgggaggcggaggttgcagtgagccgagatcccgccactgcactccagcctgggcgacagagcgagactccgtctcaaaaaaaaaaaaaaaaaaaaaaaaaaaaaacagagattcctgagcctcagaattattgattcagtagatctgattcagcagctcccagggaatgctgatgttgcagtccatggaccacactctgtgtagcattcatttaactccagtttccatctcctttctgacccagctcagaagcagagcagaagaaaattatagtaacatcatctcctgtgcaatgtaattcaatcaagacttcctgcaggtgaattatttagcagtagctctgaaccttctaaaaaataaagttagcctttatagttgtgttattttgaccataatatggaagccaactaaatatatatacatttcaattcagtagataccaaagcccaggcggtaattatagcctttaggaatgatttgaagtgaatttattccatccccaagggtcttacaaaaaattactccttgccctgaaggacctttaaatatatttaaaaacaattacataaattagaaagtattataagatactataacaccatatcattcatctttgtgatacatttaaatttttttctaccaaaaccatacgagataggaagtgttcattagtccctttataatgatgaggaaaggaagcctcagttcgatgatttagcaagaataagacagcatcaaataaaatatactgtagattcaaaaattgtaagtctataccctttccactacagcatactatctcctaatacaagtttcagaagtgttttggagaaacacttctgaagcctggtaaggagaagaaaggagccctacatttctatacttggaaaggacctgaagttcataataaactttgtgactcagtgttaggaaaaaagcaatcaggaggagtaaacagctatacacaatgctgagagtacatttcctatttgactttacttccacagtgtatcttaaagcccctctccattcccatcatttcctgggaaagaacaagtcaggagggaaagagtcagtgtcctcagctgacctctgttttcaccctcttttattctcattttctttgctgctgttcttttccggttctgaagttgatctggctacctaaaatcacccctgggacttattcttagggattctgttccaccactctatcctgtaaataaaaccccctttttattctggtttccctaaattaaagctcaaaactcagagaaaacaaaccaaaagtgcatagaaataggtttacatcaataatattttaactgacatttaactccagtttagctacagaatacttggctggcaggctctgctctctcctgtgcagtgccctaattcctctcctctccaattgccacaatcccatgttgcctgagagcatcagcttcccagcggaaaaacaggttggagaaagagggcacattgtccaggtggctagtaagctatttacttagtatttcattatttcctacatcatggatttcaaccaattttcaatacctagtaagtttaaagtttttctaaaaaattcaaaggttatgttttatatttattgtgttaaacaaaaatgaaacaaatattgaaggtacacagaaggccaatgaatacatatctttcactaaaagtatgttttctttccccttttggcttaaggtgaggaagaaatcaaaagtatttatctggaagagaagtagaagaagagaaaaagagagaaggggtggtgccagcctcacaaaggggtacacagaattaagtaaaaacagaaagggaggagggggtatagtgataacccagaaatgacaaggataacacaagacagatagaaggaggaggaggagaggaagaagagaaagagaaagagaaggaagaaaaacaagaggaaggaagtagagaaaaaggtggaggagagaatgtagatgaaagaattcaactgatgtgtcaggagggtgcctggaggtcccagctgtttcactaaatgcagcactgatgagaaagaaggtgaatagacagaaagccccagccttttctctaacatatgttatgctaaaggggctataaatagttgtccaggattcctcagtttcatgggtattcctgcttatcccaccccatcatcttttcctttgaaaaacacagttctaaatcattttgttttattcagatactcacttgatgagcacttgttgaatgcctactaagtgtcaggaactgtgcatggcaccagatatcttacctgttcatctaagggaaggcaaagtgggagactttctttcactttccaagtaaacaacacatgctgagctgatagctgcctataggacactgtttagtttaactttaggcagtgtggtctggccttagtaatattagttctattgtgcgttacaaagctgggcctacaattacctttgttagtactgtttattttgtggatttggtctgttgtctccaaggtgccatcagataaaattccaactttccttaaagtataaacaaaataattcttacaataacttacaaacatgagagacatcaatattctttgctccttctagttatctactctaataagagctggtgttcattaaagaaaatctttgcttttaagtaaaaatctgatgttaaggatctctcttcatcttaagttgtaatttaacaattagctcatgattgcttttagaataaaaaagagaacagcatagattaattctctctgaatctcatctgatttactgagtaatttataaaaagcttcctaagggttaagtattctgcacagtaatctgcattatctcatgtaatcctttcaaatttttgcaaattatgttttaccactttaaagataagaaaatgcatattcagaaaacctaagtaacttgctcatgccatgcagtctgaagccagattcaaattagatatgcctcatccaaagtctagggggttttaggccactgaaattcgaatgtaagagtgttttctaatacctgggcttaaactagctgctatgtttcctatgccaaagctacaaactaaatccttgagcatagcacagtgatggctgagagtttaggtaccaaggatggtagtgaaacacatttctaagtcccagaaatcaggcatgacaatagatttctcttttattttttcataccagttgtggaggtaaggttaccaaggcaaaggagccctatggttagaatatcctgaaataggtgttagaactagggctgaaaacttctcgagtaatcagttgtcttggccaccatagggccatatgaaggaaagatatcaattctgcagagatgtcttttcttgaagtcatcactgtttttgaccaaaaatgttctcttaatatcagagactgcaacacttggtgtaaatgtggtatggacatgtcctgttcattcctagtccagaatatccagactataaaatatccagtcttgtcactatcattcctatcatgagtgcaaagaataatgctcacttaagactaaggaattaataataacactgatgttttctcttatgcctccaatgttatttaaggctttactgtgaaaaaaaatatcaaaataaccatcatcctttgtataaggtacagagtattacaaagtgtcatatgttacactagaaactactaacttatggccctgtctattaaaaccaagaaaataatctaaatcttcattctgcaccctttggaaaatattataaatggtataattttagtttagttttgtttttaactctcagagactgaaattataagactttaacactgggatggctatgtatgaaggggcatgcatgcatgcaaagtgatatttctggattcctgcagactaaattcctctattaaaccacagaagagttttatatacaaagataaagaaatacatctttgcacacactcccactaagaagtctcaatgatgattcctttaaatgtctttgatgaaataaaactgactgagcagattgttagcaataattttcaccagtaacaaccaatttcatggtttggtgctttattatgtggtcatagaactgaggccaccaagtgatctcatcccaaaaagaaacagaggccctctctgtgtaatactctcagctctgactagatgacaaatctgacctggatagcaaaacaacaatatgacaacataatttttaaagcatatttcattatgacatcatagctgttgaatatatttattaacaaagaacaggcattgattatatattatgtatagaatacttcccttgtaaagctgaaaaaatgatttgatacacataaattttccactccaaaattgacccagttcatatataaattcactgtttatatatgaactgttttttcctaaccctgagcttccctcaccctattaccatactaaaagataactgttttcccactgtaaaatgcaacatccagataagaatttaataattcatagaaacatttggggactttcatatatccagatgcactgatgtgatacatggacaatatttgtctgtagcaaatataaaaatgcaaataatagcactctaaaattcataggaaggctctctccacagaaagcatattttatataaagcagactcaacaaaacatattgtaatttctcacaacttatccagtgatattttttataatataaactatttcttaataaatccaccacttaattctcactgtctctccctgaagctctgggcacataggctagtgtttcctcctgggtcctatttaatcactctgcttatgaatcatgtcttatgaccagtttttatttattaacacccagagatgtgtgactaatgtcactattgataataccaggctattggatgaggaaccaaagctatgagctgggtcaggaaaaactggctcagtcactacctcatgttttatttgccttgggtataaaataaataccatggcctccagaatgatcattcagaatatttatttaacattgtgctcttttagaattctctgtcaattattttcttgtaaatggaatgaattctaaaatgtgtgttgtagagtgaatacatgtaacaaatcgatatgtgtacactacagcaaaaaaaaaaaatatataggccatgaatcttggaaaattcacatacaatgtaatcatcttctgagttattataactagaggtcaaagatatggaagatgaaatttggagtgagtgcaatctatcaagataaatcatatgttttatgcgatttaagagcaactttatcctgtcttctatattagcattatcctagcacttgttgaaatataaactcataacattttcaaggtttttctctttaggacctgtttccttccaattttctcactttgtatcagtctgcaaaaacattaataatataaatagtttttaggtgataaggtgcattcacagatattgttgtttcacttgattatctcaaaaacccagtaaaatgtacaggcaaattaccattactacccctattttcaaatagaggaaactgagatgcagacaattaattatcattattataagtggggagtacagagctggagtagaggcctctgatttcaaatcctgagctctctgaactatgataaatctgtatttaattgattataatacccaatacagatacactaattaacactctatcacaagttctatctgcataagtatatattccatgtttaaatctacatgtataatgttaacatattttaggaatgctcttctgccatatccatgcctttatttaaatgtctcttcaccaactattctaggagaacattttatgcttaagcagcaattctccttgatttctgcaactgcattcttgcttattgagacttcaaacacctacccctgtctgccaagctcccatgattgaatttctggggctttccatgtacatcggtatttcttgctcaacataggtcttggcttatttgttttttcttctctgagctccattatcaagaagcttatttttgccttccctgtaacctcattagtgcaggatggtgaaagataaggagagaacagatatcaacagaaggaagtagatgaatccaccaggacttttctcccttcattctctctttccttggtttctgtcctgaggaccacagtatttttcaaagaaacccttggggaagaatattaaaattttgcattaatctcaccaatattaccctattgagctgggataaagttagctataatgcataactattcatgaacttttaaatatttgcctgatacagccaaactcaactcaaatcttgactgaaaatttttacaaagcaggacagcatcttgccattttaatctttgctacatttttacttattaatgtaatttaccttgtaactagaaaatacattaaaagatttatgtattgcttcaacaagagtaattatctcatcattttatccaccaggcttgccctaagccagtatattttcttaatattagtgtgcagtgagatattcagttagaagagagagggattcaatattaccccattggggcacaaggcagtaggaaatcaactagaaaatattccacacctcttactacccttgtaccttgtctccttctctctctctctctctctctctctctctctgccttttctcctctttaatcctaatgatcccttcctttccagctctagttaagaacatgtcattcccagaaatagtaatggagaatgaaggggagaggaaaagggcaaatctctggacattttttttctgaacatatttttatataatttaactcacgctctgtatatgataaactttctcctcctccttgggaagaaacaataggcttgtgttttcatcttaaaagtgaagaatatgagaaaaatgcctgcctttctcccatacagcttagatcattaactgtgaaaagaatttctgaattattctagtaggctatctccagggagcctcctggatttccttgctagtggtcaggcagcggtacagagatgctatatgacatatacctagtgcctcttatattgaaagattatatactcatttaaatattaattacttaattcactcgctactgaacacttgtcgttactgacattagtcaagtcagcaaaagattaatctgtaatatcttattcctagtttttgaagacttctaaaatattcactgaattccagagtctagagagataaatgggctgttcatattgtattggtgggactgaatatccctcctctgacagtatatatgctcttcttttcactgaggcccctgaggtgcagtaggcatttgctgcttcaggtagcatctccagtgtgatctcttaactgactttactaactaaattgcacaagtaggaacattctattttcaggtaactctctctattctgcctttgtataaaaacatcatattgtgcattttcagctggttccattaaattcaaagttaagggaaatcctgtgggagttttcagtctattgtacatatagatactagcggttttactctcacaccatatgacaccactcataacatcagttacaattatttctttgaatataagtgacataataaagatgaactcgataatagtattatgcataacatttacttgtatcagagaactttggtattttttgatcaaattattaactctcttatgaaatattaaaatgtgacctgttggaaaacacactgatattgaaccatgaaaacacaagtaccccaataatagggtataaaatgttaatactagatataacagaattgtagcttgcaaaaactggcagcttatctacttgtctacataagaaaaacaatcaattatatttttttgcatttttatttgtccatattccatcacatcaaatttgtacatgttgacatctttgatgataaacttcttagaaataggcattttgatacataccatgatacatcttcccaagttaaaagattagtgttaattctgggcactatattttaaacactttaccaatttagtatcaatggatttcttaaatttatattatctactggatagtattataggaaatctatttaaactaagaaaacatccactattctaaaaatgaaaaaatttctatagtcaacatttactgaagattgtccaataaaaagacaaaaaggccaaacgtgtcacataaaattgaggactccctttttgtttctcctgataaatattctacctgtacttagaaaatacaagcttctgttctttctacagtgggggacaatttaaaagcttacacaattgaaaaatgattcttatgtaatcctgagtattacatctgctatctgtctcaatgtgtcaatggctagtgataataaatacttctttgctgacaatttattccgaatttatattaagtcagcaaagtcactttctctgagcatggttttgtttattatttgtttgtttacaggaggaattaccaaacctattcatgactggcttgtattggtcctgatgcaaaatctatcttttaatcatttatttatgagtatgatgttgctttacaagacaattgtagaatgaaatatttgaacatttgctgttagatcttcattaaggcaatataaatttacactacaaatgctagtgaatactaatactttaatccatattagccattttacaagcattgtcataaactattttcctttgccacacatgaaaaaattctaataatcaattcaactggaaaactaatttatattagttgttaatcattttaattacatgatgatgacagttatgggtagggcatcatttttctcctcgggatttttattttctcctcttacctccattatggaaacaaaacaaaacaaaaacaaaaagaacaaattgcacccctatttctatagccctttcccagcatccttgtttctcatatgcataaactgatatttaaatatctactgttaacttggtggattcagcctctcaaggctattttcaacctgcttcctcccttcctgtgttccgcgggctagtgagtgaactccttattgataaaatccaatgtttacagacaaaaataacatctctaagttgacatgtgattttgcactgttttcagatgaggtgagtatgacacattaatcagaggtacttagaattttaggtcagttttgcaataaatttttcaggtgcattttaaaggtctttgaagaccataagcctatgttaatgttaaacgactttttttttcttttttctttttctttttttttttttttaaacaaaaggatctggaaaggtaacctacctttatgtgacaggcgtaaccgggggtgggtagtatcagctgtatgacctcctgtccaaagctccagtaagtaaccccacaggagcaaggtgataatgtgccccgcggatgccatgctgccgtgttcaccgtccaagccctcgctcctcactttaaggagggtctgagttttacttaggacttccctccaggggcagcgtgcgagaggctttgtcagaaatcgaacgcgttgtcatcagaaagcacagttccgaagtgccatttgtcaggctgtatttggctatgtaaaacctttctttcctcgggacagttgtttataagccgggagcaagaggacattccaaagagtgagtcttcagagccatgtcctgtctagagcgctcttcagcaactacgccggtagattcaggaagaagctgtatttttcagtcacttgggcaaagctgttcattcagaaaaaaaaaaaaaaaagagagaaaaaaacaaaaccgagcacacgcactcccttctcccgtggaggtcctctcttcgggctcctggaagcctctcagaagtcagcctcttgcactgacttgccaaactgctagttttaattcacctttcaccttgctaattaaaaacaagaagtgccattccctctaggagtcgcaggatccacccagcagggatgcagtctgtcagtggctgtttacaggaaagttcaggcagggttgagcagcgtacttgctgtttctag

SEQ ID NO: 2738 - DNA, 12070 bp, Homo sapiens
  source 1..12070: mol_type = genomic DNA
tgcaagaaatgtagttctatttattctctgttctaatgggtataaacattttgttatctaacttgaacatcataccaactcaaaggcaggtcttactagcaatgactggggctcagagaggtttggcgacttcacgaaggtcacacagctgtcagggggaaaagtcagaacttggatccaggtcttcagactctcaggtctggtgtcatcctagggggcttggtgatggccatatctttaatgtatttgtggagagtgaaaggctgtcagtgagtaagcttaagagaacaggagacttgtgtgggaaacagtcggtatccattgattagactgaatcatgtagaattgctaatttcaccattttgaactatcgaaatcactatttggtatgactcaacctcatcctttaagtacacattcatgacagtgagtggttagacagtgattcctagattagtttgggatggggcagtgccttccataggacaaggccattcctggtagagacggagggagcaggctgtccttcagctaggggcccaggggacttcctggctgctgtgtcctttagcagggccttggaggatggaaggactctcctggcccttaccacaggggctattcaggaacagcctcctgccgtggcactggagctgcggtggccctctgaagactgcagggacagcaacaggcacaaagaagtcaggctgcatgtggccccagtcgggactcagaggaggaaagggaggggttgcgggggtcaatgggtgatgtgcttcctctcccatagctgaggagtccttgcaatggccttcctgagccatcagcaggcctatggccatgtgactagggaggagaagggatatagggtaatggtcttctggggcctgctgggcctggtcaagtctgaggaggagatagagaaaacaaagcagagaccctcctcttcatctggggagaagggacctgattctaaacggagatatgtgaggctttctggggcagcgatggaaggacaaggacagaataggtgtccttgttgccccatggagaatgggcttcaggaagaatctgcctcagtcattttccagaagtgcctgagaggtgcagggcccgagtctggttaggtgacagcgggtcaagaggaggacattgtcctctctcttgtgttgctgcagatgccacaaaactgggccacggcacgatcaggcagttctggggcccccaggagggcagccttggggtgggcacagccagccctggcaggatgagcaactctgggtgggggggagtgggggatgagcagggggacatgaagatgcttggtggagcctggggtcatggctggtatctggttcctcccctgtgattccttcttggggactccaagacaggacaaggaagactggagccctccagaaacagatgggcccaggtccgtaagctgaggattcagtcccccctggattcaagcccagcatgtgcctacccagccagatgctccatgaacacagttcagggggcccgaagacagcactgttacctggagcccacatacagcctcagcaggcaaagggagactcagagaaaacatgggagggatttacagtcacatgcaggcagggaccagctcaacccttctttaatgtcatccagggagggggccagggatggaggggaggggttgaggagcgagaggcagttatttttgggtgggattcaccacttttcccatgaagaggggagacttggtattttgttcaatcattaagaagacaaagggtttgttgaacttgacctcgggggggatagacatgggtatggcctctaaaaacatggccccagcagcttcagtccctttctcgtcgatggtcagcacagccttatgcacggcctggaggggagagaagcagagacacgttgtaaggctgatcccaggcctcgagcaaggctcacgtggacacctcccaggaagcgctcactccccctggacggccctggccctgcacatcctctccctccctgtcacataggccttgctcctcctcaaggctttggctgatggggctggctcccctctgtccatcttcctgacaagcgcctctccccctgctcaggtgcacccacaactcagaacagggaagagcatcgtcactccacgtctgcctccagggctctctcctttctagtacacggcttgaagctccttgaggacacggaccctggcagtgaccttcacagtgcccagaccccaagataatgcagccattcatggaactgcagttgttcattggtcgcctttagttttccaaaataagtgtcatctttagctgaaatcattcattaattcagacaccaaatctcacagatcgaaggagtcagaaattcctttgaaacaacttagcccaaacctttctgtgtcagtatggataaatcaaggcccaatgtctagaaggtcttgggcaaagttgaaattcagggtcagtgacacaacctcaagggaggccccgaaagtgccagctgcacagcagtcccctgcctggctttgctgtttgaccacgtcccgtgtcagtgaatcacgggcatcttcaggagctcagcctgggtcttcatttgtttccctcggccccttcctcagcctcaggacagagctgcagcccccacacattcttccctacagataccagggtgcaacaaggtcgtcagggtgatctcaccttggagagcttcaggggtgcctcctctgtgaccccggagaggtcagccccattgctgaagaccttagtgatgcccagttgacccaggacgctcttcagatcataggttccagtaatggacagtttgggtaaatgtaagctggcagacctgtcgtgcagaaaagaaattcaaggcatggcacagcattcctcttgttcttctgggacccaccacagtgcaagtgttttcttttctgattatttctgccacttactcctgtgtcctccacccacactaagatgggaactcggctttggtttgttctacttttagctcttctacattgagtcaaagaatgttaacatcgaatgaatcacaaaagcttgaaatgccacctcctctgatattctaggtgtcctggaagcctgtctcatcttgccctgtagtgttgggtcacctggcccccagcctgtaacatccccagggccctacacccagagaaacacggggctggtggcagtgcccagtgacaaccgtttagtggataagagaagagtgaccacaccaggctgagtgctcctctctggttttccatggggagacaatgccaccctgagcagggtctggtgtgagcgggcagcttggctctgggctctctgatccgttaccctctcagcctctttgttctttctcaacccctggagcagagacctcaggaggtgctggcatggaacagagaaattccagcctcgattcctattatgaacccgacaccttttgtattttcatcttggttttacagtgtacaaaacgaactagatcagcagggcatgggcataatcacgaatgcacacacatacactaatgtgtggctcatgtttaagtatcacttactacaggacacccaatctaacagcaccgataaagtgacagagaaacgcaagccttctgcgaacatggcctggctgttccaattccgaaccttgcttttctgggccttgccacacaggctcttcccccgtccccccagggacattctacccttgaactccacactccactgctgcctttgccaggaagcccatctgttcctttttggttctgccagaacgtgtggtggtgctgctgtccctgccctgggcactggatattgggaagggacagtgtccacactggagtgggaagtccccagggacgagacctttacctcctcacccctgggtactgtcctcctcatggagcatggatggcgctgcctgaactcagtggtggcctcattctggaagccaagtttatacagagtagcagtgacccagggatgtggggttcaccctcctcagccctctggccagtcctgatgggcctcagtcccaacatggctaagaggtgtgggcagcttcttggtcaccctcaggttggggaatcaccttctgtcttcattttccaggaacttggtgatgatatcgtgggtgagttcattttccaggtgctgtagtttcccctcatcaggcaggaagaagatggcggtggcattgcccaggtatttcatcagcagcacccagctggacagcttcttacagtgctggatgttaaacatgcctaaacgcttcatcataggcaccttcacggtggtcacctggtccacgtggaagtcctcttcctcggtgtccttgacttcaaagggtctctcccatttgcctggagagaggggaaggtgggcatcaccaggggtgagtgaaggtttggaagagtgtagcagaataaagaaaccatgagtcccctccctgagaagccctgagcccccttgacgacacacatccctcgaggctcagcttcatcatctgtaaaaggtgctgaaactgaccatccaagctgccgaaaaagattgtgtggggataattcaaaactagaggaagatgcagaatttctacatcgtggcgatgtcaggctaagagatgccatcgtggctgtgcatttttattggaatcatatgtttatttgagggtgtcttggatattacaaataaaatgttggagcatcaggcatatttggtaccttctgtctaaggctccctgccccttgttaattggcagctcagttattcatccagggcaaacattctgcttactattcctgagagctttcctcatcctctagattggcaggggaaatgcagatgcctgagcagcctcccctctgccataccaacagagcttcaccatcgaggcatgcagagtggacaggggcctcagggacccctgatcccagctttctcattggacagaaggaggagactggggctggagagggacctgggcccccactaaggccacagcagagccaggactttagctgtgctgactgcagcctggctgctctccactgccctcctttgcctcaagagcaagggagcctcagagtggaggaagcagcccctggccttgcctcccacctcccctcccctatgctgttttcctgggacagtgggagctggcttagaatgccctggggcccccaggaccctggcattttaacccctcaggggcaggaaggcagcctgagatacagaagagtccatcacctgctgtatgccacacaccatccccacagtctttgtcatttgtttaatcctaaaaaaacctgacagcaagaatggtattttgtccatgctaagatgagaaattagcacctcaaagaggtagaatgcattgtttttgtcaaaagctaattgtgttagaggcaggatttgaacccaggtctttcagattgcaaaactgatactgattctgggacactagagtcgtgtaaagtatgttccatgaaactatccctttatgcagtgtattacaatttgttctatagttctaagcattatatattctacatatacagtatacacaaggacattaaaggctctgaaaagttctgcagagctgtcagtagttttgacagtttaatctattatttcctcaaattactcaatgatggaaaacattttagtgtttgtgtgtagaaaactgaagaatccacgctgaaaagcattgctatggcccataatgcattgccaaggagagttcaagaactgatggtttgagaatatttttgcttgtttctatgggaacagctcaggctggttgagcaaccttacctttaaagaagatgtaattcaccagagcaaaaactgtgtctctgtcaagctccttgaccaaatccacaattttcccttgagtacccttctccacgtaatcgttgatctgtttcttggcctcttcggtgtccccgaagttgacagtgaaggcttctgagtggtacaactttttaacatcctccaaaaacttatccactagcttcaggccctcgctgaggaacaggccattgccggtggtcagctggagctggctgtctggctggttgagggtacggaggagttcctggaagccttcatggatctgagcctccggaatctccgtgaggttgaaattcaggccctccaggatttcatcgtgagtgtcagccttggtccccagggagagcattgcaaaggctgtagcgatgctcactggggagaagaagatattggtgctgttggactggtgtgccagctggcggtataggctgaaggcgaactcagccaggttgggggtgatcttgttgaaggttgggtgatcctgatcatggtgggatgtatctgtcttctgggcagcatctccctggggatcctcagccagggagacagggaccaggcagcacaggcctgccagcaggaggatgccccacgagacagaagacggcattgtcctgcaagacagagatgggggggccaggccccgagtcaaggcacatgatgactcccagtgatcagggattgacaccacgtggaagtgcctagggattattaaaccagcctgtgccaagtacttgccgacatcagtaacactgaaagaatcagaagaatagcaaaatgtacgtagtgcttaccatatgccaagcactgttctccgtgctcacatgtgttaattcattgctttcttgtaacaatcccgtgaggtgctaatgctaatatccttcttttacagatgaagaaaccaaagccagagagattaggtcagctattcaatgtcactgaggaagtagcagaaccagaatcctacatctaggtcctgcacccaggctctggacagcaacacttacatctgcaatgaccctaagatgcaaatggtacagccattgttttacaaaagaagaaaatgaggcacaagaagaggaatgggcctgcccacgattatccaggaatcgggccagatcagaatcaagaatcatgtcaagctggaagcccttggagggcttctatctaatcccactatttagtggccagggaaactgctgcacagaagggaaatgcatcttgcacaatggcaacagctagagagcatggaggggctgtgattaaacctcctgggagctgttcccacccaacactcacaaggatcctcagcccttagggtttttttcccaagagacggggctgtccccacaatgctctgtggtcccagacacaagaataggctgatgctcctgcagtcagcttacctgccgtctgggtcactaatggtgtcccagttctgggctcttgctgtcaggggctttagagacgctcatctctccttgaaagcaggggtttgtgctgctttaaagtagatggaggaggtgggaagtgaaaagacacctcttttaacttcagatagacctgggatctaatctgactctgtcactttccaggtgtatgagccaggacaagtcattcatctccctggtcctcattttgcctcatacataaagtgatgtttatgtatgagaatttagtgaaataagtctcaacaccaaaccttacatcaaaaggatctgagagggcaactcttttgagggaggggttggcaggtgttgcaaattcaaaggcttcaggtgataggccagtgaggaatacatgtttcatacccggggctgagacaatagggagtggtggggcctgtggctgaaccagcgagagcaggctctgccgagcaatggtcaaagtcaacgtcatccacagcaacacagaacctgccctgccccacagtgatccttctactccagatatgcccaggcttcggaccaccagcctgcagccccctaggtagaacctgccgtcttcacagatgggaaaactgaggtcctagctgaggagaatatgcccggcagccacattgttaactactagtcacaaaaccaaaaccatcatcttaacaaaatacaaagaaaaaggtgtccttgaatttgggaaatgaaaaactggagaaaaaaagctggaaataacaaatattgagattcttcaacccccttggacttttaaaagtttccttccaataaagcaacaaatgaagtgcaaagctggtttctctccaccacctttctcctggccctcgtgcctctaagtaatccaaatggaacagaccacacattacataatacatgtttgtatttttcttcagctagctagtgttgttagaactaaagacggtgctaaaattagtgctgtatatttccatctccctttaatttctctttcacttcccaactgaactttgtgcagtccttcatggcttatggaaattcccccatcattacagggctcagtggtcaggagggagttgggcctctgcagggtggggacactaaatatgctgagtggcctcagggccagaggttgtggcttctagccctggcagggccatcactatccacttggcctttagcaagaatcctctggtcctggggcctcactctccccagttgtgcaaagtggggctgggagaagacttcactggggccctctgtacactaacataggtttttgggttttttttgagacagagtctcgctttatctgccagggtggagtgcagtggcgtgatctcggctcactgaaacctccacctcccgggttcaagaaattcttctgtctcagcttcccaaatagctgggattacaggcgtgtgccaccacgcctggctaatttttgtatttttagtagagctgaggtttcaccgtgttggccaggcaggtcttgaactcctgacctcttgatccgcctgccttggcctcccaaagtgctggggttacaggcgagagcccctgcacccagccaggattcttggttagaatggcatctgggttcaatgtagcaaaacagatggagaattcccatggctaggcatgagacaggtgccctcctagacaggggaattctgggctcaaaggaggtggagaggctggtgcagggagggtggcgagggggtgacagctgggaggagcacattcccccacacccatccatctttcctggtgtcacatcacctactctggtttcctcctttcacagtgaagagtttgaagcccagagagggtcagggccttgttgaggctatacagcaagtcagtgacaaagctggaacaagtcttggctttcccagcactcagatcatgaactgagacagctgtgtcctcagatctcagatgatgaatgtcagaattgggctgtgacattggtctcaagcatcatgttgggttcattatgcctcccaagctgttccttataacatcaggactccaaaacctgctctctcctggcccttctatcagaggcagcaccctgcactcctaaaagctagtgcctgggagggcgactggagaggagaaagtcgccatctggccaagtaccccatggtgtacggacactgaggccaagctttaaaccaaaagaatgaaggcttcatggtgacatttctgggatcggggcaggtgggagcactctttgcggggccagggacagggaagcgagccactccctgcctaatctcacaccatttctacccgggagcataaaataagggaccaagagcaacccggcagggtgcagggaagagaatctcgcctatggtcaaacaacctgttgaactgggcaataaataaacccaagtgtgaccaggccctgtcacttactggcagggggcctggggtaaatgacttcacttctttgagcactagcttcatagctgtacaatggagaaaagaatcctttggacagggatgaggaataactgacgtaatgcatgagtgggcaccaggtgaggaagccctccctgtacctgcacacaggttgagctcctgcccgagagatggtagatttcttcccggagagcctgctgcactccccaggaccatttcagcaggaaggggctcctgctcagcagtgaacagcatctgagtttggcaaattttccattaaattatccaactgtttactgcctgccagctgcctaaccctatgctaagcaaacatcagcctcagcgtcaccatcattgccacacttactaacacctggtgttttacaggcaccgtatcatctaatctgtcctcaaagcttaccctataaggtgcaaattattagccctattttatagatagaaaaattgagccccaaagagcattaaataactcactaaaaatcacagagctacttgcttacaaaactgagatgtaatcctaaatgttttgtctgggattaaacagatttcactccaaaacctgacattgaatcatctctgtgtacaaagctgaagccagaagtcttgaatcagaaaacttcagaggcagcctggctaaatgaagaggggagcatcagtctgtggctaaaattaaaggctctgaggccagattgctccacgtcaacttgctattagctgtgtgaccttggacaagttacttaacctctctgaacctcagtttcctggagatgagaaaggtggactttgtcatagagctattgtgaaattaaatacacataaaatgccaagaagtgcctgctgcgcagcaagttctcgagaataccagttcttgctgctattgctgcaggtcttttagaggcgttctataggaaactggccaccttggccttggtcatctttttgacctgtctccaaaactcagtgcaggaaaaattaaatccttccaacacttcagagatcaaggtcgggtggggtgaggggaggggacagaagtcaaaggttatcatgttttgcccaagagaacagagaggttgagcaactgtctgaagtcaccgagcatcagagaggcctcaagtccagcccaggtttcctgttccccatccagcgcctgagacccaagagaaacagtgacactagggccaggttcaagagtttggggactggagccaggtgcctgagcccgaattatggatggtgtgtgatttggggccagttattcacctctctgtccccatcttcctcatctgtaaaatgggaatcacactagtaactgccttggagggttatgaggcttaatcacgcactgagcttagccgtggcctggtgcagagcgattattcaggaatgccagcttgagccctgggtgacagtgcccctcacagcttcctgtcctccactgggacaggagggcccagaggtccacggtgcatggggaggcccattttgatgtaaggctgaggcctggcacaggtctgttcctggtcatatctggaggggatggagaatgtgagccggcgttcctccccacccctctctggaccttaacctcctcatctatagaaggggagaaagatgcatgcccaagcagtaggagaggtggtgaggcttataggagacaacagacaggagcccccgacagacagaggagctgtgcaaacagaaagaaatggctgcgctttgttgctgttgctgtatcttggctggtgtcccccatcctggggtgccaggactgcagacctagacaccctcatccacttctgcttacaggaaccagtgtatccaccaggaggtaccgaggggggaccgggcaggactgggaaacaggacacaaccctcatggctgctgttattatgaaaataggagctcagctgcagcctctccatctgccctgcacctcagcaggcggatacccactccacaacccccctcctgccccagacctgctgcctgcctgggccatggggagctcagaagcctctccagaacctctcgcagtgaaaggcatacttacgattcactgtcccaggtcagtggtggtgcctgaagctgaggagacagggccctgtcctcgtccgtatttaagcagtggatccagaggggcaacgggggaggctgctggtgaatattaaccaaggtcaccccagttatcggaggagcaaacaggggctaagtccactggctgggatctgagtcgcccgcctacgctgcccggacgctttgcctgggcagtgtacagcttccactgcacttaccgaaaggagtcattgt

SEQ ID NO: 2739 - DNA, 13946 bp, Homo sapiens
  source 1..13946: mol_type = genomic DNA
tgcaagaaatgtagttctatttattctctgttctaatgggtataaacattttgttatctaacttgaacatcataccaactcaaaggcaggtcttactagcaatgactggggctcagagaggtttggcgacttcacgaaggtcacacagctgtcagggggaaaagtcagaacttggatccaggtcttcagactctcaggtctggtgtcatcctagggggcttggtgatggccatatctttaatgtatttgtggagagtgaaaggctgtcagtgagtaagcttaagagaacaggagacttgtgtgggaaacagtcggtatccattgattagactgaatcatgtagaattgctaatttcaccattttgaactatcgaaatcactatttggtatgactcaacctcatcctttaagtacacattcatgacagtgagtggttagacagtgattcctagattagtttgggatggggcagtgccttccataggacaaggccattcctggtagagacggagggagcaggctgtccttcagctaggggcccaggggacttcctggctgctgtgtcctttagcagggccttggaggatggaaggactctcctggcccttaccacaggggctattcaggaacagcctcctgccgtggcactggagctgcggtggccctctgaagactgcagggacagcaacaggcacaaagaagtcaggctgcatgtggccccagtcgggactcagaggaggaaagggaggggttgcgggggtcaatgggtgatgtgcttcctctcccatagctgaggagtccttgcaatggccttcctgagccatcagcaggcctatggccatgtgactagggaggagaagggatatagggtaatggtcttctggggcctgctgggcctggtcaagtctgaggaggagatagagaaaacaaagcagagaccctcctcttcatctggggagaagggacctgattctaaacggagatatgtgaggctttctggggcagcgatggaaggacaaggacagaataggtgtccttgttgccccatggagaatgggcttcaggaagaatctgcctcagtcattttccagaagtgcctgagaggtgcagggcccgagtctggttaggtgacagcgggtcaagaggaggacattgtcctctctcttgtgttgctgcagatgccacaaaactgggccacggcacgatcaggcagttctggggcccccaggagggcagccttggggtgggcacagccagccctggcaggatgagcaactctgggtgggggggagtgggggatgagcagggggacatgaagatgcttggtggagcctggggtcatggctggtatctggttcctcccctgtgattccttcttggggactccaagacaggacaaggaagactggagccctccagaaacagatgggcccaggtccgtaagctgaggattcagtcccccctggattcaagcccagcatgtgcctacccagccagatgctccatgaacacagttcagggggcccgaagacagcactgttacctggagcccacatacagcctcagcaggcaaagggagactcagagaaaacatgggagggatttacagtcacatgcaggcagggaccagctcaacccttctttaatgtcatccagggagggggccagggatggaggggaggggttgaggagcgagaggcagttatttttgggtgggattcaccacttttcccatgaagaggggagacttggtattttgttcaatcattaagaagacaaagggtttgttgaacttgacctcgggggggatagacatgggtatggcctctaaaaacatggccccagcagcttcagtccctttctcgtcgatggtcagcacagccttatgcacggcctggaggggagagaagcagagacacgttgtaaggctgatcccaggcctcgagcaaggctcacgtggacacctcccaggaagcgctcactccccctggacggccctggccctgcacatcctctccctccctgtcacataggccttgctcctcctcaaggctttggctgatggggctggctcccctctgtccatcttcctgacaagcgcctctccccctgctcaggtgcacccacaactcagaacagggaagagcatcgtcactccacgtctgcctccagggctctctcctttctagtacacggcttgaagctccttgaggacacggaccctggcagtgaccttcacagtgcccagaccccaagataatgcagccattcatggaactgcagttgttcattggtcgcctttagttttccaaaataagtgtcatctttagctgaaatcattcattaattcagacaccaaatctcacagatcgaaggagtcagaaattcctttgaaacaacttagcccaaacctttctgtgtcagtatggataaatcaaggcccaatgtctagaaggtcttgggcaaagttgaaattcagggtcagtgacacaacctcaagggaggccccgaaagtgccagctgcacagcagtcccctgcctggctttgctgtttgaccacgtcccgtgtcagtgaatcacgggcatcttcaggagctcagcctgggtcttcatttgtttccctcggccccttcctcagcctcaggacagagctgcagcccccacacattcttccctacagataccagggtgcaacaaggtcgtcagggtgatctcaccttggagagcttcaggggtgcctcctctgtgaccccggagaggtcagccccattgctgaagaccttagtgatgcccagttgacccaggacgctcttcagatcataggttccagtaatggacagtttgggtaaatgtaagctggcagacctgtcgtgcagaaaagaaattcaaggcatggcacagcattcctcttgttcttctgggacccaccacagtgcaagtgttttcttttctgattatttctgccacttactcctgtgtcctccacccacactaagatgggaactcggctttggtttgttctacttttagctcttctacattgagtcaaagaatgttaacatcgaatgaatcacaaaagcttgaaatgccacctcctctgatattctaggtgtcctggaagcctgtctcatcttgccctgtagtgttgggtcacctggcccccagcctgtaacatccccagggccctacacccagagaaacacggggctggtggcagtgcccagtgacaaccgtttagtggataagagaagagtgaccacaccaggctgagtgctcctctctggttttccatggggagacaatgccaccctgagcagggtctggtgtgagcgggcagcttggctctgggctctctgatccgttaccctctcagcctctttgttctttctcaacccctggagcagagacctcaggaggtgctggcatggaacagagaaattccagcctcgattcctattatgaacccgacaccttttgtattttcatcttggttttacagtgtacaaaacgaactagatcagcagggcatgggcataatcacgaatgcacacacatacactaatgtgtggctcatgtttaagtatcacttactacaggacacccaatctaacagcaccgataaagtgacagagaaacgcaagccttctgcgaacatggcctggctgttccaattccgaaccttgcttttctgggccttgccacacaggctcttcccccgtccccccagggacattctacccttgaactccacactccactgctgcctttgccaggaagcccatctgttcctttttggttctgccagaacgtgtggtggtgctgctgtccctgccctgggcactggatattgggaagggacagtgtccacactggagtgggaagtccccagggacgagacctttacctcctcacccctgggtactgtcctcctcatggagcatggatggcgctgcctgaactcagtggtggcctcattctggaagccaagtttatacagagtagcagtgacccagggatgtggggttcaccctcctcagccctctggccagtcctgatgggcctcagtcccaacatggctaagaggtgtgggcagcttcttggtcaccctcaggttggggaatcaccttctgtcttcattttccaggaacttggtgatgatatcgtgggtgagttcattttccaggtgctgtagtttcccctcatcaggcaggaagaagatggcggtggcattgcccaggtatttcatcagcagcacccagctggacagcttcttacagtgctggatgttaaacatgcctaaacgcttcatcataggcaccttcacggtggtcacctggtccacgtggaagtcctcttcctcggtgtccttgacttcaaagggtctctcccatttgcctggagagaggggaaggtgggcatcaccaggggtgagtgaaggtttggaagagtgtagcagaataaagaaaccatgagtcccctccctgagaagccctgagcccccttgacgacacacatccctcgaggctcagcttcatcatctgtaaaaggtgctgaaactgaccatccaagctgccgaaaaagattgtgtggggataattcaaaactagaggaagatgcagaatttctacatcgtggcgatgtcaggctaagagatgccatcgtggctgtgcatttttattggaatcatatgtttatttgagggtgtcttggatattacaaataaaatgttggagcatcaggcatatttggtaccttctgtctaaggctccctgccccttgttaattggcagctcagttattcatccagggcaaacattctgcttactattcctgagagctttcctcatcctctagattggcaggggaaatgcagatgcctgagcagcctcccctctgccataccaacagagcttcaccatcgaggcatgcagagtggacaggggcctcagggacccctgatcccagctttctcattggacagaaggaggagactggggctggagagggacctgggcccccactaaggccacagcagagccaggactttagctgtgctgactgcagcctggctgctctccactgccctcctttgcctcaagagcaagggagcctcagagtggaggaagcagcccctggccttgcctcccacctcccctcccctatgctgttttcctgggacagtgggagctggcttagaatgccctggggcccccaggaccctggcattttaacccctcaggggcaggaaggcagcctgagatacagaagagtccatcacctgctgtatgccacacaccatccccacagtctttgtcatttgtttaatcctaaaaaaacctgacagcaagaatggtattttgtccatgctaagatgagaaattagcacctcaaagaggtagaatgcattgtttttgtcaaaagctaattgtgttagaggcaggatttgaacccaggtctttcagattgcaaaactgatactgattctgggacactagagtcgtgtaaagtatgttccatgaaactatccctttatgcagtgtattacaatttgttctatagttctaagcattatatattctacatatacagtatacacaaggacattaaaggctctgaaaagttctgcagagctgtcagtagttttgacagtttaatctattatttcctcaaattactcaatgatggaaaacattttagtgtttgtgtgtagaaaactgaagaatccacgctgaaaagcattgctatggcccataatgcattgccaaggagagttcaagaactgatggtttgagaatatttttgcttgtttctatgggaacagctcaggctggttgagcaaccttacctttaaagaagatgtaattcaccagagcaaaaactgtgtctctgtcaagctccttgaccaaatccacaattttcccttgagtacccttctccacgtaatcgttgatctgtttcttggcctcttcggtgtccccgaagttgacagtgaaggcttctgagtggtacaactttttaacatcctccaaaaacttatccactagcttcaggccctcgctgaggaacaggccattgccggtggtcagctggagctggctgtctggctggttgagggtacggaggagttcctggaagccttcatggatctgagcctccggaatctccgtgaggttgaaattcaggccctccaggatttcatcgtgagtgtcagccttggtccccagggagagcattgcaaaggctgtagcgatgctcactggggagaagaagatattggtgctgttggactggtgtgccagctggcggtataggctgaaggcgaactcagccaggttgggggtgatcttgttgaaggttgggtgatcctgatcatggtgggatgtatctgtcttctgggcagcatctccctggggatcctcagccagggagacagggaccaggcagcacaggcctgccagcaggaggatgccccacgagacagaagacggcattgtcctgcaagacagagatgggggggccaggccccgagtcaaggcacatgatgactcccagtgatcagggattgacaccacgtggaagtgcctagggattattaaaccagcctgtgccaagtacttgccgacatcagtaacactgaaagaatcagaagaatagcaaaatgtacgtagtgcttaccatatgccaagcactgttctccgtgctcacatgtgttaattcattgctttcttgtaacaatcccgtgaggtgctaatgctaatatccttcttttacagatgaagaaaccaaagccagagagattaggtcagctattcaatgtcactgaggaagtagcagaaccagaatcctacatctaggtcctgcacccaggctctggacagcaacacttacatctgcaatgaccctaagatgcaaatggtacagccattgttttacaaaagaagaaaatgaggcacaagaagaggaatgggcctgcccacgattatccaggaatcgggccagatcagaatcaagaatcatgtcaagctggaagcccttggagggcttctatctaatcccactatttagtggccagggaaactgctgcacagaagggaaatgcatcttgcacaatggcaacagctagagagcatggaggggctgtgattaaacctcctgggagctgttcccacccaacactcacaaggatcctcagcccttagggtttttttcccaagagacggggctgtccccacaatgctctgtggtcccagacacaagaataggctgatgctcctgcagtcagcttacctgccgtctgggtcactaatggtgtcccagttctgggctcttgctgtcaggggctttagagacgctcatctctccttgaaagcaggggtttgtgctgctttaaagtagatggaggaggtgggaagtgaaaagacacctcttttaacttcagatagacctgggatctaatctgactctgtcactttccaggtgtatgagccaggacaagtcattcatctccctggtcctcattttgcctcatacataaagtgatgtttatgtatgagaatttagtgaaataagtctcaacaccaaaccttacatcaaaaggatctgagagggcaactcttttgagggaggggttggcaggtgttgcaaattcaaaggcttcaggtgataggccagtgaggaatacatgtttcatacccggggctgagacaatagggagtggtggggcctgtggctgaaccagcgagagcaggctctgccgagcaatggtcaaagtcaacgtcatccacagcaacacagaacctgccctgccccacagtgatccttctactccagatatgcccaggcttcggaccaccagcctgcagccccctaggtagaacctgccgtcttcacagatgggaaaactgaggtcctagctgaggagaatatgcccggcagccacattgttaactactagtcacaaaaccaaaaccatcatcttaacaaaatacaaagaaaaaggtgtccttgaatttgggaaatgaaaaactggagaaaaaaagctggaaataacaaatattgagattcttcaacccccttggacttttaaaagtttccttccaataaagcaacaaatgaagtgcaaagctggtttctctccaccacctttctcctggccctcgtgcctctaagtaatccaaatggaacagaccacacattacataatacatgtttgtatttttcttcagctagctagtgttgttagaactaaagacggtgctaaaattagtgctgtatatttccatctccctttaatttctctttcacttcccaactgaactttgtgcagtccttcatggcttatggaaattcccccatcattacagggctcagtggtcaggagggagttgggcctctgcagggtggggacactaaatatgctgagtggcctcagggccagaggttgtggcttctagccctggcagggccatcactatccacttggcctttagcaagaatcctctggtcctggggcctcactctccccagttgtgcaaagtggggctgggagaagacttcactggggccctctgtacactaacataggtttttgggttttttttgagacagagtctcgctttatctgccagggtggagtgcagtggcgtgatctcggctcactgaaacctccacctcccgggttcaagaaattcttctgtctcagcttcccaaatagctgggattacaggcgtgtgccaccacgcctggctaatttttgtatttttagtagagctgaggtttcaccgtgttggccaggcaggtcttgaactcctgacctcttgatccgcctgccttggcctcccaaagtgctggggttacaggcgagagcccctgcacccagccaggattcttggttagaatggcatctgggttcaatgtagcaaaacagatggagaattcccatggctaggcatgagacaggtgccctcctagacaggggaattctgggctcaaaggaggtggagaggctggtgcagggagggtggcgagggggtgacagctgggaggagcacattcccccacacccatccatctttcctggtgtcacatcacctactctggtttcctcctttcacagtgaagagtttgaagcccagagagggtcagggccttgttgaggctatacagcaagtcagtgacaaagctggaacaagtcttggctttcccagcactcagatcatgaactgagacagctgtgtcctcagatctcagatgatgaatgtcagaattgggctgtgacattggtctcaagcatcatgttgggttcattatgcctcccaagctgttccttataacatcaggactccaaaacctgctctctcctggcccttctatcagaggcagcaccctgcactcctaaaagctagtgcctgggagggcgactggagaggagaaagtcgccatctggccaagtaccccatggtgtacggacactgaggccaagctttaaaccaaaagaatgaaggcttcatggtgacatttctgggatcggggcaggtgggagcactctttgcggggccagggacagggaagcgagccactccctgcctaatctcacaccatttctacccgggagcataaaataagggaccaagagcaacccggcagggtgcagggaagagaatctcgcctatggtcaaacaacctgttgaactgggcaataaataaacccaagtgtgaccaggccctgtcacttactggcagggggcctggggtaaatgacttcacttctttgagcactagcttcatagctgtacaatggagaaaagaatcctttggacagggatgaggaataactgacgtaatgcatgagtgggcaccaggtgaggaagccctccctgtacctgcacacaggttgagctcctgcccgagagatggtagatttcttcccggagagcctgctgcactccccaggaccatttcagcaggaaggggctcctgctcagcagtgaacagcatctgagtttggcaaattttccattaaattatccaactgtttactgcctgccagctgcctaaccctatgctaagcaaacatcagcctcagcgtcaccatcattgccacacttactaacacctggtgttttacaggcaccgtatcatctaatctgtcctcaaagcttaccctataaggtgcaaattattagccctattttatagatagaaaaattgagccccaaagagcattaaataactcactaaaaatcacagagctacttgcttacaaaactgagatgtaatcctaaatgttttgtctgggattaaacagatttcactccaaaacctgacattgaatcatctctgtgtacaaagctgaagccagaagtcttgaatcagaaaacttcagaggcagcctggctaaatgaagaggggagcatcagtctgtggctaaaattaaaggctctgaggccagattgctccacgtcaacttgctattagctgtgtgaccttggacaagttacttaacctctctgaacctcagtttcctggagatgagaaaggtggactttgtcatagagctattgtgaaattaaatacacataaaatgccaagaagtgcctgctgcgcagcaagttctcgagaataccagttcttgctgctattgctgcaggtcttttagaggcgttctataggaaactggccaccttggccttggtcatctttttgacctgtctccaaaactcagtgcaggaaaaattaaatccttccaacacttcagagatcaaggtcgggtggggtgaggggaggggacagaagtcaaaggttatcatgttttgcccaagagaacagagaggttgagcaactgtctgaagtcaccgagcatcagagaggcctcaagtccagcccaggtttcctgttccccatccagcgcctgagacccaagagaaacagtgacactagggccaggttcaagagtttggggactggagccaggtgcctgagcccgaattatggatggtgtgtgatttggggccagttattcacctctctgtccccatcttcctcatctgtaaaatgggaatcacactagtaactgccttggagggttatgaggcttaatcacgcactgagcttagccgtggcctggtgcagagcgattattcaggaatgccagcttgagccctgggtgacagtgcccctcacagcttcctgtcctccactgggacaggagggcccagaggtccacggtgcatggggaggcccattttgatgtaaggctgaggcctggcacaggtctgttcctggtcatatctggaggggatggagaatgtgagccggcgttcctccccacccctctctggaccttaacctcctcatctatagaaggggagaaagatgcatgcccaagcagtaggagaggtggtgaggcttataggagacaacagacaggagcccccgacagacagaggagctgtgcaaacagaaagaaatggctgcgctttgttgctgttgctgtatcttggctggtgtcccccatcctggggtgccaggactgcagacctagacaccctcatccacttctgcttacaggaaccagtgtatccaccaggaggtaccgaggggggaccgggcaggactgggaaacaggacacaaccctcatggctgctgttattatgaaaataggagctcagctgcagcctctccatctgccctgcacctcagcaggcggatacccactccacaacccccctcctgccccagacctgctgcctgcctgggccatggggagctcagaagcctctccagaacctctcgcagtgaaaggcatacttacgattcactgtcccaggtcagtggtggtgcctgaagctgaggagacagggccctgtcctcgtccgtatttaagcagtggatccagaggggcaacgggggaggctgctggtgaatattaaccaaggtcaccccagttatcggaggagcaaacaggggctaagtccactggctgggatctgagtcgcccgcctacgctgcccggacgctttgcctgggcagtgtacagcttccactgcacttaccgaaaggagtcattgtacctggctcagaaaccacagcgtcctgtgtccaaggtggagggggtggcgtgagtcagacagtctctgggagagtaccacttagctggccctctgctctcactgcagaatccttagtggctgttccactggtagcaagatctaccatttactgagtcaccccaaaatgcctgatgctgaagacttactgccgccctgggagatcagagtgggttagagcccatttgacagatgaggaaacaggctcagagcggagagaccgctcatccaaagttacccagtcagccttagacacaaacaccctcttgatggtcccgatggaaaaatggagcatgactgaggcagacacaaccgtcaggctggcatggggggccgtgagacagggtagaggtggggaagcacatctgtaaagaagagctgtgctgcctcaggcaggccgcttcacctctctgaaccaggaactgtttcacctgcatcccaaagagttggaagtttcattcccaagcatgcttgtgaagtgcctcgggtgaagtgcctggcacacagtaggctctttatgtgggtctgcacagccctctgcttagtctgccccccaggctgctcagagcaggaggaggttcaattttgaccagcctcaggcctgtttctgtttttgctcctggaaaaccagtgtgatccgtatacagcttggagtttctttggatacatggcccccactctggggttgttggaggcctttggagactgctgggggtggaggggaggggaggtacagggttgaggctagtggggccccacttgattgcaatccctttaaaagcctaaatcagattgcatcgcccgctgtgcaacccgcaaacctgcttgggagctggcgtacgtgccgtagatacttgcagagtgaatggatgagtgcatttttgccccttctgtcattcaccagtcccatttatgcctccaccttggggctctaccaggcgagtgacccacaggatcctccagcacacacattcagaccagggaacccacttactggctgtgaggcctcaggtgagttgtttaaccgctccgagcctcaatttccctatctgtaaaatggggatggtgacggtatgtaccttgttgagctgctgtgaggattaaaatgcaacagttcaaggaaagctcagagacgggtactgggtgtgcccagaaagcccctcctgatgctgccctccctcccccgtgtcaggggctggtgtcactggggtggggtgggccacacttgaagagctttcctccaggcagtctctcattcagttaccctgtgaagggagtaggtaccaccctcctttcaggcagcgggaaactgagctcagactcccctccccttctctctgagctcccttccctgcagctccatcccctggcttcagggcccctgtccttcccctgagctggctgaatggatattccgctgctctacatccactcacagctccagcactgggctgtggttgaggtcgcctgccctcggtagctcctgggcatttcttcccctctctgggcctttgttttcccatctgcacaatgacccccactctaagccctgctgtccctcccacctgtggaactgagtgagcagcagcagcaatgtcccacctttcctgctctcctcaagctctcctcaagctctgtctcttctggcaggcacaggagagtggcctgaaggctggcaggaggttgccgcccctccaacctggaattcctggcagcagcagcggctaggccttcctcggaggcccgaccccctcctccttcttggttcagctcaggactctgagggttgctgcgtggaggcagtgcatgccctgggcacagtgcccagttcctgccca

SEQ ID NO: 2740 - DNA, 13946 bp, Homo sapiens; identical to SEQ ID NO: 2739
  source 1..13946: mol_type = genomic DNA

SEQ ID NO: 2741 - DNA, 13946 bp, Homo sapiens; identical to SEQ ID NO: 2739
  source 1..13946: mol_type = genomic DNA

SEQ ID NO: 2742 - DNA, 13946 bp, Homo sapiens; identical to SEQ ID NO: 2739
  source 1..13946: mol_type = genomic DNA

SEQ ID NO: 2743 - DNA, 13946 bp, Homo sapiens; identical to SEQ ID NO: 2739
  source 1..13946: mol_type = genomic DNA

SEQ ID NO: 2744 - DNA, 13946 bp, Homo sapiens; identical to SEQ ID NO: 2739
  source 1..13946: mol_type = genomic DNA

SEQ ID NO: 2745 - DNA, 13946 bp, Homo sapiens; identical to SEQ ID NO: 2739
  source 1..13946: mol_type = genomic DNA

SEQ ID NO: 2746 - DNA, 13946 bp, Homo sapiens; identical to SEQ ID NO: 2739
  source 1..13946: mol_type = genomic DNA

SEQ ID NO: 2747 - DNA, 13946 bp, Homo sapiens; identical to SEQ ID NO: 2739
  source 1..13946: mol_type = genomic DNA

SEQ ID NO: 2748 - DNA, 13946 bp, Homo sapiens; identical to SEQ ID NO: 2739
  source 1..13946: mol_type = genomic DNA

SEQ ID NO: 2749 - DNA, 16186 bp, Homo sapiens
  source 1..16186: mol_type = genomic DNA
gtaacaactctcagaggagcattgcccgtcagacagcaactcagagaataaccagagaacaaccaggtatttcaatgatttccatgccatgtctatgggaaatagggtttcatgttttctcttccctcatgctggtattaatagattgaaaatttggatgtggggtgtttgtagagggcgagtaaaatttaagtggtgttttcttgtttagttgttgaattgaaaatattttatttcaagatttgaattaaatttataaggtttaattttgaatctcagaagccaacaaatacctttgtagcattaaccaaaacaaaatgtacattcagattgtgatgccaattttattgaacagattagattatatatgttctctactagctactgttttgacactaaatttgatggaaacaactagatacattaaaatattttcatttaagcaattgaatgtaatctctacattgtatataaataataggaaaagaagacttcatttgcaccttaaatgaaaaagcaggaactgcaaaaattaagtagcaatttgggctgggtcaatctagtacaacaatatgtttattgagtttagttcaataatgggtcaatttagtgaaagagaataatcagccaaagtagttgcagggttgactgaagtatggttcagtaaataacttaatatcccataaaaagatacttattcattatgaaagccatcaactaggagaaattgcttttaattctgttgggggagatgtagcagtatttgatgagatattcccttgaaactgttgttttctcttagttctcattaatttttgtggtcaatttcaaaatatttccactgtctaattgtaaacaaaatttgttttaaatgctacagcaaactccaatctaacatccagggccaacagggtgagagacaatggccgtgtgcctggtgactcctcccaaattcttccttccctgtgccaagtttcagtggtgcatttgtcaacttgtgttgcaggaaccaacacacacaccaccaggaagcccaaccctgcatattactcccattaattcatcccagtaatactattaaaccttaattaagagcatactatttggaagttaatgagatcatataaattactataatgttaaaaaattcacaacaggtatacctgttccaggaggctgtggtatttcacaataccccatgacttcaattttgccttgttttgaaagattttcattcaaacataaagtatggccttatctgagagtcaggaaacactgcatatgggtgccttcatagatttctaaaattatgaaactctcagaccttatttgaaaagtttgtaggaaagcattagacttggaatcagaagtctgtgatccagtctaggcttctgaaatggaccagctgtgcaatctctattttcatattttcattcatattacagaaattactaagccttactggacaggtaattatgcaaattgaaaagggagctgaaggaatttggtgactgccatacagacatcaaatattatttttacattaaatgtaattaattacaccttatttaaaaatataattgaaactatcttttttgaaagaagtaaatgcatccaggaaaatttgcttctgttcttattaatttttttctttatcaagttaccttaaattctaacttagtattaacagaactttctgttagtttgtctttagagttaaatatttttactatcaaagttactatgtggattgttacaaagaatccggtatgaattgttacaaagaatcacgtatttaggtatgggagaagtctaaatttatgtttgtggctctgatctcttatttacatttctcacatggggatcgagaaatattttatttgtgttattaatactcagtttgtttccaaaagatattgagataattaattttaaaaatctgtacaataaatctatttaattatgaagacaattttaagaggaagaggaacaaatttttgagccatccaatgtaatctagtatctatgatgaagcaagagaaaaaaaaagtgactttttgtttttacttcctaataagccttctagtagaattacaggtttactacttttttcttttgacttcctctttctagcatttcttgcactacaacttgcttaagctcttacacttcatagtgaagctatgcaccaccgagtgaagcgatgtggaacattggaaagagtgggcttccttagacagacctgggcttgaatccctgctccactacctaccagctgtgtgaccttatacaagttacttaatgtttctgagcatcaggatataatctataaaatagggagaatcacctctacctcatacagattctgcaaagattaaacgaggagaggaggtgagagagttttagggatacgttttatttaatttactatttttgtcttgataaaatagtctggttgtattccaaatgagacattttaatacaaataaattccaatcactttcttaaaaaaaaagagttcatgaatcaagggttcacgcaagaaagaagcgaccaatggtccttgttggagagcaatgctgtgtgagaccacaggtgtacacagccaagaccagagccagaggacatgcttcctcctgggtacttccagcccctccccagttcggggaaggcactgtcataagaaggtttcctgagggatgatcagtatcagcattgtttggtatatttacatattttgataattatcgggtatgttgcaagctatgatgaaagcaaaacatacagctggaaagacgatcattggtcaggaccaaaaaacacacacaccttgggtgtgagcatgcattcagttgcctgcagagcctgaggtcagggaaggtctcagatggttcataccttggtgtatacatgagtttcataggcctgggattaaggattatccctgcaatcttgcctggcattgactttctacctggtggggtggcagaagaagggggtcttctagtcctcccagtaatgaacaccccagtataggaagtcttttttagtaaggctgtggtatgtgtggtgcatatagggaaggggttctgggataggggctgggtgaaactccaaaccttcaaacaatgagtcaaagtcactttagaagcaggaaagcagaaagaagattgaccgtcttaccagatgcaacaaggtatgtatgcaggtggcatatatttcaatatgtgtatatcttcctgtgtggcagtgtgtgtggtgtggatgtgtgcgttgtgcttgtgggggcagcatagaagttgagagcatgatcctagggtctgcctatctggcttcaattcctactcctgtccctatatattgtcattgttattctatggaatgccacaaagtgtcgctgctcatcatacaaaacacttcatgtatctcaggactggctatgtaatttacagcgtctggtgcacaatgaaaatgtgggccttttgtttaaaattatcaagaatttcaagatggcgataggagggcatttggctaaacaaggggctttttacggctgcacaggtggtatgtccatgaagctgtccctgacctgcctcatgttgttccatgaggaagaacagacagggaatctgtccctacacagaatgcagcctgtcctactgttgctgacctcacccaaaatgttaccttatgtttcagagctgtttttttcttcctctctttgcttctagattgaaacaatggaggatctttgtgtggcaaacacactctttgccctcaatttattcaagcatctggcaaaagcaagccccacccagaacctcttcctctccccatggagcatctcgtccaccatggccatggtctacatgggctccaggggcagcaccgaagaccagatggccaaggtgagtttgagctgaagctccacatttgggccgagtagttcctgaatggaattggagaactgctcttgttttatgctaaagacattttaactcaggaggtcagcaatcatcacaggtaatgaagcactgatccttacaacacaaattccttagattcaaatctataagacagccaagcccccgaatccctcaactgtagctgttgaaggcatatgggagttgaatagcctgcaaggctggacacagttatgagtgaccacatcttatattttaataatataatattcttatttttcaaagttagtgttttgtacccattatctcattcagttttaagacagatatcattttacagatgagagccctggtggtgtcagagaagcccccactgtctcctaactcctagcctgggctccttcccattactgtgccactgtggtgtttgttccctattcctatgaagaattccttctaataatgttaagagagtatcacaaagggaaaaaaaaaaaaacataccagggtggtgctcactatacccacaggatgcatggatagtgttgtagctgcagaagatcatgcctgtgaggtcacggtagcagaatgagacctggcattattatggccagccctgaaaaccaaggtagatgggatgcacaacatcattgtgagggatttctgcaaggccactgcctgccttccttggtgaatggacgtggactcagtcaggaaactctttccacggagtctgggcccttgaaattatgccggactacttcaattatacactgcaatcgttactgtaatagtcactcagcacatacaaaattcttgtgatcatgttacttccaaggttagtgacctcgatgtggccatgatatcattaaaattcctttgcattcacacatacaaacattaacattaaatgctttaaggacacgcatgcattgtgcatgcagtcacaccaagatgccgccggctggtttccagtttcccacgagaatgtacctgagtgtaaatacattctttccatgcacatggtgacccatgtaaggtgggcctcatttgaagtttgaagtttcacagagagagcattggccaatattgctgcaggaagacaagggatgggtgaatcaatctctgtgtttgtgacagtttaaacattgagacttacaacaaaactcaattgctcaactccctgacacaagtagtcttttgcaatattctttccccattattttttattttttgccttgaaagaataaagatagtaaattggcacaaaagctttagaaacatcaggtcttaggtttttttcttttttcctttcttttttttgagatggagtctcgccctatcacccaggctggagtgcagtggtgcgatcttggctcactacaacctccaactcccaggttcaagccattctcctgcctcagcctcccgagtagctgggattacaggcgcctgccacgatgcccatctaatttttgtattagtagagatggggtttcaccattttggccaggctggtctcaaactcctgaccttgtgatccacctgcctcggcctcccaaagtgctgggattataggcgtgagccagtgcacccggcctaggtttttttgttttttaaatgtaaaggaatcagtagcaatatattttgggagcaaatgctaaatgaagtgctctgggttgttaaagtaaaaatcttgattttggtactagaggaaaataaactgattgctctggacacaagacagcttttctgtgtctaagaagtgctttaagcctttgggactatgcgaggattctatatagtctttttttttttgagactctatatatatcgtcttttgacaactctgttgcatgtgtagattttgaaattcaaatgttaatatgattgcttcccagataaaaagaaaaagacatttattggctggagaaagcagcacagactttggggacagacgtatctgtgtttgagtcatggctttgttccttactacatgtgtgtgaggacattgaaaccatttgcatctcagttttctcatctacaaaatgggaataaaaatgtgtagcatgcaagaaagttgtgaagattagaggtactatgtaaggcacttagtagcagttgctataataacaaccaatacttattagtgccttagccaggcatctttctaagaacttcttataaatttactcacataagacaaaatattatgaggtaggtacgatgattaccgtactcattttacagatgagggaatcagggcaagaagaggccacacagttgagaattgctgtagctgttagaagtggtacatttgtagtgaaagaaaagaatacataaaagatataagctcctggatggcataggtctgtgggaattaggatataagctcttttccttacagtgaggcaacagacccatccaggccaaactgcctcactattttctctgtggcctttgtgtggactaggggcagctcacagtcccacttttgcagggacatctccctgagtgactttaacactgattcaggaaggctttagtgctagcccaaagaaccctgatttaagggtcaatttccttggaagagaggaaaaccagccaagctgtcgtaggaaatcttcttcttttacgtgagggtggagttgcaccacttcttttcagagagtactaggcaggacttacgatgtatgactcaaagagcagaaaaagacctcacaaaccctaacacctctccttctagcccagaaattcaccaacttgctggacaaggctgccttaattaacttcattagcagaaccccaaccatcaagccacttaccagatcagcttctcctcagggaccccatagggaggtgctgcaggaccaagggttcccaaggaggtgggatggggtgggtggctgggaggcagggccagcttgcaggtattaagactggcagaccaaggcgggcaggcagcagtgttgtgggaaggggatctgaggaagcttcagaggggacagtccttgctgccagcttccccgtgtcagccaaaactgcctacttactatacgaagagattcacagtgtcatcagaccaacttgtccctcacatggacataaatttctctgtgtatgaatatggtatgtgtaaatattttaggtgaaccctgttaatattgcatgacctgttttatgccttagctgactctggcttgtagtttttgacagattgaaagtattttgtgtataaggccactgaaaagagagagacacacaaggttctgagttaatcttgtgactttctttaaaatactggcatttttttttcaagaccatttattggttggatataatttagataatttggggaagaggttttaaatcatttcataataacaatttgttttccaaaatggccaggatataaattaatctaaaacacctcatgctgttttctataagggaaatttaggttggctgatacttttatattacacagaaagagtattgagtatctatggttgttccccatgtataagggaagggaaaagatctaggaccattttagagccacctgatagccatctgttttaaaagttcagtaaatccgtgggcaagtgtaaccgttttctctaattctgattgcaggtgcttcagtttaatgaagtgggagccaatgcagttacccccatgactccagagaactttaccagctgtgggttcatgcagcagatccagaagggtagttatcctgatgcgattttgcaggtatctgacttactggtccaaatttcttttgtggtttatttttgcaatcttcctgtcttaaagccacagtgtcagactgggaaggaagcgaatataccctcccccattcacagaaagaaaactaagactcagagtcattaagaaaaacatgtcctaagatgatacccataacgagagacgagccaggacagaatccagacttcatgagttttaggccaagcctatttacttctaaattctctcatgcctctctgtcattggtgaggtatgtgtaatttatcataaatccacagtagagactcctagaatacacgtgtatggataaggatttccagaggagagagggtagggactgacaattgattgagaaatggcagaaggctgggcccaatgattgcatgagaaatcactgaccttcaggtaactttccttctatctatctaatctatcatctatcattgatctctctcatctatcttacctatcatacatctatcaatcctatctatctatatattttatgaatcatctatttatcatctatcttctctgtcatctgtctatcttatctatttatcaatcagctatctcggggagtaacacctttcctcagtactccatttccttaaatgtcagctatccagttaaattataaaaactgagtatagactgctcctgttggcaaccaacttccacagtcatgcttatgaggtagattatgaagaggtatctcccaaagctctcttcctgggcactctgaagctccttctacccattgcccagggaattatgggctagaggaggtggacaggatcctgatcatgtggagattccgccaggtgttctgtggtacctggcagtccatcaggagggctctgtcccctgccctaggacaggctgctgctgtgaccaagccctgtgtctgacatggtgcttacaaacttcagtttgagaactgaaataaccattcacttttgtggttttctaaaacccatgttttccactgcatagtttgccccataaaataggtatctagagaagctatatgaactttgtaagatcattactaaggcaacatttcctccctgccagctttactgaggtataatggacaaataaaaattgtacatgttcaagatgtacagtgtgatgacttgctatacctatacattgtgaaatgattacagtcaaattaatgagcacatccatcactacaattacccaccatttgtatgtatgtgtgtatgtatagtgaggacacttaaaaaatatattcttcacaaatttcaagtaaacagttttattaactataactattaatgaacacaatcttattaactatagtcattatactgtacattagatccccagaacttatccatcttataaatacaacaaaaattccttagagactttgaagtttaggaaactgagaaggggcctttcttctaggctgttggtcacctggttaaatccaatccatagacagagcaaaattggaaagaaattaaaattcaccttattagttttaatgtaccacatccttatcgaaatgattttctcaaagattcctctaatgtaccaaaaataaagtatgtattaatatagcatttcatgattgtattcaaaaactattaccatggcttaagaactatcttgtttagtagttctgtgttatatataaagaattccttctttcttttcaaggcacaagctgcagataaaatccattcatccttccgctctctcagctctgcaatcaatgcatccacagggaattatttactggaaagtgtcaataagctgtttggtgagaagtctgcgagcttccgggaagtaagtgaaacctgtaattgaaatggctggatcccaaacaagtaatgaagtcactttcaaagcagttctctacaattcaacagttcataaaagcagagttggaattccacaccagctccctagggctggccttgcgtaacagctgcccttcctgtaccctctggggcttcctcctcttcccattgcaaatgtcccaatctcagagtcataaatcaggaaaacaaatgcaactgttttccagagacactatcccccaagtcaaacctctttccttttattctgtctctataatgcaaggagtacaagagggtggatagagttggggagtaagcgtggacaaaggggtctgcactctttcccccttcagcacctgccttccatagccaacctccactcccaccctaccccaggtctcctaatttcaatgggaagaccataattcaccattatgccatggcttgtttggtatgtattttatgtagcctttgtcattttcttgctttaaaggaatatattcgactctgtcagaaatattactcctcagaaccccaggcagtagacttcctagaatgtgcagaagaagctagaaaaaagattaattcctgggtcaagactcaaaccaaaggtaaatccaagaaaatattttatttacttctttccagttagaaaactctgatctatctttttccatccatgaacttagttagccctcacccctttacaatttgtccaactgcagttactttggtggatgtgaatttattcctgattagctcagtggtgttttaactgagaagaaataattgaggcctactaatagaagacatatgtttagtacttaaatatttgattttggatattgcttgaggatagaatatgaaaggaggcagaagctttcaaaataggaaatatcagcattgaaataattgtgagtctatgcccactgtggacaaaaagaaaacaaggcttgaccctgagcttagtaaatggtgtgagctataaagaatacaggcagtggaggagggaagaatcataaaattattttcactctttcttctctttcaccattcaaagccaatccattgtcaagtttttttggtctctgcttcatccctccttgattatctaagtcacgtctaccattttaactcatgcttttaattgtttcacaggctcctgcctccctctgtatattttacaatgaataaattatttaattgaatcatttattcattgtaatttagtttattaagtcatttattcattgaattcattcattcattaagttctattaagttcattcacttagtcaacaaatatttatccaccacacaccatattccagaaactatatgtggagataaagataaaaatggtaaatcctgccaccatagagcctatagaggagggattcagtcatgttggcaattgctatagagtagtagtcagtgctttcattgagaagtacaggtgctatgtgggagtacacaggaaaggcatctgactggatttaaaaatgattaaattgtaattgggaagacaggctggagctggccaggtggagggtgcatgcctggggggagatttccagacagagtgcacagaatatgcaaaggtccagaggtaaccctaaggagaagaatagagtctggtctgactgcagtgtggagggccaagggaaggaggtgaaattaaagaggtgatgcagtacacttattatgctattcccacactaaaaactgtcagtgacctcctactgtcctcaggagaaggtctcattctttaccttgacttctgagttctcagtaatccagttgactgtgcttggctaccactggcccttggagctccttaaacactcattgctgcctctagactttgtttctgaggatgcctcaactacaggatttaagttgcagtttaaattgcagccaaagtcttactctttcctggaagtgactcccaattacttcctgatcttttcttcttctcatctcctcatctgctttttcagcttcacaagtcacattagtgttagccatatatggccttaaacaattatggaactgatttttgttagtttgttttgcttttcctctcaggctctaattatttttgggtaggtccagtatgtcacacttatcctatgcccccacaaaaatttgcacagttttttgctgacagtgaaaatccttcattcttctgaatttccaggtagagttgtaggccttaagtaaacaattgctgaataataacatataaatgtatttctaagaaacagagatgattatgaattcagaattgtgtaagtatttcattcatttatgatctgttaggattgaaaatgtcctaagagagctcctatccatcttaccaatttgtggttggagcatcctgttcccaggggattagccggctcccctaagatcccactggtagcggtaaagccagggttgcttcttcttctgatccttagtctaactccagaattcctcaatcggatgtttaaaaattttataacttatttttttaaggattttcatttaactcttatgtttaagacattgtttcaagaaatagtttggtgtcttgctttattaattaccacaatggaaaatgcacataaactaagtgctatgggatttcaaaaaatatatatttatttgtttatctgaaaataattgatttccttttagttcttcattttcattgtggatttgtgaaatactgttctaaaatattgacagaccactgacacaaaggaagcagagaaagatgatttaaatcaaaagttcaagtaaaaatggagagcaaaattaaagagacacatggaagttttgccttctttaaagaatggcatgaattgtttttctctttagacattgtgctaaatggctgtaagtcaatcagttattttgccaaaatgccaagcagctattttggcagattgttttaccagcttttgtaagaattggagagaattgtctgtttcatcatgctatgatcaaatactagttttatcatatacatcacaacattactataccccaatactaaccaaaaattttaatagcttgggaaatatattgaatgtatatattaaatgaatacattgaagatgaaactgatgcaaggcaggcaagctccaaagtggggcttagccttcaagggttcttggcttcacccaggaaagtattcaagggtgagctggaggtagggtagaagaaaacagctttattgaagtggcagtattacagctccatgattcctcctgcagagaagggctaccccaggcactgtgctgagaggcacagctcagggcagtttgggggtcatatttatacctacttttaattacatgtagattaaggggcagtttacgcagaaatttctagggaacggggaataacttttgggtcatcaggtcattgccacagaaagaggtggtaactccaaggtgttgccatcacaatggtaaactgacatggtacactgcttccatcctgtccctggtccccattttagctagccctcaatttggcctggtgtctaaaacctgcctccagagtcaggtcccacctcctacttcaaaaccacattgacctattaatttgttaagagtcttgtatttgtcagtagttttgactgtggaggcagaatttttacaagcttaccagcattgtaacgttgggaagactgctaacctggtggtgtccttttgcataaaatgacactaataaaacccacctaatagagtatcaaaataatatattttgatgcttggaatactgcagagcgagtactaactataaacaaactgcttcttaaaccaatttcatttttttaaatgaccacactcatttgtcattgtttctgtcaatcttctcgggcttactccttcactcccttctctgtatgatcatagtactcaatatattatttagctcaattacagaagttatcacacagggtttcacaactgattttgaatgtctcccccagtgttctaggctcatccaggataattcttcctttctcatctcttgtatctgcactactcttaatttaggtctagtatattttttacaaaacgtttttgaataaatgagtaagtcagatcctcagactatctagaccagatctagcagtacatgatatattttggaaaggcactattatattccctaagaacctctctttcacttccctctgatttgaataactttcaactgccaagctttgagaaaagaatataaaagggagtgaaaatctccattccaaacttgataggcggtctaaattttaaatgcattatttcttcattttttcttggattttgcaagcttttgggaaatttgtttcaattttaattttgctttaaataaacctaaaaaactttagcttgaagattaacaactctgcaatttgaagaatttagtttgatggctactcagaagattcagtaagtaatttcacagttcttgattatgaaacctaaatatatgttatgttttctgtaggcaaaatcccaaacttgttacctgaaggttctgtagatggggataccaggatggtcctggtgaatgctgtctacttcaaaggaaagtggaaaactccatttgagaagaaactaaatgggctttatcctttccgtgtaaactcggtatgagacaacaaaatacatcttcctagcatatattttagggcttttgacaagatatagacagaaaaattagagaccgctcattatagacttgctagttagaagttatgcatgttggacagttgattgactctttagaaacagtataggtaaaggggaagactgtggctttttaattatacatgcccagactccaacgttggctctaccacttatttcaaagggctgtaaatattgagacatggcacggttcctggcccatagtaagaactaaacaagtgttttagaattatggttgtcattaccattgttgtccatcttactaaataatgggtataaagttgaacaagctaataacatcagagtacccactgtaaggatgtacaaataatttattttgttgatttaaaaaaatcacatttatcctacactaaagtagaaccaatcctcctttatgtctaattgtaaatctcttgatatcttataatcgacttccatattttaccttttaataatattaggctcagcgcacacctgtacagatgatgtacttgcgtgaaaagctaaacattggatacatagaagacctaaaggctcagattctagaactcccatatgctggagatgttagcatgttcttgttgcttccagatgaaattgccgatgtgtccactggcttggagctggtaagacattcagatatttaagtttctggggctatacctacctttcgtgagatgagatgaatatatactccttacaaatggtgtggtaatttctcatggaaatatatgaaacagttgatagtaaatatggcatgcctctacatttcattcaaagccttaactatgtcatacgtgttaccttcttgtaaaaatctgaccaatctgttaactttctatatcacccacaatatagtaaagtcactgatttttaatattagacttaaagttgttttccttctttctaatacttgctgtattttcttttgtttgttttgttttgttttgctttgcagctggaaagtgaaataacctatgacaaactcaacaagtggaccagcaaagacaaaatggctgaagatgaagttgaggtatacataccccagttcaaattagaagagcattatgaactcagatccattctgagaagcatgggcatggaggacgccttcaacaagggacgggccaatttctcagggatgtcggagaggaatgacctgtttctttctgaagtgttccaccaagccatggtggatgtgaatgaggagggcactgaagcagccgctggcacaggaggtgttatgacagggagaactggacatggaggcccacagtttgtggcagatcatccttttctttttcttattatgcataagataaccaactgcattttatttttcggcagattttcctcaccctaaaactaagcgtgctgcttctgcaaaagatttttgtagatgagctgtgtgcctcagaattgctatttcaaattgccaaaaatttagagatgttttctacatatttctgctcttctgaacaacttctgctacccactaaataaaaacacagaaataattagacaattgtctattataacatgacaaccctattaatcatttggtcttctaaaatgggatcatgcccatttagattttccttactatcagtttatttttataacattaacttttactttgttatttattattttatataatggtgagtttttaaattattgctcactgcctatttaatgtagctaataaagttatagaagcagatgatctgttaatttcctatctaataaatgcctttaattgttctcataatgaagaataagtaggtatccctccatgcccttctgtaataaatatctggaaaaaacattaaacaataggcaaatatatgttatgtgcatttctagaaatacataacacatatatatgtctgtatcttatattcaattgcaagtatataataaataaacctgcttccaaacaacaata

SEQ ID NO: 2750 - DNA, 16186 bp, Homo sapiens; identical to SEQ ID NO: 2749
  source 1..16186: mol_type = genomic DNA

SEQ ID NO: 2751 - DNA, 17300 bp, Homo sapiens
  source 1..17300: mol_type = genomic DNA
ctgatttacaggaactcacaccagcgatcaatcttccttaatttgtaactgggcagtgtcccgggccagccaatagctaagactgccccccccgcaccccaccctccctgaccctgggggactctctactcagtctgcactggagctgcctggtgaccagaagtttggagtaggtttggtgctgggcaggggtggggagtagggtggaaagcatggagtgaagaggtctagggagggggtctcctcacccccgccttcctgcccgccttgatctcgggggtctctataggcttgcttccacctgggacttctgcctcctcctaccccagcccctcccgcctcaggcctgttgtgctcagccccccaggacctcccctcccccacgcctctggcctcattgtttggttaaagcaggaccccctccccctcccaccacctcccctccgactgaacagatggacagagacccgggcccacggggagaggaagggccagccggtgccgggaaagggaagcggtttggggaaaacaaaacagagggaggagccagggagaaggtggccccaggagggaggaggagggaattcgctaagagggactggggcctgagacggaatgggggcgggccccgggcggggtgggggcccctgggctcccagggtgggagctggctccgaggctggctggctccgcaggtccgctgacgtcgccgcccagatggcctccaggctgaccctgctgaccctcctgctgctgctgctggctggggtatgtggtcccttgtgggatgggggacgggggtggagacgggaggcgggatggtgcggggtgcgggcggtggctgaggattaacccttcaggctccggggaatgaggagagctcctcttgggatcattgagtgtgatccttgcacacgcactcgtagatggtggaaagagctcaggactcagacagatgcaagttctaatcttggcgggccatgtaggagctgcgcagcgtggtcctgaggacgtcacttttctcagcctactcctcctgatttataaaatgttgaataaacagatcccaccctgtccaccaagcaggcttggcaggaggatcacatagggcaaggagatgggaagcattttgtgatatcaaagcaagagtttgttgtagaaaagagctgtggggaggagaggtttggctgctgtgacacagacggtggtcccaggctagggcctgtgaagacagggaagaatggtagcaaacatacgtgggtctgggtgggggtcaatagcagtgagaggtcccagtggtctgggaggtcatggactagaaataaggctaagaagtgcaggatcccaggagaaaggtaggtaggggtgtgtgtatgtgcgtgtgtgtgtgtgtgcacgcgcaagttggtatcacatactcagcagatgatgtagttatgagcagggagtttggaatcagagaccttgttttgacccctagctgtttctcccatttctgtgagaccctggactagttaatatgtgtcggtatgagtttctctacctgtgaaatggagctaatgcgtggtttctcagtggaggatctgttgacattggggctggataattcattgctgaggggctaccctgcgcattttaggatgttttgcagtatatctctagcctctacgcactagattccggtagcatcttccctgctgtctccctgtgacaaccaaaaatgtctctggacattgccaaatatcccctgggagtcaaaattgtttcagagccgctggcctatactacttctctctccctcccttcctgcctcccttctttcctccttccctttcttcgttcccttcctaatgtgtactgtttttccacacccactaatgggttgcaacccacagtttaaaaatttactgttctaaatcaaggagcacaagttcaaatgtctgtactagccaagcaagtgagtcaaacaggtagatatttacaggaaattgcaagaacatagataaatgacaacactcagcttcactgtttggaaaacaacttcctacagggcagtaattggtcagagattacagagtccctgactatccctcatcttctgcagagcacattcctgtgcacccccaccctcaccctgtattgccccttctctgaggaattagtggtggtggttctaagacagattgctcatctgccgcactgtcagaaattactctcttgtacaggacattttccacatccacaccttctcttcctgctttgagtattttagaggactgtgcctcgtagtaagaaaaaaatgaaactcagtttcttgaaccacaggatagagcctcctcaaatccaaatgctaccagctccagctcccaggatccagagagtttgcaagacagaggcgaagggaaggtcgcaacaacagttatctccaagatgctattcgttgaacccatcctggaggtttccagcttgccgacaaccaactcaacaaccaattcagccaccaaaataacagctaataccactgatgaacccaccacacaacccaccacagagcccaccacccaacccaccatccaacccacccaaccaactacccagctcccaacagattctcctacccagcccactactgggtccttctgcccaggacctgttactctctgctctgacttggagagtcattcaacagaggccgtgttgggggatgctttggtagatttctccctgaagctctaccacgccttctcagcaatgaagaaggtggagaccaacatggccttttccccattcagcatcgccagcctccttacccaggtcctgctcggtaagaccctgcttgaattctctccaggtcatttgttggacactcccataagagtcaccaatccagacacttacaaagccatgcctctgggaagaagctgtaaaaatgggctattatatattgggggtggggtagagggatgtatcttttcattcttgaacattccatcatttcacagtgatgtaataggcacgattgcttgtaaaactctgtgactatacaagaacatataaaataaggtcgcagccactaaccatgtttcatggcaaggagaggtgataagaaagatgaaattaggcgcagtggctcacgcctgtaatcccagcactttgggaggccaaggcgggtggatcacctgaggtcaggagttcaagaccagcctggccaacatggtgaaaccctgtctctactaaaaatacaaaaattatcagggagtggtggtgcatgcctgtaatcccagctacttgggcagctgaggcaggagaatcgcttgaacccaggaggtggaggttgcagtgagccgagaccgcaccattgcactacagtctgggtgacagagcgagactctgtctcaaaaaaaaaaaaaaattatcagagatagacctagagtagatgtggttagtactgccttctagctctgtgaccttgggcagatcactttaacctctctgagccttgagtcctcttgtgtaaaatagtgatgatgctatctacctcaaaagattaagaagcagaaagccaggccggatgcggtggttcacacctgtaatcccagcattttaggaggccgaggcgggcagatcacgaggtcaggagttcgagaccagcctgactaacatggtgaaaccccgtctctactaaaaataaaaagaaattagctaggcatggtggtgcacacctgtaaccccagctactcaggaggctgaggcaggagaatcacttgaacacgggaggcagaggttgcagtgagccgaaatcatgccactgcactccagcctgggaagactgagcaagactctgtctcaaaaaaaaaaaagaagcagcctagtgtctgacttagtgggaggtcaaaaaaatgtaaatcctctgccatcttgagggattactgtcaagtcccatttggtaattaccctaggaatggcacaaacaaattactacaagcagtggggacagagctattactccccagagagaattctaaaaaggctacagaatctttcttggctgggcacggtgactcacacctataatcctggcactttgggaggccaaggcaggagttcaagaccagcctggccaacatgttgaaaccccatctctactaaaaatgcaaaaattagccaggcatagtgatgcatgcttattgtcccagctacttgggaggcagaggtgggaggattgcttgaacctggagattcaagtgagctgagattgcaccactgcattccagcctgggcaacaaagcaagactctgtctcaaaaaaaaaaaaaaaaaaaaaaaaaagagagattgagagaacacttccagctcagatgatctgtgatcccctccaaagcagggaataccctccattccagcctggtccccaaccctcattcccaaggaaggcccccgactcatcctgcaagtatctttcatctctgccctttgttgcaggggctggggagaacaccaaaacaaacctggagagcatcctctcttaccccaaggacttcacctgtgtccaccaggccctgaagggcttcacgaccaaaggtgtcacctcagtctctcagatcttccacagcccaggtgagtgcccaggaatgggcagtgtctgcagaggagggtcctgagaggactctgaagggggacccagcgctggggaaagaaaggacagagggaatgttggagctacagtatcagggatggactgcagagcaggtgaagaccttggcaggagcattaggtcactccaggaactagactgttcttctaatgagaccttagacaagtctctggcattcatcaactgctttagaataaaaataaccgggcaggtacagtaaaatagtgatgatgctatctacctcaaaagattaagaagcagaaagccaggctgggcgtggtggctcacacctgtaatcccagcactttgggaggccgaggcaggtggatcacgaggtcaggggttcgagaccagcctgaccaacatggtgaaaccctgtctctactaaaaatacaaaaattagctgggcatggtggcgggcacctgtaatcccagctattcaggaggctgaggcaggagaattgcttgaacctgggaggcggaggttgcagtgagccgagatgacgccactgcactccagcctgggcgacagagcaagactccgtctcaaaaaaaaaaacaaaaacaaaacaaaaacaaaaaaaaaaacaaagaaggagaaagccgggccgggcatggtggctctcatctgtaagttcaaggagttgaaggtatgctaggactttgggaggccaaggccttcaagaccagcctgggcagcatggcgaaacctgtctccattaaaaaaaaaaaagttgggggtacggctgggcatggtggctcacacctgtaatcccagcactttgggaggctgaggtgggtggaacacctgaggtcaggagttcaagaccagcctggccaacatggcaaaaccctgtctctattaaaaacacaaaaattagcctggcatggtggcaggcgcctataatcccaactactcaggaggctgaggcaggagaatcgcttgaacccaagagagtgaaggttgcagtgagctgagatcatgccacttcactccagcctgagtgaaacagcaaaactctgtctcaaaaaaaaaaaaaggaagaaagaaaaaaggccaggcgcggtgactcacgcctgtaatcgcaacactttggcaggccgaggcaggcgattcacaaggtcaggagttcgagaccagtctggctaactaacatagtgaaactccgtctctactgaaaatacaagaaattaccctggcatggtggtgtgcacctgtaatcccagctactcaggaggctgaggcaggagaatcgcttgaacctgggaggcagaggctgcagtgagccgagatcgcgccactgcactccagcctggatgacagagcaagactctgtctcaaaaaaaaaaggccgggcgcggtggctcatgcctgtaatcccagcactttgggaggctgaggcgggcggaccacgaggtcagaagatcaagaccatcctggctaacaagatgaaaccctgtctctgccaaaaaaatacaaaacttagccgggcatggtggcaggcgcctgtggtcccaactacttgggaggctgaggcaggagaatggcatgaacccgggaggcggagcttgcagtgagccgagattgcgccactgcactccagcctgggcaacagagcgagacaccatctcaaaaaaaaaaaaaaaaaatggggcgggcgggccaggcgcggtgtctcacacctgtaatcccagcactttgggaggctgaggtgggcggatcacttgaggtcaggagttcaagaccagcctggccaacaccaggaaaccctgtctctgttaaaaatacaaaaattagccaggtgtggtggcacgcgcctgtagtcccagcaggagaataacttcaacctgggagacagaggttgcagtcagctgagatcgcaccactgcattccagcctgggtgacagaccgagactctgtctcaaaaaaaaaaaaaaaaagaagaatacccatatgcattcattaatatatagggctagagggctagagagctatagacataaaatagacaaaaaatttttttgctcatttttgggtcaaaggagtcttgggactctaattcttttaatttttgtgttatgtgaatttgttatcatttacatgtattatgttattaagtaggtaataatgataatactaataataaacttacaaaacgatccaatgtagttgttttcagactttgttcctcggagccctaggactttgcaaagctgtttctggagtcatggtgggagtggggtgtggggagcctgagcagtggggaagggttcaccacttcctgtgagagggaaacggaccagctgggctctgagctccccacccagcctcagccagggtccattttatattgtgggcttcagacatgcctttgtttgaaagcagttctgctgctttaaaatgtttgataaccattgaactaatctacccacctccctttttaaaaaaaaaaggaaaacttttttttaagctgttttttttgttttttgtttttttttaaactgtaaaaacaatacttaggtctggctcagtgtgcctgtaattccaacactgagaggctgaggtaggaggattgcttgaggctagaatttcgagactagcctctgggcaacatagacagacctcatctctacaaaaaattttaaaaattatccgggtgtggtacgtgtctgtagttccagctatgaaggactgagacgggaggattgcttgagccaaggaattcgaagttagagtgagctatgtttatgcctctgtactctaggttgggtaacagagtaggaccctgtctctaaaaaaaaaaaaatttaatttaaattttaaaaactcacctatcaccccatcatctgaaaaacaccctctttcagatgtgggaaaaacatggctcagaggtgttcaagaaatgttgcatttatttattacttacaaagctgtaagtcagctttatccgctgtcttgctaggttggtgaaaaatacgtaacagcattcaatattagggcttctatccccatctagctgcacactggagctgtgccaagcaaggttcttggtcttatgttgtacttaggcatcagcaaagcctgggaaaatatcttttttttttttttgagacagaatctcgctctgtcgcccaggctggaatgcagtggcaccatctcagctcactgcaacctccgtctcccagattcaagtgattctcctgcctcagcctcccgaatagctgggattacaggctggtcttgaactcctggcctccagtgatccacccaccttggcctcccaaagtgctgcgattacaggtgtgagccaccatgcccagctggggaaaatatctttaatctacttagtcctagaaaaattatctttcaagtgctttttttttttttttttcagtggactgaaggcttttgcagagcaaaagccaggaagttttgtcacaaacttccaccaaggccaggaagcagagtctattccgtgccaaaattaagggaagaaaagagggaaaatctaggcaaatggaatttaatatctcaaaaagattatcttgccgagccatagtcacatagcaagctgaggcagcggaggcttggggctacttctcttgttcttggttctgggtttaccttctttgggccttatttgccacatctgtaagaggagtgggctggaccgcgctccaccatgccgtattcactaagtgagcagatagaaccatagaaagcatgctcactctcaaatcgtgctcatggaaagaacgacgtgttcaggactcatgcctccctttctcaacatacccccagacctggccataagggacacctttgtgaatgcctctcggaccctgtacagcagcagccccagagtcctaagcaacaacagtgacgccaacttggagctcatcaacacctgggtggccaagaacaccaacaacaagatcagccggctgctagacagtctgccctccgatacccgccttgtcctcctcaatgctatctacctgagtggtaagggtgcccttagccagttagtcttcccattctgggtccttcttcccctcctggcttcaaagcccacttaaccccaagttctacaatcggatctcaatgtccctgcactactctttgctaacaaggcttttagctcctcttcatccttttcctacctgcattagagcaaccctcccacctcttccctctagccaagtggaagacaacatttgatcccaagaaaaccagaatggaaccctttcacttcaaaaactcagttataaaagtgcccatgatgaatagcaagaagtaccctgtggcccatttcattgaccaaactttgaaagccaaggtaagttcttaacctttccttctcctgtttgaaacctacttgagtctcctgactttttttctgctgtagtcccatcattttggggtacatgcttacaaattcatcacttctactccttccatctgtatttccaccctatcttttctccttctcctttctctagccttggccaaggcagacattgtatattttaggctggaaacaggattctcaagtttcttcatgcatctctactatattgaatggcaaaatgtgagtcgtgttcctattctacacatctgtttctttttccagtcaactcatcagaagactctggtggcttagcaagtcctgtgtgtatgtgggtacctgtgtacagcatacatatacatgtgtagacgtgtataagtatatccttgtatatgcatatatgtggtaagtgcatgtgtgcacatgagttaaatggcttaagtgcattagcagaaattgaacaatttagtttgatgagtagggagggagagaagacagaatatggagcccagaggatcccaactggcaagctatctcatccccagttaccagatatttccacctttttaggatggcaaaacacagacctatgagacagaaaacagtaagagacaatgtctcaatacctggctgagaaacaaaggctctgttcttggaacatgctaggcttggttccacattgggagctttccttagcttttgtttctgcctgtatccctcttcactcagatcctcacatagcttgttccttcttgtcatttgggtgtcagctcagaggtcaccttggtggagaagtcttctccccattaaagcagcctcctcctcaccctgtaatatcactcctgttttattatattcattacactcatcaccatctgaaattatgtcatttatttgcttatttgcctaggacattgtctgtctccctaagatactgtctctctacttgaatacaggaacctgtcttgtttccttctgtatctgtagtgcctagaacaatgcctcctatcataggtgctcattcagtgtttgctgaataaatgaatgaatgaaatagagggtgccaaagagagctactcagtaaaagtggctggaagacttcatagaggagggtttttttcgagacagggtctcactctgtcactcaagctgcagtgcattgacatgatctcagctcactgcaatctctgcctcccgagttcaagcagttctcctgcctcagcctcccaagtagctgggactacaggagcccgccaccacacctggctaatttttgtatttttagtagagacggggtttcaccatgttagccaagctggtctcgaactcctgacctcaagtgatccacaccctcagcctcccaaagggctgggattacaggcatgagccacagcgcccagctgaggaggttatttttgaccattctttgctcagttatttatccactcatggacttatccacccatctatccatccctatctaatgtatttgaccattcatgactcatttagcagaaccaggacagcctgtataaggcacagaagagtgaatatatgtgacaggtccagagcattgttcaaattcaagatacgttgggggaggtataaatatgagatttttttcaaatcaattggaatggctatttaatcaaagccatagatgttaggtggaaagtaggaattaagaacttaacaagttaggtttaaatgtaactattcgaattataagaacaagtatttcctctctaaaaatgtttttaaagtttcacacaaaactctaaaccaaaaatcattgtaaaaatcccttgggagtagactgttgaaaccattgaggtgaggtgataggttaaggtgagcattctggacatataatatcaataataaatattcaaatacaaagcaggtataatatgaagagtaatttctatctccccaagccaatatgagttttgtttgtttgtttgtttttcttttgagataaagtctcattctgttgcccaggccggagtgcagtggcacaatcccagctctctgtaacctctgcctcccaggttcaagcgattctcctgccttagcctccctagtagctgggattataggtgcctgccaccactcccagctaatttttgtatttttagtagagatggggtttcaccatgttggccaggctggtcatgaactcctgacctcaagtgctcgtccgtcttcggcctcctaaagtgctggcattacaggcgtgagccactgcacccagcctgagttttttttttttttttaagccaaaggaggaggagtagttttgtgcacaaaagccactatttagagttccttaggttttaaacagataattaatttaatgtactaacaaatgcaaaattaaaattttacttatgccttttaattttaagctgaacttgctacattaagagtagggtgatttggctgggcgcagtggctcatgcctataatcccagcactttaggaggctgaggcaggtggatcacttgaagctaagagtttgagaccagcctggccaacatggtggaattctgtctctactaaaaatacaaaaattagccaggcatggtggcacatgtctgtaatcccagctactcaggatgctaaggcacagaatcacttgaacctgggaggcagaggttacagtgagccaaaatcgcgccactgcactccaacctgggcaacacagcaagactctgtctcaaaacacaaaaaaagaataggctgggtacagtggctcacgcctgtaatcccagcactttgggaggccgaggcaggtgaatcacctgaggtcaggagttcgagaccagcttggccaacattgtgaaaccccatctccattaaaaatacaaaaaataagccgggtgtgatggtgcacgcctgtaatcccagatacttgtgaggctgggacagaagaatcgcttgaacccgggaggcgaaggttgcagtgagccgagatcatgccactgcattccagcctgagcgacagagtgagaccttgtctcagaaaaaaaaaaatagggtgatttttatataaaaacactctcatttgttcttgaattaattgccatattgaacagattaaactcctttaaaccattttttctatctacaaacataattagtattcccataagcattttaagctccctttaaaaatttaatatgctcgattttcttttttcttttatttatttatgtagttttcccagacagggtcttactctatcacccagtctggagtacagtgacacaatcctcacttactgtaacctcaagctccttgggatgaagcagtcctcccaccctagcctcttaagtagctgagattccaggcatgagccacctcacccagctgattttctttttaaacacatctaatacctgacaggtcgtaattacgactgtgcttggccatatcatcctaacacctaaagctcacttgtaaactgaaaattaaatttgaagggtgaattaacttctagccaacattccaatatcattctcacatttaatgaaattatcctacaactttgcttaaaagcataaaactagcatgtcagagtctcttaaaaattacaatcactattttaaataacaaacatacaggttaccctgaacttaacacctggttttaacatgatgaagttggtttcttttgtcattcttatactaaattctaaatcttcctggcacttaaggatatttacccaaggaagggggtgagatttaccggctcaggtacaccgaggttactggcttgaaaattcaagaccacagcatggtaaatttttcttcagagattcaaggttcatacataggacttgaagggcacatgctactcaaatgagtatatccaacttgagtgctacatcaacagggaccccatgtccactcttttcagtcgaaattggcttactatctacttcttctgggctattcaggttccgacaattgattgctttcagttaatttctttattgcccagttgaattctgcattcttctagattctttttgttccttcagcctcaatcataataccatttaatgacagtctcatatcctattagactagggtttctcagccttggcactattgacatattgggtcagataattctttgtcctgtgcattgtagaatttagcatcttccttagcttctactcactagaagccagtagcactgtgtgcacatcctccttgccccctgccagctatgacaaccaaaatgtctccagacattaccaaatgtccactgagaggcaaattcactccgagttgacaacccctgtattaaacccaggggccctgcacttcttacatacttttgtctggtcaccagttgaaagtccttcttcttttttttttctctttttgagatggagtctcgctctgtcaccaggctggagtgcagtggcatgatctcggctcactgcagcctccacctcccgggttcaagcaattctcctgcctcagcctcctgagtagctgggattacaggcacgtgccaccacccagctaatttttgtatttttagtagaggtggggtttcatcatggtggccaggatggtctcaatctcttgacctcgtgatccgcccacctcggcctcccaaagtgctgggattacaggtgtgagccaccgtgcatgaccaaaagtccttctaatagcaaagtggaaaggtaggctgtgaacaatcttgaatgccatactaagatttgtacttattctcataggcagtgaagagccatcaatagtttttacagaggctgacctgataactctggcggttcaatgtgcatgctatatactatatgcacaacacattaggaaggaagggaacagcgctcagagaaatcaaatcacttgcccatattacatagctcgtcagtggtggagtcagggtataatcagaaactcatgctccttcctctacctctccccagcacagagttggatcagcactgttcacccagctggtatccccatttcatggtaaagcctggaagcttaggtctgactgatgcttgttgaaatacagactgtgggagcagactgcaggacagcattgtgacagagggtggggccaggagagagatgcggtaggaagactgttaagatgcatctcttattttctaggtggggcagctgcagctctcccacaatctgagtttggtgatcctggtaccccagaacctgaaacatcgtcttgaagacatggaacaggctctcagcccttctgttttcaaggccatcatggagaaactggagatgtccaagttccagcccactctcctaacactaccccgcatcaaagtgacgaccagccaggatatgctctcaatcatggagaaattgggtgagctctggcagcttagggttactcccaggccatcagaggagaaaggggggatccctaagatgtagttagcattctctagagtattttttacatccataatctcagtttgtcctgcaaccctgcaagttagaggggtaggtgctattatcccattggatcattgtggaaatggaggctcagaagctttatgtgacttacccagagattccatgatttacccttgagctagtcagaggcaaaccagaacaccgacccaggtctccagctctcctgagttttttctatggttccttgtgacataggcagtggaacagtgggacaggtaaccgaggtgaattatggatgctccttccccagacacatttcaaaacagtcagccaccccgtggaatatgcaagaagctatctggaagtgcagatctggaggcttctgagtttacgagaggcaacagagactccattttcttttttttttttttttttgagacggagtcttgctctgtcacccaggacaggctggagtgcagtggtgcgatctctgctcactgcaagatccgcctcccagattcacgccatgccattctctcgcctcagcctcccgagtagctgggactacaggtgcccgccaccacgcctggctaattttgtttttgtatttttagtagagacggggtttcactgtgttaaccaggatggtcacaatctccggaccttgtgatccacctgcctcggcctcccaaagtgctgggattacaggcatgagtcaccgcgcccagcccagagactccattttctaacctttgtttttttgtttgtttgtttttgagacggagcctcactctgtcacccaggctggagcgcagtggcatgatcttgggtcactgcaacctccgcctcctgggttcaagtgattctcctacctcagcctcccaagtagctgggattacaggcacctaccaccacgcccagctaatttttttgtatttttagtagagatggggtttcaccatgttggtgaagctggtcttgaactcctgggctcaagtgatccacccacctcggcttcccaaagtgctgggattacaggtgtgagccactgtgcccagcctcattttctaacctttgatctcatgtccagccctgtcacttcatttcttgttagagaatttgaccgcctaacacatgattccatttccttgtatatgtcatctgtataggaagaaaacctcttttttattttcattcaacacttctggccaccaaacaggtgtgggagtgttttctaagcaattctccagttatctggggacaccaactgggtgtcctacaattgaatccaattctaacactctacctggaaataacatcagatcccgtgcagtttaagtgctccgccccagcaaatttccccccgtttccaatgtcagttacaagactgggttgtcacctgtgcatcagaccaaccagctataatttggagattcccacaactccctgctagggtttcatcatttgctagaatagctgacaaaactcaggagacacttacatttactggtttattatgtaaaggattaagtaaaggatacagatgaacagccagttgaagagatacatagggcaaaatctggaagggtcctgggcccagcagcatctatcctgtggagttctgtttgctaccttcctgacacatgtatgtgttcaccaaccagaaactctcagaaccctgtactttaggagaagtcatcatgtaggcatgattgattattacccaatctccagctcctctcttctccccagaggatggagagaggggctgaaagttccaagcttctaatcacacttggtctttctggtgaccagccccaatccaggagccagcaggagtagcctcattagcacaaaaggcattcctatgacccaggaaattccaagggatctagtagctctgtgtcaggaactgggatcggagaccaaatattagatggtctaatatttggagctaaagatgctcctatagcatattttcccattatttcacagcatcatggcattgcatataacctcattttttcatatatgacctatctctgatctattacctcacttccaaggtcctgggagataaggaggcaatgacatcatttttcagggttgttttagggatgaggggcaaggcctctcaccttgagagagagtggcagtgttgggcccactaatagaggatcccacgaactgccagagggtacagtatgtaatctggcaaacaagggaagaggaagagagcactgggactcaggatgaacccagagaattcaggacaaaggtctccatcagctgagggtatcatgctggcttctgactctgtttttctctggttttgccctagaattcttcgatttttcttatgaccttaacctgtgtgggctgacagaggacccagatcttcaggtttctgcgatgcagcaccagacagtgctggaactgacagagactggggtggaggcggctgcagcctccgccatctctgtggcccgcaccctgctggtctttgaagtgcagcagcccttcctcttcgtgctctgggaccagcagcacaagttccctgtcttcatggggcgagtatatgaccccagggcctgagacctgcaggatcaggttagggcgagcgctacctctccagcctcagctctcagttgcagccctgctgctgcctgcctggacttggcccctgccacctcctgcctcaggtgtccgctatccaccaaaagggctccctgagggtctgggcaagggacctgcttctattagcccttctccatggccctgccatgctctccaaaccactttttgcagctttctctagttcaagttcaccagactctataaataaaacctgacagaccatgactttc

SEQ ID NO: 2752 - DNA, 16622 bp, Homo sapiens
  source 1..16622: mol_type = genomic DNA
gctggctggctccgcaggtccgctgacgtcgccgcccagatggcctccaggctgaccctgctgaccctcctgctgctgctgctggctggggtatgtggtcccttgtgggatgggggacgggggtggagacgggaggcgggatggtgcggggtgcgggcggtggctgaggattaacccttcaggctccggggaatgaggagagctcctcttgggatcattgagtgtgatccttgcacacgcactcgtagatggtggaaagagctcaggactcagacagatgcaagttctaatcttggcgggccatgtaggagctgcgcagcgtggtcctgaggacgtcacttttctcagcctactcctcctgatttataaaatgttgaataaacagatcccaccctgtccaccaagcaggcttggcaggaggatcacatagggcaaggagatgggaagcattttgtgatatcaaagcaagagtttgttgtagaaaagagctgtggggaggagaggtttggctgctgtgacacagacggtggtcccaggctagggcctgtgaagacagggaagaatggtagcaaacatacgtgggtctgggtgggggtcaatagcagtgagaggtcccagtggtctgggaggtcatggactagaaataaggctaagaagtgcaggatcccaggagaaaggtaggtaggggtgtgtgtatgtgcgtgtgtgtgtgtgtgcacgcgcaagttggtatcacatactcagcagatgatgtagttatgagcagggagtttggaatcagagaccttgttttgacccctagctgtttctcccatttctgtgagaccctggactagttaatatgtgtcggtatgagtttctctacctgtgaaatggagctaatgcgtggtttctcagtggaggatctgttgacattggggctggataattcattgctgaggggctaccctgcgcattttaggatgttttgcagtatatctctagcctctacgcactagattccggtagcatcttccctgctgtctccctgtgacaaccaaaaatgtctctggacattgccaaatatcccctgggagtcaaaattgtttcagagccgctggcctatactacttctctctccctcccttcctgcctcccttctttcctccttccctttcttcgttcccttcctaatgtgtactgtttttccacacccactaatgggttgcaacccacagtttaaaaatttactgttctaaatcaaggagcacaagttcaaatgtctgtactagccaagcaagtgagtcaaacaggtagatatttacaggaaattgcaagaacatagataaatgacaacactcagcttcactgtttggaaaacaacttcctacagggcagtaattggtcagagattacagagtccctgactatccctcatcttctgcagagcacattcctgtgcacccccaccctcaccctgtattgccccttctctgaggaattagtggtggtggttctaagacagattgctcatctgccgcactgtcagaaattactctcttgtacaggacattttccacatccacaccttctcttcctgctttgagtattttagaggactgtgcctcgtagtaagaaaaaaatgaaactcagtttcttgaaccacaggatagagcctcctcaaatccaaatgctaccagctccagctcccaggatccagagagtttgcaagacagaggcgaagggaaggtcgcaacaacagttatctccaagatgctattcgttgaacccatcctggaggtttccagcttgccgacaaccaactcaacaaccaattcagccaccaaaataacagctaataccactgatgaacccaccacacaacccaccacagagcccaccacccaacccaccatccaacccacccaaccaactacccagctcccaacagattctcctacccagcccactactgggtccttctgcccaggacctgttactctctgctctgacttggagagtcattcaacagaggccgtgttgggggatgctttggtagatttctccctgaagctctaccacgccttctcagcaatgaagaaggtggagaccaacatggccttttccccattcagcatcgccagcctccttacccaggtcctgctcggtaagaccctgcttgaattctctccaggtcatttgttggacactcccataagagtcaccaatccagacacttacaaagccatgcctctgggaagaagctgtaaaaatgggctattatatattgggggtggggtagagggatgtatcttttcattcttgaacattccatcatttcacagtgatgtaataggcacgattgcttgtaaaactctgtgactatacaagaacatataaaataaggtcgcagccactaaccatgtttcatggcaaggagaggtgataagaaagatgaaattaggcgcagtggctcacgcctgtaatcccagcactttgggaggccaaggcgggtggatcacctgaggtcaggagttcaagaccagcctggccaacatggtgaaaccctgtctctactaaaaatacaaaaattatcagggagtggtggtgcatgcctgtaatcccagctacttgggcagctgaggcaggagaatcgcttgaacccaggaggtggaggttgcagtgagccgagaccgcaccattgcactacagtctgggtgacagagcgagactctgtctcaaaaaaaaaaaaaaattatcagagatagacctagagtagatgtggttagtactgccttctagctctgtgaccttgggcagatcactttaacctctctgagccttgagtcctcttgtgtaaaatagtgatgatgctatctacctcaaaagattaagaagcagaaagccaggccggatgcggtggttcacacctgtaatcccagcattttaggaggccgaggcgggcagatcacgaggtcaggagttcgagaccagcctgactaacatggtgaaaccccgtctctactaaaaataaaaagaaattagctaggcatggtggtgcacacctgtaaccccagctactcaggaggctgaggcaggagaatcacttgaacacgggaggcagaggttgcagtgagccgaaatcatgccactgcactccagcctgggaagactgagcaagactctgtctcaaaaaaaaaaaagaagcagcctagtgtctgacttagtgggaggtcaaaaaaatgtaaatcctctgccatcttgagggattactgtcaagtcccatttggtaattaccctaggaatggcacaaacaaattactacaagcagtggggacagagctattactccccagagagaattctaaaaaggctacagaatctttcttggctgggcacggtgactcacacctataatcctggcactttgggaggccaaggcaggagttcaagaccagcctggccaacatgttgaaaccccatctctactaaaaatgcaaaaattagccaggcatagtgatgcatgcttattgtcccagctacttgggaggcagaggtgggaggattgcttgaacctggagattcaagtgagctgagattgcaccactgcattccagcctgggcaacaaagcaagactctgtctcaaaaaaaaaaaaaaaaaaaaaaaaaagagagattgagagaacacttccagctcagatgatctgtgatcccctccaaagcagggaataccctccattccagcctggtccccaaccctcattcccaaggaaggcccccgactcatcctgcaagtatctttcatctctgccctttgttgcaggggctggggagaacaccaaaacaaacctggagagcatcctctcttaccccaaggacttcacctgtgtccaccaggccctgaagggcttcacgaccaaaggtgtcacctcagtctctcagatcttccacagcccaggtgagtgcccaggaatgggcagtgtctgcagaggagggtcctgagaggactctgaagggggacccagcgctggggaaagaaaggacagagggaatgttggagctacagtatcagggatggactgcagagcaggtgaagaccttggcaggagcattaggtcactccaggaactagactgttcttctaatgagaccttagacaagtctctggcattcatcaactgctttagaataaaaataaccgggcaggtacagtaaaatagtgatgatgctatctacctcaaaagattaagaagcagaaagccaggctgggcgtggtggctcacacctgtaatcccagcactttgggaggccgaggcaggtggatcacgaggtcaggggttcgagaccagcctgaccaacatggtgaaaccctgtctctactaaaaatacaaaaattagctgggcatggtggcgggcacctgtaatcccagctattcaggaggctgaggcaggagaattgcttgaacctgggaggcggaggttgcagtgagccgagatgacgccactgcactccagcctgggcgacagagcaagactccgtctcaaaaaaaaaaacaaaaacaaaacaaaaacaaaaaaaaaaacaaagaaggagaaagccgggccgggcatggtggctctcatctgtaagttcaaggagttgaaggtatgctaggactttgggaggccaaggccttcaagaccagcctgggcagcatggcgaaacctgtctccattaaaaaaaaaaaagttgggggtacggctgggcatggtggctcacacctgtaatcccagcactttgggaggctgaggtgggtggaacacctgaggtcaggagttcaagaccagcctggccaacatggcaaaaccctgtctctattaaaaacacaaaaattagcctggcatggtggcaggcgcctataatcccaactactcaggaggctgaggcaggagaatcgcttgaacccaagagagtgaaggttgcagtgagctgagatcatgccacttcactccagcctgagtgaaacagcaaaactctgtctcaaaaaaaaaaaaaggaagaaagaaaaaaggccaggcgcggtgactcacgcctgtaatcgcaacactttggcaggccgaggcaggcgattcacaaggtcaggagttcgagaccagtctggctaactaacatagtgaaactccgtctctactgaaaatacaagaaattaccctggcatggtggtgtgcacctgtaatcccagctactcaggaggctgaggcaggagaatcgcttgaacctgggaggcagaggctgcagtgagccgagatcgcgccactgcactccagcctggatgacagagcaagactctgtctcaaaaaaaaaaggccgggcgcggtggctcatgcctgtaatcccagcactttgggaggctgaggcgggcggaccacgaggtcagaagatcaagaccatcctggctaacaagatgaaaccctgtctctgccaaaaaaatacaaaacttagccgggcatggtggcaggcgcctgtggtcccaactacttgggaggctgaggcaggagaatggcatgaacccgggaggcggagcttgcagtgagccgagattgcgccactgcactccagcctgggcaacagagcgagacaccatctcaaaaaaaaaaaaaaaaaatggggcgggcgggccaggcgcggtgtctcacacctgtaatcccagcactttgggaggctgaggtgggcggatcacttgaggtcaggagttcaagaccagcctggccaacaccaggaaaccctgtctctgttaaaaatacaaaaattagccaggtgtggtggcacgcgcctgtagtcccagcaggagaataacttcaacctgggagacagaggttgcagtcagctgagatcgcaccactgcattccagcctgggtgacagaccgagactctgtctcaaaaaaaaaaaaaaaaagaagaatacccatatgcattcattaatatatagggctagagggctagagagctatagacataaaatagacaaaaaatttttttgctcatttttgggtcaaaggagtcttgggactctaattcttttaatttttgtgttatgtgaatttgttatcatttacatgtattatgttattaagtaggtaataatgataatactaataataaacttacaaaacgatccaatgtagttgttttcagactttgttcctcggagccctaggactttgcaaagctgtttctggagtcatggtgggagtggggtgtggggagcctgagcagtggggaagggttcaccacttcctgtgagagggaaacggaccagctgggctctgagctccccacccagcctcagccagggtccattttatattgtgggcttcagacatgcctttgtttgaaagcagttctgctgctttaaaatgtttgataaccattgaactaatctacccacctccctttttaaaaaaaaaaggaaaacttttttttaagctgttttttttgttttttgtttttttttaaactgtaaaaacaatacttaggtctggctcagtgtgcctgtaattccaacactgagaggctgaggtaggaggattgcttgaggctagaatttcgagactagcctctgggcaacatagacagacctcatctctacaaaaaattttaaaaattatccgggtgtggtacgtgtctgtagttccagctatgaaggactgagacgggaggattgcttgagccaaggaattcgaagttagagtgagctatgtttatgcctctgtactctaggttgggtaacagagtaggaccctgtctctaaaaaaaaaaaaatttaatttaaattttaaaaactcacctatcaccccatcatctgaaaaacaccctctttcagatgtgggaaaaacatggctcagaggtgttcaagaaatgttgcatttatttattacttacaaagctgtaagtcagctttatccgctgtcttgctaggttggtgaaaaatacgtaacagcattcaatattagggcttctatccccatctagctgcacactggagctgtgccaagcaaggttcttggtcttatgttgtacttaggcatcagcaaagcctgggaaaatatcttttttttttttttgagacagaatctcgctctgtcgcccaggctggaatgcagtggcaccatctcagctcactgcaacctccgtctcccagattcaagtgattctcctgcctcagcctcccgaatagctgggattacaggctggtcttgaactcctggcctccagtgatccacccaccttggcctcccaaagtgctgcgattacaggtgtgagccaccatgcccagctggggaaaatatctttaatctacttagtcctagaaaaattatctttcaagtgctttttttttttttttttcagtggactgaaggcttttgcagagcaaaagccaggaagttttgtcacaaacttccaccaaggccaggaagcagagtctattccgtgccaaaattaagggaagaaaagagggaaaatctaggcaaatggaatttaatatctcaaaaagattatcttgccgagccatagtcacatagcaagctgaggcagcggaggcttggggctacttctcttgttcttggttctgggtttaccttctttgggccttatttgccacatctgtaagaggagtgggctggaccgcgctccaccatgccgtattcactaagtgagcagatagaaccatagaaagcatgctcactctcaaatcgtgctcatggaaagaacgacgtgttcaggactcatgcctccctttctcaacatacccccagacctggccataagggacacctttgtgaatgcctctcggaccctgtacagcagcagccccagagtcctaagcaacaacagtgacgccaacttggagctcatcaacacctgggtggccaagaacaccaacaacaagatcagccggctgctagacagtctgccctccgatacccgccttgtcctcctcaatgctatctacctgagtggtaagggtgcccttagccagttagtcttcccattctgggtccttcttcccctcctggcttcaaagcccacttaaccccaagttctacaatcggatctcaatgtccctgcactactctttgctaacaaggcttttagctcctcttcatccttttcctacctgcattagagcaaccctcccacctcttccctctagccaagtggaagacaacatttgatcccaagaaaaccagaatggaaccctttcacttcaaaaactcagttataaaagtgcccatgatgaatagcaagaagtaccctgtggcccatttcattgaccaaactttgaaagccaaggtaagttcttaacctttccttctcctgtttgaaacctacttgagtctcctgactttttttctgctgtagtcccatcattttggggtacatgcttacaaattcatcacttctactccttccatctgtatttccaccctatcttttctccttctcctttctctagccttggccaaggcagacattgtatattttaggctggaaacaggattctcaagtttcttcatgcatctctactatattgaatggcaaaatgtgagtcgtgttcctattctacacatctgtttctttttccagtcaactcatcagaagactctggtggcttagcaagtcctgtgtgtatgtgggtacctgtgtacagcatacatatacatgtgtagacgtgtataagtatatccttgtatatgcatatatgtggtaagtgcatgtgtgcacatgagttaaatggcttaagtgcattagcagaaattgaacaatttagtttgatgagtagggagggagagaagacagaatatggagcccagaggatcccaactggcaagctatctcatccccagttaccagatatttccacctttttaggatggcaaaacacagacctatgagacagaaaacagtaagagacaatgtctcaatacctggctgagaaacaaaggctctgttcttggaacatgctaggcttggttccacattgggagctttccttagcttttgtttctgcctgtatccctcttcactcagatcctcacatagcttgttccttcttgtcatttgggtgtcagctcagaggtcaccttggtggagaagtcttctccccattaaagcagcctcctcctcaccctgtaatatcactcctgttttattatattcattacactcatcaccatctgaaattatgtcatttatttgcttatttgcctaggacattgtctgtctccctaagatactgtctctctacttgaatacaggaacctgtcttgtttccttctgtatctgtagtgcctagaacaatgcctcctatcataggtgctcattcagtgtttgctgaataaatgaatgaatgaaatagagggtgccaaagagagctactcagtaaaagtggctggaagacttcatagaggagggtttttttcgagacagggtctcactctgtcactcaagctgcagtgcattgacatgatctcagctcactgcaatctctgcctcccgagttcaagcagttctcctgcctcagcctcccaagtagctgggactacaggagcccgccaccacacctggctaatttttgtatttttagtagagacggggtttcaccatgttagccaagctggtctcgaactcctgacctcaagtgatccacaccctcagcctcccaaagggctgggattacaggcatgagccacagcgcccagctgaggaggttatttttgaccattctttgctcagttatttatccactcatggacttatccacccatctatccatccctatctaatgtatttgaccattcatgactcatttagcagaaccaggacagcctgtataaggcacagaagagtgaatatatgtgacaggtccagagcattgttcaaattcaagatacgttgggggaggtataaatatgagatttttttcaaatcaattggaatggctatttaatcaaagccatagatgttaggtggaaagtaggaattaagaacttaacaagttaggtttaaatgtaactattcgaattataagaacaagtatttcctctctaaaaatgtttttaaagtttcacacaaaactctaaaccaaaaatcattgtaaaaatcccttgggagtagactgttgaaaccattgaggtgaggtgataggttaaggtgagcattctggacatataatatcaataataaatattcaaatacaaagcaggtataatatgaagagtaatttctatctccccaagccaatatgagttttgtttgtttgtttgtttttcttttgagataaagtctcattctgttgcccaggccggagtgcagtggcacaatcccagctctctgtaacctctgcctcccaggttcaagcgattctcctgccttagcctccctagtagctgggattataggtgcctgccaccactcccagctaatttttgtatttttagtagagatggggtttcaccatgttggccaggctggtcatgaactcctgacctcaagtgctcgtccgtcttcggcctcctaaagtgctggcattacaggcgtgagccactgcacccagcctgagttttttttttttttttaagccaaaggaggaggagtagttttgtgcacaaaagccactatttagagttccttaggttttaaacagataattaatttaatgtactaacaaatgcaaaattaaaattttacttatgccttttaattttaagctgaacttgctacattaagagtagggtgatttggctgggcgcagtggctcatgcctataatcccagcactttaggaggctgaggcaggtggatcacttgaagctaagagtttgagaccagcctggccaacatggtggaattctgtctctactaaaaatacaaaaattagccaggcatggtggcacatgtctgtaatcccagctactcaggatgctaaggcacagaatcacttgaacctgggaggcagaggttacagtgagccaaaatcgcgccactgcactccaacctgggcaacacagcaagactctgtctcaaaacacaaaaaaagaataggctgggtacagtggctcacgcctgtaatcccagcactttgggaggccgaggcaggtgaatcacctgaggtcaggagttcgagaccagcttggccaacattgtgaaaccccatctccattaaaaatacaaaaaataagccgggtgtgatggtgcacgcctgtaatcccagatacttgtgaggctgggacagaagaatcgcttgaacccgggaggcgaaggttgcagtgagccgagatcatgccactgcattccagcctgagcgacagagtgagaccttgtctcagaaaaaaaaaaatagggtgatttttatataaaaacactctcatttgttcttgaattaattgccatattgaacagattaaactcctttaaaccattttttctatctacaaacataattagtattcccataagcattttaagctccctttaaaaatttaatatgctcgattttcttttttcttttatttatttatgtagttttcccagacagggtcttactctatcacccagtctggagtacagtgacacaatcctcacttactgtaacctcaagctccttgggatgaagcagtcctcccaccctagcctcttaagtagctgagattccaggcatgagccacctcacccagctgattttctttttaaacacatctaatacctgacaggtcgtaattacgactgtgcttggccatatcatcctaacacctaaagctcacttgtaaactgaaaattaaatttgaagggtgaattaacttctagccaacattccaatatcattctcacatttaatgaaattatcctacaactttgcttaaaagcataaaactagcatgtcagagtctcttaaaaattacaatcactattttaaataacaaacatacaggttaccctgaacttaacacctggttttaacatgatgaagttggtttcttttgtcattcttatactaaattctaaatcttcctggcacttaaggatatttacccaaggaagggggtgagatttaccggctcaggtacaccgaggttactggcttgaaaattcaagaccacagcatggtaaatttttcttcagagattcaaggttcatacataggacttgaagggcacatgctactcaaatgagtatatccaacttgagtgctacatcaacagggaccccatgtccactcttttcagtcgaaattggcttactatctacttcttctgggctattcaggttccgacaattgattgctttcagttaatttctttattgcccagttgaattctgcattcttctagattctttttgttccttcagcctcaatcataataccatttaatgacagtctcatatcctattagactagggtttctcagccttggcactattgacatattgggtcagataattctttgtcctgtgcattgtagaatttagcatcttccttagcttctactcactagaagccagtagcactgtgtgcacatcctccttgccccctgccagctatgacaaccaaaatgtctccagacattaccaaatgtccactgagaggcaaattcactccgagttgacaacccctgtattaaacccaggggccctgcacttcttacatacttttgtctggtcaccagttgaaagtccttcttcttttttttttctctttttgagatggagtctcgctctgtcaccaggctggagtgcagtggcatgatctcggctcactgcagcctccacctcccgggttcaagcaattctcctgcctcagcctcctgagtagctgggattacaggcacgtgccaccacccagctaatttttgtatttttagtagaggtggggtttcatcatggtggccaggatggtctcaatctcttgacctcgtgatccgcccacctcggcctcccaaagtgctgggattacaggtgtgagccaccgtgcatgaccaaaagtccttctaatagcaaagtggaaaggtaggctgtgaacaatcttgaatgccatactaagatttgtacttattctcataggcagtgaagagccatcaatagtttttacagaggctgacctgataactctggcggttcaatgtgcatgctatatactatatgcacaacacattaggaaggaagggaacagcgctcagagaaatcaaatcacttgcccatattacatagctcgtcagtggtggagtcagggtataatcagaaactcatgctccttcctctacctctccccagcacagagttggatcagcactgttcacccagctggtatccccatttcatggtaaagcctggaagcttaggtctgactgatgcttgttgaaatacagactgtgggagcagactgcaggacagcattgtgacagagggtggggccaggagagagatgcggtaggaagactgttaagatgcatctcttattttctaggtggggcagctgcagctctcccacaatctgagtttggtgatcctggtaccccagaacctgaaacatcgtcttgaagacatggaacaggctctcagcccttctgttttcaaggccatcatggagaaactggagatgtccaagttccagcccactctcctaacactaccccgcatcaaagtgacgaccagccaggatatgctctcaatcatggagaaattgggtgagctctggcagcttagggttactcccaggccatcagaggagaaaggggggatccctaagatgtagttagcattctctagagtattttttacatccataatctcagtttgtcctgcaaccctgcaagttagaggggtaggtgctattatcccattggatcattgtggaaatggaggctcagaagctttatgtgacttacccagagattccatgatttacccttgagctagtcagaggcaaaccagaacaccgacccaggtctccagctctcctgagttttttctatggttccttgtgacataggcagtggaacagtgggacaggtaaccgaggtgaattatggatgctccttccccagacacatttcaaaacagtcagccaccccgtggaatatgcaagaagctatctggaagtgcagatctggaggcttctgagtttacgagaggcaacagagactccattttcttttttttttttttttttgagacggagtcttgctctgtcacccaggacaggctggagtgcagtggtgcgatctctgctcactgcaagatccgcctcccagattcacgccatgccattctctcgcctcagcctcccgagtagctgggactacaggtgcccgccaccacgcctggctaattttgtttttgtatttttagtagagacggggtttcactgtgttaaccaggatggtcacaatctccggaccttgtgatccacctgcctcggcctcccaaagtgctgggattacaggcatgagtcaccgcgcccagcccagagactccattttctaacctttgtttttttgtttgtttgtttttgagacggagcctcactctgtcacccaggctggagcgcagtggcatgatcttgggtcactgcaacctccgcctcctgggttcaagtgattctcctacctcagcctcccaagtagctgggattacaggcacctaccaccacgcccagctaatttttttgtatttttagtagagatggggtttcaccatgttggtgaagctggtcttgaactcctgggctcaagtgatccacccacctcggcttcccaaagtgctgggattacaggtgtgagccactgtgcccagcctcattttctaacctttgatctcatgtccagccctgtcacttcatttcttgttagagaatttgaccgcctaacacatgattccatttccttgtatatgtcatctgtataggaagaaaacctcttttttattttcattcaacacttctggccaccaaacaggtgtgggagtgttttctaagcaattctccagttatctggggacaccaactgggtgtcctacaattgaatccaattctaacactctacctggaaataacatcagatcccgtgcagtttaagtgctccgccccagcaaatttccccccgtttccaatgtcagttacaagactgggttgtcacctgtgcatcagaccaaccagctataatttggagattcccacaactccctgctagggtttcatcatttgctagaatagctgacaaaactcaggagacacttacatttactggtttattatgtaaaggattaagtaaaggatacagatgaacagccagttgaagagatacatagggcaaaatctggaagggtcctgggcccagcagcatctatcctgtggagttctgtttgctaccttcctgacacatgtatgtgttcaccaaccagaaactctcagaaccctgtactttaggagaagtcatcatgtaggcatgattgattattacccaatctccagctcctctcttctccccagaggatggagagaggggctgaaagttccaagcttctaatcacacttggtctttctggtgaccagccccaatccaggagccagcaggagtagcctcattagcacaaaaggcattcctatgacccaggaaattccaagggatctagtagctctgtgtcaggaactgggatcggagaccaaatattagatggtctaatatttggagctaaagatgctcctatagcatattttcccattatttcacagcatcatggcattgcatataacctcattttttcatatatgacctatctctgatctattacctcacttccaaggtcctgggagataaggaggcaatgacatcatttttcagggttgttttagggatgaggggcaaggcctctcaccttgagagagagtggcagtgttgggcccactaatagaggatcccacgaactgccagagggtacagtatgtaatctggcaaacaagggaagaggaagagagcactgggactcaggatgaacccagagaattcaggacaaaggtctccatcagctgagggtatcatgctggcttctgactctgtttttctctggttttgccctagaattcttcgatttttcttatgaccttaacctgtgtgggctgacagaggacccagatcttcaggtttctgcgatgcagcaccagacagtgctggaactgacagagactggggtggaggcggctgcagcctccgccatctctgtggcccgcaccctgctggtctttgaagtgcagcagcccttcctcttcgtgctctgggaccagcagcacaagttccctgtcttcatggggcgagtatatgaccccagggcctgagacctgcaggatcaggttagggcgagcgctacctctccagcctcagctctcagttgcagccctgctgctgcctgcctggacttggcccctgccacctcctgcctcaggtgtccgctatccaccaaaagggctccctgagggtctgggcaagggacctgcttctattagcccttctccatggccctgccatgctctccaaaccactttttgcagctttctctagttcaagttcaccagactctataaataaaacctgacagaccatgactttc

SEQ ID NO: 2753 - DNA, 48074 bp, Homo sapiens
  source 1..48074: mol_type = genomic DNA
gggcgcgggcgggacggagctgcggcggcggcgggtcccgcgggcgggagcgcctggcggccgagtcaagccgccgcctcgacccagggcccgcgggccaggagagcgctcggcgggtaagcctcggcggcgggtctcggcgggtctcgggggtctcgcgggggggcggtctccgcgtctggaaggggctcggcgggccttggcggtctgggggctctcggcgggtctcgggggtctcgggggagtctcggggtcccgacaggtctcggcgggtctcgggggtctcgggggagtctccggggagtctcaggggtcccggcaggtcttggcaggtctcgggggagtctcagggtcccggcaggtatgggcgggtgtcgggggtctcgggtgcgcagcagcctcccccgggccccggggcctccgtgtccttgccaaaggacgcacggggcctgggcacggcgggcagtgcccgagggagcgcggcttcggggcgggggccgggtgtcccttgccgggggctcaggggtgggaggcggtgcgacgcgtctgtttcgcacccctcgcgcccctctggccccgcggcggggcccctttacgcgaccctccccacaagactcaaaggctgcggcgggcactcgctctccgcccttcccggaatccaaacttccctctgcagcggccgcgcttcacggagggcaagaaaagccgcccactggcgctgattcacactgaagtgtgagtgactgatagccgggcgtctgagactctcatgggcaacagggaatctcaggggtggcagagggactggaggagttagggggcggggacagccccttccacctgtacgctggcctccctgcagcccagcactttcccgctgctctgggcctcggctccctgggggtattgagggcctgagccctgctgtggggagccttctgctggtgctcctttccgtgagcacctcctatcccctctctgtgcctcagtttgctcatctgttgacactggggacagctgtgcctcctggtctagtggccacacttaagtccttcgaattggctgtggccaggggcgggtactccgtgtgggctgctggggtggacagcctgcctggatgacatgtgtgtggccttgcaggtgacatgggccggtgatgcaatgtgtagaattgtttccacaaccgcctgaaggcagggcccacagcctcctccttgccgaagcaagcctctgggttcaggtcagccctgcaccaactccatgagcctggacaagctcctgccctcactggctcaggccctgtgggaccagaggaggggctgggctccaccccctcctggttcttcccactctgtccactgtctcctctacgtagacaccgtcgaagggccctcttggagcccaacctcagggccccactccaggcactccactcctggcaggacaggaggcctgggacgagggctgcaagggagtgaggattctgtctatcccctctccctgccacccgccaggctccctttgcctggctctgtgccctgcgttaggcacaccctggagggggcaggcagaaggaagacagataggcagccgtgtctaggaactgccagccagggccatctggtgagaggggtgctgacaggggacctggcctttcagggagtccccaggcctccaggatcatgggggagcccaccaaggaggctggcctgaagaggcagacagagggaggacaggctctgggcctgccttggccctttctgcccacatggacagaggaagcagggtgctgagtcagctggagctccccaccccccagggatgcacgcacacaagcaggcccacagacgggaagtccaggggcccagagagacgagatggccagccttggttcctgaggggcagggaggaagggcgcaaactcagccaggatcttgggtgtgaactcagatgccaccagtttccagctgtgtgatcatggccaggaggcttccccctgccacccctccgttttctcatccatgacctgagggctgtgaagcactttgtacctggtgggtggctatgagtgtccgtaggggggatggtggtggtggtgacatgtgcttggtattcagtgacagtgggtcgctgagggtgctctccctggtcctcagggccgctgtatgtcctgttttgggtgggggcagggactggcctggagaggcctgggtaaaggccaaggctcccaggttcctgcccacattggactaaggcctgagtccatcaggagtggccagtgttgggcagcccctgggtcttcctgcgttctgtcctcaaaagctcccttgtggggacaccccaggtcagtgactatgtgtggcaggctctgccctcctcactctctgtcctctcttgacctcatgatctgcccacctcccaaagtgctgggattacaggcgtgagcccccacgcctggcagagtatatagttctttaataaccgggtggcttggccatcactgtgcagcctgggtgggtgaggagaagggcaggctggcggggaaaagacggggaatttgccacaaggtgagagctgtcctaccccagacgcagtggagcggctcccacccctcgggccaatgaatacagggtgggccgtcaggaggagggatctgagccgggcgggcagccatgcaggtacagacagactaagccaaaggcgggcggtagggagggtgggagaccagtttgacgggagtggcctttgcatgccaggtgtggtgagggtatggaggggcctgggaggcaaggagaaggggccgtgcagaccctggaatccttcctccaggataggcggctcctccccagaaggcctctgcattcttctggtggccctgtctggacaccgaggggctggagacagtcccacgtgtgggctgcctaagtcccagagggggtggtagggagcatttcaggctcactggctggcccccttccctggggcactggaccctcctcaccaccccttggcctgtgcacgggagggtagacaggatggtgccaagagcaagggactggccctcagccacgggccaggagacctgagccttgtaggcgaattgcacttcctgaccctcagtttcctgatctgcaaaacgggatgacagaagtccctggctctggaccacgctgctggatttgggttccgtgccgggcccctgactacactcatccttcaagggtgacgcgagagaagcacgtgcccaggttcggggcgggtggagacctgggtcagacaggagttcgaggtggtgcaggctcccaggaggggagaaaggtgccctcccccaaccttctctcttctccccaggctctgtaacttccaaggccatgagagtggtcaggccctgcttggtttcccggcccccgatcacagatcgtgctggaactgctggccccaacgccctgaggtgactggccctttcttcatggattccggtcacatctggtccatctttgtcagctggcctctgggaagaatgtgggctcggccacctggagcagttgcctggggagatcagaggagccctgaggggttggcagagcgccctcgtggtatccatacccccatccctgtagctgagctgattccaagaagtgccctctgcttccttgtgaatcagatgtttactgcgctcctgctgagcctgctccaggcagctgggtggggcgtagggtgcctgtctgctcaagcctgcagagggaggccagctccccaccccagggtcagccaggctggcaggcaacagcctcaagaaggcagtgtgcgtgccatggcacacggggctgaggccgcgaggcaggggccgagggaagcggcacagagcttctctcaggcaccagaggggagctgagttctgggctcagagcaggcttcgtctgagggcttcagcgtcctccttgtgaaatggggtgaaagtaggtctaactcatgggaggccagatccccaggcccgagctagggcctccctgcccttgacactgtgtgaatgggcagctccgtttgggggagttccttcagcctcgatccaggggtgttgtaatctagtgatgctcttctgtggcatttgagggtcctgggtccccatgccctgcagccctgtccactgtcctgagctaggcataggggtgggcccttgctgctggctgcccctggacaaggtgggaagggatcaggggtcattctgggagcctggaatgctgggcggtccttggctttttctcagccttgggagtctggggcagtggtgcgcctttaccacccaccctggtttctgcctctggggcagtggtggacctccttcagaaggctgctgcccagccccgggccccactcatgcaacactgggtgcctgtgtactgggccctgggctaggcatgcactgcaagagcagacaggccacaggtcagagggcaggaccgctggcaggtgcccatgggtagcagctcacctgcctggcccaccttgccactctctcccttagaagcaatttcagctgaagacataagtgtctgtcctgcttggtgctcagggtaccctccctggccacccccaactccaccctgagctgggtgccttcctgagcccccagcctggtctatggccaccatgcatgttgacccatccatggtgacctgtccgcctgcccctcctgcttgggaactcaggaaggtcagggtcgcgtctgagagcccatgccctggtggtgcccacgtgggcctgtcccagaggaagggtgaggggagtgccggctctcccagcctcccactcctgggcagggaagtggcgcgggcaacgggcgggctgtgccaagctctttgaaggtggcttgtcactccccccacctgtgtttaactctactgagcatcagagcctaatgtgccagtcagcctggcagctgccgcccagttggtggagtttccaatcagataatatcagactgttgtgctttggtctcccacgaaactcttcaggtttccatcacagcctcctcccttccccctgcgggctgcgctgtgacagccaccgctgcctgccacccggcagcagggacccagctgcttctgggcctggtctcggtggccctggcagcggtagatagggaggaccaaagcctggtgaggaagagccgccgagcggagtcggtgtcccctgtcctctccctgaacgaaagtgctttctttctctgtagctgctcttcctaaacgtgtgttggcttgagattggagttagcctggcctacctgtgccaccagggctttgggtcccaaagagctggcacctgaggcaagtccaagcaaaaggccggatttctcaccattaggagggcaatggggaaagatccagaaaagctggcctgggagccctgagtggcaggtgggggtacacagccctgcatggagaccaggctcagagccagaggaggcaggccaggaaactcggcactcatctcctctctcggaaacgcccctccctgaccccagctgcttcctctcctcctactcgaggccagaaagggaagcccctttccagtggggtgagtggctggcgctgcccgaggcggtccgctgatggctgggcagatagtgctggggcctggcctggcaggcagatcagtggtcagcagagtgagtttgaccagggcagaggggaagatgacgggggtgcatcccccgagctgggggaagtgacttcccgttgccatcacctcttgtggcctcaggcgttcccaggctgagacctctaggaacacaggtgctgggtggctcaggtggctccaccaggccaggccgtgtgacctgggcatcctccgccttctctgggcagggcagggacaggaagtgcagcctcatgggatgcgtgagggtgagggtgtgcccatccagctgctggggcggggtgtgtgggagtggccccccaggagctgcacgcagcacggggcctgggaaactccaaagccggcgtcaggtcatcgaggcctccgggctgattaggactaatggcgctcaggggtgcagcctcagcctccacccgccacccgtacccgccctgcctcaggacttcgttcctgctgtacccctgctggctgcctgtccccacaggtggctccttcctccccaccggaggagctgctcccaggcgggaccctgggggtggaatctctgaaatgccttcccctcgggaccctcaccgcgactggacttcgctcagcttcagaccctgggctgcagctgcctaatgaggtgggatggggccctgggtgtgtaaagtggagggaggggcagtggccacctctgagccctgagccatcctggggtcctgggtgctggcttcaggaaggtttgctacttggggcaggggctctctgagatcaaccttcccattttcttgaggatgtgaccaggagggtgatgttttgtggtcggggtggctgtgcctgcctctggggcaggaagttgctggggaaggaagaagattgagaaaggacccccaacccccacctctgcagaggatctagcgggccttgccccatgccagggttcctgccggctggcatcaaggggacagctattccagggctggtgtcctgagaagcaggggggacccacttgggacccaggccccctcgaagacctacccagagccacccttgcggcaggcagggtcctggcccttccagtacgaagctgggaaaaggcagcaccaaagatgccaggggcgcctcacggatccccccgggggggcctccttgagggggagcaggaggaggggccaggctgagggctcaggctgtgtgaaagacaccctggttttgaaaagggagaggggctagagaggtggggcccgagggcctggtggggcttccagcaggggctggcttatgttttcaagcttactctggggtctggagaccactgccgaacatacgccctccaagcagtggccacaagaagaccatgaggagctcgggcggggtctggggaaagggtgggggctgccacagacagaagtgggttcgtcgaggctgcagaaggctgggtgggagtggaggaggtgacgtgaccaggatggggtcggtgacccctgcacaggggctacaggggatgaaaggggagggagcagcagactgctgagattggggtggcattggccctggtgggactgactgtccccggctcagtctccctcctccttggctggcttttctggcagacagtggcatggtccagagctgcctccctggggagggaaagggcatccccaagtcactcctgaggctgtgtccccagagtgtccaccgggctgtgccacctccctgtctgatgcagcctgcccctgcctgagctgcccgagcctgccccgtggctgcttcccagccaggaggaggccctaggggcagacaccggcgggcttgcttacaggccctgctgactccagagtcttactgccacccgagcagtacgtggaggtgcttgtcctgtgaccgccccccccccgggctgatgacgggccaggtggcacttcacctgggggctctggggaggctgtctcgggctcccgtgccaggggtgggtgcagggaggctgggcaggcaggagagctcaggcctcggctcccacgggtctggggctgtggtggttggggaccctaactagagccattcacccctctgaggaaggacctggcctggagcgccatccccagggagcagtaagggcattgggggtgtcttggggtgacctggccgggggcagaaggccaggcgggagtttgcaggtggggaacggctggaggaactcgtggaacagcctgagaggtgtccggcgaggtagggcatgggtggccttgagccctgaggctgagcggagctgtctttgagagccacctctgctgaggctgcagcagaaaggctgtgacaggctggctccgagggaggaaggagctgggctgtgggcggcctggccttgggaagggggctggacagttgcatggttgggggcggagaggaggagaccctgatccagactccacccctgcctgtcttgaccgcggaggaccggggcccagactgcaggggtgcagagaggctgcggcagaggctgggggctgggctcctttcccggcaggccgggcccaccgccagacccttgtcctcactgggcctctctgaacagtggagcgttgtgaggggcctgggaacgttcaggtcacccaggccccctctgggccacgctgagggtgaggacaggagccagcgggcatgagtcatcctgtcccctgcccgggccccgaggctctggggttcccaggctgaggaggaacacacagctctcggttccccaacccggggtctggcccactccttcttccttctttttgcctctctgtcagcacctcttcctgttgcctccctcttgctcctgggcctgcctgcatctcccttcccctgtccggccagagaccccggcctgggagtggctgtggcctgctctcccaccccgatgcctgctgcagccccagcagaggggctggcctgtcgccttgagcccacctgtgctggcctgtgagtggccccaggaggaagccagcgcaaggacaagacccagcctagacaggaaacctcctgaggccaacctaaaatttactaaggaataaaaaatgacaagaagcagaaggcaagggaatagaataataaacccagagagtaaaaacgaacaacatccgggaaaaaaacccatgttagaaaacagtttaaaaatattagccaggcgtggtggctcatgcctgtaatcccagcactttgggaggccaaggcgggtggattagttgaggtcaggagttcaagaccagcctgaccaccgtggtgaaaccccggctctactaaaaatacaaaaataagccaggcatgttggcgcatgcttgtaatcccagctactcgggaggctgagacgtgagaattgcttgaaactgggaggcagaggttggagtgagcaaagattgtgccactgcactccagcctgggtgacagagagacctgatctcaaaaaaaaaggggccgggcgcagtggctcacacttgtaatcccagcactttgggaggccgaggccggcagatcacctgaggtcaggagttcaagaccagcctggccaacatagtgaaaccctgtctctactaaaaatacaaattagctgggtgtggtggtatgacctgtaatcccagctataggaggctgaggcaggagaagtgcttgaaccaaggagacagaggttgcaatgagccaagatcgtgccactgcattctagcctgggcaccaaagtgagactctgtctcaaaaaaatatatgtgtgtgtgtgtgtgtgtgtgtgtgtgtgtgtgtgtgtatgtatatatgtgtgtgtatatatgtgtatgtgtatatatatgtgtatatgtatatatatgtttgtatatatgtgtatatatatatgtatgtgtgtgtgtgtatatatatgtgtatatatgtatatatgtgtatatgtatatatatgtttgtatatatgtgtatatatgtgtatatatgtgtatgtatgtggtgtgtgtatatatatatgtatatgtgtgtgtgtgtgtgtatatatatatgtatatatgtatgtatgtatatctatatacacacacacacgtaacgttagggaaaaaggatcacagcgaatgcattaaggcagcagaaagacctaaccctcaagtgctgaaatgagtggacagagggaagggaccctgttgtgctgactcagccttggtgggtcccagcctgtggcacccgctgacagatggtgacagggttcctgggtaagcgaggggcccaaggaccctcagtggtgcacagaggagccatgatgggggccacgcctgggccccagcgtcctttgccctgacccaggagcttgtccagataaaacgccgtaaagtgcctgggctgagcccgaggtgtgtgcaggagctgcatggttttgtgcggtccaagggaggccgccaagaccgccacggtacgaaaagtaccacggtgatgagtgaaagggacaggcggcgcagggctctcaggccacttactgctatacggtcccaaggcccaccctgtagggcttacacagctgcctacacagggtgcccatcgtggtggctcctgacctctgccgttggctctgggtgggagcagtggggctgggtttctctgactggcgcccctactgcatgccaccccagcaggagccccagggcctcggcatctccactctgttcccttgttatctcgccctggtgctgggatccgggataagcagggtgctgtccacttccagggcctagggacccagtgctgggccaagtgcctatggcagagtgcttgggagctgtctggtttggtcctcagagtcctgttgctaataagcgtggagggggaggacggagcaaggctcagggagtgaagtgacttgcccctagtctccagcttaagggaccaaggctgggactggagcccaggcgtgaatggtgcccaggagctcatcccagggaaggtctgagatgctgtctgcctcacctgggcatgtggcctggactggcagttctaactaagacccacctctgtctctcatgtcagaaggtgggtgccttctcttacctgcaaccccagggcctttgcacaagctatgctctgtctgactctatgtaatcccatgcttggctaactcatgtggaagattgctcccaggacgctggcggatgtgtcaacgtgtctgggtggaacagatgtcacaaggatgtgagtcagaggtggctgcctccctaacagattgggagcccagacagagggtgacagtagcttggatcccgggtgcagggtgtggcgtttgcctgtaggtgctgtgcctgagtgcctcccctgtgcccgataccatgagacttcaggccgagtggagtgacactgtgcaagagagacagggtccggctgaccagcctcaccatgactccagccgagcccactgaataggtgggctaccttccaccattccctggcctcggtttcctgctctcggtttcctcagctgcctggtgggttccactgcaactctctgggggtctccttctgtcccggcaccgcctgctcctgttcctcatccgagtctctgcggatgcgtggaccccgccctctgtgcagcctcagcactaagtcctgggtccagcagctccgggactgccccagttactcctggggaaactgaggactggagctctgcttctttgcccgagttttctctagggtgagcaccagaccactctttcttcaagggaaccagcagcattgagcgggacccaaaagggggctgtggcctgggagagcttcccaaccagcctccccaggggctcttgggatcagtttaaaacagaagcagctcctaactcctcaagggtgggctggagcccctgcttccccaggccttcctgtcctgctgagctgggccctgcggtagcttcctccctgtaccccacatggcgtggcccaccctgtgtcccctggcctcctacccagagccctgccccctccacagaggccagggcccacccccactgtccttaaggttggtgggcttccttctgagagtgggcctggggtttctcctctccttcttacccaccccagagccaggctcagcaggaaatgcctggtaggggccctgccagggccataaggctttcagggcaccctcaggttgtgttgtaggggtgggccaggtggccccaggctctgggtgacactagccacgctggctgggtagccaagcgttgcagctcactcagcctcgaggtcctaatcgggagaacaaaacgagcagttggcgatggagcgggcacagagctggcgcactcagaacacagtggacatttccttgggggctccctgcccctcccttggtccagcagcctagccctcctatcacaagaggtgactgtgggcagggaagcacccccaaccttcacacccactgtgcccgtggcccaggcgtcccacgcatcccaggagggtctggttggcgggagccctctgcttctgcttcctctagatgaggaaggtgcccggcagatttcctacctaagcacaccccctgggcccggagggtcagcagccaggctggtgtgggcgtggggtgtcccggccacagctgatctgctcagtgactgctgctgcccttgcctatcgatgaggatgctggggccgggaggtcaccctggaggcccaggctgcgcttggtgggtgcagagcccctggagtgcccccctcctgcagccaggggtcccccgagatggaagaagtggggtgcctggggctggccagatggtgtaattcagcacatgagcccatgagctaggccccacggagagtaggggttccagccagctggggtgtggacgaggtctgttcatgctgcaggaggcacctggtgccagtgtcacactgggcactgttcaggcaccaaggacatgggggacggacatgcagagatctctccccacagaactggtgtcaggggaggggcagatagccaacagacatgctgaaaatgccacagcgtcggggggtgccgggtgggggctgcctctctgaggagtgggggccctgccgtggactgagcctgtgtgggagaaggcccagggcctgcggattggggtccagcccaggggagtgtggtctagatgaggggccaaggggcaagggcggggcagaggaggtggagagggtggcgttccaggtggagggcactgctgctgccaaggtgcagagagggaaggggtgtggcactgggaatgtggctctgtctgtgccaagggccgcggggagacgcctgttctggaggccaggcccgcaggcaggaaggaaaagcacggccggacgctgagctgggcggttcctcccttcccttgacactagagcaagcccagcagccagctgccccacccccactgctcaagtgaggaaactgaggctcagagtgggccacaggccaggaggaggggattgagccaggcttgttcccaccaaagcctgcacgctgaccacggctctattctgcctgccaaggtcacatgcatagagcggccctctctggtgggagccactgggtggggcaggactgccgcccctctcgggaccctgcggggctggggcatagggtgcccaggctggctgcggtgagggacagtgaaacccttcaggccaggagaggcgaggcagggtggggaggaggtgggccccagccttgggtgggagccaggaacttggggtggtggacccggcccaccccacacatcaggactctggagaattttttctcaagtgattaaaaggtagaaactcgtcagtgtttgtgaagaactgaagtgtgaatcctgagccgcctctgctgcttgtggtttgagactggagagtggctccaggcgagcagcagtgccagccgtggcttcccccagacccacctcgccttgcctcacttcactgtctccagccccacctcaccgtctccagccccacctcaccctcaccaccctcggcctggaagcccgccctggcctcctccctccagccagtgtacggcccctgcctggccaggccagagctccgcctagggcaaccctcttccaggtgtggaggcccccgggcagtcccgactcccatgcccatctcaagaacctttcctggggacagagacaccaggcctgagagaggaaggcccagtggggcatccggagatgtgagaacattgcagcttccctctgaggacagagcttgagggccaagcatccaccaacagcttggccttgctctctgaagcccaggtgccatgcaggcagctgtgcctacagggcccttgtctgcatttttcttaattccctttgtccgttgcacacagcagtggcctgaccgtctctgcctccaccctgcaccgctctgtgaagcccctggggcctctgagccccgaacacactgcgtcttctgggaacactgctgtctccagtgcaccagcctttctctgttttgcagcgagcagcctcacgtgcgtgcccagggctggccggcggcttgtctcactgggcagaggtccaggggtgtggaagggcctcagctgcggccgtgctgcactccagttctttgaaaacctctctcattgagagtccaattagcgctaagtcacaattttttcactctgagctctgaaggatgtactggttacaacctcgctggggtctggcctcatgtatggacatgacagtgaactcatctgtttgtctgtctgtccttctcttgggtcctgccatgggcctggtgcccatctgggccttggagattcagtgggacttggacccgtggggagtgccagggacacatggggtaatgctggtggcagaactgtgccattgacttggagatttcagagaagagggcaaggttctagatggttccatcctcaaaggatgagggagcgtttggtttccatgtggaggtgactgcaggtaccaggatggggcaagtgcatgacaggtccagtgtcgggggcccagggcaggaagggaaagcaggcgccgcaccccatccacgtggacagggaaccaacctcgctgctgcgccgtggtgaatgtggcctgagacaaggaagggcaggccaaaggggtgaacgcgaggccaggaggtggggtcagcaagcctggcgggtgtgggtcaggcatggcaggtgaggctggtggaccctgtgtgcaggagggtgggaggtggagagcccagccttcaggaggctgtgggcacctgcggaggcaagctcagcagtgcccgcccaggttggtcacagccttgtggagcctgtctctccctgacaggcacgcccacactcgggatcagactaagtggagcctgcagttcatcctggggaaggactcaggtgagtccccgtgtggattcatttcctggggctgccctaagaaagttccacacacgaggggcctgaaaacaacagaaatttactctcatgattctggaggccagaagtccaaagctgaggggtctacagggctgtgttgccccggtggctctggggaagccccttcctcccctcccagcttctgctggtggccggcgatcctcggtgcccttggtgtgtggccacatccctccagcctcttttccatccttacatggtcctttccaggcatcttctcctactccatctcttacaggacagttgccttggatttagggcccacttggtcaatccaggatgtgctgcttaacttagttacatcgaagaccctttttccaaataaggtcgtgttcacaggttctggggattaggatgtggacaaagcttttgggggccacctttcagcccactacaacatgtggccccaggcagggtccttctttctagggttccctctccctctatcccagttgggtagtgcccagtccgagttcccgggaatcctcccagtcctgcatcatgggacagcaatcagaatggggcatagagggaaggggcttctggctggggagagcctgggagggtcccagggatggctgtggagcggacccaggccccatgggaggggctcatgcaaaacatcttattttgagagcttgagattttccctgggggtgcccgccttcccccaggctctgtgcccacccaccctcctagggctcagtgcccaccttcccccaggctctgtgcccacccaccctcctagggctcagtgcccaccttcccccaggctctgtgcccacccaccctcctagggctcagtgcccaccttcccccaggctctgtgcccacccaccctcctagggctcagtgcccaccttcccccaggctctgtgcccacccaccctcctagggctcagtgcccgccttcccccaggctctgtgcccacccaccctcctagggctcagtgcccgccttcccccaggctctgtgcccacccaccctcctagggctcagtgcccgccttcccccaggctctgtgcccacccaccctcctagggctcagtgcccgccttcccccaggctctgtgcccacccaccctcctagggctcagtgcccaccttcccccaggctctgtgcccacccaccctcctagggctcagtgcccgccttcccccaggctctgtgcccacccactctcctagggctcagtgcccaccttctcccagggttagtgccctccctccctccctgggctcattacccaccttcccccaggttcagtgccctccctccctcctctgggctcagtgtccaccttcccacaggctcaatgccctccctctctcccctggactcagtgccctccctgagctctgcagaccctccttggcatgttcagcacctgagcctctcctgaaggtggcaagcaggtaccaggctgggtacagggtccctgggtgccagtccccatgccactgatccctagcttcctctctgaaccccagagatgcagatggcaacaggactgtcctcttgggctgtgagccttgagatgaggcaggtgccgtgaggcaggaggtgccagggcagggtcagctccgtggtggctgcagacaccacccactgtgctgggtgtttgccttactcctgagcgggctgaaggctcccagaacccagtgaaagctccctccctcttctttttcaggctgacccttggccctctgcctgccctgctggctggctcccactcatcctggtaagtgccctgtgtctggcatggtgggaagtccccaagcctggcagtttgaggcaccagctcaggggcaggggagcagctgcaacttgggaaggatggagagggacaccagggctgcccattgaggcggccccggccatgccccgctgcacacaccccctgcttggatgcaggcgtggggtcatctccatggttaccggcacagggtaaatgtcaaggagtggccatggctgaggaggggagaatggcctgtgtttaggaatatgaacggcagtgtcatatgccgcagggatgaagaggaattgagagagcaattggagaagctaaggcccagagaggaggggtctgcagaggtcacccagcagcccaggactcccagctccagcttccctctgggaagatagggttggggaaggggctggtgtggatttgtcccccacccccagggtcccctcacctggcctgctcctctcctctgggctggactccccctgtagcatcacagcattggaccagggctgtggggggaatgggcctgggccagggtcaggtgggtcttctgcttgcttctgcctctgccgagtctatgagtgtggggcttttggcggagcaagggcaggggcgagcctggctcctgcttccagctcaggccttgtccgctcttgcatttgcctgcccagtaaggggtggcgtgttcctgagagcgccggctgcctctgggttcttatcttcatgggttgtcatccctgaagctgtgcgttggccacctcattgcctgtggattcctcccaaccctggggtgtgctcaccccaagccccttcctcccgtggctccctcaccccagctccttccagcaaacttcctcctctatcaaagctgggcccctcctctgggaggcgttccccagtccagaacccacagggcctggtccctcctctggaccctgcagccccaactgtcagaactgcctgcctcatcgtccaggctgggcagtggcccaggggttcctcacctgctgtttgatctcaaccctcctgcaaggaggaaagagaatgggaagaggccccactctgtccgtgccctcctcgctgccctctgtctgtctgcctgctgtggccagccttctgctgaaggtgtggtctgcccttggccacctgaggggactgaggctggcacaggctggggacgccagggtgtctgtgcccatgctaaggaggccccagacctaaaagcccaagctcctcaccctctaggagacagtggggtgtctgcagcccaaacgggccccgagggggaccttggcagcagggctggggctgcagacacagctggggagacggagctccttagcctgggagctgccttttttgagtgacccgacacctaggctatgggacagcttgggacctgcacagccggttacggggctggggtccagggtttgttgggaggctgatttcggggggccgtgccctaggaagcctggcgggcaagatgagacccctgcagctttgtggcctgtgctctgtggcctctgtcaccctcaaatcctgctgtgagggtggccccaggccccagaaagcccctttctccagctgcctctgcccaggggtcctgtcctccctgggcaagttctgggaggagagggagggcgctcagcagccagtggctagaatccccattccctgcttccgggctctgggcctgggcagggcactgggcttggtgggggcagagcagccctgggaggggccgaattctgagcgggccttggggcaggggccggtgagtacgggagcgtgctttgccactcagccataatgtactttctagcaaaccagatgttagcagagctggtgtggttgcggggacgtgaaaaggctggggatagagtaggaatcgaggaatgccagagcccaggcctagtccctcagtcccttggtgtcaaagggcacagagatggccaccttgaaattcatagaaccgggtgcaagacataacagccctctgtgtggcctcagatggcagagcagggtggcagcagctgccctggcaggaagagcatgctggtaaggtgacaccatccctgtgtgtgttgtaaatgctgctctgtgctgggcctgacacccagggtgcaggttgtttcatggtttgctagggagaagccgagtattcagaggtggccctgcggggaggcagcagggagcttcctcccagggatgcagctgaccttgcgctggagccagagagccctggcctctgaccacaggatgggagggcaggagcagtggaaggtaggagttaaaacccggatggtggatgaggggcagccctgggccccaggcagctttcaggacctcacagggtagaaggcaggaagtgccggctacttggtgctgcccagggagcagggaacaggaagtcccgggtggggaggaagcaccggcggccacaggcctcagaagcagcaggagtgagctgtgggcacagctgtggggcagccaggcgcgtcaggcctcacatgtctgggagatgtaggctgcctgggctggtggcccctgagccgcatggcctccctgggccccaggacaccggccccgagcaggtcacgaggacggagggccatgtgttgggtcagcaccatcaggtcagtggggcggccccaggactggggctcgggaggcggcactggtctagcacctgaagaaccagtaagggggccccacgtgggagccacagccttcctcggggctggccgtgggagcccacaggaggtggccctgagcctgcaaaaggcaacaggctctgaggagagtggcctctgtctgccttgagaggcccccgagctggcaggcacagggggaggccagagagggaatgtgatacttagaaccccccccacccccccatcacatgcggccgacagggaggcgggggccagcctgctggggtggggcccaggtccgggaacttctcatgatacagcctgcagggtggccttggtgtttgggtcctaagtacacacgttgtgtatgtgagtgtgtgtttctgttgtgggggggtaacggagagagctgtacaaggtccctgctgcccacctggggagtgccatgctctgaaacctgcaatgtggaggacccgcagggacctcagggactgccgggctggggctgtgctcgcagagcccaggctgggccaccctgcccctggccagcagtgcttctctggcatagctggttactgggcctttacgggagaattttggttttgattatgttaacagagaaagattctgggaacaggaaggaaacaagggaaaccgaaaaggaagagcagacagctgtggggaggcagggcagccagggctccaaggtggaagccgccccatctgcacatcccacgcccaccaccggccacccactgtgcgccaagctgggccgtggctgtgctgggccgggggtggtgcgtgagccaccatttactggctgtgtgactttggccaagtttcttcgtcagtgacttggggaggactctggtttgaagctcaaggtgttggatgatggggcgatcactgagaagcacagagcttggcccacagggagtgcccagtgcgctcggcacaaggcctgatcctctcccagcctctatacccaagtctgtaaaatagaagtaaagtattgagctcaggtggaccctggtcgatttagtgagctgtgaggtacagcttggcactgggccctggcagggctgggagtggtggtgatgattctgtgctcaggcttcaggacacggagacacagaagaccgcacttgacaggtcttgttggtcgttggaggctgtgtgtgtgtgaatgagtgcttgcatatgcatgagtgagtgtgatgaatgtgtatatcagtatacatatgggtgtgagtgtgcacgtatgagtagacatgagtgcatgagtgtgtatgagaacatgagagcgagtgggcatgcgggagaatgagtgtgtatatatgtgttagtgtggatggtgtgagtgttaactgtacatgcatgagtgtgacaggatgcgcatatatgagcgtgtgaataaagtgcacagggtgacctggtatcttctccctttgggctggatccccagccccaacttgccctgtggctcccacaaatggggccaacctgatcaccactaacagtaagtccttgaccctgtggtcacatgaggtgctggctcccttaccacagccaggatgatcctgcaggagcccagcctcccagagcccccaccctgctcctatgcaggggctcacgcctgtgtgcatgcgagctgtgcagctcatgtgcacgtcctgtgtgagtgcaccacctgtgacattaactgggtgtgcagagacacagcgcacatgagggcctgcacaggccatgaccacacacgccacagggctcatggggccccagggtggtgggagccacagagcctgcattaaatggaacccgatggggtgtctctgtgggactgagcacttttcacctgactgctctgccccccaccgcagcagcctcaggccttggggtcacctgaaccaattgcaactttgagagaaggtagggagatgagcacagaaacagagacctggagagtgtatcccaggtgccccgtcttccctaatgtgcatgtgcacacacacacacacacgcacacacgcacaagtgtacaggctcaaatgcaaatctccacgtgtgcacacatgcaaagatcacatactttctggaagggctcatggagcccagcagccaccaccagctttggccgcccaacgctggcccatgtgtctccagagccctgccccagagagcagctgcagaggtgtcaggggactctgagagtggactcctccatacccactttacactggaggaggtgggggctcaggggaaggaggggccccaggaaggatgtgaacccagatcttcagcactctccctcacagctcctgcccatgttaactcagccgacaccgcagcagcatggtgacaggtccccccagggtgtctgcctctacagaggaagggactgaagcacccagagagctggcaggtaggcctgtggagtcccctggaatgaatgaatggaatttaaccatcaggtccctggaagaggggctgggcactgagaagcacagccagggaggcctggccagctaggagtgtgggtgctccttggggatgccccctggttttcccgagcacaagtggggccagattctgtgagctgggctgaacttccccaagagcagcatggtcaccacggcctccatggcccatcatcaccctcagcctcagccgacctttcccctttctgctctcagcctggcctggcactgggctcctggccaggtatcaccccctggcacagggcagggccaggtggggcagaggatagtaaggtggcaggggtgggtttccccttgaatggcccctcctctggagaggggctgtgggtgtcagcgtctgtccctgaagcgaggaattcccaggggaggtgagggtgccacatgacctgcccttgtcatgacctgtccccctgcccagggtcagctgatgatcacctaagagccttcatcctgcccacagcgggacagcagccaggcaggaacgagcccctcacaggcctgcccctatctggccactgagctggacccatgtaggactgtaacctgtccctgtaactcttcctgctgagccttgtccaggtgtggagccaggaggaggtggtgggttccatctgtcctcacagtggctcctcccactttgacacacaggccaggtcttatagcttttgggtggcgggggcacagtggggtgtgatgccccagggtaggggctctgtttcagcttcctgtgccttccaggcaacttgcagtccctgtcacccacagggtgaacattccatccttcttttggggctacctgggtgtcccccctgggctgggtctgagctggtgaggatgggagacaatgaccaactagtgtggtcagtgttaggggcagagaaggctatgctagccccaagggagggacacaggactccagagaggttatgggagactgcctggaaaagggaacgcttgaactaactcttcctttcatttttggattgttgctagtatatagaaatagaattgatttttgtatgttgatcttatatcctgccaccttgctgctcatttattctaataattttttttttttgagatgaagtctcattcttgttccccaggctggagtgcaatggcgcaatctcggctcactgctacctccacctcccgggttcaagcgattctcctgcctcagcctcccaaatagctgggattacaggtgcctgccacctggtatttttagtagaaatgggggtttcaccatgttggccacgctggtctcgaactcctgacctcaggtgatctgcccgcctcagcctcccaaagtgctgggattacaggcgtgagccactgcgcatggctattctaataatttttaagtggattccttgggattttctgtatgtaaaataatctaatcagtgaataattgttctttctttccattctggataccttttatttctttttattgcctaattactctggtgagaatctccagtactatgctgaatagaagtagagcagacatcctttccttgttcctgttcttgggggaaaaactttcagtcttttaccactaggtatgttagctgtgggtttttcatagaaccctttatcagattgaggaacttcccttctattcctggtttgttgactcttcttatcatggaggagtgttgaattttgtcaaacacttgttcttcgtctatcaaaatcatgtggttgtcctttattctattgatatggtgtattacattaattgttttgaatattaaaccatccttgtattcctgggataaatcccacatggtcttggtgtagaatcccttttatatgttgcaggattcagttggccagtattttgttgaggatgtttatgtctatacccataagggatattggtttgtagttttattgtgatgtctttgtctggttttggtattgggataatgctgctctcatagaatgagttccctcctcttctattttctggaagtttgtgaaggatccatgttcttttgagccaactcttgatggctgggttagttcagtttcaactttaggctgtggcaacagcaggggctgaggcctgcaagtgggtgcttgctcgattcaggtaactggagccatagggtctggctggcgtaagagcacagaaggtagagggcaggagtggctgaatcaggaagggccaggttggcatgaggaggccctagaggtttagcactgagcagtgatgggaatggtgtgcgtgttgattctgtgctgggtggagggggctggaggcagaggaagcctgaggagaggaagtggagggggttgccaagaggcaatggagaggggcctggcagggcggctggaaggaggtgggatccttgaggcaggccagacaagggcactgagaacagaggcacagagatgggacagagcctcgaaggctgggtgcagtgggaagaagtccagatagcgggcctgaggtggggccttgaaaccagggtgggtgcccaggatggacagctaggtagggtcaggcccaggctgttagagccacacctgcatctggcccatcttggtggcagcttgtttgcaggtggaagatggaggaggcaggatgcctgggaggccagcaagggcctctgccggcctttggccaccccaggggactctcctgggtgaggtgcctgcgtttgggcaagcaggtgggaggtgccaaggaccagacccctggctccttggagaatccggggctggaggcccatggagtcccgcaggaaagtggagaaggtgagggcggggcacgtgcccgatcccttgccccgttgccgccctccatgcaggtgccgttttgcagaggccactttcccgagggagctggttgcaagggcccggcgggatgggacctgggcggggcctcagagccgaggctcccgcgccggccgtggatttccaaccaagctgtgtggactggcaggtgttgggggagtggagcgggaggcctcgtttgcatcgaaggcttcttgattccaggctgcaccaacagatgtgggcctcctgtcccaagcgcccaccaacctccttgcagcgtggggaaactgaggcccgcagggggctcacgtgcctcccgcgcacggtgacgcggcagggggcggggccgggaggggcgcgccgggatcctcacctgcccgcccagtcccccgccgagaggggaggagccggcggctgccaggccagggccggcgggcatggcgggctccgggccgcggccgcggagctggggccggcgggaggcgggcgcccgggacgaggcggcggcggccgggggacgcggcccggggccgtgccggtgctcgcaggggaggcgggcgtggatcgccccggggaagccggccatgcccgccgcgtggacgccgtgagtaccgagccccggcccccgagccccgggacccgggccgcgagcttccggctctggaccccgcaccccgagcccctggaccagggccgcgagccccgggcgctgctggtcgcccacgcgcttcttgggggaacaaaggcgggcgtggaccgtcccggcgggcggatgggggactcaggccggcacggggcttgtcgatctgcgggcagctccccgcgggcggactgggcacggggctccctcctccatccccactgcggggctccttcgggccgggcgcggttgggcgggcggcggggtgtggcggcgcctttgttccaaaccttggcctgtggttgggggtcctgcggctgggacccgcccctgacccctccctgcccagaggggctgtctttgggtgcagaaggagctggtggggtccagccgggtgacccaggccgaggccggcagaagacagcctgatgccttgaagacttcctcttgcacttttgttggagggtgctggtttgctaaaagcagagagtatttttctttttatttattttgtttttaattttttaattttagctccagctcagttgcccagactggagagcagtggccaatcatagcttactgcctcctggaactcctggctcaatcgatcctcctggataagcctcctccgggtactataggtgtgcaccaccaagctcagctaattattttttagagatggttgtctctatatgttgcccaggcaggccttgaacgcctgagctcaagtgatccgcctgccttggcctcccaaagtgctgggattacaggcgtgagccactgcgtccggctattttatttatttatagagacagtgtctcactttgttgcccaggctggagtgcagtggtacgatcatagaccactgcagcctcaaactcctgggctcaagtgatcctcctgcctcagcctcctagagcagctgggactacagatgcaccccaccatgcctgactaattaaaaaaaaatttttttttagagatagggtcttgctatgttgccctggcttagttttctttatgtatgttttttggggttggagctgtagtggaaccagtcccagccccactgggcatctgggtctgaccttagctgctccactaagggcttaacaggacactggccacaggcctgctcccatccaactccactggggccacaggagtgaccctacccaggatggagtgagggcaggcacagaccaaacagtgcagggtcggggggtactgttcactgggacaagagatgaggaagatgctggatttaagtgggcaatgagggtgcctagcagaagaggggactcttaacctgggtcttgatggatgagtagaagttctctgcatgggaaggggtggaggtcatttcaggcagaggaggaagcattaaacagcatggtgtatctcaaggagagcagctggagcatgagtaaggggggctggagtagggggcagggcatgatgttgggtcctgtgggcctgggttagccccaaggcagtcactggtcctccactgactgtgtggtcctcgcttgggctcagagggaaggggagtgatatcctgggctggtggggtggatagcagccaacccaccaaatggtggtcacgaccactgctgacaacagtgtgctgtgtgctgggctgggtgtccactctgtcctccagcatctgaggcttgggatctcccagaaagtcacaccaggatgggagcccaggtcgtttgagctgggtgctcttggctgctcacttgccttcttcctgtctaggccccttataggttcacctggcactgggacttgaagtagttatggcctgaggtctcacttacctgggctggcagttttctgagttcgttcatctctacccagcccccgtggggccttgcgctcagtggctgtgtgcagaatgaaccagtggagagaaagggctgcacgtagcgctcaggatcctggggttgggtttgtggctgagtggaccaggggctgactgagtggagcccgtggctctgtctctccctggggtcccacctggaagcccaaggccctcagaaaaggggtttccttgcctgtcatggccctaccctccaagctgtgtcctggatcttggcagtgtccccctgagcgccctggctcagccatctcctgcctgaccgtagctgagccacgtgcctttgtcctttattgcagcttcatggcggctgaagagatgcattggcctgtccctatgaaggccattggtgcccagaacctgctaaccatgcctgggggcgtggccaaggctggctacctgcacaagaagggcggtacccagctgcagctgctgaaatgtgagtccctggggtggtagggtgcacagtaggagggcatgggggcagggctagccatgtaagtaagcatcctctccaagcctctgcttcctcacatggtgtgccctctggattttcccattccctctctggtggctggcacccctggagaagcagaggttgacttccctagcccccaggactgtagcagggtccggggtggtgcacagtgctggccagctggcaaggggagctgcagcctgcagccaggacctggggaccacaggtggccaggtaggtctggcctctggtgctgccctcactgaatccgtgaatgttcagtgagttagttggtcacttcgcccacagtgaacctatgtgtcaagtcctggctgggtgctggacctctggagctgcacaagacccaggctctggcccccaggacagctggctgggaggaagaagcagccctcaggcttgagagatacccaaatgctgagatactgaaggccaagagcatcagggcctgagcagcaggtgctccatgcctttgcagtagcagtgccctctgccagggactccctggtcctgggccgcctggttgagatgtccaggctggactgattggttcctgtacgggcactggttgagctgttctcctctttgcacagacagcctccttggaggagctgtaactggcttgtcccccagcctgggacagggctggggcagtggagctagggtggtttcagtgtaactttccacctaggggtggccccacaccagtggctctcactggcaaactctccgggctcctgagtctccctcttttattttattttttcgagacagggtcttgctctgttgcccaagctggagtgtagtggcgtgatcatggctcactgcagcctcaacctcccaggctcaggtgatcccctcagctgggactacaggcatgccactatgccctgttaatttttttttaaatttcttgtagagatggaatttcattatgttgcccaggctggcctggagctcctgagctcaagcgatccatccgccttggtctcccaaagtgctgggattacaggtgtgagccaccgcatccagcctattttttatttatttttgttttttatttatttatttttttgagatggagtcttgctctgttgcccaggctggagtgcagtgacttgatctcagctcactgtaacgtccacctcctgggttccagcaattctcctgcctcagcctcctgagtagctgggattacaggagtgtgccaccacgcccagctaatttttgtatttttagtagagacagcgtttcaccatgttggtcagcctggtctcgaactcctgacttcaagtgatcctgtcttggcctcctaaagttctgggattacaggcatgagccaccgcgcctggcctatttattatttttatgtctcactctgtcacccagactgcagtgcagtgggtgcgaacacagctcactgcagcctcgacctcctgggctcaaatgatcctcccacctcagcctcccaagtagctggaactacagatgtatgccaccgtgtccggctaagttttgtattttttgtagagatggggtttcacatgttgctcaggctcaccccatcttttatttttagagacagtctcactcttgtcacccaggctggagtgcagtagcacgatcttggctcactgcaacctctgactcccgggttcaagcaattctcctgcttcagcctcctgagtagctgggatcgcaggcgtgagccactgcacccggccttagtccccctcttttagctctggggtagtgggagcctccaacagccctgcagcacccagcaagtcagctgtggcctccctgggcctctggtcctggctctgccttgcctcatgctggctccacacagccccccaaatctacctcttctttgtgggcagccaggcctgccctcgggtggcactctggggctagccagtgtgcctacaattttttccgtatttggccccagagtgggctcctggggagggggcagcatgccagccttgctccctgctcttccatttggtaaggcttagaggcaggaggcctggccccaagttgtcctgtggagggtcctcacagtgggtcttggcagctgcccctccaggctcaccttcctgcccttgccacctcccacagggcccctgcgctttgtcatcatccacaaacgctgcgtctactacttcaagagtagcacctctgcctccccgcagggcgccttctccctgagtggctataaccggtaagtgcccgacctgcctgctgacctcgggcccccacagccagcgggtccctcccagcagagccccagctgggcctgccccttattcccgcccaaggaaagtgctttcccgaagcagccttcgtgcccatcccctgtcctccccgcccagcctccacagtgcctcgccctctccgcgtgtcctgccctcaggcgcaggaccttgggggtgccagggtcttcctgtggctttgtgcacaagtcccagaggcctggacagcctgctctccagagtctccactcggccaccacccagtgacttctgcatctctcctccctccccaccttgccccttcacccaccatgacctctttccaggcagcccagaccccagccagcccaggccctgtcccaaacagaggctgggccctaggattccctgctccagggtcctcccaggccgggatcagtttccagcttcacgcatgtcctgggctgggctctatccagtgatgggccatgagctgccctggagggccttctgcactaacaggcaggtgggcggtggccaggtggcatgtgggtgggggagtgcactggcacagcccatggcctggggcccacacaaagggttaatgctggcacccagctctggttctggttgctatcccatcggagccctgcaccccacagcatttatctatgcctcttaccaccccttaagggcccagcccctcctgcctatgaggaaccaagggtcacatggtatcagtagtggaactgggacctttggagtgactctaggccccggcctgcaccctggccacaggcctggtagggcagccttgccagagcacccagcctggtgccaggcccccatgctggcacagagctccggggtcccctggggaaggtcgttccctttctgcagacagacacagcgccttccggcctccagcatgtgccagccatgccatgaaccctgggcccagtggcagatgcaatcatgccccagggaattgtctagcccatcagggaatgctgggcctgaggagttttggccaggctcttatgggccgtataagtgcacctgccccggtgcctggctggcagggctccccacgtgataaactcagcgcaaaccccacatcctggctgtgtgagtgggccgcagagcaggcacgagtcattccctgaaatgcactcagggctgctgctgggcctcaggggcacggagccctgtggggtaccccagggaggccaagcaggcctgggcaaatggggccagaggtgggagggtggcgtccatgtaaagtggcattggcgggcatcgaggcaggtttgtccttgtctcctgtgcactgctgctcccacgaagcccacccagcacccctcttccatgcccctccatgcccccttacgcctgcctgggcatgaagctcactactgggagcatcagcagccagggcccacccgatctgccctcttccgttggggcgtggtgctggtgccgagacgtgttcacaggggggtgctgtgggaaggccatccctatagctgtgaaccaggccgtgacccctggcgctgtgcccccagggtgatgcgggcggctgaggagaccacgtccaacaacgttttccccttcaagatcatccatatcagcaagaagcaccgcacgtggttcttctcggcctcctccgaggaggagcgcaaggtgactgggggtccgaggacgagtgcaaggtgactgggggtgtgggcctgcaggcaccaggctggacctgccttgggggctcgctggtcctggggcgctggcctctcagccccgggcaaagagaaggtgtggctgggacacaggcagctgggtgggtgctgccccagctccatccccatgcccagagcctggtgccagcgcccacacaaggaacatgctgtcctgggaggtgcccctgtgggctgaggggagccacacagccatgttgtatccagccgggtcgcctcctctgaccttgggagtcacagcagagcaggcagggcagtgaaggtggaggggtgcggtggggcccaccctggtggcaccgtgcccaccacagccccgctgacctgcagagctggatggccttgctgcgcagggagattggccacttccacgaaaagaaagacctgcccttggacaccaggtgagcccgggcccagggcataccgggcagtgagggtccctggggcgcctgggcctgacccgggtgtccgcctcccagccccgggcttggcatagaattccgtccttaaaggtttcctggaggtgccagctgggctgcgtctctctgctcctgtctacagataaacacagatacaggacaagcacagatgttcacacacagacgagcgacacgcggacacgcacacacaaacacaagcaacacgcggacatgcacacacacagagcaacacgtggacatgcgcacacacacagagcaacacgtggacatgcacacacacacagcaacacgtggacatgcacacacacacagcaacacgcagacatgcacacacaaacacagagcaacacacagacatgcacacacacacagagcatgcacaggtgtgcatgcatctctctgctcctgtctacctccagccccatctgtcacatctgtttctgtgttgccgccatgggtagttcctgttaggggatcatgtgtgtttatacgcctgccaccagggaggcctggcatggcagcagctgggcactttgggttcccagccccctacgcccaccctggctcactcagagtgagaccagaatgattctcctggcggggcgccactgggcagtctgagccttggcagcctcccccgtgagctggcccgacgtgcagcagatactctctggattgggacttcctggcccgagacgatgtggagggaacaaaccttcctgtcctttcacaggtggggacaggaggcccagggagggctgggcacagccaaggctgccctgcaggtccctgcctgactccgggctcccgtcccctggtccaagctgttcagcctcgggcccagcccagagtcgcccaagccctcttgaggcaggagcaggtggagacgtgggcacagtcagggcggccatccttgtgggccagaaggggcacctagtggaggcaccacagcctccagttcttctgtctgtccttgtaactgtgtgtgcatgtccgcgtgttgctccgtgtgtgtgcatgtccgcgtgttgctctgtgtgtgtgcatgtccgcgtgttgctctgtgtgtgtgtgtgcaatgtccacgtgttgctctgtgtttgtgtgtgcatgtctgcgtgttgctctgtgtttgtgtgtgcatgtccgcgtgttgctctgtgtgtgtgcatgtccacgtgttgctctgtgtttgtgtgtgcatgtccgcgtgttgctctgtgtgtgtgcatgtccgcgtgttgctgtttgtgtgtgcatgtctgcgtgttgctctgtgtgtgtgtgcatgtccgcgtgttgctctgtgtgtgtgtgtgtgcatgtctgcatgttgctctgtgtgtgtgtgcatgtctgtgtgttgctctgtgtttgtgtgtgcatgtctgcgtgttgctctgtgtgtgtgtgcatgtccacgtgttgctctgtgtgtgtgcatgtcctcatgttgctctgtgtgtgtgtgcatgtccgcatgttgctctgtgtgtgtgcatgtccgcgtgttgcttgtgtttgtgtgtgcgtgtccgtgtgtcgctcgtctgtgtgtgaacatgtgtgcttgtcctgtatctgtgtttatctgtatacttccatgtctgtgtgacagagtccttgtgtctgtgtgtctacatgtctgcgcgtgtccctgtgtctttgtgtatatatatccatgcctgtgtgcctgtgttcctgcgtgtgcttgtgtgtgcacgtgtgcatttgtgtgtttgtcagagtatgtgtgcatgtgtgtgtctgtcagcgtatccatgtgtgcatgtgtgtgtctgtcagcgtatccgtgtgtgcatgtgtgtgtctgtcagcttaaccatgtgtgcatgtgtttgtcagtgtatccgtgtgtgcatctgtgtatctgtccatgtatccgcgtgtgcctgtgtgtacctttgtgtgagcatcaagggacctcccaggcctggtgctcaccgtccgccccaacgcaccctgcattgcagcgactccagctcggacacagacagcttctacggcgcagttgagcggcctgtggatatcagcctttccccgtaccccacggacaatgaaggtgaggtctttctccgcatccactgcccgtttgcctctccccacctggcctcctcttggccgctgtggaggagagggaggtgtgttcggctgtgctccttgctctggccctttggcagtgcgcagtagcatccctgggctctggccttcagcggcagggtctggactcacagtcctcccagcaggtgcttgccccttgcctcctggactcagccccatgcatggagcattgctcggagactgggcctgggccggtttggctctcaccacccccctctccccatgcagactatgagcacgacgatgaggatgactcctacctggagcctgactccccggagcccggaaggcttgagggtaggtggggcgggtgggcccggggagctctgggtgtgtaggaagcaggggctgggaccgggagcagagcccctccgaggctggggatgctggcccaggtaccgctctgggtggcttccgcttccctgctgtgtcccaagtattatgaggattggagcagaagaggtgtagctgctgccacctctgctcatttcctcctcccacctcccaggaggagggacaggcacatggcgataagtggcaggtggagccggggtggccctgggggttaagcatggggaaggaaggacgctgaggagcgcgcaggctcagggcaggtccatgtccccatggctgccagcttgtgtggacactgctgcaggccaggtcgttgtcccaccccaccccatcccatcccagtgtccacctacctcctgcagcacatggcctagtcaaagagacaggctgatacaggtggtcacacgtggatgacggaagcacgagctgggtggggaggacgtgtctctgtcctcctctgtcgcctccctcccttcctccctccctattgtctctccagccccctcatcttgtcaatttcctcatgtctggggctgatccttgatccttccattttccctgcgtccgccctgcctccttgttttccagcctcctgttctcactgacttggcctctgccgaccccagcccctgaccccgtatcctctctgcctcccatccactcccaccttcaggctcccgggtccagcccctcttctcctgccgctccctccctccttccctctggggtcccagtgccaacagtccttcagcccacgagggtctgcgggccgcttgcctcagtttccttccatgcagagctcttgtctcacagtgttcaccatgcctgtcccttcgcccacacactactgccttccgtcttagcctggctggccaagccttggtgaactcagactccgtctgcccagccctgagctgcagcccagtgaggctagagatgggcctggggagccaccagtgctcctgcatgctactgctccactcaccctccctctgtacccccttcatcctctccccgagacatttctcgtccaggacgcctgtggcctccccattcccagttccagcgctcagtcctgagccacaccagcctggcgcctgccctgttccttgccagcccgtcctccaggcgccccgtgctcccggggtcctctttctcctcagctcctgtgctggccccatgagggatacccgggactcagacctcactcctctcccgaattccctgggtgacagcctgggtcatctgcaggctgcccgctccgagtcatgtccagcctggatttttgaactctgcacacattccctgaccccgcatcccctggcatctcccagctttctggatatgttctgagcaaacacgggccttcaccttcctcccagctgctcccctcccctgtccttgggaattccgtcctccctctcgctccagccgagccctgagatccttcttgacttctcttcctttctcttccttccacctctgggaacctgatgggctcctcaggtgtcctctaggcttcaggaagcgtccacaggctgccatagggaggatgaatggggaaggctgggggtggtgggtggtctgggaccctggggaaggcaggatgggagtgctgggtgctgggctgctgggtgggcaggctgtggggtgggcctaccatgggttgcactcctggttggcctggctgaccactgccagcagaggatagtgttggcccagtctctgtcagggtccaacccgggtctctttgctctgcagatgccctgatgcacccaccggcttacccaccacccccagtgcccacgcccaggaagccagccttctctgacatgccccgggcccactcctttacctccaagggccccggtcccctactgccacccccgccccctaagcacggcctcccagatgttggcctggctgctgaggactccaagagggacccactgtgcccgaggcgggctgagccttgccccagggtacctgctaccccccgaaggatgagcgatccccctctgagcaccatgcccaccgcacccggcctccggaaacccccttgcttccgggagagtgccagccccagcccggagccctggacccctggccacggggcctgctccacttccagtgctgccatcatggccactgccacctccagaaactgtgacaaactcaagtccttccacctgtccccccgaggaccacccacatctgagcccccacctgtgccagccaacaagcccaagttcctgaagatagctgaagaggaccccccaagggaggcagccatgcccggactctttgtgccccccgtggctccccggcctcctgcgctgaagctgccagtgcctgaggccatggcgcggcccgcagtcctgcccaggccagagaagccgcagctcccgcacctccagtgagtttgtgtggcggctgcaagccctgcctccagctacagggaccctggcctggcctctgacgggcactctgcccacctcgctcccctggcactcttagcccacgacggggtaccaggtgcaagggtaggaaggttcccggttgcctccagtccgccttggtggaacgtggagcatgtccatgactcagccctgaagcttgctggaaatgctttgtttttttttctttttgagacagggtctcacgctggcaaccaagctggagtgcagtggtgcgatctcagctcactgcaacctccacctccggggttcaggtgattctcctgcctcagcctcccaagtagctgggactacaggcacctgccaacacgcccggctaatttttgtatttttagtagagacaggggtttcactatgttggccaggttggtcttgaactcctggtctcaagtgatccgcctgcctcggcctctcaaagtgtagagattacgggcgtgagccaccgcgtcctgctgaaatgctttctgctttatttctgggaagtgccaggagaccagtttgtcccccactcccacagagttacgccaatggctgtggtcaaaggcatctgggaccccaggtgggcttcctgccttgcctggcaggcaaagggtccaggaactggaggggcaggtttcgcatgggtgtgctggccggcacgcgcacccccgaatgcccttgcccacggtgcccttctcccagggctctgcgaacacctctgagatgcctgctgcctgtgtggaagtgcctctgagcagcccttgtcacactcgtggttctagttcaccaagggctgcagagatgcagatgttcggaagtcacgtttttccatgactgtggggatagcggttccagggctcagcctcacccacaggctggcctcccatgctggcgtggcccgttaatcctccctagagcctttgaggctttgctgagcaggaccggctagccacacagggaggcgtgcagggacgccatgggcgtcctttggggtcacactgcattgttcatccagttcacgtccactcccctgtggctctgagtgggctgtgatttggccatgaccggacctcccctccccacgagcatccagagcacttgttgacggtgtgatgacactgagcttgggaaccctggactcccttgccagcatccatggcagccctgacccctgactccggtgtcgggcgattcctgctgtcccagggcagtcggcacgagccctacccggatctctgttgtcctgagctttttagggtcacaggggccatagcaggcagcttgccgtcctcacacagagggtggagtggggaggggagcagagggtggccgccccgtgtctgacagtgaaatggtcctgccttcctctccctgcccctccaggcgatcaccccccgatgggcagagtttcaggagcttctcctttgaaaagccccggcaaccctcacaggctgacactggcggggacgactcggacgaggactatgagaaggcaaggctgagcggcaagcctgggtcccagtggccagtaggtggacaggtggtgggaaagccataggccagggcggcccctcacagaccgtcctgagcaaggaccccccgagaacccgggagcctagggggacacagcaccatgtaaagccccggatcccggcaccgggtggccaccgtccggggagtggtggtgcgggtggatcactccgacgttggcactgacaccgtcagcctcttgcaggtgccactgcccaactcggtcttcgtcaacaccacggagtcctgcgaagtggaaaggtcagcacaaagccctgtgtgtgctgggtcctccgccatgcccggcttcctgcttctgtgtccctctcactagcttccgtgttggggagttgctggcacaagttcatggccctgcgtgcagcagaaaccagaggagtggacctccctgctctgtcccatgcccagctggcaccctggctggccagggctctgctgggctgcttctgtcagcctcacggcagcccgacgtgctcagctcctgagacctacaacagcgagaggacagaaagccaggcttgggagcggggcgggaaggtccgtgtgaaagctgcccgaggaggactcacccgctaatatgactgtcttattttaggttgttcaaggctacaagcccccggggagagccccaggatggactctactgcatccggaactcctctaccaagtcggggaaggtaggcgccaggggaagatgccccagggcccctctggctctccacacacccaggctgtgggtgggcccaggactccacagttcctaaaccactccccttgtggactcttacttggtgtctcagctgaattctcttcccagcagcaccccccaatctattccctaatagatctccatctgcaaattgggggccatgatggccacctcccagtgggggccaggactcgggtggggtagggctcatgctctggggtggcggaggccacatggggcaggggaacgccaggtctgcccgtgtccctccgagcgtgaagttgtgacctcactgagccatgctctcccgggtgtgtcggagtggttattggtggttatgagctgttgctcatcagaggctctctgagggctgccagtgtcgcccccgctgtccttgtgcaggtggtctggagtccctccccgccccccgagggccacaggacccagccttgatggttctgcccccctatccccagcccatggtctcccgaggctggtcccgctgtttctcagggagccgtcagcctcccgcttccgtcctgtaggtcctggttgtgtgggacgaaacctctaacaaagtgaggaactatcgcatttttgagaaggtgagagggctctgagtgggacggggaccctggccgcatggcctggcaaggggcagggcagaatctccctgatgaggcataggcagcgggtagactgagactggcacctccaggataccgccctccccttcccctccaccatcgctcaccccccacccctcctgctcagcctccctcctctcgtggcctacctttgtcctccactgaccctagtggggatgggcggtcagccatagaccctgggttgcttgtcttgtctttttctttttgcggggacaggggtctcactgtctttctcaggctggtttcaaattctggggctcaagcaatcctcccacctcggcctcccacagtgctgggattacaggcgtgggccaccgtgcctggcctaggttcatttcctgaccttgtctgaagtgctctgggtgcaggctcctggacatggaggacggaggggaagtgaggtgggaacatggagagcacaggcctgatgcggaggccaccttgggggcaccaccgacagccaggggccagcctggtgatgccgctgttgatgctgctgccttgttttacagacggggagactgaggcctagagccgcagagtggcctggccctgctgacgctcccccttctcttcccccacaggactctaagttctacctggagggcgaggtcctgtttgtgagtgtgggcagcatggtggagcactaccacacccacgtgctgcccagccaccagagcctgctgctgcggcacccctacggctacactgggcctaggtgatggcagtccatgtggctgccaggccaaggcagtcacaggggccctgaccccaggccacacagacggacatgggcccacatgggagggtgagcaggagcaaggctgtgcttgcctagggcctctgtgatggacatctcgtaggacccagccagtctcatccagcaggttgggttctagggctgaaccaggcgccaggctccagaggacgaagggactctgttgccccacactaacttgccctgtcccaatcccagaaacccaggaccaagctgtgcctgggctccaaggacaggaacactggtccccccatcacactcacccctaagtgggctgggagccaggcagggccagggcagctgggtgggggccggggctggccctgggacccccaggaacgctaagacacaggctccagtaggggctgttgcctccaataaagcagcagtgagctttgccttggtggctggggcttgattgggaaggaggggattaccagcttactgggtgcccatgctgatgtctaagtggtgaccgcagcagtacccgggaaccccaacagttggttgtcttgtcttccagggtgcaggtcactgagtgacttccccagggtgcacagcgagtaacagatcaggacccaaacttgggcagtctgggctgggagcccacaccccactcaccagttctgctgcctcaggtcaggccagggcagtgctgctgcagagctagaaggccctgcagctacagctgcttcattccctgcattagtgcctggttactgggtacctcctgagtggctgtccccgttccagaacttgcatacactgagcgggctacagagctagaaggccctgcagctacagctgcttcattccctgcattagcgagcagttattgggtacctcctgcatgcctggtcccattccagacaggggcctctggcctggctgagttcacagcccagtctggggacagctgggtatgaggtgcttacggcacagtgtccagggcagctgggtgtgcagggactgggggctcccggaagattttttggaggaagtaacagctacgatgggatgggaacagtggaccctaagcaggccaagggtgcgtagggacggtggtacccagatgcccaagtcttccaggcaatacctggctcaggcccagccccaatccatccccttactttctgccatggagttccagcaggtcactctccctggcacaccttccaggctggatttttaatgaaacagactcagggaggtaggggctggcagggaccctagaatccttgtgatttttcttagcaccttatgtcagggaaacctaaactgaggtcagcacttgggcccactgacagtgactgactgggggagaaggtcctgcagcccccttcccctgggtgtgttctggggacctgtggtttgctggcggaaacaagtgatgaggctggttagcggatgtgggaggctgtgaccccagggggccatagggtgcggtggaactgcaggccctgcagatgacggcagccagctgcttccaggaaccaggtgtccaaggccacctctgcaggggtttcctcttcagcctgcctggggtgagaggtcagtgcaccacagccgaggctggagcacagggagcttctgttgttctgatctatctctggaaaaccagccattcctcctccctgcagtcagaattctttgccctgtctgacctgaacttgcttagggagtcatgccactccccactgtggccatagtttctcttcctgtaaaattttattattttagttttttgtttttgagatgtagtctcaccctgtcgcccaggctggagtgcaatgccgtgatctccgctcactgccacctccgcctctctagttcaagcgattttcctgcctcagcctcccgagtagctgggattccaggcgcccgccaccacgcctggctaattttttgtatttttagtagagacgggattttatcatgttggccaggctggtctcgaactcctgacctcaggtgatctgcccaccttggcctcccaaagtgctgggattacaggcatgagccactgtgcctggccccttcctgtaaaatttttaaatggagaattgggtgcgagatgtggtttccagcctggtgcctggggtgctgagctagtgagtggtgcagtccaggacacctttgctttatgtcacttacacggtcacctggagccggctcaagtggctaaagcatcctggggcccagagccaggtgataggtccctctggccaactggacagttgaggcctgtggttacccgaagcccagctggggccctggtccagcctcgcctcccagactctgcacctgctagcacagctgtccacgtctgtgtgagctgctctaggccgagggcctcagtttcaagagtgtgttggggtgggatggggcaggccgtggtcctccagcatgaagaaggagccatgaggagttcccatgacctcccgagacttgccataagtgttctagtccacatataagggtagggttgggattaccatttactgaccacatctgtgaggtgccgagctgggtgcttgacatcatttgcttggagaagcagctgctagtagacccattttacaggtgagagaaccaagtctcacagaggcctgggttcaagtcccacctctgccactaactggcatgtgaccctatctatccttcactgctctgagcctagaccctggcccctgcctggctccctgccaggctccctgccacccctcacgacctctgatggtcgttgtgggggtctcttgcctggctcccagggctagggttagggctctggaggtgctttcactcaaccaagggggccacagcactggggagtgaaactgccccgcctcaccctgcgttgccctctgggtctgtgagggtgggctggcaggaggcctaggccttgccctaggggcagtcctgcttcctcattttatagatagggaaactgaggctttgggaggactcactgacatacctaccttcaagatgagttcaggtgggctcagttctggggcttgggaaaagggccccagtggctttgggaagcacccccagcccagggtgaaacatgcttcttctcttcctgtggttccatccgaaggattgtggtgagccccgtgccttcagttaataaagatttgtattgtgaaaagattttttcttttttttttgggacacagtctcactctgtcgcccaggctagagtggattggcgtgatctcggctcaatgcaaatctccagggttcaatcgattctcctgcctcaccctcccatgtagctgggattacagctgcctgccaaatttttgtatttttagtggaaccggggtttcaccatgttggccaggctggtcttgaactcctgacctcaactgatccgcccaccttggcctcccaagtgctgggattacaggcgcgagccacggcgcccagccttgaaaagatgtttttagaaccagaagaaacctcggttcccactgatccttctgggccacgttgtgcggagctcccctgctggttggggctcagcgcagccccagggaggtgcttcctgcacctcaggatgggcgagggtgggcattgggggagagggggacctgggacctgcggcttagttccctgaggcaggcagggcttattggggccatttcatagaaaggcagattgaagctcagcagggaagaggcttttgagggtgatccaggcgctggagggatggcctaggacaccagggtcacaccaggaacatgggagggccgtgcttgtctctagacgaggggaatgggggaagggccacaacctctgtttctgtgacccagcagcatcaagcccctcgctgggcacctcgcacacaccccctgccttatctctgcctgcacgccctgttccctccacctagactgcctgctgagggggcagtgccaggaggttgcctgtccttggggaagaggggcagtgaccctgtgaagatgcttgacagacaacccccaccacctcagaagtgtgtgtgagtggtgaacccttttaagccatcttccagccattctcactggagggagatttgatgggtacagagcagacccctacctgtctaccctccttcggacccctaggaagcttcgcaggccttccaggctgccagacagctgccctggcgttgccgtctgcttcttccctggccccactctgaggggctcagagctgaggcagaatccctttttcattcatttcctgcagaataaaacaacatacagaaaagtgaataaaacataaatgcacaacctaacacactgttaggaagtgaacgatctgcaaccaccatcaggaaatagttttgccagcacccaagtgccctcccctcacagtgtcacttccggcctctctgccctggcttatgtgagtcttgtgttcttgtttttctaaaaagtcttcagcacccaattatgcaggcattgcagtattttcctgtttctgtgctttatccccttgaatcatacagatgcaaattctggcagctggcttctttggctcgttattatgtctgtgagatttattcatgttgctgtgcgtagtatagtttgtgcatgttcattgctaaaaacttccattgtttggctgtatcgtagttcacagattcatttcactgtcagtcaagcttgtccaatgcatgcagcccaggatgcctttgaatgtggcccaacacaaatttgtaaactttcttaaaacattataaagatttttgtttgcgatttttttttttagctcatcagctatagttagtggtagtgtattttatgcgtgacccgagacagttcttccggtatggtccatggaagccaaaagattggacatgcctgctgtagatggacagttggtttgtttctagtttggggtaactacacacaatgctgctagcaacagttttgtccatgtctctgatgcacgtgtgttttttgcaaatggtgcacaaatttttctagggtttgtactcaggagtctgactcctgggttctagggtatgaagatctttctaaatattgttctagtttacgtgcccaccagcagtaaaacagaattcccttgccttcccatccttggcagacatttcacttttgccagtctggtggggtgtatagttatggccttaatttgcatttagctaattaccaaggagattgagcatatttttatgtttttattaaccattttgattttgtctcctgtgaagtgtctatcatcttttgcccattttttaacttgttgtctttttctttttcttttctttttttttttttctgagacagggtctcactctgttgccctggctggagtgcagtggtgcaatctcagctcactgcagccttgagtcaggctcaggtgattctctcacctcagcctcccaagtagctgggaccacaggcccacaccaccaagcccagctaattttttgtatttttaagtagagacgggtttcatcatgttatgcaggctgctctcaaactcttgagctcaagcgatctgctggcctcagcctcccaaagttgggattataggcgtgagctaccagattttttcttattaatctaataattctttgtatagtcttgatattatccataatgtgtattgcaaatatcttctctaactctggcttgactgtttatggtgtcctttttttttggggggggttttttgagacaaggtcttgctctgtcacccaggctggagtgttatggcacaatcttggcttattgcagcctcaattcctaggcttaaacagtcctcccacctcagcctcctgagtagccggaactacagtcacgcacttccatgtccagataattttttttttttttttagagataggatcttactatgccccagctggtctcaaactcctagactcaatgagcctcccatcttgacctcccaaagtgctgggagtacaggcatgagccactgtgcatgccagttcttatttttaatgcagttgaattgatcagtgttttcattttggttagtgctttttgtggcttaagaaattctttccaggctgggtacagtggctcacacctgtaatgccagcactttgggggcagaggcaggaggattacttgagctcaggagtttgagaccaacctggacaacatggcgaaacaccatctctacaaaaaatacaaaaattagctggacatggtggtgcgtgcctgtagtcccagctactcaggtggctggggtgagaggattgcttgagcccagaaggtcaaggctgcagtgagctgtgattgtgccactgcacttcagcctgtgagacagagtgagaccctatctcaaaaaaaaccaaaaaaaaaaaaaaaaaaaagaaaaccactgaaattatttccactccaaggtcatgaagatagtctcttagattatattctgaaatccttataaatgtaaatttcatatttaggcctttaattcacctagatttggttttttgcatatggtgtgaggtaaggattcactttcatttttttctctccatagggttacacacctgtcctatcattgtttgtaatctaactttctgcgcccatctgcaatgccacctctgtcatatgtccacatatgacatatgtagatctgttgttggattctttcctctgttccattagtctgtctgttcttgtgccaatatcaagctgtcttcattattatcaattatgtattgagatctgataaagtaagtcttttccaccttatttttcttctttgagagtgtcttgactattctggctctttgtattttcatgtaaggtttttctcccatataagttttaaaatcagcttgtcaattccaacaacaatgatgcacttgatagtttgggaatttattatagctatcaatcagttttgggaaaattgacgtctttacaatattgagttttctgattcatgaacatggtttacctctctttccatttgggtcttctttaaggtttaccaataggattttatatttttgtccattgtggtcttgcttatcttaagtttgatttgtaaatattttatgtttcttttagtctattgtaaattgtgtatttttaatttcatttttttttttgttaatagcatataaaacacaccttgtcttttaactggagcattttgtccattgtgtatttaatgtaattaaatctaccatcttattttatgcta

SEQ ID NO: 2754 - DNA, 28878 bp, Homo sapiens
  source 1..28878: mol_type = genomic DNA
acttggtgctgcccagggagcagggaacaggaagtcccgggtggggaggaagcaccggcggccacaggcctcagaagcagcaggagtgagctgtgggcacagctgtggggcagccaggcgcgtcaggcctcacatgtctgggagatgtaggctgcctgggctggtggcccctgagccgcatggcctccctgggccccaggacaccggccccgagcaggtcacgaggacggagggccatgtgttgggtcagcaccatcaggtcagtggggcggccccaggactggggctcgggaggcggcactggtctagcacctgaagaaccagtaagggggccccacgtgggagccacagccttcctcggggctggccgtgggagcccacaggaggtggccctgagcctgcaaaaggcaacaggctctgaggagagtggcctctgtctgccttgagaggcccccgagctggcaggcacagggggaggccagagagggaatgtgatacttagaaccccccccacccccccatcacatgcggccgacagggaggcgggggccagcctgctggggtggggcccaggtccgggaacttctcatgatacagcctgcagggtggccttggtgtttgggtcctaagtacacacgttgtgtatgtgagtgtgtgtttctgttgtgggggggtaacggagagagctgtacaaggtccctgctgcccacctggggagtgccatgctctgaaacctgcaatgtggaggacccgcagggacctcagggactgccgggctggggctgtgctcgcagagcccaggctgggccaccctgcccctggccagcagtgcttctctggcatagctggttactgggcctttacgggagaattttggttttgattatgttaacagagaaagattctgggaacaggaaggaaacaagggaaaccgaaaaggaagagcagacagctgtggggaggcagggcagccagggctccaaggtggaagccgccccatctgcacatcccacgcccaccaccggccacccactgtgcgccaagctgggccgtggctgtgctgggccgggggtggtgcgtgagccaccatttactggctgtgtgactttggccaagtttcttcgtcagtgacttggggaggactctggtttgaagctcaaggtgttggatgatggggcgatcactgagaagcacagagcttggcccacagggagtgcccagtgcgctcggcacaaggcctgatcctctcccagcctctatacccaagtctgtaaaatagaagtaaagtattgagctcaggtggaccctggtcgatttagtgagctgtgaggtacagcttggcactgggccctggcagggctgggagtggtggtgatgattctgtgctcaggcttcaggacacggagacacagaagaccgcacttgacaggtcttgttggtcgttggaggctgtgtgtgtgtgaatgagtgcttgcatatgcatgagtgagtgtgatgaatgtgtatatcagtatacatatgggtgtgagtgtgcacgtatgagtagacatgagtgcatgagtgtgtatgagaacatgagagcgagtgggcatgcgggagaatgagtgtgtatatatgtgttagtgtggatggtgtgagtgttaactgtacatgcatgagtgtgacaggatgcgcatatatgagcgtgtgaataaagtgcacagggtgacctggtatcttctccctttgggctggatccccagccccaacttgccctgtggctcccacaaatggggccaacctgatcaccactaacagtaagtccttgaccctgtggtcacatgaggtgctggctcccttaccacagccaggatgatcctgcaggagcccagcctcccagagcccccaccctgctcctatgcaggggctcacgcctgtgtgcatgcgagctgtgcagctcatgtgcacgtcctgtgtgagtgcaccacctgtgacattaactgggtgtgcagagacacagcgcacatgagggcctgcacaggccatgaccacacacgccacagggctcatggggccccagggtggtgggagccacagagcctgcattaaatggaacccgatggggtgtctctgtgggactgagcacttttcacctgactgctctgccccccaccgcagcagcctcaggccttggggtcacctgaaccaattgcaactttgagagaaggtagggagatgagcacagaaacagagacctggagagtgtatcccaggtgccccgtcttccctaatgtgcatgtgcacacacacacacacacgcacacacgcacaagtgtacaggctcaaatgcaaatctccacgtgtgcacacatgcaaagatcacatactttctggaagggctcatggagcccagcagccaccaccagctttggccgcccaacgctggcccatgtgtctccagagccctgccccagagagcagctgcagaggtgtcaggggactctgagagtggactcctccatacccactttacactggaggaggtgggggctcaggggaaggaggggccccaggaaggatgtgaacccagatcttcagcactctccctcacagctcctgcccatgttaactcagccgacaccgcagcagcatggtgacaggtccccccagggtgtctgcctctacagaggaagggactgaagcacccagagagctggcaggtaggcctgtggagtcccctggaatgaatgaatggaatttaaccatcaggtccctggaagaggggctgggcactgagaagcacagccagggaggcctggccagctaggagtgtgggtgctccttggggatgccccctggttttcccgagcacaagtggggccagattctgtgagctgggctgaacttccccaagagcagcatggtcaccacggcctccatggcccatcatcaccctcagcctcagccgacctttcccctttctgctctcagcctggcctggcactgggctcctggccaggtatcaccccctggcacagggcagggccaggtggggcagaggatagtaaggtggcaggggtgggtttccccttgaatggcccctcctctggagaggggctgtgggtgtcagcgtctgtccctgaagcgaggaattcccaggggaggtgagggtgccacatgacctgcccttgtcatgacctgtccccctgcccagggtcagctgatgatcacctaagagccttcatcctgcccacagcgggacagcagccaggcaggaacgagcccctcacaggcctgcccctatctggccactgagctggacccatgtaggactgtaacctgtccctgtaactcttcctgctgagccttgtccaggtgtggagccaggaggaggtggtgggttccatctgtcctcacagtggctcctcccactttgacacacaggccaggtcttatagcttttgggtggcgggggcacagtggggtgtgatgccccagggtaggggctctgtttcagcttcctgtgccttccaggcaacttgcagtccctgtcacccacagggtgaacattccatccttcttttggggctacctgggtgtcccccctgggctgggtctgagctggtgaggatgggagacaatgaccaactagtgtggtcagtgttaggggcagagaaggctatgctagccccaagggagggacacaggactccagagaggttatgggagactgcctggaaaagggaacgcttgaactaactcttcctttcatttttggattgttgctagtatatagaaatagaattgatttttgtatgttgatcttatatcctgccaccttgctgctcatttattctaataattttttttttttgagatgaagtctcattcttgttccccaggctggagtgcaatggcgcaatctcggctcactgctacctccacctcccgggttcaagcgattctcctgcctcagcctcccaaatagctgggattacaggtgcctgccacctggtatttttagtagaaatgggggtttcaccatgttggccacgctggtctcgaactcctgacctcaggtgatctgcccgcctcagcctcccaaagtgctgggattacaggcgtgagccactgcgcatggctattctaataatttttaagtggattccttgggattttctgtatgtaaaataatctaatcagtgaataattgttctttctttccattctggataccttttatttctttttattgcctaattactctggtgagaatctccagtactatgctgaatagaagtagagcagacatcctttccttgttcctgttcttgggggaaaaactttcagtcttttaccactaggtatgttagctgtgggtttttcatagaaccctttatcagattgaggaacttcccttctattcctggtttgttgactcttcttatcatggaggagtgttgaattttgtcaaacacttgttcttcgtctatcaaaatcatgtggttgtcctttattctattgatatggtgtattacattaattgttttgaatattaaaccatccttgtattcctgggataaatcccacatggtcttggtgtagaatcccttttatatgttgcaggattcagttggccagtattttgttgaggatgtttatgtctatacccataagggatattggtttgtagttttattgtgatgtctttgtctggttttggtattgggataatgctgctctcatagaatgagttccctcctcttctattttctggaagtttgtgaaggatccatgttcttttgagccaactcttgatggctgggttagttcagtttcaactttaggctgtggcaacagcaggggctgaggcctgcaagtgggtgcttgctcgattcaggtaactggagccatagggtctggctggcgtaagagcacagaaggtagagggcaggagtggctgaatcaggaagggccaggttggcatgaggaggccctagaggtttagcactgagcagtgatgggaatggtgtgcgtgttgattctgtgctgggtggagggggctggaggcagaggaagcctgaggagaggaagtggagggggttgccaagaggcaatggagaggggcctggcagggcggctggaaggaggtgggatccttgaggcaggccagacaagggcactgagaacagaggcacagagatgggacagagcctcgaaggctgggtgcagtgggaagaagtccagatagcgggcctgaggtggggccttgaaaccagggtgggtgcccaggatggacagctaggtagggtcaggcccaggctgttagagccacacctgcatctggcccatcttggtggcagcttgtttgcaggtggaagatggaggaggcaggatgcctgggaggccagcaagggcctctgccggcctttggccaccccaggggactctcctgggtgaggtgcctgcgtttgggcaagcaggtgggaggtgccaaggaccagacccctggctccttggagaatccggggctggaggcccatggagtcccgcaggaaagtggagaaggtgagggcggggcacgtgcccgatcccttgccccgttgccgccctccatgcaggtgccgttttgcagaggccactttcccgagggagctggttgcaagggcccggcgggatgggacctgggcggggcctcagagccgaggctcccgcgccggccgtggatttccaaccaagctgtgtggactggcaggtgttgggggagtggagcgggaggcctcgtttgcatcgaaggcttcttgattccaggctgcaccaacagatgtgggcctcctgtcccaagcgcccaccaacctccttgcagcgtggggaaactgaggcccgcagggggctcacgtgcctcccgcgcacggtgacgcggcagggggcggggccgggaggggcgcgccgggatcctcacctgcccgcccagtcccccgccgagaggggaggagccggcggctgccaggccagggccggcgggcatggcgggctccgggccgcggccgcggagctggggccggcgggaggcgggcgcccgggacgaggcggcggcggccgggggacgcggcccggggccgtgccggtgctcgcaggggaggcgggcgtggatcgccccggggaagccggccatgcccgccgcgtggacgccgtgagtaccgagccccggcccccgagccccgggacccgggccgcgagcttccggctctggaccccgcaccccgagcccctggaccagggccgcgagccccgggcgctgctggtcgcccacgcgcttcttgggggaacaaaggcgggcgtggaccgtcccggcgggcggatgggggactcaggccggcacggggcttgtcgatctgcgggcagctccccgcgggcggactgggcacggggctccctcctccatccccactgcggggctccttcgggccgggcgcggttgggcgggcggcggggtgtggcggcgcctttgttccaaaccttggcctgtggttgggggtcctgcggctgggacccgcccctgacccctccctgcccagaggggctgtctttgggtgcagaaggagctggtggggtccagccgggtgacccaggccgaggccggcagaagacagcctgatgccttgaagacttcctcttgcacttttgttggagggtgctggtttgctaaaagcagagagtatttttctttttatttattttgtttttaattttttaattttagctccagctcagttgcccagactggagagcagtggccaatcatagcttactgcctcctggaactcctggctcaatcgatcctcctggataagcctcctccgggtactataggtgtgcaccaccaagctcagctaattattttttagagatggttgtctctatatgttgcccaggcaggccttgaacgcctgagctcaagtgatccgcctgccttggcctcccaaagtgctgggattacaggcgtgagccactgcgtccggctattttatttatttatagagacagtgtctcactttgttgcccaggctggagtgcagtggtacgatcatagaccactgcagcctcaaactcctgggctcaagtgatcctcctgcctcagcctcctagagcagctgggactacagatgcaccccaccatgcctgactaattaaaaaaaaatttttttttagagatagggtcttgctatgttgccctggcttagttttctttatgtatgttttttggggttggagctgtagtggaaccagtcccagccccactgggcatctgggtctgaccttagctgctccactaagggcttaacaggacactggccacaggcctgctcccatccaactccactggggccacaggagtgaccctacccaggatggagtgagggcaggcacagaccaaacagtgcagggtcggggggtactgttcactgggacaagagatgaggaagatgctggatttaagtgggcaatgagggtgcctagcagaagaggggactcttaacctgggtcttgatggatgagtagaagttctctgcatgggaaggggtggaggtcatttcaggcagaggaggaagcattaaacagcatggtgtatctcaaggagagcagctggagcatgagtaaggggggctggagtagggggcagggcatgatgttgggtcctgtgggcctgggttagccccaaggcagtcactggtcctccactgactgtgtggtcctcgcttgggctcagagggaaggggagtgatatcctgggctggtggggtggatagcagccaacccaccaaatggtggtcacgaccactgctgacaacagtgtgctgtgtgctgggctgggtgtccactctgtcctccagcatctgaggcttgggatctcccagaaagtcacaccaggatgggagcccaggtcgtttgagctgggtgctcttggctgctcacttgccttcttcctgtctaggccccttataggttcacctggcactgggacttgaagtagttatggcctgaggtctcacttacctgggctggcagttttctgagttcgttcatctctacccagcccccgtggggccttgcgctcagtggctgtgtgcagaatgaaccagtggagagaaagggctgcacgtagcgctcaggatcctggggttgggtttgtggctgagtggaccaggggctgactgagtggagcccgtggctctgtctctccctggggtcccacctggaagcccaaggccctcagaaaaggggtttccttgcctgtcatggccctaccctccaagctgtgtcctggatcttggcagtgtccccctgagcgccctggctcagccatctcctgcctgaccgtagctgagccacgtgcctttgtcctttattgcagcttcatggcggctgaagagatgcattggcctgtccctatgaaggccattggtgcccagaacctgctaaccatgcctgggggcgtggccaaggctggctacctgcacaagaagggcggtacccagctgcagctgctgaaatgtgagtccctggggtggtagggtgcacagtaggagggcatgggggcagggctagccatgtaagtaagcatcctctccaagcctctgcttcctcacatggtgtgccctctggattttcccattccctctctggtggctggcacccctggagaagcagaggttgacttccctagcccccaggactgtagcagggtccggggtggtgcacagtgctggccagctggcaaggggagctgcagcctgcagccaggacctggggaccacaggtggccaggtaggtctggcctctggtgctgccctcactgaatccgtgaatgttcagtgagttagttggtcacttcgcccacagtgaacctatgtgtcaagtcctggctgggtgctggacctctggagctgcacaagacccaggctctggcccccaggacagctggctgggaggaagaagcagccctcaggcttgagagatacccaaatgctgagatactgaaggccaagagcatcagggcctgagcagcaggtgctccatgcctttgcagtagcagtgccctctgccagggactccctggtcctgggccgcctggttgagatgtccaggctggactgattggttcctgtacgggcactggttgagctgttctcctctttgcacagacagcctccttggaggagctgtaactggcttgtcccccagcctgggacagggctggggcagtggagctagggtggtttcagtgtaactttccacctaggggtggccccacaccagtggctctcactggcaaactctccgggctcctgagtctccctcttttattttattttttcgagacagggtcttgctctgttgcccaagctggagtgtagtggcgtgatcatggctcactgcagcctcaacctcccaggctcaggtgatcccctcagctgggactacaggcatgccactatgccctgttaatttttttttaaatttcttgtagagatggaatttcattatgttgcccaggctggcctggagctcctgagctcaagcgatccatccgccttggtctcccaaagtgctgggattacaggtgtgagccaccgcatccagcctattttttatttatttttgttttttatttatttatttttttgagatggagtcttgctctgttgcccaggctggagtgcagtgacttgatctcagctcactgtaacgtccacctcctgggttccagcaattctcctgcctcagcctcctgagtagctgggattacaggagtgtgccaccacgcccagctaatttttgtatttttagtagagacagcgtttcaccatgttggtcagcctggtctcgaactcctgacttcaagtgatcctgtcttggcctcctaaagttctgggattacaggcatgagccaccgcgcctggcctatttattatttttatgtctcactctgtcacccagactgcagtgcagtgggtgcgaacacagctcactgcagcctcgacctcctgggctcaaatgatcctcccacctcagcctcccaagtagctggaactacagatgtatgccaccgtgtccggctaagttttgtattttttgtagagatggggtttcacatgttgctcaggctcaccccatcttttatttttagagacagtctcactcttgtcacccaggctggagtgcagtagcacgatcttggctcactgcaacctctgactcccgggttcaagcaattctcctgcttcagcctcctgagtagctgggatcgcaggcgtgagccactgcacccggccttagtccccctcttttagctctggggtagtgggagcctccaacagccctgcagcacccagcaagtcagctgtggcctccctgggcctctggtcctggctctgccttgcctcatgctggctccacacagccccccaaatctacctcttctttgtgggcagccaggcctgccctcgggtggcactctggggctagccagtgtgcctacaattttttccgtatttggccccagagtgggctcctggggagggggcagcatgccagccttgctccctgctcttccatttggtaaggcttagaggcaggaggcctggccccaagttgtcctgtggagggtcctcacagtgggtcttggcagctgcccctccaggctcaccttcctgcccttgccacctcccacagggcccctgcgctttgtcatcatccacaaacgctgcgtctactacttcaagagtagcacctctgcctccccgcagggcgccttctccctgagtggctataaccggtaagtgcccgacctgcctgctgacctcgggcccccacagccagcgggtccctcccagcagagccccagctgggcctgccccttattcccgcccaaggaaagtgctttcccgaagcagccttcgtgcccatcccctgtcctccccgcccagcctccacagtgcctcgccctctccgcgtgtcctgccctcaggcgcaggaccttgggggtgccagggtcttcctgtggctttgtgcacaagtcccagaggcctggacagcctgctctccagagtctccactcggccaccacccagtgacttctgcatctctcctccctccccaccttgccccttcacccaccatgacctctttccaggcagcccagaccccagccagcccaggccctgtcccaaacagaggctgggccctaggattccctgctccagggtcctcccaggccgggatcagtttccagcttcacgcatgtcctgggctgggctctatccagtgatgggccatgagctgccctggagggccttctgcactaacaggcaggtgggcggtggccaggtggcatgtgggtgggggagtgcactggcacagcccatggcctggggcccacacaaagggttaatgctggcacccagctctggttctggttgctatcccatcggagccctgcaccccacagcatttatctatgcctcttaccaccccttaagggcccagcccctcctgcctatgaggaaccaagggtcacatggtatcagtagtggaactgggacctttggagtgactctaggccccggcctgcaccctggccacaggcctggtagggcagccttgccagagcacccagcctggtgccaggcccccatgctggcacagagctccggggtcccctggggaaggtcgttccctttctgcagacagacacagcgccttccggcctccagcatgtgccagccatgccatgaaccctgggcccagtggcagatgcaatcatgccccagggaattgtctagcccatcagggaatgctgggcctgaggagttttggccaggctcttatgggccgtataagtgcacctgccccggtgcctggctggcagggctccccacgtgataaactcagcgcaaaccccacatcctggctgtgtgagtgggccgcagagcaggcacgagtcattccctgaaatgcactcagggctgctgctgggcctcaggggcacggagccctgtggggtaccccagggaggccaagcaggcctgggcaaatggggccagaggtgggagggtggcgtccatgtaaagtggcattggcgggcatcgaggcaggtttgtccttgtctcctgtgcactgctgctcccacgaagcccacccagcacccctcttccatgcccctccatgcccccttacgcctgcctgggcatgaagctcactactgggagcatcagcagccagggcccacccgatctgccctcttccgttggggcgtggtgctggtgccgagacgtgttcacaggggggtgctgtgggaaggccatccctatagctgtgaaccaggccgtgacccctggcgctgtgcccccagggtgatgcgggcggctgaggagaccacgtccaacaacgttttccccttcaagatcatccatatcagcaagaagcaccgcacgtggttcttctcggcctcctccgaggaggagcgcaaggtgactgggggtccgaggacgagtgcaaggtgactgggggtgtgggcctgcaggcaccaggctggacctgccttgggggctcgctggtcctggggcgctggcctctcagccccgggcaaagagaaggtgtggctgggacacaggcagctgggtgggtgctgccccagctccatccccatgcccagagcctggtgccagcgcccacacaaggaacatgctgtcctgggaggtgcccctgtgggctgaggggagccacacagccatgttgtatccagccgggtcgcctcctctgaccttgggagtcacagcagagcaggcagggcagtgaaggtggaggggtgcggtggggcccaccctggtggcaccgtgcccaccacagccccgctgacctgcagagctggatggccttgctgcgcagggagattggccacttccacgaaaagaaagacctgcccttggacaccaggtgagcccgggcccagggcataccgggcagtgagggtccctggggcgcctgggcctgacccgggtgtccgcctcccagccccgggcttggcatagaattccgtccttaaaggtttcctggaggtgccagctgggctgcgtctctctgctcctgtctacagataaacacagatacaggacaagcacagatgttcacacacagacgagcgacacgcggacacgcacacacaaacacaagcaacacgcggacatgcacacacacagagcaacacgtggacatgcgcacacacacagagcaacacgtggacatgcacacacacacagcaacacgtggacatgcacacacacacagcaacacgcagacatgcacacacaaacacagagcaacacacagacatgcacacacacacagagcatgcacaggtgtgcatgcatctctctgctcctgtctacctccagccccatctgtcacatctgtttctgtgttgccgccatgggtagttcctgttaggggatcatgtgtgtttatacgcctgccaccagggaggcctggcatggcagcagctgggcactttgggttcccagccccctacgcccaccctggctcactcagagtgagaccagaatgattctcctggcggggcgccactgggcagtctgagccttggcagcctcccccgtgagctggcccgacgtgcagcagatactctctggattgggacttcctggcccgagacgatgtggagggaacaaaccttcctgtcctttcacaggtggggacaggaggcccagggagggctgggcacagccaaggctgccctgcaggtccctgcctgactccgggctcccgtcccctggtccaagctgttcagcctcgggcccagcccagagtcgcccaagccctcttgaggcaggagcaggtggagacgtgggcacagtcagggcggccatccttgtgggccagaaggggcacctagtggaggcaccacagcctccagttcttctgtctgtccttgtaactgtgtgtgcatgtccgcgtgttgctccgtgtgtgtgcatgtccgcgtgttgctctgtgtgtgtgcatgtccgcgtgttgctctgtgtgtgtgtgtgcaatgtccacgtgttgctctgtgtttgtgtgtgcatgtctgcgtgttgctctgtgtttgtgtgtgcatgtccgcgtgttgctctgtgtgtgtgcatgtccacgtgttgctctgtgtttgtgtgtgcatgtccgcgtgttgctctgtgtgtgtgcatgtccgcgtgttgctgtttgtgtgtgcatgtctgcgtgttgctctgtgtgtgtgtgcatgtccgcgtgttgctctgtgtgtgtgtgtgtgcatgtctgcatgttgctctgtgtgtgtgtgcatgtctgtgtgttgctctgtgtttgtgtgtgcatgtctgcgtgttgctctgtgtgtgtgtgcatgtccacgtgttgctctgtgtgtgtgcatgtcctcatgttgctctgtgtgtgtgtgcatgtccgcatgttgctctgtgtgtgtgcatgtccgcgtgttgcttgtgtttgtgtgtgcgtgtccgtgtgtcgctcgtctgtgtgtgaacatgtgtgcttgtcctgtatctgtgtttatctgtatacttccatgtctgtgtgacagagtccttgtgtctgtgtgtctacatgtctgcgcgtgtccctgtgtctttgtgtatatatatccatgcctgtgtgcctgtgttcctgcgtgtgcttgtgtgtgcacgtgtgcatttgtgtgtttgtcagagtatgtgtgcatgtgtgtgtctgtcagcgtatccatgtgtgcatgtgtgtgtctgtcagcgtatccgtgtgtgcatgtgtgtgtctgtcagcttaaccatgtgtgcatgtgtttgtcagtgtatccgtgtgtgcatctgtgtatctgtccatgtatccgcgtgtgcctgtgtgtacctttgtgtgagcatcaagggacctcccaggcctggtgctcaccgtccgccccaacgcaccctgcattgcagcgactccagctcggacacagacagcttctacggcgcagttgagcggcctgtggatatcagcctttccccgtaccccacggacaatgaaggtgaggtctttctccgcatccactgcccgtttgcctctccccacctggcctcctcttggccgctgtggaggagagggaggtgtgttcggctgtgctccttgctctggccctttggcagtgcgcagtagcatccctgggctctggccttcagcggcagggtctggactcacagtcctcccagcaggtgcttgccccttgcctcctggactcagccccatgcatggagcattgctcggagactgggcctgggccggtttggctctcaccacccccctctccccatgcagactatgagcacgacgatgaggatgactcctacctggagcctgactccccggagcccggaaggcttgagggtaggtggggcgggtgggcccggggagctctgggtgtgtaggaagcaggggctgggaccgggagcagagcccctccgaggctggggatgctggcccaggtaccgctctgggtggcttccgcttccctgctgtgtcccaagtattatgaggattggagcagaagaggtgtagctgctgccacctctgctcatttcctcctcccacctcccaggaggagggacaggcacatggcgataagtggcaggtggagccggggtggccctgggggttaagcatggggaaggaaggacgctgaggagcgcgcaggctcagggcaggtccatgtccccatggctgccagcttgtgtggacactgctgcaggccaggtcgttgtcccaccccaccccatcccatcccagtgtccacctacctcctgcagcacatggcctagtcaaagagacaggctgatacaggtggtcacacgtggatgacggaagcacgagctgggtggggaggacgtgtctctgtcctcctctgtcgcctccctcccttcctccctccctattgtctctccagccccctcatcttgtcaatttcctcatgtctggggctgatccttgatccttccattttccctgcgtccgccctgcctccttgttttccagcctcctgttctcactgacttggcctctgccgaccccagcccctgaccccgtatcctctctgcctcccatccactcccaccttcaggctcccgggtccagcccctcttctcctgccgctccctccctccttccctctggggtcccagtgccaacagtccttcagcccacgagggtctgcgggccgcttgcctcagtttccttccatgcagagctcttgtctcacagtgttcaccatgcctgtcccttcgcccacacactactgccttccgtcttagcctggctggccaagccttggtgaactcagactccgtctgcccagccctgagctgcagcccagtgaggctagagatgggcctggggagccaccagtgctcctgcatgctactgctccactcaccctccctctgtacccccttcatcctctccccgagacatttctcgtccaggacgcctgtggcctccccattcccagttccagcgctcagtcctgagccacaccagcctggcgcctgccctgttccttgccagcccgtcctccaggcgccccgtgctcccggggtcctctttctcctcagctcctgtgctggccccatgagggatacccgggactcagacctcactcctctcccgaattccctgggtgacagcctgggtcatctgcaggctgcccgctccgagtcatgtccagcctggatttttgaactctgcacacattccctgaccccgcatcccctggcatctcccagctttctggatatgttctgagcaaacacgggccttcaccttcctcccagctgctcccctcccctgtccttgggaattccgtcctccctctcgctccagccgagccctgagatccttcttgacttctcttcctttctcttccttccacctctgggaacctgatgggctcctcaggtgtcctctaggcttcaggaagcgtccacaggctgccatagggaggatgaatggggaaggctgggggtggtgggtggtctgggaccctggggaaggcaggatgggagtgctgggtgctgggctgctgggtgggcaggctgtggggtgggcctaccatgggttgcactcctggttggcctggctgaccactgccagcagaggatagtgttggcccagtctctgtcagggtccaacccgggtctctttgctctgcagatgccctgatgcacccaccggcttacccaccacccccagtgcccacgcccaggaagccagccttctctgacatgccccgggcccactcctttacctccaagggccccggtcccctactgccacccccgccccctaagcacggcctcccagatgttggcctggctgctgaggactccaagagggacccactgtgcccgaggcgggctgagccttgccccagggtacctgctaccccccgaaggatgagcgatccccctctgagcaccatgcccaccgcacccggcctccggaaacccccttgcttccgggagagtgccagccccagcccggagccctggacccctggccacggggcctgctccacttccagtgctgccatcatggccactgccacctccagaaactgtgacaaactcaagtccttccacctgtccccccgaggaccacccacatctgagcccccacctgtgccagccaacaagcccaagttcctgaagatagctgaagaggaccccccaagggaggcagccatgcccggactctttgtgccccccgtggctccccggcctcctgcgctgaagctgccagtgcctgaggccatggcgcggcccgcagtcctgcccaggccagagaagccgcagctcccgcacctccagtgagtttgtgtggcggctgcaagccctgcctccagctacagggaccctggcctggcctctgacgggcactctgcccacctcgctcccctggcactcttagcccacgacggggtaccaggtgcaagggtaggaaggttcccggttgcctccagtccgccttggtggaacgtggagcatgtccatgactcagccctgaagcttgctggaaatgctttgtttttttttctttttgagacagggtctcacgctggcaaccaagctggagtgcagtggtgcgatctcagctcactgcaacctccacctccggggttcaggtgattctcctgcctcagcctcccaagtagctgggactacaggcacctgccaacacgcccggctaatttttgtatttttagtagagacaggggtttcactatgttggccaggttggtcttgaactcctggtctcaagtgatccgcctgcctcggcctctcaaagtgtagagattacgggcgtgagccaccgcgtcctgctgaaatgctttctgctttatttctgggaagtgccaggagaccagtttgtcccccactcccacagagttacgccaatggctgtggtcaaaggcatctgggaccccaggtgggcttcctgccttgcctggcaggcaaagggtccaggaactggaggggcaggtttcgcatgggtgtgctggccggcacgcgcacccccgaatgcccttgcccacggtgcccttctcccagggctctgcgaacacctctgagatgcctgctgcctgtgtggaagtgcctctgagcagcccttgtcacactcgtggttctagttcaccaagggctgcagagatgcagatgttcggaagtcacgtttttccatgactgtggggatagcggttccagggctcagcctcacccacaggctggcctcccatgctggcgtggcccgttaatcctccctagagcctttgaggctttgctgagcaggaccggctagccacacagggaggcgtgcagggacgccatgggcgtcctttggggtcacactgcattgttcatccagttcacgtccactcccctgtggctctgagtgggctgtgatttggccatgaccggacctcccctccccacgagcatccagagcacttgttgacggtgtgatgacactgagcttgggaaccctggactcccttgccagcatccatggcagccctgacccctgactccggtgtcgggcgattcctgctgtcccagggcagtcggcacgagccctacccggatctctgttgtcctgagctttttagggtcacaggggccatagcaggcagcttgccgtcctcacacagagggtggagtggggaggggagcagagggtggccgccccgtgtctgacagtgaaatggtcctgccttcctctccctgcccctccaggcgatcaccccccgatgggcagagtttcaggagcttctcctttgaaaagccccggcaaccctcacaggctgacactggcggggacgactcggacgaggactatgagaaggcaaggctgagcggcaagcctgggtcccagtggccagtaggtggacaggtggtgggaaagccataggccagggcggcccctcacagaccgtcctgagcaaggaccccccgagaacccgggagcctagggggacacagcaccatgtaaagccccggatcccggcaccgggtggccaccgtccggggagtggtggtgcgggtggatcactccgacgttggcactgacaccgtcagcctcttgcaggtgccactgcccaactcggtcttcgtcaacaccacggagtcctgcgaagtggaaaggtcagcacaaagccctgtgtgtgctgggtcctccgccatgcccggcttcctgcttctgtgtccctctcactagcttccgtgttggggagttgctggcacaagttcatggccctgcgtgcagcagaaaccagaggagtggacctccctgctctgtcccatgcccagctggcaccctggctggccagggctctgctgggctgcttctgtcagcctcacggcagcccgacgtgctcagctcctgagacctacaacagcgagaggacagaaagccaggcttgggagcggggcgggaaggtccgtgtgaaagctgcccgaggaggactcacccgctaatatgactgtcttattttaggttgttcaaggctacaagcccccggggagagccccaggatggactctactgcatccggaactcctctaccaagtcggggaaggtaggcgccaggggaagatgccccagggcccctctggctctccacacacccaggctgtgggtgggcccaggactccacagttcctaaaccactccccttgtggactcttacttggtgtctcagctgaattctcttcccagcagcaccccccaatctattccctaatagatctccatctgcaaattgggggccatgatggccacctcccagtgggggccaggactcgggtggggtagggctcatgctctggggtggcggaggccacatggggcaggggaacgccaggtctgcccgtgtccctccgagcgtgaagttgtgacctcactgagccatgctctcccgggtgtgtcggagtggttattggtggttatgagctgttgctcatcagaggctctctgagggctgccagtgtcgcccccgctgtccttgtgcaggtggtctggagtccctccccgccccccgagggccacaggacccagccttgatggttctgcccccctatccccagcccatggtctcccgaggctggtcccgctgtttctcagggagccgtcagcctcccgcttccgtcctgtaggtcctggttgtgtgggacgaaacctctaacaaagtgaggaactatcgcatttttgagaaggtgagagggctctgagtgggacggggaccctggccgcatggcctggcaaggggcagggcagaatctccctgatgaggcataggcagcgggtagactgagactggcacctccaggataccgccctccccttcccctccaccatcgctcaccccccacccctcctgctcagcctccctcctctcgtggcctacctttgtcctccactgaccctagtggggatgggcggtcagccatagaccctgggttgcttgtcttgtctttttctttttgcggggacaggggtctcactgtctttctcaggctggtttcaaattctggggctcaagcaatcctcccacctcggcctcccacagtgctgggattacaggcgtgggccaccgtgcctggcctaggttcatttcctgaccttgtctgaagtgctctgggtgcaggctcctggacatggaggacggaggggaagtgaggtgggaacatggagagcacaggcctgatgcggaggccaccttgggggcaccaccgacagccaggggccagcctggtgatgccgctgttgatgctgctgccttgttttacagacggggagactgaggcctagagccgcagagtggcctggccctgctgacgctcccccttctcttcccccacaggactctaagttctacctggagggcgaggtcctgtttgtgagtgtgggcagcatggtggagcactaccacacccacgtgctgcccagccaccagagcctgctgctgcggcacccctacggctacactgggcctaggtgatggcagtccatgtggctgccaggccaaggcagtcacaggggccctgaccccaggccacacagacggacatgggcccacatgggagggtgagcaggagcaaggctgtgcttgcctagggcctctgtgatggacatctcgtaggacccagccagtctcatccagcaggttgggttctagggctgaaccaggcgccaggctccagaggacgaagggactctgttgccccacactaacttgccctgtcccaatcccagaaacccaggaccaagctgtgcctgggctccaaggacaggaacactggtccccccatcacactcacccctaagtgggctgggagccaggcagggccagggcagctgggtgggggccggggctggccctgggacccccaggaacgctaagacacaggctccagtaggggctgttgcctccaataaagcagcagtgagctttgccttggtggctggggcttgattgggaaggaggggattaccagcttactgggtgcccatgctgatgtctaagtggtgaccgcagcagtacccgggaaccccaacagttggttgtcttgtcttccagggtgcaggtcactgagtgacttccccagggtgcacagcgagtaacagatcaggacccaaacttgggcagtctgggctgggagcccacaccccactcaccagttctgctgcctcaggtcaggccagggcagtgctgctgcagagctagaaggccctgcagctacagctgcttcattccctgcattagtgcctggttactgggtacctcctgagtggctgtccccgttccagaacttgcatacactgagcgggctacagagctagaaggccctgcagctacagctgcttcattccctgcattagcgagcagttattgggtacctcctgcatgcctggtcccattccagacaggggcctctggcctggctgagttcacagcccagtctggggacagctgggtatgaggtgcttacggcacagtgtccagggcagctgggtgtgcagggactgggggctcccggaagattttttggaggaagtaacagctacgatgggatgggaacagtggaccctaagcaggccaagggtgcgtagggacggtggtacccagatgcccaagtcttccaggcaatacctggctcaggcccagccccaatccatccccttactttctgccatggagttccagcaggtcactctccctggcacaccttccaggctggatttttaatgaaacagactcagggaggtaggggctggcagggaccctagaatccttgtgatttttcttagcaccttatgtcagggaaacctaaactgaggtcagcacttgggcccactgacagtgactgactgggggagaaggtcctgcagcccccttcccctgggtgtgttctggggacctgtggtttgctggcggaaacaagtgatgaggctggttagcggatgtgggaggctgtgaccccagggggccatagggtgcggtggaactgcaggccctgcagatgacggcagccagctgcttccaggaaccaggtgtccaaggccacctctgcaggggtttcctcttcagcctgcctggggtgagaggtcagtgcaccacagccgaggctggagcacagggagcttctgttgttctgatctatctctggaaaaccagccattcctcctccctgcagtcagaattctttgccctgtctgacctgaacttgcttagggagtcatgccactccccactgtggccatagtttctcttcctgtaaaattttattattttagttttttgtttttgagatgtagtctcaccctgtcgcccaggctggagtgcaatgccgtgatctccgctcactgccacctccgcctctctagttcaagcgattttcctgcctcagcctcccgagtagctgggattccaggcgcccgccaccacgcctggctaattttttgtatttttagtagagacgggattttatcatgttggccaggctggtctcgaactcctgacctcaggtgatctgcccaccttggcctcccaaagtgctgggattacaggcatgagccactgtgcctggccccttcctgtaaaatttttaaatggagaattgggtgcgagatgtggtttccagcctggtgcctggggtgctgagctagtgagtggtgcagtccaggacacctttgctttatgtcacttacacggtcacctggagccggctcaagtggctaaagcatcctggggcccagagccaggtgataggtccctctggccaactggacagttgaggcctgtggttacccgaagcccagctggggccctggtccagcctcgcctcccagactctgcacctgctagcacagctgtccacgtctgtgtgagctgctctaggccgagggcctcagtttcaagagtgtgttggggtgggatggggcaggccgtggtcctccagcatgaagaaggagccatgaggagttcccatgacctcccgagacttgccataagtgttctagtccacatataagggtagggttgggattaccatttactgaccacatctgtgaggtgccgagctgggtgcttgacatcatttgcttggagaagcagctgctagtagacccattttacaggtgagagaaccaagtctcacagaggcctgggttcaagtcccacctctgccactaactggcatgtgaccctatctatccttcactgctctgagcctagaccctggcccctgcctggctccctgccaggctccctgccacccctcacgacctctgatggtcgttgtgggggtctcttgcctggctcccagggctagggttagggctctggaggtgctttcactcaaccaagggggccacagcactggggagtgaaactgccccgcctcaccctgcgttgccctctgggtctgtgagggtgggctggcaggaggcctaggccttgccctaggggcagtcctgcttcctcattttatagatagggaaactgaggctttgggaggactcactgacatacctaccttcaagatgagttcaggtgggctcagttctggggcttgggaaaagggccccagtggctttgggaagcacccccagcccagggtgaaacatgcttcttctcttcctgtggttccatccgaaggattgtggtgagccccgtgccttcagttaataaagatttgtattgtgaaaagattttttcttttttttttgggacacagtctcactctgtcgcccaggctagagtggattggcgtgatctcggctcaatgcaaatctccagggttcaatcgattctcctgcctcaccctcccatgtagctgggattacagctgcctgccaaatttttgtatttttagtggaaccggggtttcaccatgttggccaggctggtcttgaactcctgacctcaactgatccgcccaccttggcctcccaagtgctgggattacaggcgcgagccacggcgcccagccttgaaaagatgtttttagaaccagaagaaacctcggttcccactgatccttctgggccacgttgtgcggagctcccctgctggttggggctcagcgcagccccagggaggtgcttcctgcacctcaggatgggcgagggtgggcattgggggagagggggacctgggacctgcggcttagttccctgaggcaggcagggcttattggggccatttcatagaaaggcagattgaagctcagcagggaagaggcttttgagggtgatccaggcgctggagggatggcctaggacaccagggtcacaccaggaacatgggagggccgtgcttgtctctagacgaggggaatgggggaagggccacaacctctgtttctgtgacccagcagcatcaagcccctcgctgggcacctcgcacacaccccctgccttatctctgcctgcacgccctgttccctccacctagactgcctgctgagggggcagtgccaggaggttgcctgtccttggggaagaggggcagtgaccctgtgaagatgcttgacagacaacccccaccacctcagaagtgtgtgtgagtggtgaacccttttaagccatcttccagccattctcactggagggagatttgatgggtacagagcagacccctacctgtctaccctccttcggacccctaggaagcttcgcaggccttccaggctgccagacagctgccctggcgttgccgtctgcttcttccctggccccactctgaggggctcagagctgaggcagaatccctttttcattcatttcctgcagaataaaacaacatacagaaaagtgaataaaacataaatgcacaacctaacacactgttaggaagtgaacgatctgcaaccaccatcaggaaatagttttgccagcacccaagtgccctcccctcacagtgtcacttccggcctctctgccctggcttatgtgagtcttgtgttcttgtttttctaaaaagtcttcagcacccaattatgcaggcattgcagtattttcctgtttctgtgctttatccccttgaatcatacagatgcaaattctggcagctggcttctttggctcgttattatgtctgtgagatttattcatgttgctgtgcgtagtatagtttgtgcatgttcattgctaaaaacttccattgtttggctgtatcgtagttcacagattcatttcactgtcagtcaagcttgtccaatgcatgcagcccaggatgcctttgaatgtggcccaacacaaatttgtaaactttcttaaaacattataaagatttttgtttgcgatttttttttttagctcatcagctatagttagtggtagtgtattttatgcgtgacccgagacagttcttccggtatggtccatggaagccaaaagattggacatgcctgctgtagatggacagttggtttgtttctagtttggggtaactacacacaatgctgctagcaacagttttgtccatgtctctgatgcacgtgtgttttttgcaaatggtgcacaaatttttctagggtttgtactcaggagtctgactcctgggttctagggtatgaagatctttctaaatattgttctagtttacgtgcccaccagcagtaaaacagaattcccttgccttcccatccttggcagacatttcacttttgccagtctggtggggtgtatagttatggccttaatttgcatttagctaattaccaaggagattgagcatatttttatgtttttattaaccattttgattttgtctcctgtgaagtgtctatcatcttttgcccattttttaacttgttgtctttttctttttcttttctttttttttttttctgagacagggtctcactctgttgccctggctggagtgcagtggtgcaatctcagctcactgcagccttgagtcaggctcaggtgattctctcacctcagcctcccaagtagctgggaccacaggcccacaccaccaagcccagctaattttttgtatttttaagtagagacgggtttcatcatgttatgcaggctgctctcaaactcttgagctcaagcgatctgctggcctcagcctcccaaagttgggattataggcgtgagctaccagattttttcttattaatctaataattctttgtatagtcttgatattatccataatgtgtattgcaaatatcttctctaactctggcttgactgtttatggtgtcctttttttttggggggggttttttgagacaaggtcttgctctgtcacccaggctggagtgttatggcacaatcttggcttattgcagcctcaattcctaggcttaaacagtcctcccacctcagcctcctgagtagccggaactacagtcacgcacttccatgtccagataattttttttttttttttagagataggatcttactatgccccagctggtctcaaactcctagactcaatgagcctcccatcttgacctcccaaagtgctgggagtacaggcatgagccactgtgcatgccagttcttatttttaatgcagttgaattgatcagtgttttcattttggttagtgctttttgtggcttaagaaattctttccaggctgggtacagtggctcacacctgtaatgccagcactttgggggcagaggcaggaggattacttgagctcaggagtttgagaccaacctggacaacatggcgaaacaccatctctacaaaaaatacaaaaattagctggacatggtggtgcgtgcctgtagtcccagctactcaggtggctggggtgagaggattgcttgagcccagaaggtcaaggctgcagtgagctgtgattgtgccactgcacttcagcctgtgagacagagtgagaccctatctcaaaaaaaaccaaaaaaaaaaaaaaaaaaaagaaaaccactgaaattatttccactccaaggtcatgaagatagtctcttagattatattctgaaatccttataaatgtaaatttcatatttaggcctttaattcacctagatttggttttttgcatatggtgtgaggtaaggattcactttcatttttttctctccatagggttacacacctgtcctatcattgtttgtaatctaactttctgcgcccatctgcaatgccacctctgtcatatgtccacatatgacatatgtagatctgttgttggattctttcctctgttccattagtctgtctgttcttgtgccaatatcaagctgtcttcattattatcaattatgtattgagatctgataaagtaagtcttttccaccttatttttcttctttgagagtgtcttgactattctggctctttgtattttcatgtaaggtttttctcccatataagttttaaaatcagcttgtcaattccaacaacaatgatgcacttgatagtttgggaatttattatagctatcaatcagttttgggaaaattgacgtctttacaatattgagttttctgattcatgaacatggtttacctctctttccatttgggtcttctttaaggtttaccaataggattttatatttttgtccattgtggtcttgcttatcttaagtttgatttgtaaatattttatgtttcttttagtctattgtaaattgtgtatttttaatttcatttttttttttgttaatagcatataaaacacaccttgtcttttaactggagcattttgtccattgtgtatttaatgtaattaaatctaccatcttattttatgcta

SEQ ID NO: 2755 - DNA, 22912 bp, Homo sapiens
  source 1..22912: mol_type = genomic DNA
ggggaggagccggcggctgccaggccagggccggcgggcatggcgggctccgggccgcggccgcggagctggggccggcgggaggcgggcgcccgggacgaggcggcggcggccgggggacgcggcccggggccgtgccggtgctcgcaggggaggcgggcgtggatcgccccggggaagccggccatgcccgccgcgtggacgccgtgagtaccgagccccggcccccgagccccgggacccgggccgcgagcttccggctctggaccccgcaccccgagcccctggaccagggccgcgagccccgggcgctgctggtcgcccacgcgcttcttgggggaacaaaggcgggcgtggaccgtcccggcgggcggatgggggactcaggccggcacggggcttgtcgatctgcgggcagctccccgcgggcggactgggcacggggctccctcctccatccccactgcggggctccttcgggccgggcgcggttgggcgggcggcggggtgtggcggcgcctttgttccaaaccttggcctgtggttgggggtcctgcggctgggacccgcccctgacccctccctgcccagaggggctgtctttgggtgcagaaggagctggtggggtccagccgggtgacccaggccgaggccggcagaagacagcctgatgccttgaagacttcctcttgcacttttgttggagggtgctggtttgctaaaagcagagagtatttttctttttatttattttgtttttaattttttaattttagctccagctcagttgcccagactggagagcagtggccaatcatagcttactgcctcctggaactcctggctcaatcgatcctcctggataagcctcctccgggtactataggtgtgcaccaccaagctcagctaattattttttagagatggttgtctctatatgttgcccaggcaggccttgaacgcctgagctcaagtgatccgcctgccttggcctcccaaagtgctgggattacaggcgtgagccactgcgtccggctattttatttatttatagagacagtgtctcactttgttgcccaggctggagtgcagtggtacgatcatagaccactgcagcctcaaactcctgggctcaagtgatcctcctgcctcagcctcctagagcagctgggactacagatgcaccccaccatgcctgactaattaaaaaaaaatttttttttagagatagggtcttgctatgttgccctggcttagttttctttatgtatgttttttggggttggagctgtagtggaaccagtcccagccccactgggcatctgggtctgaccttagctgctccactaagggcttaacaggacactggccacaggcctgctcccatccaactccactggggccacaggagtgaccctacccaggatggagtgagggcaggcacagaccaaacagtgcagggtcggggggtactgttcactgggacaagagatgaggaagatgctggatttaagtgggcaatgagggtgcctagcagaagaggggactcttaacctgggtcttgatggatgagtagaagttctctgcatgggaaggggtggaggtcatttcaggcagaggaggaagcattaaacagcatggtgtatctcaaggagagcagctggagcatgagtaaggggggctggagtagggggcagggcatgatgttgggtcctgtgggcctgggttagccccaaggcagtcactggtcctccactgactgtgtggtcctcgcttgggctcagagggaaggggagtgatatcctgggctggtggggtggatagcagccaacccaccaaatggtggtcacgaccactgctgacaacagtgtgctgtgtgctgggctgggtgtccactctgtcctccagcatctgaggcttgggatctcccagaaagtcacaccaggatgggagcccaggtcgtttgagctgggtgctcttggctgctcacttgccttcttcctgtctaggccccttataggttcacctggcactgggacttgaagtagttatggcctgaggtctcacttacctgggctggcagttttctgagttcgttcatctctacccagcccccgtggggccttgcgctcagtggctgtgtgcagaatgaaccagtggagagaaagggctgcacgtagcgctcaggatcctggggttgggtttgtggctgagtggaccaggggctgactgagtggagcccgtggctctgtctctccctggggtcccacctggaagcccaaggccctcagaaaaggggtttccttgcctgtcatggccctaccctccaagctgtgtcctggatcttggcagtgtccccctgagcgccctggctcagccatctcctgcctgaccgtagctgagccacgtgcctttgtcctttattgcagcttcatggcggctgaagagatgcattggcctgtccctatgaaggccattggtgcccagaacctgctaaccatgcctgggggcgtggccaaggctggctacctgcacaagaagggcggtacccagctgcagctgctgaaatgtgagtccctggggtggtagggtgcacagtaggagggcatgggggcagggctagccatgtaagtaagcatcctctccaagcctctgcttcctcacatggtgtgccctctggattttcccattccctctctggtggctggcacccctggagaagcagaggttgacttccctagcccccaggactgtagcagggtccggggtggtgcacagtgctggccagctggcaaggggagctgcagcctgcagccaggacctggggaccacaggtggccaggtaggtctggcctctggtgctgccctcactgaatccgtgaatgttcagtgagttagttggtcacttcgcccacagtgaacctatgtgtcaagtcctggctgggtgctggacctctggagctgcacaagacccaggctctggcccccaggacagctggctgggaggaagaagcagccctcaggcttgagagatacccaaatgctgagatactgaaggccaagagcatcagggcctgagcagcaggtgctccatgcctttgcagtagcagtgccctctgccagggactccctggtcctgggccgcctggttgagatgtccaggctggactgattggttcctgtacgggcactggttgagctgttctcctctttgcacagacagcctccttggaggagctgtaactggcttgtcccccagcctgggacagggctggggcagtggagctagggtggtttcagtgtaactttccacctaggggtggccccacaccagtggctctcactggcaaactctccgggctcctgagtctccctcttttattttattttttcgagacagggtcttgctctgttgcccaagctggagtgtagtggcgtgatcatggctcactgcagcctcaacctcccaggctcaggtgatcccctcagctgggactacaggcatgccactatgccctgttaatttttttttaaatttcttgtagagatggaatttcattatgttgcccaggctggcctggagctcctgagctcaagcgatccatccgccttggtctcccaaagtgctgggattacaggtgtgagccaccgcatccagcctattttttatttatttttgttttttatttatttatttttttgagatggagtcttgctctgttgcccaggctggagtgcagtgacttgatctcagctcactgtaacgtccacctcctgggttccagcaattctcctgcctcagcctcctgagtagctgggattacaggagtgtgccaccacgcccagctaatttttgtatttttagtagagacagcgtttcaccatgttggtcagcctggtctcgaactcctgacttcaagtgatcctgtcttggcctcctaaagttctgggattacaggcatgagccaccgcgcctggcctatttattatttttatgtctcactctgtcacccagactgcagtgcagtgggtgcgaacacagctcactgcagcctcgacctcctgggctcaaatgatcctcccacctcagcctcccaagtagctggaactacagatgtatgccaccgtgtccggctaagttttgtattttttgtagagatggggtttcacatgttgctcaggctcaccccatcttttatttttagagacagtctcactcttgtcacccaggctggagtgcagtagcacgatcttggctcactgcaacctctgactcccgggttcaagcaattctcctgcttcagcctcctgagtagctgggatcgcaggcgtgagccactgcacccggccttagtccccctcttttagctctggggtagtgggagcctccaacagccctgcagcacccagcaagtcagctgtggcctccctgggcctctggtcctggctctgccttgcctcatgctggctccacacagccccccaaatctacctcttctttgtgggcagccaggcctgccctcgggtggcactctggggctagccagtgtgcctacaattttttccgtatttggccccagagtgggctcctggggagggggcagcatgccagccttgctccctgctcttccatttggtaaggcttagaggcaggaggcctggccccaagttgtcctgtggagggtcctcacagtgggtcttggcagctgcccctccaggctcaccttcctgcccttgccacctcccacagggcccctgcgctttgtcatcatccacaaacgctgcgtctactacttcaagagtagcacctctgcctccccgcagggcgccttctccctgagtggctataaccggtaagtgcccgacctgcctgctgacctcgggcccccacagccagcgggtccctcccagcagagccccagctgggcctgccccttattcccgcccaaggaaagtgctttcccgaagcagccttcgtgcccatcccctgtcctccccgcccagcctccacagtgcctcgccctctccgcgtgtcctgccctcaggcgcaggaccttgggggtgccagggtcttcctgtggctttgtgcacaagtcccagaggcctggacagcctgctctccagagtctccactcggccaccacccagtgacttctgcatctctcctccctccccaccttgccccttcacccaccatgacctctttccaggcagcccagaccccagccagcccaggccctgtcccaaacagaggctgggccctaggattccctgctccagggtcctcccaggccgggatcagtttccagcttcacgcatgtcctgggctgggctctatccagtgatgggccatgagctgccctggagggccttctgcactaacaggcaggtgggcggtggccaggtggcatgtgggtgggggagtgcactggcacagcccatggcctggggcccacacaaagggttaatgctggcacccagctctggttctggttgctatcccatcggagccctgcaccccacagcatttatctatgcctcttaccaccccttaagggcccagcccctcctgcctatgaggaaccaagggtcacatggtatcagtagtggaactgggacctttggagtgactctaggccccggcctgcaccctggccacaggcctggtagggcagccttgccagagcacccagcctggtgccaggcccccatgctggcacagagctccggggtcccctggggaaggtcgttccctttctgcagacagacacagcgccttccggcctccagcatgtgccagccatgccatgaaccctgggcccagtggcagatgcaatcatgccccagggaattgtctagcccatcagggaatgctgggcctgaggagttttggccaggctcttatgggccgtataagtgcacctgccccggtgcctggctggcagggctccccacgtgataaactcagcgcaaaccccacatcctggctgtgtgagtgggccgcagagcaggcacgagtcattccctgaaatgcactcagggctgctgctgggcctcaggggcacggagccctgtggggtaccccagggaggccaagcaggcctgggcaaatggggccagaggtgggagggtggcgtccatgtaaagtggcattggcgggcatcgaggcaggtttgtccttgtctcctgtgcactgctgctcccacgaagcccacccagcacccctcttccatgcccctccatgcccccttacgcctgcctgggcatgaagctcactactgggagcatcagcagccagggcccacccgatctgccctcttccgttggggcgtggtgctggtgccgagacgtgttcacaggggggtgctgtgggaaggccatccctatagctgtgaaccaggccgtgacccctggcgctgtgcccccagggtgatgcgggcggctgaggagaccacgtccaacaacgttttccccttcaagatcatccatatcagcaagaagcaccgcacgtggttcttctcggcctcctccgaggaggagcgcaaggtgactgggggtccgaggacgagtgcaaggtgactgggggtgtgggcctgcaggcaccaggctggacctgccttgggggctcgctggtcctggggcgctggcctctcagccccgggcaaagagaaggtgtggctgggacacaggcagctgggtgggtgctgccccagctccatccccatgcccagagcctggtgccagcgcccacacaaggaacatgctgtcctgggaggtgcccctgtgggctgaggggagccacacagccatgttgtatccagccgggtcgcctcctctgaccttgggagtcacagcagagcaggcagggcagtgaaggtggaggggtgcggtggggcccaccctggtggcaccgtgcccaccacagccccgctgacctgcagagctggatggccttgctgcgcagggagattggccacttccacgaaaagaaagacctgcccttggacaccaggtgagcccgggcccagggcataccgggcagtgagggtccctggggcgcctgggcctgacccgggtgtccgcctcccagccccgggcttggcatagaattccgtccttaaaggtttcctggaggtgccagctgggctgcgtctctctgctcctgtctacagataaacacagatacaggacaagcacagatgttcacacacagacgagcgacacgcggacacgcacacacaaacacaagcaacacgcggacatgcacacacacagagcaacacgtggacatgcgcacacacacagagcaacacgtggacatgcacacacacacagcaacacgtggacatgcacacacacacagcaacacgcagacatgcacacacaaacacagagcaacacacagacatgcacacacacacagagcatgcacaggtgtgcatgcatctctctgctcctgtctacctccagccccatctgtcacatctgtttctgtgttgccgccatgggtagttcctgttaggggatcatgtgtgtttatacgcctgccaccagggaggcctggcatggcagcagctgggcactttgggttcccagccccctacgcccaccctggctcactcagagtgagaccagaatgattctcctggcggggcgccactgggcagtctgagccttggcagcctcccccgtgagctggcccgacgtgcagcagatactctctggattgggacttcctggcccgagacgatgtggagggaacaaaccttcctgtcctttcacaggtggggacaggaggcccagggagggctgggcacagccaaggctgccctgcaggtccctgcctgactccgggctcccgtcccctggtccaagctgttcagcctcgggcccagcccagagtcgcccaagccctcttgaggcaggagcaggtggagacgtgggcacagtcagggcggccatccttgtgggccagaaggggcacctagtggaggcaccacagcctccagttcttctgtctgtccttgtaactgtgtgtgcatgtccgcgtgttgctccgtgtgtgtgcatgtccgcgtgttgctctgtgtgtgtgcatgtccgcgtgttgctctgtgtgtgtgtgtgcaatgtccacgtgttgctctgtgtttgtgtgtgcatgtctgcgtgttgctctgtgtttgtgtgtgcatgtccgcgtgttgctctgtgtgtgtgcatgtccacgtgttgctctgtgtttgtgtgtgcatgtccgcgtgttgctctgtgtgtgtgcatgtccgcgtgttgctgtttgtgtgtgcatgtctgcgtgttgctctgtgtgtgtgtgcatgtccgcgtgttgctctgtgtgtgtgtgtgtgcatgtctgcatgttgctctgtgtgtgtgtgcatgtctgtgtgttgctctgtgtttgtgtgtgcatgtctgcgtgttgctctgtgtgtgtgtgcatgtccacgtgttgctctgtgtgtgtgcatgtcctcatgttgctctgtgtgtgtgtgcatgtccgcatgttgctctgtgtgtgtgcatgtccgcgtgttgcttgtgtttgtgtgtgcgtgtccgtgtgtcgctcgtctgtgtgtgaacatgtgtgcttgtcctgtatctgtgtttatctgtatacttccatgtctgtgtgacagagtccttgtgtctgtgtgtctacatgtctgcgcgtgtccctgtgtctttgtgtatatatatccatgcctgtgtgcctgtgttcctgcgtgtgcttgtgtgtgcacgtgtgcatttgtgtgtttgtcagagtatgtgtgcatgtgtgtgtctgtcagcgtatccatgtgtgcatgtgtgtgtctgtcagcgtatccgtgtgtgcatgtgtgtgtctgtcagcttaaccatgtgtgcatgtgtttgtcagtgtatccgtgtgtgcatctgtgtatctgtccatgtatccgcgtgtgcctgtgtgtacctttgtgtgagcatcaagggacctcccaggcctggtgctcaccgtccgccccaacgcaccctgcattgcagcgactccagctcggacacagacagcttctacggcgcagttgagcggcctgtggatatcagcctttccccgtaccccacggacaatgaaggtgaggtctttctccgcatccactgcccgtttgcctctccccacctggcctcctcttggccgctgtggaggagagggaggtgtgttcggctgtgctccttgctctggccctttggcagtgcgcagtagcatccctgggctctggccttcagcggcagggtctggactcacagtcctcccagcaggtgcttgccccttgcctcctggactcagccccatgcatggagcattgctcggagactgggcctgggccggtttggctctcaccacccccctctccccatgcagactatgagcacgacgatgaggatgactcctacctggagcctgactccccggagcccggaaggcttgagggtaggtggggcgggtgggcccggggagctctgggtgtgtaggaagcaggggctgggaccgggagcagagcccctccgaggctggggatgctggcccaggtaccgctctgggtggcttccgcttccctgctgtgtcccaagtattatgaggattggagcagaagaggtgtagctgctgccacctctgctcatttcctcctcccacctcccaggaggagggacaggcacatggcgataagtggcaggtggagccggggtggccctgggggttaagcatggggaaggaaggacgctgaggagcgcgcaggctcagggcaggtccatgtccccatggctgccagcttgtgtggacactgctgcaggccaggtcgttgtcccaccccaccccatcccatcccagtgtccacctacctcctgcagcacatggcctagtcaaagagacaggctgatacaggtggtcacacgtggatgacggaagcacgagctgggtggggaggacgtgtctctgtcctcctctgtcgcctccctcccttcctccctccctattgtctctccagccccctcatcttgtcaatttcctcatgtctggggctgatccttgatccttccattttccctgcgtccgccctgcctccttgttttccagcctcctgttctcactgacttggcctctgccgaccccagcccctgaccccgtatcctctctgcctcccatccactcccaccttcaggctcccgggtccagcccctcttctcctgccgctccctccctccttccctctggggtcccagtgccaacagtccttcagcccacgagggtctgcgggccgcttgcctcagtttccttccatgcagagctcttgtctcacagtgttcaccatgcctgtcccttcgcccacacactactgccttccgtcttagcctggctggccaagccttggtgaactcagactccgtctgcccagccctgagctgcagcccagtgaggctagagatgggcctggggagccaccagtgctcctgcatgctactgctccactcaccctccctctgtacccccttcatcctctccccgagacatttctcgtccaggacgcctgtggcctccccattcccagttccagcgctcagtcctgagccacaccagcctggcgcctgccctgttccttgccagcccgtcctccaggcgccccgtgctcccggggtcctctttctcctcagctcctgtgctggccccatgagggatacccgggactcagacctcactcctctcccgaattccctgggtgacagcctgggtcatctgcaggctgcccgctccgagtcatgtccagcctggatttttgaactctgcacacattccctgaccccgcatcccctggcatctcccagctttctggatatgttctgagcaaacacgggccttcaccttcctcccagctgctcccctcccctgtccttgggaattccgtcctccctctcgctccagccgagccctgagatccttcttgacttctcttcctttctcttccttccacctctgggaacctgatgggctcctcaggtgtcctctaggcttcaggaagcgtccacaggctgccatagggaggatgaatggggaaggctgggggtggtgggtggtctgggaccctggggaaggcaggatgggagtgctgggtgctgggctgctgggtgggcaggctgtggggtgggcctaccatgggttgcactcctggttggcctggctgaccactgccagcagaggatagtgttggcccagtctctgtcagggtccaacccgggtctctttgctctgcagatgccctgatgcacccaccggcttacccaccacccccagtgcccacgcccaggaagccagccttctctgacatgccccgggcccactcctttacctccaagggccccggtcccctactgccacccccgccccctaagcacggcctcccagatgttggcctggctgctgaggactccaagagggacccactgtgcccgaggcgggctgagccttgccccagggtacctgctaccccccgaaggatgagcgatccccctctgagcaccatgcccaccgcacccggcctccggaaacccccttgcttccgggagagtgccagccccagcccggagccctggacccctggccacggggcctgctccacttccagtgctgccatcatggccactgccacctccagaaactgtgacaaactcaagtccttccacctgtccccccgaggaccacccacatctgagcccccacctgtgccagccaacaagcccaagttcctgaagatagctgaagaggaccccccaagggaggcagccatgcccggactctttgtgccccccgtggctccccggcctcctgcgctgaagctgccagtgcctgaggccatggcgcggcccgcagtcctgcccaggccagagaagccgcagctcccgcacctccagtgagtttgtgtggcggctgcaagccctgcctccagctacagggaccctggcctggcctctgacgggcactctgcccacctcgctcccctggcactcttagcccacgacggggtaccaggtgcaagggtaggaaggttcccggttgcctccagtccgccttggtggaacgtggagcatgtccatgactcagccctgaagcttgctggaaatgctttgtttttttttctttttgagacagggtctcacgctggcaaccaagctggagtgcagtggtgcgatctcagctcactgcaacctccacctccggggttcaggtgattctcctgcctcagcctcccaagtagctgggactacaggcacctgccaacacgcccggctaatttttgtatttttagtagagacaggggtttcactatgttggccaggttggtcttgaactcctggtctcaagtgatccgcctgcctcggcctctcaaagtgtagagattacgggcgtgagccaccgcgtcctgctgaaatgctttctgctttatttctgggaagtgccaggagaccagtttgtcccccactcccacagagttacgccaatggctgtggtcaaaggcatctgggaccccaggtgggcttcctgccttgcctggcaggcaaagggtccaggaactggaggggcaggtttcgcatgggtgtgctggccggcacgcgcacccccgaatgcccttgcccacggtgcccttctcccagggctctgcgaacacctctgagatgcctgctgcctgtgtggaagtgcctctgagcagcccttgtcacactcgtggttctagttcaccaagggctgcagagatgcagatgttcggaagtcacgtttttccatgactgtggggatagcggttccagggctcagcctcacccacaggctggcctcccatgctggcgtggcccgttaatcctccctagagcctttgaggctttgctgagcaggaccggctagccacacagggaggcgtgcagggacgccatgggcgtcctttggggtcacactgcattgttcatccagttcacgtccactcccctgtggctctgagtgggctgtgatttggccatgaccggacctcccctccccacgagcatccagagcacttgttgacggtgtgatgacactgagcttgggaaccctggactcccttgccagcatccatggcagccctgacccctgactccggtgtcgggcgattcctgctgtcccagggcagtcggcacgagccctacccggatctctgttgtcctgagctttttagggtcacaggggccatagcaggcagcttgccgtcctcacacagagggtggagtggggaggggagcagagggtggccgccccgtgtctgacagtgaaatggtcctgccttcctctccctgcccctccaggcgatcaccccccgatgggcagagtttcaggagcttctcctttgaaaagccccggcaaccctcacaggctgacactggcggggacgactcggacgaggactatgagaaggcaaggctgagcggcaagcctgggtcccagtggccagtaggtggacaggtggtgggaaagccataggccagggcggcccctcacagaccgtcctgagcaaggaccccccgagaacccgggagcctagggggacacagcaccatgtaaagccccggatcccggcaccgggtggccaccgtccggggagtggtggtgcgggtggatcactccgacgttggcactgacaccgtcagcctcttgcaggtgccactgcccaactcggtcttcgtcaacaccacggagtcctgcgaagtggaaaggtcagcacaaagccctgtgtgtgctgggtcctccgccatgcccggcttcctgcttctgtgtccctctcactagcttccgtgttggggagttgctggcacaagttcatggccctgcgtgcagcagaaaccagaggagtggacctccctgctctgtcccatgcccagctggcaccctggctggccagggctctgctgggctgcttctgtcagcctcacggcagcccgacgtgctcagctcctgagacctacaacagcgagaggacagaaagccaggcttgggagcggggcgggaaggtccgtgtgaaagctgcccgaggaggactcacccgctaatatgactgtcttattttaggttgttcaaggctacaagcccccggggagagccccaggatggactctactgcatccggaactcctctaccaagtcggggaaggtaggcgccaggggaagatgccccagggcccctctggctctccacacacccaggctgtgggtgggcccaggactccacagttcctaaaccactccccttgtggactcttacttggtgtctcagctgaattctcttcccagcagcaccccccaatctattccctaatagatctccatctgcaaattgggggccatgatggccacctcccagtgggggccaggactcgggtggggtagggctcatgctctggggtggcggaggccacatggggcaggggaacgccaggtctgcccgtgtccctccgagcgtgaagttgtgacctcactgagccatgctctcccgggtgtgtcggagtggttattggtggttatgagctgttgctcatcagaggctctctgagggctgccagtgtcgcccccgctgtccttgtgcaggtggtctggagtccctccccgccccccgagggccacaggacccagccttgatggttctgcccccctatccccagcccatggtctcccgaggctggtcccgctgtttctcagggagccgtcagcctcccgcttccgtcctgtaggtcctggttgtgtgggacgaaacctctaacaaagtgaggaactatcgcatttttgagaaggtgagagggctctgagtgggacggggaccctggccgcatggcctggcaaggggcagggcagaatctccctgatgaggcataggcagcgggtagactgagactggcacctccaggataccgccctccccttcccctccaccatcgctcaccccccacccctcctgctcagcctccctcctctcgtggcctacctttgtcctccactgaccctagtggggatgggcggtcagccatagaccctgggttgcttgtcttgtctttttctttttgcggggacaggggtctcactgtctttctcaggctggtttcaaattctggggctcaagcaatcctcccacctcggcctcccacagtgctgggattacaggcgtgggccaccgtgcctggcctaggttcatttcctgaccttgtctgaagtgctctgggtgcaggctcctggacatggaggacggaggggaagtgaggtgggaacatggagagcacaggcctgatgcggaggccaccttgggggcaccaccgacagccaggggccagcctggtgatgccgctgttgatgctgctgccttgttttacagacggggagactgaggcctagagccgcagagtggcctggccctgctgacgctcccccttctcttcccccacaggactctaagttctacctggagggcgaggtcctgtttgtgagtgtgggcagcatggtggagcactaccacacccacgtgctgcccagccaccagagcctgctgctgcggcacccctacggctacactgggcctaggtgatggcagtccatgtggctgccaggccaaggcagtcacaggggccctgaccccaggccacacagacggacatgggcccacatgggagggtgagcaggagcaaggctgtgcttgcctagggcctctgtgatggacatctcgtaggacccagccagtctcatccagcaggttgggttctagggctgaaccaggcgccaggctccagaggacgaagggactctgttgccccacactaacttgccctgtcccaatcccagaaacccaggaccaagctgtgcctgggctccaaggacaggaacactggtccccccatcacactcacccctaagtgggctgggagccaggcagggccagggcagctgggtgggggccggggctggccctgggacccccaggaacgctaagacacaggctccagtaggggctgttgcctccaataaagcagcagtgagctttgccttggtggctggggcttgattgggaaggaggggattaccagcttactgggtgcccatgctgatgtctaagtggtgaccgcagcagtacccgggaaccccaacagttggttgtcttgtcttccagggtgcaggtcactgagtgacttccccagggtgcacagcgagtaacagatcaggacccaaacttgggcagtctgggctgggagcccacaccccactcaccagttctgctgcctcaggtcaggccagggcagtgctgctgcagagctagaaggccctgcagctacagctgcttcattccctgcattagtgcctggttactgggtacctcctgagtggctgtccccgttccagaacttgcatacactgagcgggctacagagctagaaggccctgcagctacagctgcttcattccctgcattagcgagcagttattgggtacctcctgcatgcctggtcccattccagacaggggcctctggcctggctgagttcacagcccagtctggggacagctgggtatgaggtgcttacggcacagtgtccagggcagctgggtgtgcagggactgggggctcccggaagattttttggaggaagtaacagctacgatgggatgggaacagtggaccctaagcaggccaagggtgcgtagggacggtggtacccagatgcccaagtcttccaggcaatacctggctcaggcccagccccaatccatccccttactttctgccatggagttccagcaggtcactctccctggcacaccttccaggctggatttttaatgaaacagactcagggaggtaggggctggcagggaccctagaatccttgtgatttttcttagcaccttatgtcagggaaacctaaactgaggtcagcacttgggcccactgacagtgactgactgggggagaaggtcctgcagcccccttcccctgggtgtgttctggggacctgtggtttgctggcggaaacaagtgatgaggctggttagcggatgtgggaggctgtgaccccagggggccatagggtgcggtggaactgcaggccctgcagatgacggcagccagctgcttccaggaaccaggtgtccaaggccacctctgcaggggtttcctcttcagcctgcctggggtgagaggtcagtgcaccacagccgaggctggagcacagggagcttctgttgttctgatctatctctggaaaaccagccattcctcctccctgcagtcagaattctttgccctgtctgacctgaacttgcttagggagtcatgccactccccactgtggccatagtttctcttcctgtaaaattttattattttagttttttgtttttgagatgtagtctcaccctgtcgcccaggctggagtgcaatgccgtgatctccgctcactgccacctccgcctctctagttcaagcgattttcctgcctcagcctcccgagtagctgggattccaggcgcccgccaccacgcctggctaattttttgtatttttagtagagacgggattttatcatgttggccaggctggtctcgaactcctgacctcaggtgatctgcccaccttggcctcccaaagtgctgggattacaggcatgagccactgtgcctggccccttcctgtaaaatttttaaatggagaattgggtgcgagatgtggtttccagcctggtgcctggggtgctgagctagtgagtggtgcagtccaggacacctttgctttatgtcacttacacggtcacctggagccggctcaagtggctaaagcatcctggggcccagagccaggtgataggtccctctggccaactggacagttgaggcctgtggttacccgaagcccagctggggccctggtccagcctcgcctcccagactctgcacctgctagcacagctgtccacgtctgtgtgagctgctctaggccgagggcctcagtttcaagagtgtgttggggtgggatggggcaggccgtggtcctccagcatgaagaaggagccatgaggagttcccatgacctcccgagacttgccataagtgttctagtccacatataagggtagggttgggattaccatttactgaccacatctgtgaggtgccgagctgggtgcttgacatcatttgcttggagaagcagctgctagtagacccattttacaggtgagagaaccaagtctcacagaggcctgggttcaagtcccacctctgccactaactggcatgtgaccctatctatccttcactgctctgagcctagaccctggcccctgcctggctccctgccaggctccctgccacccctcacgacctctgatggtcgttgtgggggtctcttgcctggctcccagggctagggttagggctctggaggtgctttcactcaaccaagggggccacagcactggggagtgaaactgccccgcctcaccctgcgttgccctctgggtctgtgagggtgggctggcaggaggcctaggccttgccctaggggcagtcctgcttcctcattttatagatagggaaactgaggctttgggaggactcactgacatacctaccttcaagatgagttcaggtgggctcagttctggggcttgggaaaagggccccagtggctttgggaagcacccccagcccagggtgaaacatgcttcttctcttcctgtggttccatccgaaggattgtggtgagccccgtgccttcagttaataaagatttgtattgtgaaaagattttttcttttttttttgggacacagtctcactctgtcgcccaggctagagtggattggcgtgatctcggctcaatgcaaatctccagggttcaatcgattctcctgcctcaccctcccatgtagctgggattacagctgcctgccaaatttttgtatttttagtggaaccggggtttcaccatgttggccaggctggtcttgaactcctgacctcaactgatccgcccaccttggcctcccaagtgctgggattacaggcgcgagccacggcgcccagccttgaaaagatgtttttagaaccagaagaaacctcggttcccactgatccttctgggccacgttgtgcggagctcccctgctggttggggctcagcgcagccccagggaggtgcttcctgcacctcaggatgggcgagggtgggcattgggggagagggggacctgggacctgcggcttagttccctgaggcaggcagggcttattggggccatttcatagaaaggcagattgaagctcagcagggaagaggcttttgagggtgatccaggcgctggagggatggcctaggacaccagggtcacaccaggaacatgggagggccgtgcttgtctctagacgaggggaatgggggaagggccacaacctctgtttctgtgacccagcagcatcaagcccctcgctgggcacctcgcacacaccccctgccttatctctgcctgcacgccctgttccctccacctagactgcctgctgagggggcagtgccaggaggttgcctgtccttggggaagaggggcagtgaccctgtgaagatgcttgacagacaacccccaccacctcagaagtgtgtgtgagtggtgaacccttttaagccatcttccagccattctcactggagggagatttgatgggtacagagcagacccctacctgtctaccctccttcggacccctaggaagcttcgcaggccttccaggctgccagacagctgccctggcgttgccgtctgcttcttccctggccccactctgaggggctcagagctgaggcagaatccctttttcattcatttcctgcagaataaaacaacatacagaaaagtgaataaaacataaatgcacaacctaacacactgttaggaagtgaacgatctgcaaccaccatcaggaaatagttttgccagcacccaagtgccctcccctcacagtgtcacttccggcctctctgccctggcttatgtgagtcttgtgttcttgtttttctaaaaagtcttcagcacccaattatgcaggcattgcagtattttcctgtttctgtgctttatccccttgaatcatacagatgcaaattctggcagctggcttctttggctcgttattatgtctgtgagatttattcatgttgctgtgcgtagtatagtttgtgcatgttcattgctaaaaacttccattgtttggctgtatcgtagttcacagattcatttcactgtcagtcaagcttgtccaatgcatgcagcccaggatgcctttgaatgtggcccaacacaaatttgtaaactttcttaaaacattataaagatttttgtttgcgatttttttttttagctcatcagctatagttagtggtagtgtattttatgcgtgacccgagacagttcttccggtatggtccatggaagccaaaagattggacatgcctgctgtagatggacagttggtttgtttctagtttggggtaactacacacaatgctgctagcaacagttttgtccatgtctctgatgcacgtgtgttttttgcaaatggtgcacaaatttttctagggtttgtactcaggagtctgactcctgggttctagggtatgaagatctttctaaatattgttctagtttacgtgcccaccagcagtaaaacagaattcccttgccttcccatccttggcagacatttcacttttgccagtctggtggggtgtatagttatggccttaatttgcatttagctaattaccaaggagattgagcatatttttatgtttttattaaccattttgattttgtctcctgtgaagtgtctatcatcttttgcccattttttaacttgttgtctttttctttttcttttctttttttttttttctgagacagggtctcactctgttgccctggctggagtgcagtggtgcaatctcagctcactgcagccttgagtcaggctcaggtgattctctcacctcagcctcccaagtagctgggaccacaggcccacaccaccaagcccagctaattttttgtatttttaagtagagacgggtttcatcatgttatgcaggctgctctcaaactcttgagctcaagcgatctgctggcctcagcctcccaaagttgggattataggcgtgagctaccagattttttcttattaatctaataattctttgtatagtcttgatattatccataatgtgtattgcaaatatcttctctaactctggcttgactgtttatggtgtcctttttttttggggggggttttttgagacaaggtcttgctctgtcacccaggctggagtgttatggcacaatcttggcttattgcagcctcaattcctaggcttaaacagtcctcccacctcagcctcctgagtagccggaactacagtcacgcacttccatgtccagataattttttttttttttttagagataggatcttactatgccccagctggtctcaaactcctagactcaatgagcctcccatcttgacctcccaaagtgctgggagtacaggcatgagccactgtgcatgccagttcttatttttaatgcagttgaattgatcagtgttttcattttggttagtgctttttgtggcttaagaaattctttccaggctgggtacagtggctcacacctgtaatgccagcactttgggggcagaggcaggaggattacttgagctcaggagtttgagaccaacctggacaacatggcgaaacaccatctctacaaaaaatacaaaaattagctggacatggtggtgcgtgcctgtagtcccagctactcaggtggctggggtgagaggattgcttgagcccagaaggtcaaggctgcagtgagctgtgattgtgccactgcacttcagcctgtgagacagagtgagaccctatctcaaaaaaaaccaaaaaaaaaaaaaaaaaaaagaaaaccactgaaattatttccactccaaggtcatgaagatagtctcttagattatattctgaaatccttataaatgtaaatttcatatttaggcctttaattcacctagatttggttttttgcatatggtgtgaggtaaggattcactttcatttttttctctccatagggttacacacctgtcctatcattgtttgtaatctaactttctgcgcccatctgcaatgccacctctgtcatatgtccacatatgacatatgtagatctgttgttggattctttcctctgttccattagtctgtctgttcttgtgccaatatcaagctgtcttcattattatcaattatgtattgagatctgataaagtaagtcttttccaccttatttttcttctttgagagtgtcttgactattctggctctttgtattttcatgtaaggtttttctcccatataagttttaaaatcagcttgtcaattccaacaacaatgatgcacttgatagtttgggaatttattatagctatcaatcagttttgggaaaattgacgtctttacaatattgagttttctgattcatgaacatggtttacctctctttccatttgggtcttctttaaggtttaccaataggattttatatttttgtccattgtggtcttgcttatcttaagtttgatttgtaaatattttatgtttcttttagtctattgtaaattgtgtatttttaatttcatttttttttttgttaatagcatataaaacacaccttgtcttttaactggagcattttgtccattgtgtatttaatgtaattaaatctaccatcttattttatgcta

SEQ ID NO: 2756 - DNA, 22283 bp, Homo sapiens
  source 1..22283: mol_type = genomic DNA
cagccgggtgacccaggccgaggccggcagaagacagcctgatgccttgaagacttcctcttgcacttttgttggagggtgctggtttgctaaaagcagagagtatttttctttttatttattttgtttttaattttttaattttagctccagctcagttgcccagactggagagcagtggccaatcatagcttactgcctcctggaactcctggctcaatcgatcctcctggataagcctcctccgggtactataggtgtgcaccaccaagctcagctaattattttttagagatggttgtctctatatgttgcccaggcaggccttgaacgcctgagctcaagtgatccgcctgccttggcctcccaaagtgctgggattacaggcgtgagccactgcgtccggctattttatttatttatagagacagtgtctcactttgttgcccaggctggagtgcagtggtacgatcatagaccactgcagcctcaaactcctgggctcaagtgatcctcctgcctcagcctcctagagcagctgggactacagatgcaccccaccatgcctgactaattaaaaaaaaatttttttttagagatagggtcttgctatgttgccctggcttagttttctttatgtatgttttttggggttggagctgtagtggaaccagtcccagccccactgggcatctgggtctgaccttagctgctccactaagggcttaacaggacactggccacaggcctgctcccatccaactccactggggccacaggagtgaccctacccaggatggagtgagggcaggcacagaccaaacagtgcagggtcggggggtactgttcactgggacaagagatgaggaagatgctggatttaagtgggcaatgagggtgcctagcagaagaggggactcttaacctgggtcttgatggatgagtagaagttctctgcatgggaaggggtggaggtcatttcaggcagaggaggaagcattaaacagcatggtgtatctcaaggagagcagctggagcatgagtaaggggggctggagtagggggcagggcatgatgttgggtcctgtgggcctgggttagccccaaggcagtcactggtcctccactgactgtgtggtcctcgcttgggctcagagggaaggggagtgatatcctgggctggtggggtggatagcagccaacccaccaaatggtggtcacgaccactgctgacaacagtgtgctgtgtgctgggctgggtgtccactctgtcctccagcatctgaggcttgggatctcccagaaagtcacaccaggatgggagcccaggtcgtttgagctgggtgctcttggctgctcacttgccttcttcctgtctaggccccttataggttcacctggcactgggacttgaagtagttatggcctgaggtctcacttacctgggctggcagttttctgagttcgttcatctctacccagcccccgtggggccttgcgctcagtggctgtgtgcagaatgaaccagtggagagaaagggctgcacgtagcgctcaggatcctggggttgggtttgtggctgagtggaccaggggctgactgagtggagcccgtggctctgtctctccctggggtcccacctggaagcccaaggccctcagaaaaggggtttccttgcctgtcatggccctaccctccaagctgtgtcctggatcttggcagtgtccccctgagcgccctggctcagccatctcctgcctgaccgtagctgagccacgtgcctttgtcctttattgcagcttcatggcggctgaagagatgcattggcctgtccctatgaaggccattggtgcccagaacctgctaaccatgcctgggggcgtggccaaggctggctacctgcacaagaagggcggtacccagctgcagctgctgaaatgtgagtccctggggtggtagggtgcacagtaggagggcatgggggcagggctagccatgtaagtaagcatcctctccaagcctctgcttcctcacatggtgtgccctctggattttcccattccctctctggtggctggcacccctggagaagcagaggttgacttccctagcccccaggactgtagcagggtccggggtggtgcacagtgctggccagctggcaaggggagctgcagcctgcagccaggacctggggaccacaggtggccaggtaggtctggcctctggtgctgccctcactgaatccgtgaatgttcagtgagttagttggtcacttcgcccacagtgaacctatgtgtcaagtcctggctgggtgctggacctctggagctgcacaagacccaggctctggcccccaggacagctggctgggaggaagaagcagccctcaggcttgagagatacccaaatgctgagatactgaaggccaagagcatcagggcctgagcagcaggtgctccatgcctttgcagtagcagtgccctctgccagggactccctggtcctgggccgcctggttgagatgtccaggctggactgattggttcctgtacgggcactggttgagctgttctcctctttgcacagacagcctccttggaggagctgtaactggcttgtcccccagcctgggacagggctggggcagtggagctagggtggtttcagtgtaactttccacctaggggtggccccacaccagtggctctcactggcaaactctccgggctcctgagtctccctcttttattttattttttcgagacagggtcttgctctgttgcccaagctggagtgtagtggcgtgatcatggctcactgcagcctcaacctcccaggctcaggtgatcccctcagctgggactacaggcatgccactatgccctgttaatttttttttaaatttcttgtagagatggaatttcattatgttgcccaggctggcctggagctcctgagctcaagcgatccatccgccttggtctcccaaagtgctgggattacaggtgtgagccaccgcatccagcctattttttatttatttttgttttttatttatttatttttttgagatggagtcttgctctgttgcccaggctggagtgcagtgacttgatctcagctcactgtaacgtccacctcctgggttccagcaattctcctgcctcagcctcctgagtagctgggattacaggagtgtgccaccacgcccagctaatttttgtatttttagtagagacagcgtttcaccatgttggtcagcctggtctcgaactcctgacttcaagtgatcctgtcttggcctcctaaagttctgggattacaggcatgagccaccgcgcctggcctatttattatttttatgtctcactctgtcacccagactgcagtgcagtgggtgcgaacacagctcactgcagcctcgacctcctgggctcaaatgatcctcccacctcagcctcccaagtagctggaactacagatgtatgccaccgtgtccggctaagttttgtattttttgtagagatggggtttcacatgttgctcaggctcaccccatcttttatttttagagacagtctcactcttgtcacccaggctggagtgcagtagcacgatcttggctcactgcaacctctgactcccgggttcaagcaattctcctgcttcagcctcctgagtagctgggatcgcaggcgtgagccactgcacccggccttagtccccctcttttagctctggggtagtgggagcctccaacagccctgcagcacccagcaagtcagctgtggcctccctgggcctctggtcctggctctgccttgcctcatgctggctccacacagccccccaaatctacctcttctttgtgggcagccaggcctgccctcgggtggcactctggggctagccagtgtgcctacaattttttccgtatttggccccagagtgggctcctggggagggggcagcatgccagccttgctccctgctcttccatttggtaaggcttagaggcaggaggcctggccccaagttgtcctgtggagggtcctcacagtgggtcttggcagctgcccctccaggctcaccttcctgcccttgccacctcccacagggcccctgcgctttgtcatcatccacaaacgctgcgtctactacttcaagagtagcacctctgcctccccgcagggcgccttctccctgagtggctataaccggtaagtgcccgacctgcctgctgacctcgggcccccacagccagcgggtccctcccagcagagccccagctgggcctgccccttattcccgcccaaggaaagtgctttcccgaagcagccttcgtgcccatcccctgtcctccccgcccagcctccacagtgcctcgccctctccgcgtgtcctgccctcaggcgcaggaccttgggggtgccagggtcttcctgtggctttgtgcacaagtcccagaggcctggacagcctgctctccagagtctccactcggccaccacccagtgacttctgcatctctcctccctccccaccttgccccttcacccaccatgacctctttccaggcagcccagaccccagccagcccaggccctgtcccaaacagaggctgggccctaggattccctgctccagggtcctcccaggccgggatcagtttccagcttcacgcatgtcctgggctgggctctatccagtgatgggccatgagctgccctggagggccttctgcactaacaggcaggtgggcggtggccaggtggcatgtgggtgggggagtgcactggcacagcccatggcctggggcccacacaaagggttaatgctggcacccagctctggttctggttgctatcccatcggagccctgcaccccacagcatttatctatgcctcttaccaccccttaagggcccagcccctcctgcctatgaggaaccaagggtcacatggtatcagtagtggaactgggacctttggagtgactctaggccccggcctgcaccctggccacaggcctggtagggcagccttgccagagcacccagcctggtgccaggcccccatgctggcacagagctccggggtcccctggggaaggtcgttccctttctgcagacagacacagcgccttccggcctccagcatgtgccagccatgccatgaaccctgggcccagtggcagatgcaatcatgccccagggaattgtctagcccatcagggaatgctgggcctgaggagttttggccaggctcttatgggccgtataagtgcacctgccccggtgcctggctggcagggctccccacgtgataaactcagcgcaaaccccacatcctggctgtgtgagtgggccgcagagcaggcacgagtcattccctgaaatgcactcagggctgctgctgggcctcaggggcacggagccctgtggggtaccccagggaggccaagcaggcctgggcaaatggggccagaggtgggagggtggcgtccatgtaaagtggcattggcgggcatcgaggcaggtttgtccttgtctcctgtgcactgctgctcccacgaagcccacccagcacccctcttccatgcccctccatgcccccttacgcctgcctgggcatgaagctcactactgggagcatcagcagccagggcccacccgatctgccctcttccgttggggcgtggtgctggtgccgagacgtgttcacaggggggtgctgtgggaaggccatccctatagctgtgaaccaggccgtgacccctggcgctgtgcccccagggtgatgcgggcggctgaggagaccacgtccaacaacgttttccccttcaagatcatccatatcagcaagaagcaccgcacgtggttcttctcggcctcctccgaggaggagcgcaaggtgactgggggtccgaggacgagtgcaaggtgactgggggtgtgggcctgcaggcaccaggctggacctgccttgggggctcgctggtcctggggcgctggcctctcagccccgggcaaagagaaggtgtggctgggacacaggcagctgggtgggtgctgccccagctccatccccatgcccagagcctggtgccagcgcccacacaaggaacatgctgtcctgggaggtgcccctgtgggctgaggggagccacacagccatgttgtatccagccgggtcgcctcctctgaccttgggagtcacagcagagcaggcagggcagtgaaggtggaggggtgcggtggggcccaccctggtggcaccgtgcccaccacagccccgctgacctgcagagctggatggccttgctgcgcagggagattggccacttccacgaaaagaaagacctgcccttggacaccaggtgagcccgggcccagggcataccgggcagtgagggtccctggggcgcctgggcctgacccgggtgtccgcctcccagccccgggcttggcatagaattccgtccttaaaggtttcctggaggtgccagctgggctgcgtctctctgctcctgtctacagataaacacagatacaggacaagcacagatgttcacacacagacgagcgacacgcggacacgcacacacaaacacaagcaacacgcggacatgcacacacacagagcaacacgtggacatgcgcacacacacagagcaacacgtggacatgcacacacacacagcaacacgtggacatgcacacacacacagcaacacgcagacatgcacacacaaacacagagcaacacacagacatgcacacacacacagagcatgcacaggtgtgcatgcatctctctgctcctgtctacctccagccccatctgtcacatctgtttctgtgttgccgccatgggtagttcctgttaggggatcatgtgtgtttatacgcctgccaccagggaggcctggcatggcagcagctgggcactttgggttcccagccccctacgcccaccctggctcactcagagtgagaccagaatgattctcctggcggggcgccactgggcagtctgagccttggcagcctcccccgtgagctggcccgacgtgcagcagatactctctggattgggacttcctggcccgagacgatgtggagggaacaaaccttcctgtcctttcacaggtggggacaggaggcccagggagggctgggcacagccaaggctgccctgcaggtccctgcctgactccgggctcccgtcccctggtccaagctgttcagcctcgggcccagcccagagtcgcccaagccctcttgaggcaggagcaggtggagacgtgggcacagtcagggcggccatccttgtgggccagaaggggcacctagtggaggcaccacagcctccagttcttctgtctgtccttgtaactgtgtgtgcatgtccgcgtgttgctccgtgtgtgtgcatgtccgcgtgttgctctgtgtgtgtgcatgtccgcgtgttgctctgtgtgtgtgtgtgcaatgtccacgtgttgctctgtgtttgtgtgtgcatgtctgcgtgttgctctgtgtttgtgtgtgcatgtccgcgtgttgctctgtgtgtgtgcatgtccacgtgttgctctgtgtttgtgtgtgcatgtccgcgtgttgctctgtgtgtgtgcatgtccgcgtgttgctgtttgtgtgtgcatgtctgcgtgttgctctgtgtgtgtgtgcatgtccgcgtgttgctctgtgtgtgtgtgtgtgcatgtctgcatgttgctctgtgtgtgtgtgcatgtctgtgtgttgctctgtgtttgtgtgtgcatgtctgcgtgttgctctgtgtgtgtgtgcatgtccacgtgttgctctgtgtgtgtgcatgtcctcatgttgctctgtgtgtgtgtgcatgtccgcatgttgctctgtgtgtgtgcatgtccgcgtgttgcttgtgtttgtgtgtgcgtgtccgtgtgtcgctcgtctgtgtgtgaacatgtgtgcttgtcctgtatctgtgtttatctgtatacttccatgtctgtgtgacagagtccttgtgtctgtgtgtctacatgtctgcgcgtgtccctgtgtctttgtgtatatatatccatgcctgtgtgcctgtgttcctgcgtgtgcttgtgtgtgcacgtgtgcatttgtgtgtttgtcagagtatgtgtgcatgtgtgtgtctgtcagcgtatccatgtgtgcatgtgtgtgtctgtcagcgtatccgtgtgtgcatgtgtgtgtctgtcagcttaaccatgtgtgcatgtgtttgtcagtgtatccgtgtgtgcatctgtgtatctgtccatgtatccgcgtgtgcctgtgtgtacctttgtgtgagcatcaagggacctcccaggcctggtgctcaccgtccgccccaacgcaccctgcattgcagcgactccagctcggacacagacagcttctacggcgcagttgagcggcctgtggatatcagcctttccccgtaccccacggacaatgaaggtgaggtctttctccgcatccactgcccgtttgcctctccccacctggcctcctcttggccgctgtggaggagagggaggtgtgttcggctgtgctccttgctctggccctttggcagtgcgcagtagcatccctgggctctggccttcagcggcagggtctggactcacagtcctcccagcaggtgcttgccccttgcctcctggactcagccccatgcatggagcattgctcggagactgggcctgggccggtttggctctcaccacccccctctccccatgcagactatgagcacgacgatgaggatgactcctacctggagcctgactccccggagcccggaaggcttgagggtaggtggggcgggtgggcccggggagctctgggtgtgtaggaagcaggggctgggaccgggagcagagcccctccgaggctggggatgctggcccaggtaccgctctgggtggcttccgcttccctgctgtgtcccaagtattatgaggattggagcagaagaggtgtagctgctgccacctctgctcatttcctcctcccacctcccaggaggagggacaggcacatggcgataagtggcaggtggagccggggtggccctgggggttaagcatggggaaggaaggacgctgaggagcgcgcaggctcagggcaggtccatgtccccatggctgccagcttgtgtggacactgctgcaggccaggtcgttgtcccaccccaccccatcccatcccagtgtccacctacctcctgcagcacatggcctagtcaaagagacaggctgatacaggtggtcacacgtggatgacggaagcacgagctgggtggggaggacgtgtctctgtcctcctctgtcgcctccctcccttcctccctccctattgtctctccagccccctcatcttgtcaatttcctcatgtctggggctgatccttgatccttccattttccctgcgtccgccctgcctccttgttttccagcctcctgttctcactgacttggcctctgccgaccccagcccctgaccccgtatcctctctgcctcccatccactcccaccttcaggctcccgggtccagcccctcttctcctgccgctccctccctccttccctctggggtcccagtgccaacagtccttcagcccacgagggtctgcgggccgcttgcctcagtttccttccatgcagagctcttgtctcacagtgttcaccatgcctgtcccttcgcccacacactactgccttccgtcttagcctggctggccaagccttggtgaactcagactccgtctgcccagccctgagctgcagcccagtgaggctagagatgggcctggggagccaccagtgctcctgcatgctactgctccactcaccctccctctgtacccccttcatcctctccccgagacatttctcgtccaggacgcctgtggcctccccattcccagttccagcgctcagtcctgagccacaccagcctggcgcctgccctgttccttgccagcccgtcctccaggcgccccgtgctcccggggtcctctttctcctcagctcctgtgctggccccatgagggatacccgggactcagacctcactcctctcccgaattccctgggtgacagcctgggtcatctgcaggctgcccgctccgagtcatgtccagcctggatttttgaactctgcacacattccctgaccccgcatcccctggcatctcccagctttctggatatgttctgagcaaacacgggccttcaccttcctcccagctgctcccctcccctgtccttgggaattccgtcctccctctcgctccagccgagccctgagatccttcttgacttctcttcctttctcttccttccacctctgggaacctgatgggctcctcaggtgtcctctaggcttcaggaagcgtccacaggctgccatagggaggatgaatggggaaggctgggggtggtgggtggtctgggaccctggggaaggcaggatgggagtgctgggtgctgggctgctgggtgggcaggctgtggggtgggcctaccatgggttgcactcctggttggcctggctgaccactgccagcagaggatagtgttggcccagtctctgtcagggtccaacccgggtctctttgctctgcagatgccctgatgcacccaccggcttacccaccacccccagtgcccacgcccaggaagccagccttctctgacatgccccgggcccactcctttacctccaagggccccggtcccctactgccacccccgccccctaagcacggcctcccagatgttggcctggctgctgaggactccaagagggacccactgtgcccgaggcgggctgagccttgccccagggtacctgctaccccccgaaggatgagcgatccccctctgagcaccatgcccaccgcacccggcctccggaaacccccttgcttccgggagagtgccagccccagcccggagccctggacccctggccacggggcctgctccacttccagtgctgccatcatggccactgccacctccagaaactgtgacaaactcaagtccttccacctgtccccccgaggaccacccacatctgagcccccacctgtgccagccaacaagcccaagttcctgaagatagctgaagaggaccccccaagggaggcagccatgcccggactctttgtgccccccgtggctccccggcctcctgcgctgaagctgccagtgcctgaggccatggcgcggcccgcagtcctgcccaggccagagaagccgcagctcccgcacctccagtgagtttgtgtggcggctgcaagccctgcctccagctacagggaccctggcctggcctctgacgggcactctgcccacctcgctcccctggcactcttagcccacgacggggtaccaggtgcaagggtaggaaggttcccggttgcctccagtccgccttggtggaacgtggagcatgtccatgactcagccctgaagcttgctggaaatgctttgtttttttttctttttgagacagggtctcacgctggcaaccaagctggagtgcagtggtgcgatctcagctcactgcaacctccacctccggggttcaggtgattctcctgcctcagcctcccaagtagctgggactacaggcacctgccaacacgcccggctaatttttgtatttttagtagagacaggggtttcactatgttggccaggttggtcttgaactcctggtctcaagtgatccgcctgcctcggcctctcaaagtgtagagattacgggcgtgagccaccgcgtcctgctgaaatgctttctgctttatttctgggaagtgccaggagaccagtttgtcccccactcccacagagttacgccaatggctgtggtcaaaggcatctgggaccccaggtgggcttcctgccttgcctggcaggcaaagggtccaggaactggaggggcaggtttcgcatgggtgtgctggccggcacgcgcacccccgaatgcccttgcccacggtgcccttctcccagggctctgcgaacacctctgagatgcctgctgcctgtgtggaagtgcctctgagcagcccttgtcacactcgtggttctagttcaccaagggctgcagagatgcagatgttcggaagtcacgtttttccatgactgtggggatagcggttccagggctcagcctcacccacaggctggcctcccatgctggcgtggcccgttaatcctccctagagcctttgaggctttgctgagcaggaccggctagccacacagggaggcgtgcagggacgccatgggcgtcctttggggtcacactgcattgttcatccagttcacgtccactcccctgtggctctgagtgggctgtgatttggccatgaccggacctcccctccccacgagcatccagagcacttgttgacggtgtgatgacactgagcttgggaaccctggactcccttgccagcatccatggcagccctgacccctgactccggtgtcgggcgattcctgctgtcccagggcagtcggcacgagccctacccggatctctgttgtcctgagctttttagggtcacaggggccatagcaggcagcttgccgtcctcacacagagggtggagtggggaggggagcagagggtggccgccccgtgtctgacagtgaaatggtcctgccttcctctccctgcccctccaggcgatcaccccccgatgggcagagtttcaggagcttctcctttgaaaagccccggcaaccctcacaggctgacactggcggggacgactcggacgaggactatgagaaggcaaggctgagcggcaagcctgggtcccagtggccagtaggtggacaggtggtgggaaagccataggccagggcggcccctcacagaccgtcctgagcaaggaccccccgagaacccgggagcctagggggacacagcaccatgtaaagccccggatcccggcaccgggtggccaccgtccggggagtggtggtgcgggtggatcactccgacgttggcactgacaccgtcagcctcttgcaggtgccactgcccaactcggtcttcgtcaacaccacggagtcctgcgaagtggaaaggtcagcacaaagccctgtgtgtgctgggtcctccgccatgcccggcttcctgcttctgtgtccctctcactagcttccgtgttggggagttgctggcacaagttcatggccctgcgtgcagcagaaaccagaggagtggacctccctgctctgtcccatgcccagctggcaccctggctggccagggctctgctgggctgcttctgtcagcctcacggcagcccgacgtgctcagctcctgagacctacaacagcgagaggacagaaagccaggcttgggagcggggcgggaaggtccgtgtgaaagctgcccgaggaggactcacccgctaatatgactgtcttattttaggttgttcaaggctacaagcccccggggagagccccaggatggactctactgcatccggaactcctctaccaagtcggggaaggtaggcgccaggggaagatgccccagggcccctctggctctccacacacccaggctgtgggtgggcccaggactccacagttcctaaaccactccccttgtggactcttacttggtgtctcagctgaattctcttcccagcagcaccccccaatctattccctaatagatctccatctgcaaattgggggccatgatggccacctcccagtgggggccaggactcgggtggggtagggctcatgctctggggtggcggaggccacatggggcaggggaacgccaggtctgcccgtgtccctccgagcgtgaagttgtgacctcactgagccatgctctcccgggtgtgtcggagtggttattggtggttatgagctgttgctcatcagaggctctctgagggctgccagtgtcgcccccgctgtccttgtgcaggtggtctggagtccctccccgccccccgagggccacaggacccagccttgatggttctgcccccctatccccagcccatggtctcccgaggctggtcccgctgtttctcagggagccgtcagcctcccgcttccgtcctgtaggtcctggttgtgtgggacgaaacctctaacaaagtgaggaactatcgcatttttgagaaggtgagagggctctgagtgggacggggaccctggccgcatggcctggcaaggggcagggcagaatctccctgatgaggcataggcagcgggtagactgagactggcacctccaggataccgccctccccttcccctccaccatcgctcaccccccacccctcctgctcagcctccctcctctcgtggcctacctttgtcctccactgaccctagtggggatgggcggtcagccatagaccctgggttgcttgtcttgtctttttctttttgcggggacaggggtctcactgtctttctcaggctggtttcaaattctggggctcaagcaatcctcccacctcggcctcccacagtgctgggattacaggcgtgggccaccgtgcctggcctaggttcatttcctgaccttgtctgaagtgctctgggtgcaggctcctggacatggaggacggaggggaagtgaggtgggaacatggagagcacaggcctgatgcggaggccaccttgggggcaccaccgacagccaggggccagcctggtgatgccgctgttgatgctgctgccttgttttacagacggggagactgaggcctagagccgcagagtggcctggccctgctgacgctcccccttctcttcccccacaggactctaagttctacctggagggcgaggtcctgtttgtgagtgtgggcagcatggtggagcactaccacacccacgtgctgcccagccaccagagcctgctgctgcggcacccctacggctacactgggcctaggtgatggcagtccatgtggctgccaggccaaggcagtcacaggggccctgaccccaggccacacagacggacatgggcccacatgggagggtgagcaggagcaaggctgtgcttgcctagggcctctgtgatggacatctcgtaggacccagccagtctcatccagcaggttgggttctagggctgaaccaggcgccaggctccagaggacgaagggactctgttgccccacactaacttgccctgtcccaatcccagaaacccaggaccaagctgtgcctgggctccaaggacaggaacactggtccccccatcacactcacccctaagtgggctgggagccaggcagggccagggcagctgggtgggggccggggctggccctgggacccccaggaacgctaagacacaggctccagtaggggctgttgcctccaataaagcagcagtgagctttgccttggtggctggggcttgattgggaaggaggggattaccagcttactgggtgcccatgctgatgtctaagtggtgaccgcagcagtacccgggaaccccaacagttggttgtcttgtcttccagggtgcaggtcactgagtgacttccccagggtgcacagcgagtaacagatcaggacccaaacttgggcagtctgggctgggagcccacaccccactcaccagttctgctgcctcaggtcaggccagggcagtgctgctgcagagctagaaggccctgcagctacagctgcttcattccctgcattagtgcctggttactgggtacctcctgagtggctgtccccgttccagaacttgcatacactgagcgggctacagagctagaaggccctgcagctacagctgcttcattccctgcattagcgagcagttattgggtacctcctgcatgcctggtcccattccagacaggggcctctggcctggctgagttcacagcccagtctggggacagctgggtatgaggtgcttacggcacagtgtccagggcagctgggtgtgcagggactgggggctcccggaagattttttggaggaagtaacagctacgatgggatgggaacagtggaccctaagcaggccaagggtgcgtagggacggtggtacccagatgcccaagtcttccaggcaatacctggctcaggcccagccccaatccatccccttactttctgccatggagttccagcaggtcactctccctggcacaccttccaggctggatttttaatgaaacagactcagggaggtaggggctggcagggaccctagaatccttgtgatttttcttagcaccttatgtcagggaaacctaaactgaggtcagcacttgggcccactgacagtgactgactgggggagaaggtcctgcagcccccttcccctgggtgtgttctggggacctgtggtttgctggcggaaacaagtgatgaggctggttagcggatgtgggaggctgtgaccccagggggccatagggtgcggtggaactgcaggccctgcagatgacggcagccagctgcttccaggaaccaggtgtccaaggccacctctgcaggggtttcctcttcagcctgcctggggtgagaggtcagtgcaccacagccgaggctggagcacagggagcttctgttgttctgatctatctctggaaaaccagccattcctcctccctgcagtcagaattctttgccctgtctgacctgaacttgcttagggagtcatgccactccccactgtggccatagtttctcttcctgtaaaattttattattttagttttttgtttttgagatgtagtctcaccctgtcgcccaggctggagtgcaatgccgtgatctccgctcactgccacctccgcctctctagttcaagcgattttcctgcctcagcctcccgagtagctgggattccaggcgcccgccaccacgcctggctaattttttgtatttttagtagagacgggattttatcatgttggccaggctggtctcgaactcctgacctcaggtgatctgcccaccttggcctcccaaagtgctgggattacaggcatgagccactgtgcctggccccttcctgtaaaatttttaaatggagaattgggtgcgagatgtggtttccagcctggtgcctggggtgctgagctagtgagtggtgcagtccaggacacctttgctttatgtcacttacacggtcacctggagccggctcaagtggctaaagcatcctggggcccagagccaggtgataggtccctctggccaactggacagttgaggcctgtggttacccgaagcccagctggggccctggtccagcctcgcctcccagactctgcacctgctagcacagctgtccacgtctgtgtgagctgctctaggccgagggcctcagtttcaagagtgtgttggggtgggatggggcaggccgtggtcctccagcatgaagaaggagccatgaggagttcccatgacctcccgagacttgccataagtgttctagtccacatataagggtagggttgggattaccatttactgaccacatctgtgaggtgccgagctgggtgcttgacatcatttgcttggagaagcagctgctagtagacccattttacaggtgagagaaccaagtctcacagaggcctgggttcaagtcccacctctgccactaactggcatgtgaccctatctatccttcactgctctgagcctagaccctggcccctgcctggctccctgccaggctccctgccacccctcacgacctctgatggtcgttgtgggggtctcttgcctggctcccagggctagggttagggctctggaggtgctttcactcaaccaagggggccacagcactggggagtgaaactgccccgcctcaccctgcgttgccctctgggtctgtgagggtgggctggcaggaggcctaggccttgccctaggggcagtcctgcttcctcattttatagatagggaaactgaggctttgggaggactcactgacatacctaccttcaagatgagttcaggtgggctcagttctggggcttgggaaaagggccccagtggctttgggaagcacccccagcccagggtgaaacatgcttcttctcttcctgtggttccatccgaaggattgtggtgagccccgtgccttcagttaataaagatttgtattgtgaaaagattttttcttttttttttgggacacagtctcactctgtcgcccaggctagagtggattggcgtgatctcggctcaatgcaaatctccagggttcaatcgattctcctgcctcaccctcccatgtagctgggattacagctgcctgccaaatttttgtatttttagtggaaccggggtttcaccatgttggccaggctggtcttgaactcctgacctcaactgatccgcccaccttggcctcccaagtgctgggattacaggcgcgagccacggcgcccagccttgaaaagatgtttttagaaccagaagaaacctcggttcccactgatccttctgggccacgttgtgcggagctcccctgctggttggggctcagcgcagccccagggaggtgcttcctgcacctcaggatgggcgagggtgggcattgggggagagggggacctgggacctgcggcttagttccctgaggcaggcagggcttattggggccatttcatagaaaggcagattgaagctcagcagggaagaggcttttgagggtgatccaggcgctggagggatggcctaggacaccagggtcacaccaggaacatgggagggccgtgcttgtctctagacgaggggaatgggggaagggccacaacctctgtttctgtgacccagcagcatcaagcccctcgctgggcacctcgcacacaccccctgccttatctctgcctgcacgccctgttccctccacctagactgcctgctgagggggcagtgccaggaggttgcctgtccttggggaagaggggcagtgaccctgtgaagatgcttgacagacaacccccaccacctcagaagtgtgtgtgagtggtgaacccttttaagccatcttccagccattctcactggagggagatttgatgggtacagagcagacccctacctgtctaccctccttcggacccctaggaagcttcgcaggccttccaggctgccagacagctgccctggcgttgccgtctgcttcttccctggccccactctgaggggctcagagctgaggcagaatccctttttcattcatttcctgcagaataaaacaacatacagaaaagtgaataaaacataaatgcacaacctaacacactgttaggaagtgaacgatctgcaaccaccatcaggaaatagttttgccagcacccaagtgccctcccctcacagtgtcacttccggcctctctgccctggcttatgtgagtcttgtgttcttgtttttctaaaaagtcttcagcacccaattatgcaggcattgcagtattttcctgtttctgtgctttatccccttgaatcatacagatgcaaattctggcagctggcttctttggctcgttattatgtctgtgagatttattcatgttgctgtgcgtagtatagtttgtgcatgttcattgctaaaaacttccattgtttggctgtatcgtagttcacagattcatttcactgtcagtcaagcttgtccaatgcatgcagcccaggatgcctttgaatgtggcccaacacaaatttgtaaactttcttaaaacattataaagatttttgtttgcgatttttttttttagctcatcagctatagttagtggtagtgtattttatgcgtgacccgagacagttcttccggtatggtccatggaagccaaaagattggacatgcctgctgtagatggacagttggtttgtttctagtttggggtaactacacacaatgctgctagcaacagttttgtccatgtctctgatgcacgtgtgttttttgcaaatggtgcacaaatttttctagggtttgtactcaggagtctgactcctgggttctagggtatgaagatctttctaaatattgttctagtttacgtgcccaccagcagtaaaacagaattcccttgccttcccatccttggcagacatttcacttttgccagtctggtggggtgtatagttatggccttaatttgcatttagctaattaccaaggagattgagcatatttttatgtttttattaaccattttgattttgtctcctgtgaagtgtctatcatcttttgcccattttttaacttgttgtctttttctttttcttttctttttttttttttctgagacagggtctcactctgttgccctggctggagtgcagtggtgcaatctcagctcactgcagccttgagtcaggctcaggtgattctctcacctcagcctcccaagtagctgggaccacaggcccacaccaccaagcccagctaattttttgtatttttaagtagagacgggtttcatcatgttatgcaggctgctctcaaactcttgagctcaagcgatctgctggcctcagcctcccaaagttgggattataggcgtgagctaccagattttttcttattaatctaataattctttgtatagtcttgatattatccataatgtgtattgcaaatatcttctctaactctggcttgactgtttatggtgtcctttttttttggggggggttttttgagacaaggtcttgctctgtcacccaggctggagtgttatggcacaatcttggcttattgcagcctcaattcctaggcttaaacagtcctcccacctcagcctcctgagtagccggaactacagtcacgcacttccatgtccagataattttttttttttttttagagataggatcttactatgccccagctggtctcaaactcctagactcaatgagcctcccatcttgacctcccaaagtgctgggagtacaggcatgagccactgtgcatgccagttcttatttttaatgcagttgaattgatcagtgttttcattttggttagtgctttttgtggcttaagaaattctttccaggctgggtacagtggctcacacctgtaatgccagcactttgggggcagaggcaggaggattacttgagctcaggagtttgagaccaacctggacaacatggcgaaacaccatctctacaaaaaatacaaaaattagctggacatggtggtgcgtgcctgtagtcccagctactcaggtggctggggtgagaggattgcttgagcccagaaggtcaaggctgcagtgagctgtgattgtgccactgcacttcagcctgtgagacagagtgagaccctatctcaaaaaaaaccaaaaaaaaaaaaaaaaaaaagaaaaccactgaaattatttccactccaaggtcatgaagatagtctcttagattatattctgaaatccttataaatgtaaatttcatatttaggcctttaattcacctagatttggttttttgcatatggtgtgaggtaaggattcactttcatttttttctctccatagggttacacacctgtcctatcattgtttgtaatctaactttctgcgcccatctgcaatgccacctctgtcatatgtccacatatgacatatgtagatctgttgttggattctttcctctgttccattagtctgtctgttcttgtgccaatatcaagctgtcttcattattatcaattatgtattgagatctgataaagtaagtcttttccaccttatttttcttctttgagagtgtcttgactattctggctctttgtattttcatgtaaggtttttctcccatataagttttaaaatcagcttgtcaattccaacaacaatgatgcacttgatagtttgggaatttattatagctatcaatcagttttgggaaaattgacgtctttacaatattgagttttctgattcatgaacatggtttacctctctttccatttgggtcttctttaaggtttaccaataggattttatatttttgtccattgtggtcttgcttatcttaagtttgatttgtaaatattttatgtttcttttagtctattgtaaattgtgtatttttaatttcatttttttttttgttaatagcatataaaacacaccttgtcttttaactggagcattttgtccattgtgtatttaatgtaattaaatctaccatcttattttatgcta

SEQ ID NO: 2757 - DNA, 44138 bp, Homo sapiens
  source 1..44138: mol_type = genomic DNA
aagcccagtggtcctggccgtgcgccggaggcagcggcggcgtggcgcagcggcgacagtaagtgcgggccggctcgggctcttccggctacggtcccggccgcccccagactcgcgctcagcgacctccctcccgggccctgggggcggctgcgggctgccaggggagccgcaggaccctaccccatccgtggtcccttccccaccgtccctcctctctctccttgctctctgccacccctctttctgggtctctatcttctcttccccaaatcctctcccctcctcctccctgagactggacctcaccgcctgtatggtgggggcctggtatggacccgtcggcccgaagtatccagacggtggctgattctctcggtcccagctgcggggcctgaggctggggctgtttacaccgcaaagccggttctgccgcggccagtaggcggtgccctgcgcttcccagtgccttcccacaggttagccctaccagctccccaccccggttcacagcccaggagatcgaggcacagaggggcgagccacctagccagagtcaggaacctccttggaaccagcacccaggcttcccagcccagatgaggttttgccgcggccccagcagtgcctgcctccttgtgtggggctgtctgtctgtgcatggccgggctcccgcaggtgacccaggagcacgttccaggccacagccagcttgttttggggaaggttgggcacttccttgcctgcctttctctttattttttaatccagaagccagcagctagcttttataaagactaataagactttgctcactccagtgccctggcctgtgaccctggttagagaaaattcctggctccttcttcagaagctcagtcaagccttgacaaatagacgctaggaactgagaagggggccctagccaggtgtggtcctgagtgacagggctggtggaccttctagccgcccccacaggtagctggagcctctggaaagaaccacttgccggttctctcttgttctatgtgggtgggtcatgattattttttacattttaaacactaatttttaaaatgtaacaagtgagcttgttacatttgtaccattttgtgccagacaaaatagcatagactgggtggcttaaacaaaatttgtttctcatggatctggaggctgggaagggcaagatcaaggtgctggttgatttggtttctgatgagggctctcttcctggcttgcagacagcctccttcttgctgtgccttcacatggcttttcctctatgagtgggtgcatgtggaaaaagcgattttccacacagtgagcttccagacagtgagcttgttaatgctggcctccatgcgaatccaggctggggaggggctctgctaaccaggggagtttaaaatagacttgctggctggatgcattgcacttgggcatccagtggccccccacctgctggctccagggtacatgctaccccagcaggggagaatgtcctggtcgtgcagagtccgttcattcagcaaacattgacaagggtgcctgcagtgtgcctgggcccctcccgactcactggcttcaaggcttgcaggaaggatgcctgtacttggaaccagcagacacagattcccattcccagccagtcctccccggtgtgctgaggagtccagcatgggccccagtctgcttggctgtgtaacttcactcttgtcatctactagttatgtgaccctgggcaagttactcaacctttctgagcctcagacccctctgtgaaatgggtcttagagtagtacctaatatattaggctgttgtcagcctcaagtgtgacctctgttaggcacagaccttggcatttgtgatcactggacttaagtttagctattgggagttctttctatttgtgggacatagcaagtgccttccagacctcagtttttccatctgaaaaaagggggcaatgttttctgccctgcctaattccaagggatgctctgaggttctcctgaaatagtggataaggttctgcacccatgtgaggaggtgttcccatcccaccagggaataaaggccccagtcttcttggtacgatgctttgagttaggcttagcctcctatagaaaccaagatgcatttatttattagtttattgggtggggaagaggctactgcagaagggactctgaagtgtcccatcctcagcattttggagacatttctcatttatcaagctgctgccacatcctaggtgctatgtagagcaaagaagcaggcatgctaccttacagccaaattcagcagccagccagccagccatgcgacaggcccaggatgccagggagatgctgacatttgttcaacagctgcttataggccaggcattgccagccagttgcagttgcataactatcataaaaacagcttctctgggtttacatttggggaaattgaggcacagaaatgtggtaacttgcccaaggccatgtaggcaatagttgctggcagcctaggctcttccatttatcttaggcgctaccatagattgaaagtggctggctccttgtagggtgtgatgagcagaggtgggacccaggcaggagctgcaaacccaggcttggccatttacgtggcctatggccttcagttctttggacctctctttcctcacaaatgaaatgggaatggactgtcagaggctacacaccagcttctggaggcagccctggacactaccagttttttaaacaattattacttaatttgaatttttttaaatttacacttttaattttgtttttgaaccggtaataaactagtcacatagttcaaaattcaagagacacaaataagaatgcagggaagtccccctccccgccccccaccatcccagtttccctccttagagacagccactgttagaaacttcttatgtagccttccagagatattctgtgcatatacaaatacatatgtgtatgtatattttctctccccactttttttacacacatagtagcatattctacacaccatcctgctccttatttctttcacctgaaatcgaaaagggtttagagatcattctttgcccattaagggtcctaattcttttttatggctgcacagaactgtgaatgcccttagaccaggtttgcctttctgggtacattgccacagtccccactatcatgcagtgttttacaaaacccagcctgttccacagttatgtgctactgctacctctgttgcccttgcatggttggggtgacctctgaggacacttacagttctgacatcctgcccttctccaggtctgatttttgtctttctccctgatccttaaaatgaagctctccaaccaggctttggtgactttacagagcccagggtgagggggcatggtcattttgtaggctgggtgggtccccagctgtcccccagccttggtttctactcacctaccctgtctctgttgccctccttgctccaatagtggccgttgtctcagaggacgactttcagcacagttcaaactccacctacagaaccacaagcagcagtctccgagctgaccaggaggcactgcttgagaagctgctggaccgcccgccccctggcctgcagaggcccgaggaccgcttctgtggcacatacatcatcttcttcagcctgggcattggcagtctactgccatggaacttctttatcactgccaaggagtactggatgttcaaactccgcaactcctccagcccagccaccggggaggaccctgagggctcagacatcctggtaagggcatgtttctcctgcaaggctggtgggagcatacagaggcctcatgcctcacatgcaggggaagatggagatttcagacacatttccagcctttagatcacttactgtttagcttgggaagaagatgcaaattatggttccatgtggtgtgtatggtaaacccataaatccagagtccatgcctccagggatgtgaaggtatggactgaatagtgttatgttcagctatgagttacagaaaattccaaaagactagtaactaaaatgagatggaaggtcatttttctcccatgttcaattctggtcgggacagcccaaggctggtatgatgttctatggcattaggaacccagttgcttcacttctgtgcagctttcatggccaaggccacctcatagtgcaagacggctgttgtaagtccagccattacatcagtaggaaaaagcaagaggagaaggaggaaatgcctgttgcctgtacgaacacttcctggaagtaacatacattgctcttcttacattgcattggtcaaaacttaggcatgtgaccacatcagcttgcagagcaggctgggaaatgtagtctttcaatgtagctttatctcagaaccatgtgcctgctaaaatgggaggttctgttatggaagacaaggaaaatgaatccgaagggataattagtctgatcaccatgggagagattgctgtgacttgggagttggtgggtttcaagaaaggggaggaaacgatccaggtagaagaaaaaggctgggcaacggcagaatgggaggaaagttcaggtgtgtatgacaaactgtgaagctgtgtttggggcacaagtaagagcaagaggtcttgagatcattgcctggggccttgaatgtccaggtgaggagtcaattttgtttagttgacagggctgctcactttgctgggtggcttttccagagaggtgggggcagtaggggaagaggattaaggaaaaaaattatactgacactcgttaaaacagtaaggaaagctttatttaagactattgtagtaggggagataaatggagctcaactctgaagaggagatggggatttatagccaaggagcagcatgagggctggaggatggaacatttctaagaggagacgtcaaggcgaggcctctgcttgctgaaagcaggcccaggacttacacagtcaacccttgaacaacaagggttcactttagatgcagatttttgtttcagccaaacatggaaaatacagtatttgtgagttgtgaaacctgcatatacagagggccgacatttcctattcctggttctgtaagaccgactgagtatgcttgggttttggtatatggggggatcctggaaccaatcccttgggtatactgagtggggtgaggcgcttgatcagatgtgagataagggaatattctggctcaactggcccaacagaattcttgttgaaagcaggtctaggacttacacagtctactgttaaacaatatgggtttgaattgcaggggttcatttatatgtgaagtttttcaaacaaatgctgatggaaaatgtactattagtggagttcaaaacctgattacagggagagctgggttccacaaggctggctagggacctgagtatgtgtggatttgggtataggtgggagtcctggaccaatgccctgagtatatggagggacagctatacatcagaggtggggaatgaggaacttgatcagatctcaaaggtggggggatgctggctaatctgactttgaaggattcttggctaagactgagttgggcaggcagaagtcaggactggggggtcgggccaaggtcgaggatggggctcagaggagcctgacgaaagttaggtcaatgagagtcttggtcaggagcctccgtttccacggctgccccaggctggtgtctgatctcacttgagagcacggggaggcaagggcttctccgacaaatgccgagatgagatgttgccagctgcccagctgtgcccttcttctccaggggagcatcagaaacaagaagggggtatgctagcaccccagccgcaccttccagtggcccaggaggtggctcatcactgcttcccagaaggaaatccttggcctcgccctgaggagctgtcctcagttttataggcatgaatctgccatagtgagggaggcatccctgttgtccatctcaaggactcactgcagctacacatgtgggtcacccaggcagcttcttaaaaaataccagtccagagtccttttgtagttcatgagtgtgatgactgggtttccacgcacatgtgtgagatgggcctccctcaaaccttgttatgtcatcggcacattacccgtccgatgaaaaggaataaaaataccaatgcgggccacgccccagggattctgactggattagcctgagctggggtgtgaacattgatatgtttacaacttcacacttccacactcctgtactccacccctcaactccccccatgatctgacacctgtgagggccttttctgttaactgaggaattcacagatgcctcccagggccagagcaatgggatataaaccatttctacagctgaggaagtgccacaggaacgccgcagagtagtttacagcccctcaactcaaggtgtgtccttggaccagcagcctcacctgggagcttgttagtgatgcagtctcccacccactcgaggccaattgagacagggccttcgagctaccaagcccctcgggtgactgaagggcacagtagagtttgtggtgcactggacagggcttggctgtgtgaactctccatgctgcctcatatttctggactatattagtactttttttttttttttttttgagacagggtcttgcactgtcacccaggctggagtgcagtggtgcagtcaaggctcactgcagcctcaacctccctgggctcaagtgatgctcttgcctcagcctcctgagtagctgagactacaggcacacaccaccatgcctgaccagtttttttgtatttttggtagagacagggtctcactatgttgcccaggctggtctcaaactcctgggctcaagagatccgcccgcctcagcctcccaaagtgctggggttacaggcatgagccaccacacccggccatctttctggtatgttaaaggaagatattataataccaccaccaacttcttagggctgttgtgaggattaagtaaattaatatgtattaaaaagcacttaggacagggcctggcacccctatctgaagtgctttataaacactattattgtgatgatcatttgagggatgggcccatacttctaagctgcctgcagccctggtgcatttccacaggcgcaggcttagccggggtgctttacaatccgcttttatttaccagtgactccaacgtcccagctttctgccagccgtggtaaatcacctggcctactgggcttcctccagaaggtccctgcctgtctcggccggcacagagctagattgcgtgtgcacctgccctgcccctcctctgtccactgccaggtccccgggatcaagcagcctctggagggaggggtgtccaggcctggctctgggagcagccctcgcctcgtgtactgctttcaccgcaaggcgatcccttcccagctgcaggcacttggcattctgagccctgctacgatgctttatggcctctctccaactgctggcaggtgcagatgtagtaccttcagctgcccggagctcctggctcttggcatcggagatgagagacctgtcacccctcgattcatgggccgggattgggaagcgagcatgctgaggcatttctgcattttgcgggccatttctctttgcctcattcctcatcccagccacccacctccccagctctttcctcctctcttcctgatttccctgtgagaggctgcccgtctgccctgtcacctgagggccactttaggggaaggagggggagagtcaaattggcctgtctctagccaccacctgcaactcaattagctgtgggtctagatgtttattctttcctgtactttcctttgaacattttctggggatggatgccatttgatggggagcttgacccaggaggaaggtttacccagacaccctctcccccaaattatgtcactttcaaggtcagcgggctcatttccttctgcctggacaaatgtggggatggcttagaaagtatcctgctcactctgccctcctgtctctattctctggaataagaacctccaataaatatatcacaggtgtattggcccagggcaaaacaaaatttagagcataaatgaggaagaattgataagagaagatggcacaggggcctgcaacagccgccattgcctgagcccgactctgggcccaccatcctggcaggggtattgcatgtgttgtttctcagccctgcaatgcagatcttagtaaccattttcttaagacaaaaagccagaggctcagagaggctaggtaacctgcctgagattacacagctaggaagggctatagggaatttcacggggcattgaggtggacagatgattacagactcattcatactcagagagtggtatgtagggtactatcctggagattccccaccccccacccccacactttgactccaccaaacaccatcttccttcctttggagagcctgcccctggtctggcctccttttccagcctgaaaccccaggtgcctgggttctacacctgggtcctggacccagcgtcccttgtcccttccctacctgacctgtttagctggaggtcctccccggctctggggttgtaagccatcccctgccctgtggggcctccttgccctcccccaggctctcctgcaggcctgtattggctgcccttggccaagaacaaaacagtgagctggacaagccctacttcctaccccggagagaagagtgtctgcaccttctcctggccattccttgctgcaaggcccccacagccgctctctacaccttccttcctgtgtacctcggtctgcccagggactcctctctgagggactgcaggatgcggccaggtcatgagtgggacctacagcccgacttagtgtcagcagggctgggacccgggctaggcactctactgatgcccctgtccatccccccatctgaccaggaggtaccccaacactcagtcccaggggtgaggcaggagacagaagcagctcatccctgggcacgtcccctgaagccacctctctgagttaggggctccatgcctgggtcttcagagctgcatcatacttccccatcacgttcctgccctacagctcatggagaccgagcgctggctgggtgggagctcctgctctcagcactttgcctgcattatctcatgcagcgctgcagcacccgtaggtcaggaactgttatcatccaccatgacagatgaggaggcctcccccgctggtgaataaaactctcttactctacatcctatgcccctggtacacctggcatgacacccaacacataatagcacataaatatttgtcacattagttattgtaagtctgagaaggaaagctccacaacccaatccatgatagtgatgccatggctctgcaagggagcagaagaagatctgggagtcacagtggctaccagtaaaggagttttgatctttcaggtgtgttggcatagacatgaagtggggttcctgccatagggaaggtagccaggttgtcctggttcagcaagtgggggacctagggcatcccctccccttatttccagttccttagttctggtccagtctctcagccctgcaaagaagcaagatagcatacttgggatctgcccttgaagggctgacctcccaatccaaggaggaagtgttcaaaggaagcaggatgagcttgtgtggagaagaggatactggaggacaggttatcagaggttaccaagtccctgccatgcagcctgtacccacctcccgcttgacctgccatcttctttttccacatgacatcctggtgagctaggtgctgccattccagttgccaaatgaaaccaaggctcacagattttaggccactgacccaaggttatttgctagcaagtgatagaactgcagagcccatgcttataaccagcgtgttctccaagctatctgtctaccttggcacgctcagccctggctgcacatcgggatcacctgggaagcttttagaaaataccccacctgcgtgtgcctgtaatcccagctacccaggaggctgaggcaggagattcgttggaacctgggaggcagaggctgcagtgagccatgatcgtggcactgcactccagcctgggcaacagagcaagactctgtctcaaaaaaaaaaaaaaaagaaaagaaaataccccacatcccacgtgttccactcacccaattctaattcattctgaggggcctgggcacaagcattttaagttctctagataaggctaatgtgtagccagataagaaccgtgatccaagccaggtgtggtcgcgtgtgcctgtagttccagctactcaggaggctgaggtgggagaacagaacagtgagcttgagcccaggagttcgagttcagacttggcaacatagtgaaacaccagtctcaaaacaaaaaggactatgattcaagtaaaatgttaccacatagggagaaaaagcagctgtcctctgcctccactagagtacccattaacccattaaacaggcaaaggctacatcatgagagacttaggtgagccttctgggagaacttcctgccatgcaagtcgagttgtcaaacctggcagtgaaggggacagtttcccccttggagaattagggccacatcctgtgggaagtctaaggagttggcctagtctacctcgagtgtggggttcctcatgggactccctacaaatgtaggtggttggagggttcggtgcttgtctaacggaaatgctctgggcttgagctccacccgcaagcccacagttccacgccagccagtggtggcccctggaagagcctttgccctttctcttggtaatgctcccctttgctgggccagggggccaagggatatagttaggagatgggggctccacagccaccctcctcttccttccaatttcccaggctcctggaaaaggagtgatagggccaactgggctcaacatgggcatcctacacctggggtggcacaaagcaagagcaagtgaaactgggagagcagaagagaggcagtcctgaggccctgacccagctgggtaacctctctgtgctgtgtcagggagtggaggctccctgttcccagaggtttaaaagtcacaggatatctatttggtaaaggctccacagctaggtgaaaggtggattggtcctgtctcataggaccacaaggtagctgggaggaacccagatttggcaacagagggactctagtctagcagtgcccttacccactgtgtgggttggaggcatgctctgtcgcccttgggccttttgcccacagacccacctggcagcatttacataacgctgcagacacaggtagggtggaaagtcctgacagttatggtgtgccttatagatggtggctcctgcatgaggacttcactaaatcccaacattcgctgcctttactaagctcttaccatgtgccaggcactgctaagggcacagattcattcattaactcagcaatatttattaagcaatctactgtgtactagaagctttttttttcatgatcttttgtttgttttttttttacagcccaaagacataggtttattatacccattatacagagaaggaaaccaaggttgaaaagtttaagtcatttgctcccaggtacaaagtaagtgatgactgggactcagacctgggccctgtcaacccaggtatccgtgatcttaaccccagtgctttatatcagcattttcgaaattttttggagcatgatggctgtctcacctggcaagatatttgtgtctataatgcaaacaacagtttcatgaagctgcgtctgtacttaaaaaaagaaaactccactctgactgcagtttcaaggaggagcaagtgatgcaacagtggcagtgctggttgtaagccatgcaggatgaggatggaaagtttgtccttgagtttgaccttgtgcaggttcatggtgaccttggggagcagcatcgtggaggatggggggagagacagaggagacagcaaactcaaggaattttgctttaaatgggagcaggacaatgaggcacaagctgcagggaactgtgattcagaagggggagaattttctgttcttttatttttaatacgagagacatagcaggcagtttgtgtgtggaagcaaatgatccagcagagaaggaaaaacgcatgatgaagaagagggagcatagctcagcgaggtccatgagcaggccagagggctcaggtgcacagagaagggttccagaaaaagatgcagacagctcactcacctttagtaagaaagaaggcaacaaaggattaaatagaataaaataaaattctggtcgtgacccatcaaatgaatttcatattctttaatgagctgtgcaacctgtagtttgaaaaaccctgctctgcctgtttcccctaactttgtagccatctatgaggatgcgtcatgtcctcattccacagaggaggaaagtagagacagtaagtaactcgttggtgccacatagctaataagaaggggggtggcagcccagggtacctgaatcagtatcagatttcctgggacacttgccaaatacccggattcctagacccttccctgatggctttatctccctgggtgaggcctgggcactgttgccaggtggtcctgttgccagctggccaggggagcaggtatctaggagtctctcctttgtgccaggtggtgttcctgcagaaccgttttagtgctactcagatctctctccaaatggaaacaatgtttagactccctttgcaatcctcttttattctttttttcttttttcttctcttttctttttcttttttttcttttttttttttttgagacacattcttattgtatcgccgaggttggagtgcagtagtgcgatcttggctcctgggttcactctgcctcccgggttcaagtgattctgctgcctcagcctcctgagtagctgggattacaggcgcccgccaccacacctggctaatttttgtatttttggtagagatggggtttcaccatgttggccaggttggtcttgaactcctgacctcaagtgatccgcccaccttggcctctcaaagtgctgggattacaggcgtgaaccactgcaccctaccagcaatccaatgtttaagagcagaattcccaagagtggagaagggcacaacacccctcctccccgcatagaaagaagtgtattaaagtgggattttgcctgagctttgtcatcctaggaaaagagatggggagtctgaggtcaggcagcatgggcttcaggctttctgccactgggtgtgcatgagtggctgccagttgctttggctggcgtggatgactgctctacaccatttttaaaaattagaaccaaaagtgagtcattttttaaaatccccttgtccaccctctgattctaactgcgggcccagccagcgtgccattcccaataaataatacacctgtgatggctttttcttctgtttttagctcttgctgcatcctgcagaggggaaaaaagcctagtttgaaacgctgtcagtcatgcctttggtggcctcagcttctctagttctcttcttattttctccctaagtgctcacgacccttcttccccacccgcgctgcgctcccttgccctccaggctattgactgctccctctctgccttcgattttatttcttcctgcatatatccttaaaatccagaggcgatttcctggacaaattagaagatggcctggaccttaagtgctccagtgtctctttaacatgattgatatcacaagtgtccagagagcggaacctaaattagagtctccaccaaggagcccagcgcttttgacacaggcaggcagcctgggaagggtctgcagcactgggtgcctgggacctccttgctggcctcttgccggtcctcactgcctgggaggactgtgtaacagcctttgcctgtttaatgggttaatgagtactctagtggaggcagaggacagctgctgtttctccctatgtgcctgtgtttctgtgcacgtctgtgcctgtctgcatgcaggcacctgaggcctagagcagcctgtggtttctgcccacatgcacctccaaagagaaacagccttcccaaggcgggagcagtctgttgttgaggaagtgcctgccaggggttggctaaggactccctcttcctgatggtccctaaggttttctactacagagagaggctggagcacccccagaccacctcctcattaccaccaggccacagggcatggcccttgtccctggtcatcagccttgtgacactgatgcacgggaccctctgggggatgcagaagcctgcccggtcaggcaagagtaggtggggtgttttcttgaaaggccttcttcctcttttccctatcacatggcagaagtcaggctgcagaagaggaaagactggctggcccgagcatcagcagtggctgagcctctgatcagctcatcctcagggagcttggggtcactcgtgcatggatccgtgaggttccctgtttctctgaccccttggtttctgagcccttactctgcctattctggttacagcctgagagtacatgaggggaataaaggggataagaatcagagcagtcagcttgccccttgctaggggaccttgcgaaggcttggccgaggcagggtataaaggtaggtagaaatgaggtttccatcttccttgctcaccctgcctggcagaaagactctggattcaggagagctggcttctgtttctgactgtgtttcaaacttgctgggtgacttgagaccatgtcctcctttgaggaatgaagatatgagaccgtagattgggacccagaaacttttcccgcaaagggccagatggttcgtattttaggctttgtgggccccacagtctctgtttgctactcagccctgcccttgcagagtgaaagctgcccttgacaacatgtaaacaaatgggctgaccgaaggccgaccgcgttccagtgttcacacaaaggaagagggcagatttggcccgggggtaacccgctgctaacctctggactgggaacactcacttacagctctttcccagttctgtgatctattatagtggtacctaccctgctgaatttgtcttcatatcactgaccactgcctggcctattatctatttgtttatgcatttgctagccatctctttgactagatgggcagttccataaaggcaggaacttgagctgaatctcccatgtctacaacatctagcgagctcagtaaatatttgcagaaggatgaatccatctctgagtatttgtggagaggagacagggacaggaggaagaaccgccatcgctggattgtgcaccgtgatcccgcagtgcacctccaccacagcctgcacacccggacctgcctgggccccagcctccccccatccccattcatactccagctcacccctgtggaggcttgagcacatcaagctcattcccgactcagggccaaccgtacgctgttccctctgtccaggctctaggttagccaattatttgtattttagttttattgcatttatcctaatttgcagtcttttttccccccacttgctgttgactctttttttttctttttttttttttttgtgcctccctccctagaacactggcattcccagcccctagaacacattgagcacatacaagctgcttggccatcatttgttgaatgagtgaatgagctctagaaggtcaactgcctttcacctttagtgagtgaatagatgaatgaataaattaaccactgctacctgcttcttcccatctgctccctccacccatttctgccaggtgattccttctacacccagcactgccccccatactgtttggcgttgagaagcccccagagctccccagtaccttccaaaacaaaacccctctttaggcagctgcctgagaccacccgcgaatcggccctcagccacccttgcctccacgcgccccatcatttctccaagtggagcccccaaggtttccggcaaaggagccaagcgaggggacaatgcagcaaggtgcaggaggggcctggaagcgaggctgcaaggaggaggggcgtggcagtcacagggaggctgatttataaggcgcagaggctgagggtggccaggcccagggaggaacttgagcaaaggcgtggaggggatgcctgggggagaggctagaacccgaggggagactgggtggacacgtgagccatagtcaggtgatgtggagacggggccagtagatgtgattgactggggtgagggtgaaggagaaaccaaggaagctttgaagaggggctgagaaaaggaggatgaccatggggccttcagaggggctgcttgggagtcttctcttgaaggcctttgatttgaggagcttggggtttgggctcagcaggacccccaagcggttgttctggatgaagagacggatgtatgggtagaggtcatgaagccaggggaggtgagcttctcctaccaccacccccacccttacaaaaggagggcaggaaacgaaggatggagctcagggggcaccttgggatggtggagggagccagaggtggacagagatgatgaggaagtgtggaggtgggggcgggtgtgtccttgtgaatctggaggagaggagtgctggaaggacattgcattagtttcttgtggctgccttcaccaagtaccacaaactgggtagctgaaaagcaaggctctagggaataacatttccttgctgctgctttggcattttttggctcatggcagcatcactgcagtctgtggctctgtcttcacgcagcctctgcctgtgtgtctgtgtgtccttccctcttttcccgtatactgtggattgaggggtcattcctcctccagtaggatctcctcttaactaagcatgtctgcaaagaccctatgtccagataagtcacatcctgaggttctgggtagacatgaattttgggggcatgaattcagccccctctagacggggtagcatgcagtgtctggattgtgaggaacaagaccaggccttggttacaggtgggctgcgaggaggacgctgaggacccttagaggaaatgtttccccagggcagccgggagggacacggctttggcagtggcaacatggactacattttcaaggagtgtggagtgaaggggaggaggggcctggttcctggaggcagcaaagttaaagtagtttttttttctttacccaaagggagacctaagagagtctcttggccagcagagaaaggaacaagcagcagtgagggaaagagaaaatgcaggcaagaaaggtgggattcatggtgtgagtctccaggaagtcagcttaggctggaggaagagccctttttgcggagtggaaaggaggtgtgctccagaaagccttgcacacactgcaaggaggaaggcggggaagctcattccagaagacaggaactttgctcatcgtccagcagggattcctgaggaggtgtgagaaaggattgaaggctggggagagccccggggtgctcagagagcaagatttacagtgagcccaggcctggagctgtcatgagaggccaaaggagggacggttgcatgcaagggtcagatggggaccctcttccttagggtggccacagtggcttcgtctgtctggccagcattttccagagcttacctgtctgattctgaccccagatttgtccttcccttgggcctctggcctccccttcagcctggctgcatctagcctcctgcctggcccctggaacaggcattgccccccttccctgcccagccagccctcccagctggtccctgcccttggccacacacccattatctttcctgagccagtgctccaaacacagggccttggaacttgcagaaaggttaccagccccaccccttatggggacatctgccctctgctcacctcattttgctcaggaatgatctgggctgatgcccagggcaagggcacctcccctgcaatatcccaggccgcagaactcagctatccgaaagcggcaagtttgcaatggcaaactattcttggctccaacctgctcgctgctgctaatttcatgcccctgtgatccaggtaacgctctgctgccttgagctgccacccccaggcttgaatcgcttttcctcgcccgcccggtaggagcccagctgcctctgctgctgcttcctggaggtgggggctgcacaaagctgcctcgcagaagccactcagcagcacggacactgagtctgccgcagctcgtgactaatttgctgcacttatttcaaagtgcccaaatggcattcagggaagagaaagcttaaccagggtctgccagagataaacgggctcatttcggggcctccctgcccgaagaaacctctttacctggactctgagcctggaattgaattcttccagaagagacccttagcacggagcctctcagtgtggcggaggagaggaaatgtggcccgtcataaaatgggcctcacatctggccagctggctctggtgggcttttaaattgtgtttgaagagcatctctcccctttcctggtgttcgcaaactgggtcagtgtagcaaatggaaatgagtttccttctcaccatagcgagcaactcaagtgcccccctgcccaggccagcagtggctcatccacattcacccaccatatgggggtaccctggcgcctggcacccctgggccagggcctgtccacagtctgggtgaggaacccccatgcccaccctgggccagtctgggtgaggcccccatgcccactctggggctctttgcaggggttgcagagtaaggcgagagcttggaagcctgccccatgctgcccacccacagacactctttaacatggtctttgcttagctgccaaccatgtccgtcaattttgggtaactgacagaggtgggggcttttctcttaatctttttcttttcttttctttttaaaactacgaagacccataggcctctggaaatgctgaggggaatgggcggtgggatttgagagaaaagattagctaatgtattcctttactcttgtctaccactgcagaaagaggagaaagaaatcaaaccctggccgggcaccatggctcagcacctgtaatcccaacactttgggaggtcaaagcaggtggatcacctgaggtcgggagctcaagaccatcctggctaacatggtgaaacactgtctctactaaaaatacaaaattagctgcgtgtggtattgtacgcctgtaatcccagctactcgggaggctgaggtgggagaattgcttgaacccaggaggcggaggttgcagtcagccaggatcatgccactgcactccagcctgagcgacagagcgagactctgtctcgaaaaaaaagaaaaaaaaatcaaactctgtcatttgctggcttgggcaggtcacctgcaccttagggccaggtagaagaaagacactgccctccctgagaggaacgtgtctcacattcctgcttgctgctggaaggcatgtggctgccaggcccagcatctgaggcttcctggtgatgcaccgcgaccccagtgatagtgtttgggcttgtgcctccaggagacagacaacctcagctagagcagcttatacatttgtagggggatgataaatatgtctccacccggtctctgccctgctctgcagcaaaagatgctgccaccagcactcccaatgtggacctctgtgtacctctgggaaattcctctacctctgtgagcctcaggctgcttatctgtaaaatgagagcgattccagccctgcctcgccctcactggctgtggtaagagcacatgggctggggtgtgtgcaggccctctggaagctgtgctgcttgcatgtcagagttccctggcattctgcagagctcccacttccccacctgggttaactgactttgatgcgattacttagagactggatgttgagtcccacaccctgcctgagctccaggtcattgcagggtgcagataacgctagggagatagtggtgcgcagggagatcagatctcacattcagggagcacagctatccctctgttcctcagagctgggcctctcccacgtgggtttgagaattcagaggtgactgatgggcctctctgccattagcgctctgggggttgagtgccttggctgcttgaggttctgccagccctcctgtggatgggatggacaacacagtgtggtttgcttcagctcaggaggggctgttggtgctaaggaagcctcaggttgctttcaacagatgagctgcgctggcatcctcactggtggggaagcatcccttcatgcttttgtgccagccgttctgtcctgttgggaatgtttctctccccactggcacccatacctgccatatctgtctgacatgcttcccccaatctttccagctgccgtccaagatggccctggtggaaaccccccagagcccctccttccatgccccccaacactttgtatctgttgtactccagctccaggcttgcgtccacctccccgagggcacgcaggtgccacagctcctccgttgtatccacccagccaccagcacagcactggcacacgggcttgacacctcttcagcaaacaaagggacaggtcaaaacaggaagaggtgctgacctgcacagaagtggctgcccagccagggctgagcaccatgagattactaaccagcctaagggtctcctgcccagggccctcctgctggggcagagaaacttgcttgggaggcctgtcacctcctaatgtctttgccctgcatccacctgcgttccagccctgccttcttgctgagtcatacccagcctttcacctctggttctataaggcccacattgacccccaggcctccaggcttttagtcagctatgtaaacagagctgctgtggcataattctgagtggcgccattcctatcacaagcctacaggtctggtgcccctggagttgtgcaaagttcaacctccaccatcatacacagtggccccactgccagctccctgacgatcttctcatcccccaactcctctatggctggagctggcctttgggtccatgtgctcatctctagaagtggagttggttgtaggggtagaacaaatcaaaacagacttttgagggagctctcaggaatcaggccccagtggaggtgaactctgtgaacgatccccaaacactgctgtacataaaatcccccattcattagatggatggattgctttgggggcagtcttgttaccatcctagtcacagtgagtttggagctgtattcaaatgttttcacatttccgtaagtaaaatgggagaagatagccccaacacctcttggaagcaaatgagatgaacccaggagggacatgccagctgcctggctacaaagtaaataatcaagagtggaacgtagaccttcgccgctggtttcttaggaaggcagtgctggtgggaatactccatcagggagtgcggtccagggaagtaagagggagggaaagggaagtagggctgggacacagagagcaaacacaatgggcgatggtattttggagcggccacagctttgcagcagcacacacggaacaccttggaaaagtcttgtggagccaccacgttcagagcagccagtctggggagaggagaggcgggcgaacgatctgtgggctccttccagctcctgcctctcattggttaaagtgggtctcacggggcttgactcccccatcctcaggggagcgtcccccacccctctcacagccactggtgcagcctagcagggcgtggggtctctctgtgggggtcagctcctcctttggtggcagtggtggcagcagtggcagtgattttatgaccatgggaccaatggctgtggacaggggaccaaggtgagttacctgaggggcaggcagggtaagtccgtctggagcaacatccactaagtccgtttcttgaaatcagcacatgccacctgcaaaaaccctaatttcagcagagggtttggtggggaagggctgcagggactggtgtgctaaccctctgtgcccctcatgggtgagcacactgctcctcctgtctcttggggggtcaaagaaaggaacatgatcaactgtcctggttttcttcaaggaactgaatttaaattgaaacaggaaggctgaaatattcaggaaaaccctgattagtaggaacccagctatcggaaaccctcatgaattaggaatctatctctgcctagcaaaatactacaaatgagtggcttaaaacaacctggatttataattacagggtttctgtgggccagaagtccaggcacagcttagctgggtctcctgcctgaatttgcacaaggctgcaatcagtcagccagagctacagtctcctctgaggcttagctggagaaaggtcacttccaagcccactccagttgttggcagaattcagttcctagtggttgtaggcctgagagcttcagtttcttgtggggagagggctggagaccgccctcagcaacttggggttccatgccaggtagggttccccaacatggccacttgcctccccaaatctggcaagggaggaaaagagtccagcaatgtgggtgctacagtcctatgtaacacctcatgtttgctctactctctcggttggaagcagccacaggtctcatccacactcaggggagggcatcgcacaggtgtgagcatcaggaggcacggatcacgggccaccttagagtctgccaccacacctcattttagaacttttcctataggcaaaagcagcaaataattgaatacaacccaccatgtgtttctatcaggaattaagtggtttgtttttataaattctgtgggatgtgctgagtcaactcctgtcaccatgtgcatctccatctcctgatctgtgctcatggaatgatggcctggcctcaagtctgttctctgagttctttgtaaggcagagaaatgggcccagacaacagaaagagactcagagtcttatccagtggtcaatatccaaaaagcttttcaacattaaatgataccttttactgcttcaatatcaacaaacaggcacattcagttacctgaaaaattctcattcagggaacctgagcctgctcgaagaaacaaaatcatcagagattctgcattacacagatcgagcagccactggatgaaggggcctcaccggggcttgggctgggggcagacgcagccccatctgcagccctctcctcctaagggcctctctccttcattctactcagtgtcctcccagcctcagaggcccagccactgtgtcaagatgtaattgactgagtgcccccgaccagtccaggctctactgagcccatcagggcaggaacaatgaggtgcagctcaaaggctatttctcaggctcatggttgacggacctcactagctgcgattatcattttaattgcaaggccaccacagccttatattcagggtacagatttcaaagaccacaaagcactctgcaggcttcaaagggaactatggaaggcttgtgcttcagactcaaaggggcccatgacatctttctttctgttattttttagagatggggtctcactctgttgcccaggctaaagtgcagtggtttactcactgcagcctcgaactccttgctccagcaatccccctgcctcagccttctgagtagctgggacttacaggtgcataccaccatgcccgactaatttttttattttttgtagagacagagtctcactatttgcccagggtggtctcctgggttcaagccatcctcccaccttggcctcccaaaatgctgggattacaagtatgagtcaccatgcccagccttgttttgtttttaaagataggtatattaagagataatgcacacatagtacagtccatcctaatgactggacattctttgagttttcacagacacatacagctgccacacagctgctttagctgtgagttccagcacatcataatcaggcaattcatctgtctgtgtttgcacagttctttgtcacacccctgagctgctgccagaaaatgccctttttcctcattctgtgcaatctaggagctacttccccaaatggctttgaccttctgtagctgctctatcaagagagaaaatccagagtgagaacagagtttccctgtagggagcagggcctcttgtatatctaagaggtcactttgtggcaagaaagcgagaatgtggttgggtcacaagaaaacccaagcgagcggtgcctcatgcctgtaataccagcactttgcggggccaaggcgagaggatcacttgagctcaggagtttgagaccagcctgggcaacatagcaagacctcgtctctactaaaaacttaaaaacaaaaacgtggatagtcttgcattttggtgataggccaagaaggctgataggtcaaacttttcttttcagacataacactgagttctgtccccatggcctcagtccatgggcagaagtgtgggctgcacagcaccaagggcctcactggggacaggaacgacttatccttcctatgcctctagcacttagtacagctgacattggcagctatttgttgagtggctgagtgagcggtcttaggctggagatggggtggggccttgtttggaggtgggctcacccacggctcctgggtgtctgaagacagtggggagaagccccacagagaggggccctgtctctgctcgcgtggaactgctcacctccatccctgagtgaccgcagcacctcctcacttgtgtgcttgcagaactactttgagagctaccttgccgttgcctccaccgtgccctccatgctgtgcctggtggccaacttcctgcttgtcaacaggtaggcgactctcttccctctctcaggcctctgccttggtctcctgcctcctctactcccctcttgcctgcagctgctttttttctgcctacttaagtggtggtcaccaaagtaggatgcagcagctcagatttatgcatgaagagtgagaagtcagatcagatccctggtgatgcccccagggagctgggctgtcactctccagccacatactgtgacatcgctgtgacattgtggcagcagccagtgggaagtgtgtggggatgcaggggtcttcctcccttctcttctcagggatcctgtcagtctgcaagtctgtggcccagaatgggtcacctgactgttcagtgctaagctggtaacaccagctcctgtgtcaaccactcccaagagggctcacgggggaagttccaacattgtaatggtaagggccacgagaggctccatctggatatgcctgggaaggagttattcaggagctagctgggcaaattagcatgtccatagacccccgtgggtgacttgctggctcaaattctcaatttgagtttacaaagacaatagccctagctactttgcctgcatttctcctaagctgccactaaatgatatcaatggctatgttatggtcggtccagaaacctgggctgctgttcgccatggcctactaaaacctgaggtcactgatagcaaatctgttttgcccagttctaatcaatttgtagtgactgccagatctctagctggacaagattctaaggcaggtctggcttcagggagggtgctgggattgattagtgatgtctgctctgggtgcaagaggagagagggcaccacgagtgtcttttacatgctgagcctgaatagatcagtctttccaaacatattatgtcatggggatattgcagttatctgttacataatatgatcccaaagcatagtggcttaaaacaatacaagtcatgagtacttctcatgttctgggggttatcgaggttcagctgtcatactctctcctgcagttgcagtcagatggcagctggagctgcagccattcatatcccctctctctctctcttctctctttgtagtgtcacatgtcagcctcagggtaataggatggcttacccagtggctgagaacaagggagaggctgcgtggtttttacaacctggtcttggaagtcatgtgctgtcacttttgccacacttgactggtttgggcagtcacaaagcccccttcatttcaaggggacatagatcccacctcccaatggaatttgcacccttctccaaaccaaagtgcagtctggaagaatgagaaggagaggggcgttgcagcccctctcaccagccaactggccttcacaggcctcactcctgccttcgaagctagggccatagtcagtgtcctagcagagggggcacagcctgcggagaccgccaccccaggaggagagtagaggagggcagagcaggggtcccggctgcgcctcgcaggagagagggtgtgttgagagccagtgcaggcaggagcaggaggcgaggaagaggggagacagccgtggtggggggagcccttggctcacttatggttttatctgtctactcgctcagcccgcccagaggatgtggggctgtttgtccagcccagatagcctagagagagctcccagccccttccagttccagaatcaccatctgaactatagcaagagtgtaatgcctcgatcaccccttgtcatgtcccttaggctgcactgcaacccaggagggaggctgtgacattgcctcattttccaggtggaaatcaggagaccacaggggcaccatgggacagctgagtctgcctgttgcctcttcagtggtctggaggtcccacaggctgaaagtactcctgggccatgggtcaggagtggcagggaacgtccagcctctgggctgtgagagaatgctagccaattaacagtagcacttctgagcattatatcctgcagatgcattatctcttttaaccctcacggcagcctaagagctggaaactgctgtgaccctggtttgagatgggaaaacaggctcatggaggtgactggcccaagggaaggtggccattaaggatggagccaggcggagtgcagtggctcaaacctgtaatctcagcactttgggaggccaagtcaggaggattgcttgagcccaggagtttgagagaacgctgggcactatagcaagatactgtttctacaaaaataaatttttaaaaaattagcctggcacggtgacacatgcatgtagtcccagctactcagtaggctgaggcaggaggatcgcttgagccgaggagttcaagtctgcagtgagctatggtcacgtcactgcactccagccttggctagaatgaaagggaggagtcaggatttgaactgggaccttctcaccctacatctgtgcttggaacccctgagccacctacatcctagttccccagctttgcacccacccctgcccctgcaggcagaaccactcccaagatccttctagtgagagccctgtctctccgggattcaggctgctgcgatggaagggggtggttaagaagggctgggtctgtctccagtgagatgtgggcccccaggccagctaccctctgagattgggtcccggcagatggctcagcagttacaggacattctcagagggaattagcccacccctggcctgcccctgctcctcctaggctctaggagagggggcaagggcaatgcaggaacatcctctgaggcctccatctgtttccaggctgtgggaagatggtctggggctaagctgttttttatttaatgtgcgagattgaaaagtctccttttctcccctcctggagaaccgtggctttcccgactggcttatccataatcgccaagtgttttattatgttaaatctgcagcatcataaatacttatgaggaggatttacatcttggagacttatgaagaaatcataagtggggtcctgagccctcacgagtcagggagtcgggggaccggcaacctgggtactggaggcagcctctccaagagtcttcacaggactgagacctgccccagggtcttggtcttgaagctgtcctcttggccatgccctgtctccaagtagaaccccagacattacagcagctgaaagtctagactttcctaagaccctaagagcacgactgtcccctgggccactctcccttcctgggtggaagcagcagagagggaagccagtgtcctctgttcatgcctgtggaccaggcttgcagctggcacatttcatgaagcttgatgaatgttgaaaatagccctagagcccacggatggaggctctgggcaagagtggtttatgcagcagataattagcaggcgggaaggagacctgtgcgggtgaagggccatgtagggggacagaggaggggacagagcagcgttccacactgcatcgtttctggaatgcatttggtattgacctcctcctctctgattcctccccaactttcctgccctgggggtacctgagtaagcagtcccccagctctctgcaaaacaaccttcctgttcaaggaacttattaccttgtagcgacaggcacacaggagggctcccatgatgctgcaccattcctgctggactttttcctggccgtgtctgtgaggaggcagttagaggcagaggccattcccgaggctggcggatgcttccagctggacttcctgccatgctgaggcagcagggatcaagaagcagacagccgctgggaggttcagaccagcatgaaacctccccacccccgggtgctactgatctcccttgcttgtcaatttgtacatccagcaaatatttacccagtgcctgccaggccctgtgcctgtgctgggggagaacaaggcagggctctgcctttgcagcgcgcctcatctttccagcctggcctttgcctccttcttgccccaaggaactggttcaaacttcttggcatttgttcccaacctctctctccacttgaattttttcagatttagaatcattagctgttagggaccttaatattatcgggtctagctgcttctttttagagatgaagggactgaggcccagagaggttgaatatttgtcaggggttacacggagagccgatgacagagctgggcagggctccggtctcctgactcaggctccatgccctgctggcccttatcttgggagtgggtgggacagctccagctgctaggagagggtggggacactgtgtgacagagctgagtgtgtaggaccacctcgagcatcaggggtaagtcttgactgctggcctccagggcccctgctgtactcttacgatagatgctccgggccgccaagggtccaggtgtctacctggctgcccaacagctcctgtccaggccaaagcccctgcagaccttgagaagatgtgtgtcagtgtgaggtcttcatgggcatcttaatgcaaggttccccacaagcaggccctgaaacaaggattcaaatgcgagtagtttatctgggaggtgaaggtgggagagtatggaatggggacaggaaagggaaggcagtcagcagaggatgccttatcaagtcagctccttcaggagggacaagaacacagtcctgctggggatcttggagagccagtgtggagcatggctgagcaggagggagctggggtatttatgtaccaacttccctagtcattggttgaaggctgctcttaggaggtgttccttacctgtcactcccaggtaagtaacaccactcctggagttgtaaaagggagggcacatgggcaggacaccagcagcattgctgtagcttctgaccatatcattcccagcttgaaaccctgatgtacctctttgcgttagtgggtactttgagtacccacaataaaaggatgtcctctttaagtgaaaattaaaggcaggtccacctttaggcatctttggatctaggggatctcctctgcaccacccctgggctccgtgtgtctctgcatggcttttcctccatgtctagcctcgccctacgcaactggctagatggcagccagcagccccagacacagtctcggcagtgagcttctctccacggctcccatgtagcagtcccagggaagacttaaagatcctatgtgggtcacatgctaattcctaactcaaccccagggtctaggagcaggcaacactgactgccccaggctgcgtcacatgcctgttgtttgtggctgtgtgggtgtgggtgtgggcaacctggctgaccacctccccaggatgactaggcgaaggaatgttctcccagggaacattgtgctggcagacaaaggccccacaccccgccctcctccaggacatgagtccacgcctctccccagcatcacctctgtgctcctctgctcgcatcttgactacagccagagtccatttgcagctccctgaacatgcctcactctctctcccaagacacatgcacttatatcctcccattcgtcgttaccatccagcatagacattgcctccaaatggccttccacgatgcccagggtgggttttgtgcccctcagatgtgctgtgtgatgccctggggcctcctgatggagcacctaccacagtgagatgacatatctgttgctggtctgtcccgtgtcctgggcatccagcatagtactggacacacagtagttgctcaatgcacatttgcggaatgaccacaccattgagtacacatgttaacagactgagtgatgggctggggctcagcacacctgggttctcatcccagctccctacagactcactccacaaccttgaactgtcccttcatttcttgggcttcctcataccccttagaaagcagtgacagcacctgctctccctttagctgaggaccagagggaaactcaaattagcctggggccacaaaagcactttgaaaaaattcctttcttgcttttcttgctcatcatttcacacctacgtgtgtgtgtgtgtgtgtgtgtgtgtgtgtgtgtgtatttttcctacctttcaagtttttctttttttaattaaaaaaaagtatgtaatctggcttttctcccagccccctcccactggttagcaggaaaattaactacacatccaatccggtttaaagcttagtctaatctgatgatttaagcagccccttgagatgatgttcttgcttcctagaataaaaatgtgcagcttctcagatagaatccttccctgcttttctccccaggccagtatgggggctgggaagagtacatggctcatatgcaggcatggtgctggggagtgtgggggttcccttggccccaggcagcactaacttggcatcacctgctccccatgatgactgaggccatcacaggaggatgcccctgccctggccaccacttctgtgccatccatatttcctcactccaggggaggcagtagagcatcattctgagaactgaccagagccaggcctcctgggttcattgctgagtgactttgagctagttcctcagcctctctgatgtcagcttccttatctgtatacatgggataggtacgaatacctgtcttacagaaccggtgtaacaatcaaacacactggcatacagaaaatgcctagaagagtgctagaaaagtatgcattaaacactgtttgagtgtttgctatggcgacgatgatgatgaagatgacgacgatgattttctttccttcttccctttgcccccaaacctcctgctaagttttggggaaaggaagctcagtgggtggctgctctgtttaaacactagacaaagccagcaggagctcagccctgtggcaggaagagcaggggtttgccttgaacatcctggtgtcctcgtgtccttgaacctcacagcaaggtgaaaagcagcagaacccactgagcgctggccctgagccaggcactgccgcttgcaccccacactgctcacctcttcagcctcacccccctgtgagttgaatcaactctccccattgtacaagttcaaaagctgaaaccagagcaactgagtcccttacccaaggccacacagctagggagccgggaaggcaggattcgagtgcaggcctcttgactgcagagtgaacagtcctaactgctaagctcgcctgcttcccttaaggtggctcaccagccccagcccacacaggagccccgaaggggtgtctaactgcttctggcatcctcgccccagggttgcagtccacatccgtgtcctggcctcactgacggtcatcctggccatcttcatggtgataactgcactggtgaaggtggacacttcctcctggacccgtggcttttttgcggtcaccattgtctgcatggtgatcctcagcggtgcctccactgtcttcagcagcagcatctacggcatgaccggctcctttcctatgaggaactcccaggcactgatatcaggtgagagccagggtccgggcagctgaccaggttcatccacccaggagtcatgggagggagccagagatgagcatgtggtggccttttctgaaaaggaaatggcatgggtgctgattgtgtttcagtcatctagtgttgtagaacaacaacggtcatttctactactcacaaatttgcagcttggacaggagtttgcaggtgtagctcttctcttctccccatggcatcagccagcatagctcgacggggagcggaggatccagttccaggtggcacgccctcctggctggcgtgttgatagtggctgctggctggaagcttagccagggctgggctggggccagggacttccgttcctctctatgtggacctcaaatggcaactttgacttcctcatggcatggtgtctgggttgcaaaagccggcatttcaggagatccaggcagaagctttatttctgatttagcaaaagaagccacatagggtcagttctgccatagccataagctcacccagactcaagacagatggacccacctctgggagagtatgaaagtctcccaccgtgactgtgagaaggtaggcaggaggggagacagagtcgcagctatttttggataacatggtctgcctacaaaaggcaattcctgaaaccagccttcctccctttccttccctccttctcctattcctctcctatttttccttttccttatctttcttccccttcttgtctcctttccttccttctgtcttttcttcctttctgattttatagaggacctgctatgtcctggggatgcaaagatgaacaagcaccagtcccctcggagctgatggctcagtgaataaactctcacccccagcacccccaagctttggtatcccgtgggtatgcctgtgcacgacgtgggccgacccctctagctgatgtttgatgctgatgttgatgagcctgttccggaggccttggcacttttgttctctaagctggagacacacacatctctcacccagatgacccagccaggtaaaaaggagcgggtcaggaaccattggtgctttgccaggaggccacagtccctgggagcaagactggaggttctgctgctgtgtctgcccttccacatgcccctgttatgcagaggagagctctaaacatttgcccactgacagcaatttcacaaggaacctgtgctgtgccccttagttaataatgccaggaagcatgtggccaggatgacaatactttgacaagggtatgtcccttccccactcgagccagtgccagacatcactggtggatctctatctttcatcctgagcttctaaatccttctcagcgcagcacttgaggcagttactctcagcagatcagagtctagatgtgagcttcaatctgtttgccatttctgagatcagattaggcttctggctgtatcctgggaaacacttgggcctaagataaaataaaaatggacttgttgctaagtttcctgggtgcaggcaacatgcatcagcgatgctttcaaacgggcatttctggactgaaggcagtggccactggacatgggatttaattccttctgtcaccgccatctcagaaggaggctcttatccccttagttccttccatccttgctggcaggctctccaggagccagtgaccaaactcaccatttacattggcaagcggtcctcgggttaatctgtccacctgtgatcttctagggatggggagtctcctatggatttttcagaaagtccgttcagaaaagtggggaagtttagtacttctacgccagtattaatgaccctgagtctaaaccgtggtcaccactgtattgggccctcgtgggtgcccaacaccctggaaaatcaaggtgtcccagtcttccagaggccacaagaccacctcgccagccccacttgcttttttccagcacagcccgtctgtgaattccgcacgcgttggcatctgaggaacaattcatttgttttgcgctggtgtttttttaaacccctcatttgcatgtatttccataactgatgagataaaagtggagagtcatgaaggatgagctcccggaggcctggtttgttgttgatgataatattgtaaattctctacaagttggaaagagagagaggaaaatcagtaggcagtgatgttaagatctcctccttggggcagctggggagtgtcttactgagtttaaccccagttcttgcaaaatgtctaggcggggattacagcttctcagaagtgggcatcctcttggcaaagggtttacccgttgttgctgctttgatgtgggaagcacagaaatagccaagcacctaactgggaatcagaaaggatttgtttggtatttggcacttctccgcaccaggcaggcttctgagtgcttcacgtgtaataatccttttaatcttcatcacagccctacgaggtgggtattattaacacccccattgtatagatgaggatacagaggcacagtgaggttaagggacttgctgaaggtcacacaactagaagaagtagagccaggtttggactcggatgttttgattctggagtctgagttcctaattacagtgctaatttttatacctttgccctccctcaagtactacccaggctaatagaacttatggtggagaggctggggaaaggatcctccgtcagaccaagggctattctctgtagagccatagaggccacaggcagagcatggggagccgtgatggtgcgcacggtggacggggcctgactgtcccccttcccctctgcttcgtgcaatagtgggcaggaaagtggtgctgtgtaagagctgcctgatggagacagagcaggccatgcccacacggacccagccttcttcccacctcttcaggaatggacattctgatcctctgaagtgggcaggttcatcccgccagtcaacccagctcatccatcaggcccttcccgcattgatggtgatggtgttggccttgttgtcagtgcttttccactcatcgtcctgtttccacctcactacggtcacctgtgatgaacaggacaagtgttagccccactttccaggcaaataaacacaggcagggaagaaagtaagtgatcagcccacgctggtgccagtgttcccaagcaatgctgcacacagaccttctgactcatggccagcacaggaagatgacccatggctgtgagggttcgaaggaacagaaagacatgtctgctgcctcccagaagcaacaatgcagtcgtggcgaggcagggcatagcgtttgttgaagtctactgtgtgccaggccctttgtgaacatctcagtcagtcctcaaagcaacacacagggcaggggttgttattcccattctataagcgagcaaactgtaaagtcagagaagccacgttacccctagggtcccagctagcaagtagcagagtccagggtgacacgtccatccgcctgactcctagccccgttggcacccgagtaggtcgtgtggcctcctctgttaggtagcagtgaaaggtgtggcagccacacggtctcacaggtaatgtgtgtcaaagccattggcaaggagaacattccatgtggtggggtggttgcgtgcttgtgtgtgcatgtaggtgtatgactgtgtgtgtgagtgttgtatgtgttacacatgcattcacatgtgcatggtgccacagccgccttggggtacacagtaggttctgtgagctcatgggtgggcaatggtgggggtttatagccagtgaggacacccccagaaagggtggcctctgggcagcaggggaccctatgtgaggacagtccctgagcctccttcccagtttggttggtgggtactttgggccgggggcagagaagaggaaatccagaggtctctggcacttcctgcccctaaatctaaaatttcagcccccactagaagggcaataaagagagatggaggttgagggtcagaggtgaaacaggaaaggcagaggactggtggtcccctgaaggccatgtgccacctcaggcagcagcctcttacaagtccagcagagggaggggaaaatgacccccttggaaactcaggaaatgctggaaatgcttggctgctgggccctccctgtctctgaggcttcaggacactgagagagctttggcatttttcgcacggaggaatttttattttggtttgtgaaacccaagcagggaggggcccgcagccactcctcctcgcccacccctcaccatctctgcgtgtcctctgttctctgcaggaggagccatgggcgggacggtcagcgccgtggcctcattggtggacttggctgcatccagtgatgtgaggaacagcgccctggccttcttcctgacggccactgtcttcctcgtgctctgcatgggactctacctgctgctgtccaggctggagtatgccaggtgaaggtgccactcactgtccatgcctccttcctgtgtatccagttatagccatgcttctttttctcagcagcttctatgctggcttctttgtctaggtgctatggctcaaagcagttgttcaacaaataggcttggctggtggacgtgagaggctggctctgtgccacagtcaagcagttggagcctcaagtttaatcatggtgaataatagttcacactggtgaaacacaaccccttattccagcgctgtgttcctgcgagcttgatgtgtcctacctcatacaatgctcacacctctatccaggcaccgtggagcacacctgtaatcccagcactttgggaggccaaggcagtggatcgcttgagcccaggagttcaagacccattctgggcaacacagtgagaccctgtctctacaaaaaataaaaaattagctgggcatggccgcatgtgcctctagtcccagctactcaggaggctgaagtgggaggatcacttgagcccaggagttggaggctgcagtgagctgactgcactactgcaattccagcctgggtgacggcaagaccctgtctctctgaaaatgaacaaacaaacaaaagacaaactcacactcccctgttcctcttagagtacagtactattattattttttattattcccatgcacagattagaaaaccagggttcagagagattaaattgctgttgttttagtagagacagggtttcactctgcaggccaggctggagtgcagggatgcaatcgtggcctgctgcagccttgacctcctgggctcaagctgtccttccacctcagcctcccaaatagctgggactccaggtgtgccaccacacccagctattttttaaaaaagtttttgtaggccaggcacggtggctcacgcctgtaatcccagcactttgggaggccaaggcaggccggatcatcaggtcaggagatcgagaccatcctggctaacacagtgaaaccccatctctactaaaaatacaaaaaattagccgggcatggtggcgggtgcctgtagtcccagctactcgggcggctgaggcaagagaatggtgtgaacctgggagacggagcttgcagtgagctgagatcgcacccctgcactccagcctgggcgacagagcaagcctccatctcaaaaaaaaaaagcttgtatagagacagagtctcactatgttgcccagggtggtcttgaactcctgtgctcaagtgatcctcctgcctcagcctcccaaagtgctaggattacaggcatgagccaccatgcccagcacaaagaggttaaattattacttgcctgaatctcagagccagtaggcagtagagccaggcaggattttaagatgactccaaacctgtgcttggacaacttgctgccttatggggctcctttccacctctaggacctgttttcttgtctcgagtcttactcttgctttctgtctccagttcctccttttgctttcttgctgcctgctgctttttataaaaacaacgcttgtctttctctcgtgttttattcttttcaaagcattttcctatccactatcttatttgatgtaggaaaggcaggagttatccccatttaacaggtgaggaaactgagaccaagagaaggctaagtgaagtgccaggtgcgttagccagcagagctggggagagatctgcccctgatgcggccctgttccacaggaagctattttttgcagtggcacaaagctaagcagtttatgtgtatatttttgtttatgatttatgacaatctgtgcagctgtgatcgtattttctcacttgagagctggggaaactgaagctttggagagttcacaagcatgccccaggtcactcatctggtgagtcacggcaggactggagctgtttctggagtagcctctccccaccggatcatgctgcatccctggctcgcaactgcaagggccttatctcatcattcattctccctgtcctcatgaggagagtcacttcgttaacccctagaacccccagcctttcagcagaacagcgattccccctgggctggtagtgagccactttccccagctaaaggattcttcaccgcttcagcagtcctcagggttctgaggataggagggggctgatctgcttgagctatgcagtatcccaggcacctacagacccctgggctgcccagtcctccccgccccttcagggctgtcatcagaaattgcctagctgtggctccaggctgacgtccccgtgcttcctgtgccctggctggctctccatcccccagcatcctgtacactgcctggcacctcagcgttgtgccttaaatgattctccagccactgaatgaacagaggaacaggagggtcgccccactccttgtgttgtttgctcgtgtcctgtttctggtgctttgggtgggtctgtttccagcagggtagccaaccttccttgcttgcctagagccaaaggagctcccaggacaagggactgtaagtattaaaaccaggacaatttcaggcaaaccaggatggttggtcagcctagctcctagtctcatttgggcaggccagagtcccttccagctgagcatgtgagacagagaacacccaggaccatgctatcctgtagacgcttctatttctttttctttttctttttttgtgatggagtctcactctgtcgcccaggttggagtgcagtggcacaatcacggctcacggcagcctttatctccagggctcaagcgatcctcaagttagcctcccgagtagctgggacaacaggcatgggctgccacgcccagctaatttttgtattttttgtagagacagagtttcaccgtgttggccaggctggtctcaaactcctgacctcaagtgatccacccgcctcagcctcccaaagtgctgggattgattacaggcacgagccactgtgcctggaccgaagcttctgtttctttgctgattaaaactagggtctggatctgtgggctcacagacacttctctaaggatggggctcatggagagagctgtgctcccaggtctgcttggactaaatcttcctgaaaaggcaagctcgcccgtcctacatttgggagagtgaggcgatgcaggaaaatttggaagaacttaggaggaagagctgcgaccagaggaacttggtggggaatttcctgagagcagacttaaggcaaggacctgacgacgctgaatagaggggaagtaagaatattcctttccgtagatagcgattgtgaaaccagacagggcttttggctgaagcaccccgttcaccgtcactgaagagtgattctggattctggggacgggccctcccacacacccactcacccacatgggtgttatctgcaggtcctcagggtgggaggactgactggggcttcaaaacttcttggctgtttgaaacctccattttacagaggaggaagcaggcccagagaggggtgtgcctggcccaagatcacacagggaggcagagacaaggctgaaaccagaaccaagttactgcttacacacacacccctacaccaactccctctgtttgagctgcattaatacagtcagcctgtgtctcctggttttcagatacctgggacccagagaggttgagtggctcaggcaaggtcacacagtaagggaaagtgatctaagctttcttattggtcagagtgcagaagttggaaagattaatgatattcagtgttgaggataaggaagacacttctataggctgcttctcagttctttcaacagttatgtgttgaagggctactccgtgcctgaagatttagctggaaacagtcaaatgtggtccttgctccaggaacctgtcttcttcttctttttttttttttttttttttttttttgagacggaatcttactctgtcacctaggctggagtgcagtgatgcggtcttggctcactgcaatgtccatctcccgagtttaggtgattctcctgcctcagcctcctgagtagctgggactacagttgcacaccaccatgcctggctaatttttgtatttttagtagaggtggggtttcaccattgggtcaggctggtcttgaactcctaacctcaagtgacccgcccgccttggcctcccaaagtgctgggattacaaggatgacaagaacctgtcttctaccgaaggagacacatgataaacaagtaaaccaatgcaattactgtagattgtggttagttcttttgaaggaactaaacaggtgcctctggtagagatgaacagggcaagttacttcagttagggtgggtaaatggtgctgggcagagttaaactggtagtacctattaggagagcagtttatcagtagctatcaaaatgttaaaggtataaaccttttaatccagtaatttcctcttctagaaatctgccctaccaaaatactagtatacatgtgcaaggatttatgtgtagggatattcattgcaacattgtctgtagtaatgaaaagtcgaggcaacctaagtgtccatcagtagaggagcagttaaattgtacatccatccggtgaaccatcatagagtaacataagggagacataggccacatgttcctgtgtagaaggatggccacaagatactgttctttatgcaattttatgtattcatttatgtttcacagttatgcatgatttaggcagttagtataaggcatttatatatattatttacagatattgtatttaggcattacactgttgcagaaagttttacaatatgtatggcttgaccccactcttgcttaagaaatgtaactgtgtgagtgttgtttgtgtgtgcatggaacagtatgtaccagattggtttttctgttttgttttgttttgttttgttttgttgagacagggtctcgctctgttatccaggctggagtgtggtagtgtgatcatagctcactatattgaacaactgggctcaagcaatcctcctgcctcagcctccccagtagctgggactatgggcatataccaccacacctggctaatttcttttattttacaattattattatcgtcatttttgtagagacagagtttcacttggttgtgcaggctgatgttgaactctggggctcaagcaatccttctgcctctatctcccaaagtattgggattataggcgtgagccatcatgcccggcctagaatgttaacagccagtaccactaaggagtgaaatcagaagtgggaagaggtcagagtcccctttctattaatactatatcatttattttctgtattatttgggtttgttgtatcaagcttgcattccttttatcattttagaaatctgcatttttaatactattttacctctactctcctaaaatataacaaaaacaggtgagccaggacaggggcccagactcaccatgcagtggtcagtcctggtttcctctgtccctgctcatggcatggccaccgcgctggcaggcaggccagggacaacgcaggccttcccctggccaccccgtgacagcatctgtcatctcagggaacgctggagctgtgggcatacggggcttgggctctccatgctgggctggaaggttctgttctgagtgcccacccctggctgtgctgactcagatcccaagcaacctgcttgatggtggccctgtctcctccctgcaggtactacatgaggcctgttcttgcggcccatgtgttttctggtgaagaggagcttccccaggactccctcagtgccccttcggtggcctccagattcattgattcccacacaccccctctccgccccatcctgaagaagacggccagcctgggcttctgtgtcacctacgtcttcttcatcaccagcctcatctaccccgccatctgcaccaacatcgagtccctcaacaagggttcgggctcactgtggaccaccaagtttttcatccccctcactaccttcctcctgtacaactttgctgacctatgtggccggcagctcaccgcctggatccaggtgccagggcccaatagcaaggcgctcccagggttcgtgctcctccggacctgcctcatccccctcttcgtgctctgtaactaccagccccgcgtccacctgaagactgtggtcttccagtccgatgtgtaccccgcactcctcagctccctgctggggctcagcaacggctacctcagcaccctggccctcctctacgggcctaagattgtgcccagggagctggctgaggccacgggagtggtgatgtccttttatgtgtgcttgggcttaacactgggctcagcctgctctaccctcctggtgcacctcatctagaagggaggacacaaggacattggtgcttcagagcctttgaagatgagaagagagtgcaggagggctgggggccatggaggaaaggcctaaagtttcacttggggacagagagcagagcacactcgggcctcatccctcccaagatgccagtgagccacgtccatgcccattccgtgcaaggcagatattccagtcatattaacagaacactcctgagacagttgaagaagaaatagcacaaatcaggggtactcccttcacagctgatggttaacattccaccttctttctagcccttcaaagatgctgccagtgttcgccctagagttattacaaagccagtgccaaaacccagccatgggctctttgcaacctcccagctgcgctcattccagctgacagcgagatgcaagcaaatgctcagctctccttaccctgaaggggtctccctggaatggaagtcccctggcatggtcagtcctcaggcccaagactcaagtgtgcacagacccctgtgttctgtgggtgaacaactgcccactaaccagactggaaaacccagaaagatgggccttccatgaatgcttcattccagagggaccagagggcctccctgtgcaagggatcaagcatgtctggcctgggttttcaaaaaaagagggatcctcatgacctggtggtctatggcctgggtcaagatgagggtctttcagtgttcctgtttacaacatgtcaaagccattggttcaagggcgtaataaatacttgcgtattcaatgtaa

SEQ ID NO: 2758 - DNA, 44138 bp, Homo sapiens; identical to SEQ ID NO: 2757
  source 1..44138: mol_type = genomic DNA

SEQ ID NO: 2759 - DNA, 44138 bp, Homo sapiens; identical to SEQ ID NO: 2757
  source 1..44138: mol_type = genomic DNA

SEQ ID NO: 2760 - DNA, 44138 bp, Homo sapiens; identical to SEQ ID NO: 2757
  source 1..44138: mol_type = genomic DNA

SEQ ID NO: 2761 - DNA, 8945 bp, Homo sapiens
  source 1..8945: mol_type = genomic DNA
tccccgcacgcacttctggaagtgcaagccggtagcgcggcgggccagggatacagccaagtcccgggacgtgccagctgcggtaactgaagccgggtcccgggcgggcgggggtaccagggacaggagtagccttggaaagaggagagggcctcctcccacgaccgtccggatcaccgcctctccgccggcacccccggggcccatgccgcgaacaggccggcgaggctggcaaggtgcccgggcccggggcggaaagcaggaagtcgatcccgcgggcgcggcccagggtgcggcgctgcagatgcagcacggggtcgcggggcgggcgcccagtgcaccggaggaggtgagcgccaggtcgccttcgcggcccggggacacaggcagggacgcgggagctgatgcggctggaccggccggggaaacagtattttctggaaggggtaagagatgctgtcttgagcctttggaatctcggatccgggccgcccagaggacctcgacaggagcacagggaggacaaactgaagtccgagagaggcggcgtggcctccggcctcggggagcgctgccgggggtctcgggcttgggagagggcctgggggcggtgaaaatggggggaaaggaggggaccacaacattgttatggaagagtgagctcggattggcagagggacgcggggctgcaacgcgagtctccggaggtggaggggtccaggctgatgtagcgccgcccgggtcctgggtcggggttccgggaagtggacctgcgagccaagcctagccaagtcgggggacggaggctccggggcggacggagctgagggtgggcaggcgaggttgatggagcccttccaggaagcagggcgaggctcaagcacccagaaaaacctgtggctgccgaggtcccccgccagcagcgggcagcggagcgcaggggcggggctggggactggcgaactccgcctctctggggctgtcgctttaagggcaaggcggggcgtgcgggccctttaaggccacgtgggggcgtgtcaggaagtgagtccagggcccgcctcccggggagtcggcctcggatgtccggaggctcctgggctgagccggcgacagagcccgggaaggcagcgagacgtgggcgccggcccagccccctcccgcgtccttcagccccaagccccgagcccctctgacccttccgcagccctccctccagccgcgcccggcctccggcagctccctgtacgcctccctccccctgcccgcccctccctcccacagccgcccatgacgccctctcggcacctcttcccactctgccacgcgtccttttcctgcaccttcgccccgcgtacctactcctgccccgccctgccattcctctcccctcccttctctctgcgacccctccctgttaggccccagcctcttctcccctcacaggtcttctctgtcctggcctcaccgccttatcctattcctctcccttgccctgtgtcttgtctcagagccccctcggggtgggagtaggttgtggagcagcacaactgggctcaccccaaagcagaacttctcaatccatgaggacaatggggaggcctttaggccagcccacatgtgacaatggagggctgcggcttccttgcggagagcacaagtgagctcactgccctggactccagggaatcagagttctggccgcggggtgacccagctcctctgctaccatgaatagggcccctctgaagcggtccaggatcctgcacatggcgctgaccggggcctcagacccctctgcagaggcagaggccaacggggagaagccctttctgctgcgggcattgcagatcgcgctggtggtctccctctactgggtcacctccatctccatggtgttccttaataagtacctgctggacagcccctccctgcggctggacacccccatcttcgtcaccttctaccagtgcctggtgaccacgctgctgtgcaaaggcctcagcgctctggccgcctgctgccctggtgccgtggacttccccagcttgcgcctggacctcagggtggcccgcagcgtcctgcccctgtcggtggtcttcatcggcatgatcaccttcaataacctctgcctcaagtacgtcggtgtggccttctacaatgtgggccgctcactcaccaccgtcttcaacgtgctgctctcctacctgctgctcaagcagaccacctccttctatgccctgctcacctgcggtatcatcatcggtgagtggcagctggggccacgggggatagagtggtcatggggactgaagcagtgaagaacaactcttctaggcatcctaggacttcatctgtcccagctcctttggtgcagcagtcataggagaaagagcctgggggcacagagagagcaagtaacttactaaaggtcacccagcaagttaggagcccagccggggcaagaacaatagtaataataatagtaacaacagcagcaaaagcaactgacatttgttgagtgattaaaatgtgccaggcacatggatcttagccatattaactcagctaatcttcataacaagatgggattataatccacattttacagagggaaaaaccaaggcacagagaagttaactaacttgtccaagatcacccagctaataagtggcagagctgggatctgaactcaagcaatctggcttcacagttcacatgcccgaccactgtactttattgtttctcaagagctcaggtgtcctgatttcccagccagtgctcttagtagaggacaatacgtcttttaataaatataccatcactctctgccagctcaggatagcgcctgagacagtagcaagcaatatgctttgagaggcctcagctgtcttcctggacttgaccctcagaaaataataattattgatggggaaattatgctaattatttcacatatagcatctcctttgttctcccagagatcccctgggttgtggcatcactaccagcggtcatctctatacaaacaaggaaactgaggctcagagatgttacattacttgcccacggccacacagctagcaagcagccaggctgggatgcaaacccagattggccagactcccaggcctgtgcttctatcccctctgctcgtcttggaggttagaactgcagtattcaatgcagtagccattggccacttatttaaattagttaaaattaagcaaaatgttaaacattcacttcctcatttgcagatgttacaacctgattttctagccacatttcaagggctcagtagccaaatgtggctgagggctatggtatgggacagcacaggttagatgggcccatattttactgggccccatgctgcgttagagagcctccagcatcccattccctccgagtcttcccagggctgcgtcatctaggaatggggtcttcatttgaacctatgctggtttttcctggtgctataaagtttatcttatttggcctacatatcatattctttgctgatggctcagggtcccaggctagatgcaccggttggtgggggaagggacccatcccatgccacctgtcctagaaaatgtttccccttgttgagcagctgctggatctagggctgctgggtctaagtccaagaggggagaagggagaaggtcacagttagagtaggggaagctgcaagaccccccctgccagaactctcccagcctgcttccatttccctctccagggaacaggtgtacctcccctcctccctgtcctcctcagatgccccagggctctctacttcattcctgctgaccctgccaggagtggcctcaggggtagaggctcctagttggagaatttgcttgcaggaaggtgaagacactagggtaactgggcccaaatcccaaaggtaatccaagtaaccagtggtgaggttctgagaatggtgcattcacgggcgtgcctgactgggacaggggccagggaggtggacgctctctgccagcccaggacctggctccctatctgcaatgtttcctctttcttcctccttgtaggggaagacgagtctcaggcaactattctaggcctcccctcctagccccccatgtcacacagtaactttcaaagctccttctgggccaggcacagtggctcatgcctgtaatcccagcactttgggaggctgaggcaggtggatcacctgagatcagtagttcgagaccagcctggccaacatggtgaaaccctgtctctactaaaaatacaaaaaattagccgggcgtggtggcatgtgcctgtaatcccagctactcgggaggctgaggcaggataattgcttgaacccgggaggcagaagttgcattgagccaagatcgcgccactgcattccagcctgggcgacagagcaagacacagtctcaaaaaaaagttctttctgggcaagagtcgctctagaacattgatgttgcagttgcttctggactcagaaggtaaccaccaggagggctaggggtgctgtagccaagcaggtgagtgggtggtgcagccctctgcccccctcaccctacccccagcaggtctgtgggtaccccttgtgcaaaggttctgtcaagaaagaggagggtcgggctctgtggttgggctgggcatggtggctcatgcctgtaatcccagcacttggggaggctgaggcgggcagatcacctgaggtcaagagttcaagaccagcttggccaacatggtgaagccccctctctactgaaaatacaaaaattagccaggcatggtggcgcatccctgtaatcccagctactcaagaggctgaggcacgagaatcgcttgaacccaggaggcgaaggttgcagtgagccaagatcgcaccactgtactccagccagggtgacacagcgagactccgtctcaaaaaacaaagagaaaaagagaagagtgctgtgtgttgagtgcctatgatgtaggaagtatcctgtctcctttaatacaaccacctccataacaactttcattcattcattccacgactagtaattggtggctaaacacatgccaggcaccatgccaggctttggggatacaagtttggaaaaggtaacctcagctcctacactcctggagggcatggtggtgacagttacgctagcatagtaagggctgtgatggggcatgcataaaaggggctgtgggagctctgggcaagggaggggacccggggacagggcagtctaagcaggccttctggaggaagtttagaaactgggtttagaggaagaagtagggacagaacattctagatagaaggaagagcacgtgcacttcttcatggctgggccacagcaagactcaccagacacaaggctgcccagtcaggccgactccacgtggtgcaggtcctaagagctgtggtgagtgagtggaatttctcctgaaggcagtggagagccacagagaggcttcacaccagggcacagcctggaccgatctggacttcaggatgatcatatcagttgcaaggtggagagtagattggctggagtggaggacagggaggtgacccagagagctcagagtggttaagtaacttctcccaggccactcagcttctaaattgcagagcctgattggaggctaaatccctctgaccccaaaactttccccactgccccgtgttgccagatgctgtggcaggaagtataacatgcattgttcagcccctggcttctgggagcatgggatctggctaaaaagaccagactgtcaccatgggcaggggcccagcagcccagagcaggcaaggggctttgcaggaaagcgaggcagtaagagtccaggttctgggattatcaggaaaggattccccaggagaagccaactttgaccttgacagatgagtagaatcccccagaaaggaggagggtgtttctggcacaggacatgaacaaggacactgaggcccagggtgagaagcagggagacgagcagggaagctggggcgaccataggacagaggaagggcctgcacccccgcctgccacgccaaggagtgtagtcctcatggcagaagtggggagccacggaagctctttgagcaggaagtgacacaagatgagagtctcagagtcactgccccaaatgacacaagagattctaacttaatgtgccccatgatgacatcataggctcccattccatgcaagaagcagccaaggcttagacactggaagtcatttacgcagggtcaccttaaatcacattaaccactaagtggcactcattcttcagaactcagttcaactgttattttcagatgccccaggccagcacagtcgcccacttacaggctctcacagcaccttgtactactttatggacctcattacaattcttacaattgtaattaaagaagtaactgggaagatttgttttaatgtctttctcctctgctagcagataagctgccagaggaggttttcttgccctgggcggctcccatagttcatgtggagtgctttgcctgcagtggagactctggctgtgcttattggagggaggcctggggaggaacggggagggccgcaatactcagtctgtgaaatttggtgtctgatcctctgtccttcttcctcctcgtcctcatccctcttcctcacccttccccactcctcctctccccactgcagggggcttctggcttggtgtggaccaggagggggcagaaggcaccctgtcgtggctgggcaccgtcttcggcgtgctggctagcctctgtgtctcgctcaacgccatctacaccacgaaggtgctcccggcggtggacggcagcatctggcgcctgactttctacaacaacgtcaacgcctgcatcctcttcctgcccctgctcctgctgctcggggagcttcaggccctgcgtgactttgcccagctgggcagtgcccacttctgggggatgatgacgctgggcggcctgtttggctttgccatcggctacgtgacaggactgcagatcaagttcaccagtccgctgacccacaatgtgtcgggcacggccaaggcctgtgcccagacagtgctggccgtgctctactacgaggagaccaagagcttcctctggtggacgagcaacatgatggtgctgggcggctcctccgcctacacctgggtcaggggctgggagatgaagaagactccggaggagcccagccccaaagacagcgagaagagcgccatgggggtgtgagcaccacaggcaccctggatggcccggccccggggcccgtacacaggcggggccagcacagtagtgaaggcggtctcctggaccccagaagcgtgctgtggtgtggactgggtgctacttatagacccaatcagaatacggtggttgagaaggaaccagtgtttacaagtaatatcagaaagttgaaggaaccagtgtttacaagtaataccagaaagttgccaaacccttctctatcctctcgtatttctgagtttttgtccttcccgagggagcaccctagtgagagttgaaccccttccttctgcctccagggcctgtctgcctccacatcactctgaggacagggacaggcaacaaccttgaagggacagcaatggcaaagccacaaaggcttcactgtactcaggggagatggccctaccacagccacctggagagggttgggaagccttccgtctgcggtgggcaggcagcctcaccctgggcccacagaccggccttcctttggaggaaagtgtggcctggactgagggaggaaatgagcgagttccctctgacaccagcagatccccaggggctgctgggcagtggcctgggaatggggtggattgtgagaaagtgctcaccatctatacaccctgtatgtccagcttttgaacacaagggaaccatgcttctcttagaggttaagcagggtcattaacatcctcccccagtccctaacatcacattgtcctgcgtggctcctctggccctgagtggcacctgtccctctggtctcccagcacctggcccaggtaacagccttctgaaagcagagccaaggagctgcttctctcttctcccagttctacctccccagaagccttcctccccaggtggggctgatggagcaagggtccagactaggagccttccaccccagctgtgtctggcgcccctagatctctgcaagggaggtgttacagctggttctgagccgcttgccttgtgatggtaagacaccaacctttacattcttccctgaggttgtggctgacagagcctgcttggccccactgttagtccagcgagctcctatatcaaaatgccgtaggccgggtggcttacaaacaacagaaacgtattgctcacagtcctggggggctgggacgcccaagatcaagaggccagcagattcggactccgctgagggctgtttcccgatccatagatggtgccttctcgctgtatcctcaatggtagaagcacaaacaagcaagctccttcctgcctcttttataaggactccaaccctgttcatgagggttccgcccccatgacccaatcagctccaaaggccccacctcctaatactgtcaccttgggggtgagaattccaatgtgaatttgcagggggagtgggggacacacacaaatttcggggccataccacccttcaccacaccctcctgcgctcagggtggcttgcagtccctggcccttctggtgggcatttggtatgtcctttctcttggggtgatttctgatgtttttactctatatagtgaaaagctagggagagcgggtcttctcccccctccctctccagtcccctcacaatcccagatgggttctaatgcagctgctggggcctgatgccctgagttgtttgtgattcaataaagaatccataaga

SEQ ID NO: 2762 - DNA, 8945 bp, Homo sapiens; identical to SEQ ID NO: 2761
  source 1..8945: mol_type = genomic DNA

SEQ ID NO: 2763 - DNA, 7927 bp, Homo sapiens
  source 1..7927: mol_type = genomic DNA
aaggccacgtgggggcgtgtcaggaagtgagtccagggcccgcctcccggggagtcggcctcggatgtccggaggctcctgggctgagccggcgacagagcccgggaaggcagcgagacgtgggcgccggcccagccccctcccgcgtccttcagccccaagccccgagcccctctgacccttccgcagccctccctccagccgcgcccggcctccggcagctccctgtacgcctccctccccctgcccgcccctccctcccacagccgcccatgacgccctctcggcacctcttcccactctgccacgcgtccttttcctgcaccttcgccccgcgtacctactcctgccccgccctgccattcctctcccctcccttctctctgcgacccctccctgttaggccccagcctcttctcccctcacaggtcttctctgtcctggcctcaccgccttatcctattcctctcccttgccctgtgtcttgtctcagagccccctcggggtgggagtaggttgtggagcagcacaactgggctcaccccaaagcagaacttctcaatccatgaggacaatggggaggcctttaggccagcccacatgtgacaatggagggctgcggcttccttgcggagagcacaagtgagctcactgccctggactccagggaatcagagttctggccgcggggtgacccagctcctctgctaccatgaatagggcccctctgaagcggtccaggatcctgcacatggcgctgaccggggcctcagacccctctgcagaggcagaggccaacggggagaagccctttctgctgcgggcattgcagatcgcgctggtggtctccctctactgggtcacctccatctccatggtgttccttaataagtacctgctggacagcccctccctgcggctggacacccccatcttcgtcaccttctaccagtgcctggtgaccacgctgctgtgcaaaggcctcagcgctctggccgcctgctgccctggtgccgtggacttccccagcttgcgcctggacctcagggtggcccgcagcgtcctgcccctgtcggtggtcttcatcggcatgatcaccttcaataacctctgcctcaagtacgtcggtgtggccttctacaatgtgggccgctcactcaccaccgtcttcaacgtgctgctctcctacctgctgctcaagcagaccacctccttctatgccctgctcacctgcggtatcatcatcggtgagtggcagctggggccacgggggatagagtggtcatggggactgaagcagtgaagaacaactcttctaggcatcctaggacttcatctgtcccagctcctttggtgcagcagtcataggagaaagagcctgggggcacagagagagcaagtaacttactaaaggtcacccagcaagttaggagcccagccggggcaagaacaatagtaataataatagtaacaacagcagcaaaagcaactgacatttgttgagtgattaaaatgtgccaggcacatggatcttagccatattaactcagctaatcttcataacaagatgggattataatccacattttacagagggaaaaaccaaggcacagagaagttaactaacttgtccaagatcacccagctaataagtggcagagctgggatctgaactcaagcaatctggcttcacagttcacatgcccgaccactgtactttattgtttctcaagagctcaggtgtcctgatttcccagccagtgctcttagtagaggacaatacgtcttttaataaatataccatcactctctgccagctcaggatagcgcctgagacagtagcaagcaatatgctttgagaggcctcagctgtcttcctggacttgaccctcagaaaataataattattgatggggaaattatgctaattatttcacatatagcatctcctttgttctcccagagatcccctgggttgtggcatcactaccagcggtcatctctatacaaacaaggaaactgaggctcagagatgttacattacttgcccacggccacacagctagcaagcagccaggctgggatgcaaacccagattggccagactcccaggcctgtgcttctatcccctctgctcgtcttggaggttagaactgcagtattcaatgcagtagccattggccacttatttaaattagttaaaattaagcaaaatgttaaacattcacttcctcatttgcagatgttacaacctgattttctagccacatttcaagggctcagtagccaaatgtggctgagggctatggtatgggacagcacaggttagatgggcccatattttactgggccccatgctgcgttagagagcctccagcatcccattccctccgagtcttcccagggctgcgtcatctaggaatggggtcttcatttgaacctatgctggtttttcctggtgctataaagtttatcttatttggcctacatatcatattctttgctgatggctcagggtcccaggctagatgcaccggttggtgggggaagggacccatcccatgccacctgtcctagaaaatgtttccccttgttgagcagctgctggatctagggctgctgggtctaagtccaagaggggagaagggagaaggtcacagttagagtaggggaagctgcaagaccccccctgccagaactctcccagcctgcttccatttccctctccagggaacaggtgtacctcccctcctccctgtcctcctcagatgccccagggctctctacttcattcctgctgaccctgccaggagtggcctcaggggtagaggctcctagttggagaatttgcttgcaggaaggtgaagacactagggtaactgggcccaaatcccaaaggtaatccaagtaaccagtggtgaggttctgagaatggtgcattcacgggcgtgcctgactgggacaggggccagggaggtggacgctctctgccagcccaggacctggctccctatctgcaatgtttcctctttcttcctccttgtaggggaagacgagtctcaggcaactattctaggcctcccctcctagccccccatgtcacacagtaactttcaaagctccttctgggccaggcacagtggctcatgcctgtaatcccagcactttgggaggctgaggcaggtggatcacctgagatcagtagttcgagaccagcctggccaacatggtgaaaccctgtctctactaaaaatacaaaaaattagccgggcgtggtggcatgtgcctgtaatcccagctactcgggaggctgaggcaggataattgcttgaacccgggaggcagaagttgcattgagccaagatcgcgccactgcattccagcctgggcgacagagcaagacacagtctcaaaaaaaagttctttctgggcaagagtcgctctagaacattgatgttgcagttgcttctggactcagaaggtaaccaccaggagggctaggggtgctgtagccaagcaggtgagtgggtggtgcagccctctgcccccctcaccctacccccagcaggtctgtgggtaccccttgtgcaaaggttctgtcaagaaagaggagggtcgggctctgtggttgggctgggcatggtggctcatgcctgtaatcccagcacttggggaggctgaggcgggcagatcacctgaggtcaagagttcaagaccagcttggccaacatggtgaagccccctctctactgaaaatacaaaaattagccaggcatggtggcgcatccctgtaatcccagctactcaagaggctgaggcacgagaatcgcttgaacccaggaggcgaaggttgcagtgagccaagatcgcaccactgtactccagccagggtgacacagcgagactccgtctcaaaaaacaaagagaaaaagagaagagtgctgtgtgttgagtgcctatgatgtaggaagtatcctgtctcctttaatacaaccacctccataacaactttcattcattcattccacgactagtaattggtggctaaacacatgccaggcaccatgccaggctttggggatacaagtttggaaaaggtaacctcagctcctacactcctggagggcatggtggtgacagttacgctagcatagtaagggctgtgatggggcatgcataaaaggggctgtgggagctctgggcaagggaggggacccggggacagggcagtctaagcaggccttctggaggaagtttagaaactgggtttagaggaagaagtagggacagaacattctagatagaaggaagagcacgtgcacttcttcatggctgggccacagcaagactcaccagacacaaggctgcccagtcaggccgactccacgtggtgcaggtcctaagagctgtggtgagtgagtggaatttctcctgaaggcagtggagagccacagagaggcttcacaccagggcacagcctggaccgatctggacttcaggatgatcatatcagttgcaaggtggagagtagattggctggagtggaggacagggaggtgacccagagagctcagagtggttaagtaacttctcccaggccactcagcttctaaattgcagagcctgattggaggctaaatccctctgaccccaaaactttccccactgccccgtgttgccagatgctgtggcaggaagtataacatgcattgttcagcccctggcttctgggagcatgggatctggctaaaaagaccagactgtcaccatgggcaggggcccagcagcccagagcaggcaaggggctttgcaggaaagcgaggcagtaagagtccaggttctgggattatcaggaaaggattccccaggagaagccaactttgaccttgacagatgagtagaatcccccagaaaggaggagggtgtttctggcacaggacatgaacaaggacactgaggcccagggtgagaagcagggagacgagcagggaagctggggcgaccataggacagaggaagggcctgcacccccgcctgccacgccaaggagtgtagtcctcatggcagaagtggggagccacggaagctctttgagcaggaagtgacacaagatgagagtctcagagtcactgccccaaatgacacaagagattctaacttaatgtgccccatgatgacatcataggctcccattccatgcaagaagcagccaaggcttagacactggaagtcatttacgcagggtcaccttaaatcacattaaccactaagtggcactcattcttcagaactcagttcaactgttattttcagatgccccaggccagcacagtcgcccacttacaggctctcacagcaccttgtactactttatggacctcattacaattcttacaattgtaattaaagaagtaactgggaagatttgttttaatgtctttctcctctgctagcagataagctgccagaggaggttttcttgccctgggcggctcccatagttcatgtggagtgctttgcctgcagtggagactctggctgtgcttattggagggaggcctggggaggaacggggagggccgcaatactcagtctgtgaaatttggtgtctgatcctctgtccttcttcctcctcgtcctcatccctcttcctcacccttccccactcctcctctccccactgcagggggcttctggcttggtgtggaccaggagggggcagaaggcaccctgtcgtggctgggcaccgtcttcggcgtgctggctagcctctgtgtctcgctcaacgccatctacaccacgaaggtgctcccggcggtggacggcagcatctggcgcctgactttctacaacaacgtcaacgcctgcatcctcttcctgcccctgctcctgctgctcggggagcttcaggccctgcgtgactttgcccagctgggcagtgcccacttctgggggatgatgacgctgggcggcctgtttggctttgccatcggctacgtgacaggactgcagatcaagttcaccagtccgctgacccacaatgtgtcgggcacggccaaggcctgtgcccagacagtgctggccgtgctctactacgaggagaccaagagcttcctctggtggacgagcaacatgatggtgctgggcggctcctccgcctacacctgggtcaggggctgggagatgaagaagactccggaggagcccagccccaaagacagcgagaagagcgccatgggggtgtgagcaccacaggcaccctggatggcccggccccggggcccgtacacaggcggggccagcacagtagtgaaggcggtctcctggaccccagaagcgtgctgtggtgtggactgggtgctacttatagacccaatcagaatacggtggttgagaaggaaccagtgtttacaagtaatatcagaaagttgaaggaaccagtgtttacaagtaataccagaaagttgccaaacccttctctatcctctcgtatttctgagtttttgtccttcccgagggagcaccctagtgagagttgaaccccttccttctgcctccagggcctgtctgcctccacatcactctgaggacagggacaggcaacaaccttgaagggacagcaatggcaaagccacaaaggcttcactgtactcaggggagatggccctaccacagccacctggagagggttgggaagccttccgtctgcggtgggcaggcagcctcaccctgggcccacagaccggccttcctttggaggaaagtgtggcctggactgagggaggaaatgagcgagttccctctgacaccagcagatccccaggggctgctgggcagtggcctgggaatggggtggattgtgagaaagtgctcaccatctatacaccctgtatgtccagcttttgaacacaagggaaccatgcttctcttagaggttaagcagggtcattaacatcctcccccagtccctaacatcacattgtcctgcgtggctcctctggccctgagtggcacctgtccctctggtctcccagcacctggcccaggtaacagccttctgaaagcagagccaaggagctgcttctctcttctcccagttctacctccccagaagccttcctccccaggtggggctgatggagcaagggtccagactaggagccttccaccccagctgtgtctggcgcccctagatctctgcaagggaggtgttacagctggttctgagccgcttgccttgtgatggtaagacaccaacctttacattcttccctgaggttgtggctgacagagcctgcttggccccactgttagtccagcgagctcctatatcaaaatgccgtaggccgggtggcttacaaacaacagaaacgtattgctcacagtcctggggggctgggacgcccaagatcaagaggccagcagattcggactccgctgagggctgtttcccgatccatagatggtgccttctcgctgtatcctcaatggtagaagcacaaacaagcaagctccttcctgcctcttttataaggactccaaccctgttcatgagggttccgcccccatgacccaatcagctccaaaggccccacctcctaatactgtcaccttgggggtgagaattccaatgtgaatttgcagggggagtgggggacacacacaaatttcggggccataccacccttcaccacaccctcctgcgctcagggtggcttgcagtccctggcccttctggtgggcatttggtatgtcctttctcttggggtgatttctgatgtttttactctatatagtgaaaagctagggagagcgggtcttctcccccctccctctccagtcccctcacaatcccagatgggttctaatgcagctgctggggcctgatgccctgagttgtttgtgattcaataaagaatccataaga

SEQ ID NO: 2764 - DNA, 42676 bp, Homo sapiens
  source 1..42676: mol_type = genomic DNA
ttaggaacataaacttttattgtcatccagcacctgtgatagtttcatgtctctctaaaggagacaggaaattggagcattgtgggcccttttaaaagaaaagaggagtaggtaggcacacccaggtgcttctaaaacaaccaagcccaaacctgacatgctcctccccacagtcaccttcattgtcccctttaaaagtctggaacagtatgtagcaaaacaaataaattacttttcatttcaaaaagtaagttcaaaggttgaagctgcctaggccaggcttctggacaggtgcctccaaagaagtgagctttccttttcaacttccttagctctagccagtagaccagaaacccctgctttccacatcaggattccagatggtgtttagttagatttgggatcccgttgcttgggcatctctcctccatcttccaaatccatttctgcagcaactgacatacacaggacctggaggtaccttgtggcagaccctacaaagagaactttgagttggaattgagaagaggtcagctgggctgagttcaagtgtcactgaatggaactcagtgtgaggggagtgattccactaagccgaagggttcataagaaggggctaaggcaaagatgtctttggaggctggatttacagaaaaaggcaaaaaccaagctctgcaatagctgagcggacttaaggatgcacggcttacccacgatccttcggaggtaaagcggtcgcttatgttctggcactctgatgatgaggaagtaaaagggcaggcctgagagggcaatggcaatgccgatgagggagttgatagtatcactgtaaagtggaacagccaccaggaagatggtgcagaggcagaagacaatcgggaagaaaacgctgagctaagggcacaggaaacataactggagtggacaactcaggattcttaacagctaaaataaccccacctcccataaggattagcgcactgagccttctttccatacctttaatttcaacacattactaacgaccaagtcccaggcaaaggtttctaaataaagtgctttgtcatagtcccttgtagcaacaactccagctgtttcaggtggagcagaggtaggatggagttgccttaccttgaggggacgaggtcgatcaggctccttccagcgcagataaagctgacccacaatagaaagccccacaaagaaccagtagctgaagctgtagtagttaatgagctggaagatgtcttccacgcacaagtagatcaatgccatgataccctgtaagcgtgagcctaagtcagctcttctcagggcctttgttaatccaaaggcttttcactccctttataccccagaaatccatcccctgtcaatcctcaaagtctcctggtcctcttctggttttaatccctttaacaccctagtttcagtaccttatcccctctcttataagtcagtagtctcaactggcttttcaacccattcttcaagttaaccctgtataaagcaagctcgaaacaatccctcaaaagtcttgcataggaccctttccataatggctccaacctacaataacccgctcttatctcctcctacatgttgagtatccctgttctgaaaatccaaaatgctccaatgagcatttcctttgagtgtcaagtcagcactcaaaaagtttcagatttttagagcatttcagattttggatattcagattagggatactcaacctgtattaaaacccatactgctttatcacaggattttctgatgctatttctcctacctaaagcccatctctaccatttgcaaccctagccatcaagatgcactttttttttctgagaacactttggtggattttaagacacacacacacacttctagatgtaattcttcaccctctactcccatggaagtgatcgtttcttctcttaaacaccgtatcactcactatctgtcatggcaatcaatcattacagtgtattccatgtactttttgccttatcttagagcagaggtgtaccattccttagagcatttggatttcccctgtagcggttagcatagtgccttgcccgtggtgaacattctgatccaccaatagtttttctattggaatctttcagagctttcaggaagctagaacagtcgcttctgctgttactaaagtttcccccgcaatctggctttcagtctcatccttgagttcacttacattgaagagcagagaaggcactggtgtgaaccgctcaacatggatcatgcagatggcatcagggagatggccttctcttgagcccacaaagaaaagcctatgttaggtaagataggagaagctgagaaaattggtggacacggtgcagcctggttcacctgccacatggccctccctctctgccatcccttccttcaaaagtatttggataatatggactggagctcagtattaagattaatgacaactgcaggcttctgctagaaacaagaagaaagaggttgtggtatcggttggagaacacaagtaatcaaaggctgggtcctgtaagttctgtccactgcatagccctttgatgatacacccctcacaaaagttgccactcttacctagaagcagccacaatggaggcattgaggccaccaaaacaggataatgcaactgacagtggaattatccagttaaatattccaaatatctgatctgcaaaagtctaagggaaaagaatggaagagtcattagcaggatctaaaagggatgaaagacatggatgggcatgcccccagattccccttattaggtattccaacctttcttccacagtggggttaacaggaccttcttgcaagcccggtattctaaatgaactcctttcaaggctgtctaccccctttccaggactttcaagagccagaatatacccagtaccccacaagacaccctcaaccttctgctagtgaaaatcctttaccacagcaacagcatcactggccaagatgtctctcatgtctagcacagtataataggccacattggtcaagatatagatgatggtgacaatgggcatggagatgccaatggagaggggcaggttcctacagccaaatagaataaaatgcacattagtcccacagtcatatccctatctctcctttaatccttagactctccctgccacaccggtctttccagggatggagactgttgctacatttcctcaatgcatttgtctttgacggtgccctggatagtggctgaagctctgaacacttaagaactaaagaacattaggggaaaggaatatcatattaggagacaggactgtgcagctgggagcagtggctcatgcctgtagtactaacactttgggaggctgaggcagggagatggctcgagtctaggagttggagaccagcctgggcaacatggcaaaaccctgtctctacaaaaaactagccaagcagctgggcgtggtggctcacgcctgtaatcccagcactttgggaggccgagccgggtggatcacctgaggtcaggagttcaagaccagcctggccaacatggcaaaaccctgttcctactaaaaatataaataattagccaggcatggtggcatgcacctgtagtcccagctactcaggaggctgaggtacgagaatcacttgaactcgagaggcggaggttgtggtaagccaaaattgtgccactgcactccagcatgggcgacagagcgagactctgtctccaaaaacaaaccaaaaaaaaaaaaattagccaagcgtggtggtgcatgcctgtaatcccagctatttgggaggctgaggtgggaggatcacttgagcctggggaggtcaaggctgcagtgaaccatgactgggccactgcactccagcctgggcaaggcagccagaccctgtctaaaaaaaaaaaaaaaaaaaaaaaagcagggcgggggggattaacaaagactgtccccagcatcataacgcacaggaaaatgggaggttgttttgttttataccccaaagatcttttggtgtcaggattccatctctaagattatcaacattggcaattttgcctcaaggttgagaaatataaaaagaaattatggaggcaaattgtgaaatttaacatcttcagagaataagataggccttcagtaggaagagaagtgtatgtatctgactagcagcctggaagatatgtctgcccaccccttcctcagtttgagaacctcaggagccatcctaactggtgggcaaaagaaagatgcaaagagctctcaaggtccctgtagcccaataaagccatgatctttataagcatccttaacagtaaggctgccaaaaaaaaagcacaaagtggggcaaatactctgcaaatagagtcatgcagtttctgtccggtaggtggaagtaccacccaggccttgatcctgcttctgttatctctgttcccatagcgttaccactagttgtgtaccaagagtgctcttctgtttctcaagccaaaaggagtttattggtataagaattgtgattcttttcacttaagcatttacagaaagctgggcacagtggctcatgcctgtaatcccagcactttgggaggctaaggcgggcggatcacctgaggtcaggagttcgagaccagcctggccaacatggtgaaacccatgtctctactaaaaatacaaaaattagccaggcgtggtggcaggcacctgtaattctagctatttgggaggctgaagcaggagaatcacttgaacctgggaggcagaggttgcaatgagccaagatcacgccattgcactccagcctgggaaatacagcaagactctctccaaaaaacaaaaaacattttaccgaaactccactccctggcaaatcttagttcccagaatcatagaattttagagccaggaaaggccatggagatcacagaatttaaccccctcaattacagataaggaaacaggcaaagagatggccgggcaactccctcaaggttagccaacaagtcagtggaaagatcaactctaggtccttgacttcctgtccagttctcttttcactctatatatagactacagagcaataatggtagggtgacttaattgaatgactgaaactataccacaatgtcagtatgaatttaggaaacaaggaaggtatcagagggaaacacaggaaggtttctggaagtctatatcccaaagctatgtatgtggggataagggtggataaaatatctatcaaggaaaatctgttttaaaaacatacataagcatataatacaacctgctttaattaatgcagaaattaatgaacaaatgtaaaaatgcctttaaaaatttacaaagcatacatgagtaagttcatattttagccctgttactgtgatcatagacaagttacttctctgagcctcaggcctcccatctattaaaatgaggctggtaaaattaacctcatagtggttgtggtatgctgtctggcacgtagtaggagctcattaaatgatggctatcactgctatggaaagttggtggtgcagtacctacctctcaggattcttgatctcttcagtgacatagttgagggtgtcccagcctgagtaggagaacagagctgagtacagtgccagggcaatgtcacccactgcaaatgatgaaccctcaaaggaattctcaaaatgagtagaggctcctggaacccaagaacattggaaggcaggggattagtggctcattctcccacttcaagatggtcaagtaaaggactgacagaatatggtaatataatagcaggtaagtggcctacaacacctttggcagcaagagtaccagtaagggaacaggaaacagaagagagacgtctatagagatagaccagaatgccctgcatcctaatgacatagatggggatcttgacaggaagggtccagggtagctttctaggataagaaaccaccatagagcagaaaagctggagaatagaaacaatgcagttctgttctgctctgcaggctgcctgattcctgcctcctatcacaatctgccaaaggcagctcccagggcatggctgtcaaccctttgccaagatcagcctcctctgggaggcagcgtgcatggaagttaaaggacagacttttgggtcagttgtcctggatacaaatttcaactcctctacttaccggtagcaacttgggcaagatatttaattcttttttttttttgggggggggacagagtctcgctctgtcgcccaggctggagtgcagtggcgtgatctcagctcactgcaaccaccgcctcctggattcaagcgattctcctgcctcagcctcccgagtagctgggattacaggcgcctgccaccatgcccggctaatttttgtatttttagtcgagatggggtttcaccatcttggccaggctgatcttgaactcctgacctcatggatccacccgcgatggcctcccaaagtgctgggattacaagcacgagccactgcgcccggcccaaggtacttaattctgcaggctgtttcctcatccataaaatgagaataataatagtgcccaccgaataaggttatagtaagaaatgagataatgcacaaagagcacttagaggagtgcggctcacagaaaatgcttaaaaaagattagttgctactaatattatttcttaccctggccaagtctaacaatgcctgcaacgatgaccgcgatcagtgccaatactttagcataggtgaaaatatcttgtaccagggttccccatttgacataggcacagttaatgaaggttaagagacctgaaagaaaaataatactgattggtgacttacccttaccaccctagggccttagactcccaagcaatttttccagtaccagtcaccaagatatatatacccttcagccaaagacagaccctctgacctgctctgcactggaaccctcggggccccagaatgtcctcaccattatcatacaaaggcctctatactccccacccccagcaccttatatgggagacacaaaacaaagtgactgcagatctgcttacataaaaaatacatccaaatgtccaatcacagcagtgggaggcaactgggaactgtacaggattagtgattgttccggctcttggctctgaaaagtcatggtctctccctcctacctcccattccccatgggctccaggacacagcactctgactctgtggtattactgttaaccttgaggagttctgctgtgacttatccaatgctgagccagcaggtcaggctgtgtggccaaggattaggatgaaggccagacttcctgcccactgcctggcagctcagctgcctgcttttgtgcttggaaagattcttgcagctaagagtggttcctgtagaatggggacagggcatttttcctgatgggacaatagagaagtaagagccacacacattcccccagtccttctactcagaagtacaggttttaaaagtaccttttatcagggttcttaactagggcctccatgaggctcgaaattctctttcaaagtgttatgtccatatgaatacagacatacctaagaaaaagtttcatatcttttcttagaaagggatcatagcttttatcagaatctcaagtccattatccctcccccaacaaaaaagttacaatctacgacttgaatttgaattacttgaagaagttcaacaagggaggctcacgcatgctgtgaggttgaccagtagccccagaatgtggccgagaagaaagttggaaaaaaaaatacagatcttcccactggtagcatagcgaatcgcttcattgctccctccttcccagctcagcaactggaacactataaggagggcttaactttaaagcccttctcccaagggctccaagggcaaggtcaacatcaccctgccttaccagtcaagagaatgaggcctagtacagttcttgcctacttcaggccaccaacacagtcagaaacaccctctgagttctcctggcagtggtgtggccttggtgtcgctagtcctcctattttgtggtgtcctggcctcaccacattctggctacttcatcctgagaagcagggaagtctggcctctcagaacagctgccccatcttctctctctcaccctcccttccaccaccaccctcattctactgactgcccaagttcctttctgctcttcctgagaaggcacattcctgtcctatataaatgcttgcctttctgcctaataaacaacaaaccttatcacagggctgggcaaaaatgtacccacagctccaggccaccccagtgctaagttaataatttaagacacaagtgtgcagcaccccacaaaatgaccaaagtggctgtatcttgccctccacaaatctttcaaatctgtcactcctcctcagccagtcacccatcctttactccccactggactccagcctccagccactcaacagcttagtgccccttctccccagcttgtaacctctgcccttatcctaggctctgcggctggctcataaccacaacatagccaggtttccaagtagaaacaccagacacaaaggatgctgccacattgtcaggaaaatgggatccccaaatacaaatttatgattccctgcagggtaaccatgagtcataacaccaaactggaataagcttacaggactagctctagttcagactcagagtctgagctgtgtgccacaaggttcttctcagttctgtccagggatgtaggcagggaaaaggagggataagcaaccaattcaccacctgctaccacagcagattctgaaatggaaatacatggcttgtttatattttattttatttatttttctttttctttttgagacagagtttcacccttgttgcccaggctggagtgcaatggcgtggtctcggctcatggcaacatctgcctcccgggttcaagccattctcctgcctcaacctcccaagtagctgggattacaggtgtgcgccactatgcccagctaatttttatatttttagtagagatgaggtttcaccatgttggccaggcttgtcgcaaactcctgacctgaggtgatccacccacctcagcctcccaaagtgctgggattacaagcatgagccaccgcgcccggcctatattttattatttttttttatttacttatttattgacttatttatttatttatttatttattttatttattttttgagacacagtcttgctctgtcacccaggctgaagtgcaatggcatgatcttggctcactgcaacccccacttcccaggttcaagcaattctcctgcctcagcctcccgagtagctgggactacaggtgtgtgccaccatgcctggctaatttttgtatttttagtagagatggggtttcaccatactggccaggctaatctcgaactcctgagctcaggtgatccgcccacctcggcctcccaaaatgctgagattacaggcgtgagccaccacacccgtccctttttgttttttttttggagatggggatctcactctttcacccaagccagagtacagtggagaaatcatagctcactgcagcatcgaactcctgagctcaagggatcctcccagctcagccaccctagtagctgggatcaaaggtgtgcaccaccatgcccagctaatttgttttaattttttttttttttgagatggagtcttgctgtcacccagcctggagtgcagtggtgcgatctcagctcactgcaacctctgcctccagggttcaagcagttctcctgcctcagcctcttgagtagctaggactacaagtgcccaccaccacacctggctaatttttgtatttttagtagagacagggtttcaccatgttggtcaggctggtctcgaactcctgaccttgtgatctgccctcctcagcctcccaaagtgctgggattacaggtgtgagccaccgtgcctggctgttttaatttttttagagacggggtcttgctatgtggcccaggctggtctcgaactcctggcctcaggcaatccttccacctcagctatctgaggagtaactgggattatagggaagagccatggcacctgggtggcttgtttacattttaatccctattgcttctctacttctttttttttttttttcgagacagtcttgctccgtcccccaggctggagtacagtggtgcgatctcagctcactgcaacctccgcctcctgggttcaagcggttctcctgcctcagcctcccgagtagctagaattacagacattcaacaccatgcccagctaatttttgtatttttagtagagacagggtttcgccatgttagccagactagtctcaaactcctgacctcaggtgatccgcctgcctcagcctcccaaagtgctgggattacaggtgtgagtcaccggcgtggcgtgcccagtctcttctctacttctctatccatccatttgtatccctctctttgtccaccagtatcccacctcccccactcctgagcctgatttctctgacccaccttctagccctgatctgctctctgtactgagcacagaaggctcagtttgaatgaggaagggaatcctacagaaagaaaccagggagcagagggaactgcctgaagagagctagccctcctcttcctcaaagcctagcttcctccagggcctcttgactgtgggagcaggaaatgggtatggcaggcagcagtgctgacagggctttttgtccccacctcagcggatacagctgaccactggccccagagcccagctaagtgcactgctcttgaagtggagcccaacctcctgcttcagggccaaggacaggaggggaccatggggttaggataatatggaggcaactgcaagttaacctcaagggcagagatgccctccccttctacctctaggggcaattcaatccccacccaacactgggccaagtctataagaggataacctgaaatcacctttgacccttgactcggtgcagcagcactcctgctttgaccccagggggagaaaaaaagaatctgcaaagaagtcactcgtggccgggtgcagtggctcacgcctgtaatcccagcactttgggaggccgaggtggacagatcacgaggtcaagagatcgagaccatcctggccaacatggtgaaaccctgtctctactaaaaatacaaaaattagctgggcatggtggtgtgtgcctgtagtcccatctacttgggaggctgaggcaggagaatcacttgaacccaggaggcggaggatgcagtgagccaagatcacaccactgcactccagcctggtgacagagcaagactccatctcaaaaaaaaaaaagagaagtcactcctataaccatctaaaaagatgttcctgaatggatcatcaaacccagcctacatacggtccccgggagtaggagactagttctagtggtaaggcccagcatcagcgctagaactaaaagccagaaagcaccagaccaggtggatccagaacagaacaaagcttgcaggcccactctggatcagatgctcaggtttagtttagacacctaaatgaaacatttcctgaaaaagaacattaaacccacaattctgtaagcactattacctttaaatacacacaatgtaacacacaaaacttatgattacaggcgtgaaccaccatgcccggcgtcattccattttaaaagtgatctatagagccaggcgcggtggttcgcgcctgtaatcccagcaccttgagagactgaggcgggcagatcacttgaggccaggagtttgagaccagtctggccaccatggcgaaaccccgtctctactaaaaatataaatattagctgagtgtggtggcgcatgcctgtaatcccagctacttggaggcagaggtaggagaatcatttgaacccgggaggcagaaattgcagtgagccaagatcacgccactgcactccagcctgggtgacacagtgagactccatctcaaaaaataaaataaaataaagtgatctatagctcttccttttactaagccaacagcgtcttcctcccagcttctaccagtagtgccagacccctcctctgtctccacacagaatgaagctaaatcctcttccacccaatggcccttcttaacattaaagatgaatatcacggccaggcgctggctcacgcctgtaatcccagcactttgggaggccaaggcgggcagatcatctgaggttgggagttcgagaccagcctgaccaacatggagaaactccgtctctactaaaaatacaaaaattggccaggcgtggtggcacatgcctgtaatcccagctagtcgggaagctgaggcagaagaatcacttgaactcgggaggtggaggttgcggtgaactgagatctcgccattgcaccagcctaggcaacaaaagcaaaactccatctcaaaaaaaaaaaaaaaagccaggcgcggtggctcacgctgtaatcccagcactttgggaagctgaggcaggcggatcatgaggtcaggagatcaagaccatcctggctaacacggtgaaaccccatctctactaaaaatacaaaaaattagccgggtgtggtggcaggcgcctatagtcccagacactcaggaggctgaggcaggagaatgacgtgaacccgggaggcggagcttgcagtgaaccgagattgcgccactgcactccagcctgggccacagagcgagactctgtctcaaaaaaaaaaaaaaaaaagccaggtgcagtggctcacgcctgtaatctcagcactttgaaaggccaaggcgggtggatcacgaggtcaggaaattgagaccagcctgcccaacatggtgaaaacctgtctctactaaaatacaaaaattagccaggcatggtggcacaagcctgtagtcccagctactcgggaggctgaggcaggggaattgcttgaacccgggaggcagaggttgcagtgggccgagatcacggcactgcactccagcctggccacagagcaagactccatctaaaaacaaacaaaaaggatgaacatcctgtccccttgagtctttactccttcaggctaaaacccagattttacaaccccttgtggagcaaatgtggcttccagacccctcaccatcccaggactgtcatttatttcactttgtcatttactgcatatacttcactgtgtcagtatttccccagaaatgcaagaccccacacagaaaactccagaccgtgttgccgactacggagtctcaacctgaaatcattgtttactacaactcctttctttcccacctcaaagtgatgagatctttcctcccctctttctggacctataaaaatgatttttttagctgggtgcgatggctcatgcctataatcccagcattttgggaggccgaggttggaggatcgcttgagtccaggagttcaagaccagcctgggcaacattgtgagaacacatctccacaaaacattttttttagttagccagacatggtggcacacacctgtggtcccagctacttgggaggttgaggcagggggatcgcttgagcccaagtggtcaaggctgcagggagctgtgatcgcaccactgcactgcagcctgggcaacacagtaagatcctttctccaaaacaaaaaaagtgattttttccccccagatacaggacttcatatttagtcttagtgactttcctctgagtttttatgcattattcttatatgatatgggatttttccttcttcattttattagttcaaatcccttctttaattttgtgaaatctgcaaatttgatcagcatacctcctgagtcttcactgaagtcaccctaaaaatgttgactagggccgggcgcagtggctcacgcctgtaataccagtactttgggagaccgaggagggaggatcacctgaggtcaggagtttgagaccaggttggccaacatagtgaaaccccgtctctactaaaagaacaaaaattatccgggtgtggtggtgggcacctgtagtcccagctactcgggaggctgaggcaggagaatcgcttgaacccaggaggcggaggttgcagtgagccaagattacaccactacactccagcctgggcgacagagtgagactccgtctcaaaataaataaataaataaataaatgttgacatgggctggcagcagtggctcacgcctgtaatcccaacactttgggaggctgaggcaggcagatcacttgaggccaggagttcgagaccagcctggcaatatggcaaaaccccatctctactaaaaggaaaatgcaaaaattagcagggtgtgatggcacacgcctgtggtcccagctactcaggaggctgagacatgggaattgtttgagcctaggaggcagaggttgcactgagccaagattgtgccactgcactccagcctaggtgacagagcaacactctgtctcaaaaaaaatttttttaataaaaaaattaaaatgttaggccgggcacggtggctcacgcctgtaatcccagcactttgggaggccgaggcaggcagatcacaaggtcaggagatcgagaccatcctggctaacacaatgaaaccccatctctactaaaaatacaaaaagttagccgggcgtggtggcgggtgcctgtagtcccagctactcgggaggctgaggcaggagaatggcgtgaacccgggaggcggcggttgcagtgagccgagatcgcgccaccgcactccagcctgggtgacagagcgagagttcgtctcaaaaaaaaaaaaattaaaatgttgactaagatcaacagagctgtatagtctatcactgtagacctttctgtatttgtcattattccacaatgttattcagccaactaagaatctaccaaactttatttttatctagtctaccttgtcaacaagaatatcatgagaatttgccacgaacctctccgaaatctgcatacacatgcctctgctctaacaatctaatgatgctatcaaacaattcaaatcaaattagtatatatttatgtagaatattcatagttacacccttgcagtagtcaaaaactagaaacaacccaaatgcccagcaacagtagattgaataaatactaaacagcactaagaataaacaatctgtaatcctagcacgttgggaggccaaggcgggcagatcacaaagtcaggagtttgagatcagcctggccaacatggtgaaacccccgtctctactaaaaatacaaaaattagctgggcgtggtggcgggcacctgtcatcccagctactcaggaggctgaggcaggagaatcgcttgaacccgggaggtggaggttgcagtgagccaagatcctaccactgcactccagcccgggcgacagagtgagactctgtctgggaaaaaaaaaaaaaaaaagtgaacaatctacgactacagacaaaaatacagaagaatctcaaacataataagcaagccagatgcaaaagtgtacatatagattatatccatttacataaaatcagagaaaactaatcaatgctactagaagtcagaatagtgatttccctttgtgtggggtggagaggcagggactgggaagagcataagaagggctcaagggtgctagttacacatgtgctcaactagtgacaattcattaagccataaacttatgagattgcactgttccttctgtatattatatttgaataaaaaaattaaaattgaaccaaaaagtgaggttagcagagtatggcttgttcttagtgaattcatacacgttactaatgatttcccacccttctgctcgtacttcactaaccagatttaacttacaagcctagaatttgggcaagaatccaccttaagttatcacttcagagtgctgctcatccacctccggtggaaagctgggctatcacttgtggtaggtagactaatggccccccaaagatgtccaccccctaatccctggaacctgtgagccatgttatattgcatggcaagggagaattaaagttgcagatagaggccaggcgcagtggctcatgcctgtaatcccagcactttaggaggccaaggcgggcagatcacctgaggtcaggaattctaaccaacatgagtcagcctaaccaacacggtgaaaccccgtctctactaaaaatacaaaaaatagctgggtgtggtggtgggtgcctataatcccagctactcaggaggctgaggcaggagaattgcttgaacccaggaggcggaggttgcagtgagccaagatcacaccactgcacttcagcctgggcaacagagcaagactctggctcaaaaaaaaaaaaaaaaaagaaaaaagttgcagacagaatgaagattgctaatcaagtgacaaaacagggaaatcattctgtattctctgggtgggcccaatgtaatcacaaaagttcttaaagatgaaagagggaggcagaaaggtcaatgtcagagtagtacaatatgagaaagactctcccagttactgctgactttgaaaatggaagggtccatgagactctagaagctgggaaaggcaagaagatggatcctctccttaagcctccagaaagaaacacagtgctacttcatattagcccagtgagacccatttcagacttctgacctccagaattatgagatgataaatttgtgttgttttcagccactcaattggtggtaacttgttagagaagcaatagaaaactcatatgttggctgggcacagtggctcgctcctgtaattccagcactttgggaggccagggtgggctgatcccttgagctcaggagtttgaaaccagcctgggcaacatagagaaaccctgattctacaaaaaatacaaaaattagctgggcctggtggcgtgcacctgtagtctcaactactcaggaggctaaggtgggagaattgcttgagcctggggaggtcaaggctgcagtgatccttgattgcaccactgcattccagcctgggtgacagagcaagactgtctcaaaaaaaaaaaaaaaaaaaaaaaaaaaacctaactgcaggcagaaaactggaagtagcactgggtggtactattcattacatttgttgaaaaatggagaaaggggaagtgaaacccttgacagctcactggatcttggtgtactgaaatttccctctcactgcaatcaaaagaatctaaatgtgaccttatgcaaagaaggcaggcatcccttatgatagcagatcctcaaacaagtatgtacctctctctttaatgtactacatgaatcccagctcttctagcaaatcatcatttttgaacaaagtatactctttcattatcatattctaatcaaatatcgctgatgcctatgaaattgtttcctcctttcagtaaaaggtcaaatacgggccgggcacagtggctcatgcctgtaatcccagcactttgggaggcggaggcagacgaatcacgagttcaagagattgagaccatcctggccaacatggtgaaaccccgtctctactaaaaatacaaaaattagctgggtgtggtggtgtgcgcctgtagtcccagctactggggaggctgaggcaggagaatcacttgagcccaggaggcggaggttgcagtgagctaagatcgcgccactgcactccagcctggtgacagagcgagactccgtctcacaaaaaaaaaaaaaaaaggtcaaatacgtttattagccttacttgtaatatttgtagataagagttcaaaagcatcatttctgatcttccatcccattttctccaaatgcgttactgagcaactcctctctgcctttattctctgctatgtagtctccaaaatacccagatttatacttttatctaggcatttttctccttgcctctaaaatttccattctaaagccttattatacacatctctcccaatccctataaacctcctctatcccttaccaggagtttatctttctggtatcttagaatcttagaatttacggttaggaactctgttctgtgttcttttttctttcacatacacagccttcagctgacaaagagacgaaaattccacctgccactcagtttgctactttaaacttcacgtcaccagtgagacatctcagctatcttctgactggtgacatcattcatcccacagcaattagcagaaggatagcagtccctaggcttaattggtgtgagcaagctcttggtcacatgttgctcagaaaaactgcacatttctaggttaggctgggtctgtgtatagtcagatgcacactattcctgggggaaggccaaaccccacaactggcatactcaggcctgctaataccctggtgtctccaaaatactctaccactgctgtttcctcagaaggtccagatataagctctctggaaacgcctcatatctgttacctaaacccagagatttcaagtctcttcttccttttctttgctgcatccccatttgttttgtctaatgttggtttgggaaaatctctacacctttttttttttttttttaattgagatggagtctcgctctgtcgcccaggctggagtgcagtggcgccatctcggctcactgcaagctccgcctcctgggttcacgccattctcctgcctcagcctcccgagtagctgggactacgggcgtccgccaccacgtccggctaatttttttgtactcttagtacagacggggtttcaccatgttagccaggatggtctcaatttcctgaccccgtgatccacccgccttggcctcccaaagtgctgggattacaggcttgagccaccgcgcccggcctggaaactctctacaccttgaaatcacaatttcaccctggcttctttgatacattatttcttccactctccctaggtgctgttatttctctcagatagcagatggccttcaaattattttacctttcagactacagaaaccttttactccaggtgcagtggctcatgcctataatcccagcactttggaaggccaagacgtgaggatcacttgaggccaggagttggagaccagcctgggcagcatagcaagaccctttctctacaaaaaaattacaaattagctggacttggtggtgcacactgatggtcctagctacttggaaggctgaggtgggaaggtcacttgagtgcaggattgagcccataaccatgctactgcacaccagcctgggcaacaaagcaagacttcgtctcagaaaataaaataacatttttgaccaggcgtggtggtggctcacacctgtaatcccagcattttgggaagccgaagtgggcggatcacctgaggtcaagcgttcatgaccagcctgaccaacatggcaaaaccccgtctctactaaaaatacaaaaattagccagccgtggtggcgcacgcctgtaatcctagctacctgggagtctgagagaggagaatcattttgaacccaggaggcggaggttgcagtgagccgagattgcaccactgcactccagcctggatgatagtgtgaggccccgtctcaaagaaagaaagagagagagagagagagagagagagagaaaggaaaagaaaagaaaaatatcttttttttttttttaaagacagagtctcgctctgtcgcccaggctggagtgcagtggtgcgatcttggctcactgcaacctccgcctcccgggttcatgccgttctcctgcctcagcctcccaagtagctgagactacaggcgcccgccaccaagcccagctaattttttgtattctttagtagagacagggtttcaccgtgttagccaggatggtctcgatctcctgacctcgtaatccgcccgcctcggcttcccaaagtgctgggattacaggcgtaaaccaccacgcccagccaattaaaataaaaattttaaagaaacaaccaattcgcttactcaggtgtcatgggtgagagcctctgtaattgcaaaattttgactgagacagtgaaagagatctaacttaactgactccatcttgcttctaacctccaagctgcctttattcattcccaggcataggctgaactaactttgggagaaacttagtttataatttagacaaagaggataacagccctttcccaaagcagacctccttcttgcctggggactagattgcctttgtaggactaacattagccacaagattagaaattatggtttagggctgggcacggtggctcatgcctgtaatcccagcactttgggagccataggagggcggatcacctgaggtcaggagttcaagaccagcctgggcaacatggtgaaaacctgtctctactaaaaataaaaaataaaattagctgggtgtggtggcgtgcacctgtaaccccagctactagggaggctgaggcaggagaattacttcaactcgggaggtggaggtggcagtgagccaatatcacaccactgcactccagcctgggtgacagagcaagactccatctcgaaaaaaaaaaagaaattatggtttaggagtcacgcagctggaagctacaagattctgaccttccctaaactgctcctaagatcagtgcttgaggtattttgtagaccctgctcttggtggatcagctggcccccacccagatcaataaactggcttagctgatcttgtggcccccacccaggaactgactgagagcaagaagacagctctgattccctgtgatttcatctctaactaatcagcactcctggctcactggcttcccctgacccaccaagttatccttaaaaactctgctcccagaatgttcggggagactgatttgagtaataataaaactccggtctcccgcacagccggctctgtgtgaattactcattattgcaatatccctgtcttgaagaattggctctgtctaggcagtgggcaaggtgaaccccttgggcagttacacctctggcaagaagacacaccaaatgcaatccctgtgggtcactggatcagagtcctcccgctctccttcctggaactcagtcagcactttggtccctgtggctctgaccactctgagggagcaagcaggcagtttgtaccaggagggtcttatagtaacaaccccgtgagtcccttctccaagccgtgtaaatccaatccttattggtttgcttagctaggggtcagttcaagtcctcaggtaccagatctcaagcctgagtgagcatcagtaccacctgaggaatttgtcgacccacaacttcagggccccacaccccagaggttctgatgcaggagacctgagacagtttcgcaggctaatctgaggatctgcttctctgggtgtgtttccttaggtaatcacctacggaaataaccacacacagagcagctgtatcagaacagtcgcaaccctttgctaactcaaggctcctctatcctggctgcaaactagcatcacttgacgagctttaacagtccagtgctcaggccccacccagaccaatgaagtcagaaattctggggtggaacccaggcatcggcatgtttttaaaactccccaggtgactctgaagcatggtgacaattgagaacggcttttcccacctctagtgacacaagaccctcatcaattctcctcaaaagcaatttttctgcttccttaattctcgttctccaagccaattctcatctcattcttctccccagtggttcagatttatgtagtcagggagtgggagtgatgagtattgttttctttctttcttttttttttttttttttttttgagacagcgtctcactctgttgcccatgctggaatgcagtggcacaatcttggctcactgcagcttggaccaaatgggcttaaacaatcctcccacctcagccacctgagtagctgggactacaggcatgcaccaccatgcccaattaattttttttttttttttttgtagagaccaagttctccagactggtctcctgagcttaagccatcctcctacctcagtctcccaaaatgctaggattacaggtgtgagccaccgtgcccaatctgagtattgcttgcttgctttctttctttctttctttctttctttctttctttctttctttctttctttctttcttttctattcttttcttttcttttcttttcttttcttttcttttttaattgagacagagtctcactctgtcgcccaggctggagtgcagtggtgcaatctcggctcactgcaagctccgcctcccgggttcacaccattctcctgcctcagcctcccgagtagctgggaccacaggcgcctgccaccacacccagctaattttttgtatttttagtagagacgggtttcaccatgttagccaggatggtctcaatctcctgaccttgtgatctgcccgcctcggcctcccaaagtgctgggattacaggcgtgagccaccgtgcccggccttgttttcttaattctccagatgattccaatccacagccagagttaggacccactgctgcccagcatcttccgcaacctcctctaggctacctgcccagcttcttctgaggcagagagaaaaagaaaggaacatagaaacatagaacatagaaaggaagagagcaaggatgagcccccaaagggacttgatgatcaaagcagcataaaggtctaccccttcactgctggtcaagagtttgttccaaagttcacaacaaacccacactagaacccaaggctctgatgaaagcctatttcttgaggtgaatatgggccagaaaaggtaagtttcttcacctccaccctcagatggctcttgggaaaagccctctgaaaaaggcaactagcttccaagtagaaggttcaaagggcaaaagtccgttggggggcccagcatctgactgttccacctcattagccacaagtacatgagatcagtcattctggtaccaggagaagctgcacgaggacacctggccaaagctctcagacacacagagatccaaagtccttcacagcccacagcggctctggcagactcagggtaagctgtctgcccccttcccacagcaaccctcagcccccaccagcaccctgaaaggcaaaagcacgaaatacccttctcagccaagttgaacctggaatcatatcttctgttcattcatccagccaacatttattgaagaacccactacatgcaattcactgtggccacatgtgtatgacacgaagaatctttgcctgatccctgaagaacagtactctgtaaacaaagagccctgaactgccaggtactgctgactcactggtacaggggacatactgaaggcatagatggtaaaaatgtcctggtagtgtcctgaatggcaaaacaactaggtctcagtgtgggcaagtgtaggtaaggcaagaacagtcatgtccacctgtgaacagtgggccaaaacaccttggctctgaggaaaggacagtcgggtggagctggacttctggacacctatcctcttgctgagaggaaagttccacctctcttgcaaaacagaaagaaaaggctcagccctcctttctgatccctgagctattgtgaagtaaaatgtaaactgcttttaagtcatccaaagacagcatgcggaaggtaaagcttttagaaatcaataagatgcatatgatatgaatataacttgcagtaatagatactatttttaactgacaactgtgtgccaggtcactatgtacttacacctatcttctaatttaatctgacagagagtaagttttattatctttattttacacttgagaaaactgaggtcaggcagtgactagctccaaagcctacatccattccaccacaccacatacctccctaactgtatgcaagaatgtgagacggggagtgggattatctccccctgtggtaatggagatgcctagaacttcagagcactggggcagtccacgaatttctccaagaagtcagaataagcagcttcaggaggtgccatctgcacacctctctgtttgggaaaagcaaccatttctactaccctagacaggacagtgaggctccttcaaaactcagaattccttcactcactcactcattcattcattcattaagcttatattgagtacccactgtgttccaggccctgtgcaggctctgagattaagatccagtctccagccttcactcaaaagtggacattgacaattacaagaatcagttgctatgaaagtcactgagaggcaacctatctacccacacgtcactggaggagtgaatggggtgcaggcaagcaccaggatcactgttatctggactgagtgcatggaggctgctgctggggtgggggaggggaagcaatattcctgacagagagggcaaaacgttattaccctgacaatgaaatcagcaatgaatgaagtcaaccacccgtataaaaaaacctacttaagcaataaccagtaaatgatttcaaggtctattagtaataccagactatctagggctgtagttcaacagctctaaaggtagactatgcctgccaaaagactgcaaacaactggcaggagcagagactctgtgtttgctctttggaaactgtcatgatttgaatagaaaaagatgaaaatatggtacaaatatagatcacatttctatgaggtagggaccccattttatagaagagagaactgagggctgggcacggtggctcatgcctgtaatcccagcaatttgagaggccgaggaaggtagatcacctgaggtcaggagtttcagactagcctggccaacatggtgaaaccccatctctactaaaaatacaaaaaattagccgggcatagtggtgggcacctgtaatcccagctactcgggaggctgaggcaggagaatcgcttgaacccaggaggcggaggttgcagtaaactgagattacgccactgcactccagactgggcaacaagagtgaaactctgtcaaaaaaaaagaagaagaagaaggagaaggaggaaaaggagaaggagaaggagaacaagaggaaactgaggctaataaatttgacctagcattgattgaatcctgcctgattccacgctgttcaccaccatgcaccagtgccttccaaagggataagggtatcccctacactgttcaagaaaaagaagtctgactcagggcacccaatcattacagccatggagaaggcatcattgtagggtagagatatttcatccaacttttccagaaacatacctcaaccaacctaaggcaggcttaactctttttcataaaatcgtccctcaaccttggtcctttcctctaacaatcaccctccatgctttcagaatcattcatctgaagagcatgtctacattccttcccgttcctgggtctctacaatgcagtctgagatgttgcaactccttcctctttcaccctgcaaaagttttcctttgaccctctgagttgccaattccaaatgacattttattccttattttaaacttaatagctcctccagaaaggctatttttgagtgtaaacctgccacctctggtatgctgcccttgctctgtgctctcacctccccaattaactacactgcattagaacagtgtacatatgtctctcccacccacgagagctgtgtgagggcagagagtggataacagttatccttgtacccatgggcatagtcctgaactagacacacagtaacacttaatacattttgctgggtgaataaatgatatttctgaaacctgatttcaccctcactgccctgaaatttcattgccttaggagaaagcccacatgaaaagccaccagtgaccttcatatcaataaatccaatcaactatactcaatctttacctagcttgacctcttagcagattggacacaggtagtcattcattccttctcaattcactcccttccactcaccatcttccaggtttccacctatctctctagatgctccttctccatcttttcacaaaatacctatccctcaaatgtgggtattcctcagaatgcttctaagcccctttgtcctccctttctacatcttgtcccaaggtcatctcatctgttcctgtggtttctttttctttttatttttttctttcttttttttttttttttttttttttgagacagaatcttgctctgtcacccaagatggagtgcagtggagctgtctcggctcactgcaacctcttcctccagggttcaagcgattctcctgcctcagcctccagagtagctgggactacaggtgcacaccaccatgcccggctagtttttgtatttttagtagagacagggtttcgccatgttggccaggctggtctcgaactcctggcctcaagtgatcagcccacctcagcctcccaaagtgttgggattacaggtgtgagccaccgccctggcctgttcctatggtttcaataaccatatatacaatgatgactcccaaaagtatatcatcagcccaactgtcatgattctagatatatatgaatattcaaccacctactggacattaccaggcacatcaaactcaacatgtccaaaactgattccatcaatttctcccaaacctactgcaccttcggtgttccccatacaagtaactggcgtcaccatccacccatttatgcaagccaaagacctgggcatgttattgtcatcaacaacttccactcatatctactcatagtccaagtcttaagtctccctgtccccaaaacatgactctagtccaagccaccatcatttctcactaggatcatagcagcagcttcccacctgtctcccagctttcaatcctacatagaaaaactaatctttcttaaactcacaaattctaaaatctaaatcacaaatgccactcttctgcttttaaaggccttaagagttttctcattgccttagaagacagcccaccaaactccttaatatagttggtgcaatagattggagttttccaatatgcctcaacgtctcccatcccatattcctttcttacaatgtgactttgacactctacccatcaagaggcagggtctgtacccctcttctcgaaactggatggtcttctgtgaatgcctctacctatagagtatgacagaattgacaccatgcaacttcagagactaggtcataaaaggcaatgcaacttccactttgggtgctacaacactcattctggacgctttcagctgcctgcataagcagtctgactgcccacgagtcaccacgctgtgagaaagctcaacacagtccatacggaaagaccacatggaaagactgacacaatttgataaagaaggccgggtgcggtggctcacacccgtaatcctaacactttgtttgggaggccgaggcgggtagatcacctgaggtcaggagttcaagactaacctggccaacacggtgaaaccccgtctctactaaaaatataaaaattagccgggcgtggtggggcacgcctgtaatcccagctactcaggaggctgaggaaggagaattgcttgaatctgagaggtggaggttgcagtgagccgagatcgcgccactgcactccaacctgcacaaccggagcaagactccacctcaaaaaaagaaaaaaaagaagcccagattgtctgcaacttcctcagcaaccgtttttccagctcctgtcaccatctgctgcaaccacatgagggaccctgacctagaactgtcccactaagcccttcccaaatttctaagccacagaaatcataaaaaaaatgactactgttttaagacactacgttttagactatttgttatagcacaataataactagcacagcttataaagctttgaacaacctatgccttgactctatttacctctgcaagccaactctcaaccttttcttcctgaaattcaacactgcagcccaccctgaactcctttcagtgcctgaaaggagcacttctggcatttaggttttcatacattctgttcttgctgcttggaacactcctcttctactcttgattaattcttcttcgccattcaggtatcagctcaaacttctacaggaatggtttctaaatgcctaggttaggactggtctcctcctgtgccttgttctaccttgcaaatcacaacaccatcacaatccattaaaaccctgtatcagaggccaggcacggtggctcacgcctgtaatcccagcactttgggaggccgaggcaggcggatcatgaggtcaagagatcaagaccatcctggccaacatggtgaaaccccgtctaaaaaatacaaaaattagctgagcatggtggtgcatgcctgtagtcccagctactcaggaggagacaggagaatctcttgaacctgggaagcagaggttgcagtgagctgagattgcgccactgcactccagcctggtgacagagcgagactccgtctcaaaaaaacaaaacaaaacaaaaatccctgtattgggttgcccatcctgaccccggcatgcacccatgcatgcggtcacacacacccacgcacacacataaagtgctccaaaaagacaatgacagtgcagggaacgtggcaacctcttcgcaaatacttgttgaatgtttaatctccaaccctatctctttcctaaattccaaagagcatatctgcctactatgctaaaaataaattccaaattcaacatgcccccatcctcctcctcacagtaaatgatatcactgcctacaaattgtctaaaccagaaacatcatctcttcattcaaagactatttattgagggccgggcacggtaggtggctcacgcctgcaatcccagcactttgggaggccgaggcaggcagatcacttgagttcaggagttcgagaccagcctggccaacatggtgaaaccccatctgtactaaaaatacaaaaattagcagggcggggtgacatgcacctgtagtcccagctactcaggacactgaggcaggagaatcccttgaacccgggaggcagaggttgcagtgagccaagatcctgctactgtactccagcctgggcgacagagcaagactctgtctcaaaacaacaacaacaacaaccaaacaaacaaacaaaaaaaatatttatcaagcttctctgtttccttgctggggatacagtggattatagataggcacagctcttctggcacaaaacttacaagatggtagatgttttccttgacacttccctctcccttatacttgacatcttaataggtctcattggttgtattgattataccttctaaattgtgctcagatctatccttccttgtccaccccaactgccatcaccgtagttcaggtttttgtcatttcctgcctggattgctacaagagcttcctaatagtgtctctgcctccagccttgtcccctaagttccaccccagctatatcactcccctgtttaaagtcctttaatggttcctcatatgctttgaataaattctaaaaccctacaaagatataccttgtgttctagccccttgcccatcttggtcccctcatatcccacaatcccccatgcacccccacaccccatacatttttttcatcttgtgcctttacattggctttccctgtgcctaaaacgtcctgcccccttcttcattcaacatacaattattgagcacctagcagataccaggcactgttctatgtgctggtgattcagcagtgagtaaaacaaagtccttattcacatatgtttatattctagagggaaagagagacaagtaaatgatgtgttgaacactgttataaagaaaaagaggccaggcacggtggctcatgcctgtaatcccagcaccttgggagaccaaggcgggcagatcgcctgaggtcaggagtttgagaccagcctgactaacatggtgaaaccctatttctgctaaaataccaaaattagccaggcacagtggcagcgcctgtaatcccatctacacaggaggctgaggaaggagaatcgcttgaacccggaaggcggaggttgcagtgagctgagatcgtgccattgcactccagcctgggcaacagagcgagacaccatctcaaaaaaaaagaaaaagaaaacaggatggggaactgagagtgaccattttagatacgataggtctctagtaaggtactatttttgcaaagaggtgaatggagtaagggaataagctctgcaggcatctggagacgtgccttccttgcagaagaaacaaatacaaaatccctgagacatgtatgtgccaggaaaatgcaggagaggcaagaaggccagtgtagctggagcagacaaagtgagggcaagaagtccaaggtgaatcaaagaagtcaggtggagtagggccacataggccacggtagaaatgtgggtgcttcagcccagcctgactcctttcatccttcagtgctgatgcagacatcatcccctgaacaagccactctccacccctgcaagcacctgccacatatacatgtttaagtgactatgtctacctcgcttcccaccacactgtgcgttccctacaggcaggggctccacctttcagttccatgctttatagagcccaacatgttcagaaaaaatttctcaaattattcaaactttcttcttttgttccaattccacaccctgcaagcaacttcctgattactagattggtttcccagttactagggtatcagggaggggatgccttgatagtgaacacacaccttctggtcattagaaattactcatgtgggaaaggattccgtatttaataaatggtgctgtgagaactgcctagccatatgcagaaaattgaaactggagcccttccttatatcttatacaaaaattaactcacgatggattcaagacttaaatgtaaaacccaaaactataaaaaccctagaaaaaaatctagggttttatagcaataccattcaggacataggcacgggcaaagatttcatggcaaaaataccaaaagcaattgccaaaaaagcaaaaattgacaaatgggatcttattaaactaaagagcttctgcacagcaaaataaattatcatcagagggaagagacaacctctacagaatgggagaaaatttttgcaatctatccatctgaaaaaggtctaataaccagagtctacaaggaatttaaacaaatttacaagaaagaaacaaacaatcccattaaaaagtgagaaaaggacatgaacaaacacttctcaaaagaggacattcatgcggccaacaaacatgaaaaaaagctcaacagcactgatcattagagaaatgcaaatcaaaaccacaatgagaaatcatctcacgtcagtcagaatgtcaataattaaaaagtcaagaaacagtcaggcatggtggttcacatctgtaatcccagcacttcgggaggctgaggcaggtggatcacctgaggtcagtagttcaagaccagcctgaccaacatggagaaaccccgtctctaacaatacaaaattagccaaatacaaaattagctgggcatgggggtgtgtacgcctgttatcccagctactcaggaggctaaggcaggagaattccttgaacttgggaggcggaggttgcattgagccgagattgtgccattgcactccagcctgggcaacaagagtgaaacttcgtctcaaaaaacaaaaaacaaacaaacaaaaaaaggcaagaaacaacagatgctgacaagtttgcagagaaaaaggaacacctggccaggtgcagtggctcatgcctgtaatcccagcactttgggaggccaaggcaggtggaccacaaggtcaggagttcaagaccagcctggccaagatggggaaactccatatctactaaaaatacaaaaattagccaggtgtggtggtgggctcctgtaatcctagctactcagaaggctgaggcagagaaccactcaaaacaaggaggcagaggttgcagttagccaagatcatgccactgcattccagcctaggtgacagagcaagactcagtctcaaaagaaaaagaaaggtacggcaagtaagaaaatgtggtacatatataccatgaaatagtatgcagccataaaaaggaatgagatcatgtcctttgcagggacatggatgaaactggaagccattatcctcagcaaactaatgtaggaacagaaaaccaaacaccaaatgttctcacttataagtgggagctgaacggtgagaacacatagacaaatgcgggggaagaacaacacacactggggcctgtcggtagaggttggtagagggagggcatcaggaatcatagctaatggatgctaggcttaatacccaggtgatgggttgatctgtacagcaaacaatcatggcacatgtttacctatgtaacaaagctgcacatcctgcacatgtgccctggaacttaaaataaaagtggaagaaaaattaaataaataaaaattttaaaaaaagaaattacccatgtatgctcatcaataaactgtacatacatcaaaggccgagggcggtggctcacgcctgtaatcccagcactttgggaggctgaggcgggcagatcacgaggtcaggagattgagaccatcctggccaacatggtgaaacctcgtctctactaaaaatacaaaaattagctgggtgtggtggcaggagcctgtaatcccagccactcgggaggctgaggcaggagaatcgcttgaagctgggatctcggctcactgcaacctccgcctactgacatagcgagactctgtctcaaaaaaaaaaaaaaaaaaaaaactgtacatacatcagtaaactgacattatcattcacacatcaatctcttttttttttttttttttttttttttgagacagagtcttgctctgtcgcccaggctagagtgcaatggtgcaatctcggctcactgcaacctccacctcccaggttcaagcgattctcctgcctcagcctcccaagtagctgggattacaggtgcccgccatcatgcccggctaatttttttgtgttttagtagagacagggtttcaccatatcgacctctttttttaggtaagcgtgactcaactgctgggaaaatgacccaaatctgtgtcatgacacccaaagaaggcgctgctcatggaagggccacataagcagcctggcagaagacttggatgccctgtctacctcacactcagcccaccttccctattttagatggcagccccatcacccacacctgtccaagctcaaatctctagcttcatgaactctgagagcttccatattccccatacctagaatatatgggtaatggggtgtgcatgaaggattatgggatatgagaaggccaaagcggcaaaagcacaaggcacaccttcctagggatttagattttatcctaaagcatatgaggagccactggaggattttaaacagggagcaacatactggggtggaaacctatgggcaaggctggaggcagggctttacctgtgagagctccccgacccccggcaaaaagtccttgaaagtccactgttaacttttttttttttttttttttgagacggagtctcgctctgtcgcccaggctagagtgcagtggcgcgatctgggctcactgcaagctccgcttcccgggttcatgccattctcctgcctcagcctcccaagtagctgggactacaggctcctgccaccatgcccggctaattttttctgtatttttagtaaagacgggatttcactgtgttagccaggatggtctcaatctcctgacctcgagatccaccagcctcggcctcccaaagtgctgggattacaggcgtgagccaccgcgccgggccaactatttctttattcataccctcatctctgttcctaaggccactccacagtgcagatattcatcacccttcacatggattcaggtttcagctccctaaaccagtctccccaccttctgtctcttgctctttccaaaaacattctccatgtggccaccagagttctccttttaactaagtctcattatttcactagtccccatacccctgcttaataatcagtagctgtgtagctttgtagctcccacctgtaatcctagctactcaggaggtaggaggattacttgaggccaggagttggaggctgcagtgagctatgactgcaccactgcactcctgcctgggcgacagagcaagaacccccatctctaaaaatataaaaataaacaatagcttccccttatcttttagataaagtccaacctgattataaaacccatctcacccagggctgtctcctcgcccttctcccaccccacattccaaccataccaaaccaacgacctggaattctctgaacattctgtaccttgcacctccacacctttgcacatgcagtctcctgtgtgaaaggtcacaggagacagctatatttattttcaaaattcagctcagacaccatgttctctgcgataccttcctaagctatcctcccctacaaaaataaagttgtcccatttaggtcgggcgtggtagctcatgcctgtagtcccagcaatttgggaagctgaggcgggcagttcgcctgaggttaggagttcgagaccagcctggccaacgtggtgaaaccccgtctctactaaaaacacaaaaattagccgggtgtggtggtgcacagctgtaatcccagctgctcaggaggctggggcaggagaatcgcttaacttgggacatggaggttgcgtgagtgaggcgagatcacaccactgcactccagcctgggcaacaagagtgaaacttcatctcaaaaaaaaaaaaagaagttgccccatttgctcttatggtgcctctatcagtgtacaaattatattgcatgacaattatttgttaacatgtcagtctcctttctggactataaattattgaatggcaagggccagacatcattcttctttgtttttcagcactaagtaaaatatctagcacacacatagcatgccctaattaaattttttctaagggagggaatgtatgaaagctctaaattaaagcccttctcttgctaaatctgaagattctgcctaagttctcacttaggctaatcagaatgtcttcataggtcccagcatctgacttgtgtcaggtgcttattcaacagtgcctgaagaccaggcacaatggctcacgcccgtaatcctagcactttgggaggccaaggcaggcagatagcttgagcccaggagtttgagaccagcctgggcaacatagcgagaccccatctctattaaagaaaattaaaaaacaaaaccaaaacagtggctgaaggaataaacccatgaatcatatgtcactaaattcttagtcttggttgcccttctgaaccttctttagatctctatgctcctctgaagttatcaaagatagaacaaagtccagatattatctatgcagtaatatttcatttatctaaccataactactcagatgaagccaagaagcaggaagaggaacaggactataagtgaccaagaaagacagtaatttgaaacataattcataattcatggttttcactgaatctcattccattctcacaacagcctggaattaaacagtcagtgcacctggctcaaggtcacatagctattgagcccaacctcaaacacaagtgtgtgcacaagtgctgtgcacctttcactctatcagagaaatctcaaatgtgtgtcacacatgtgtgtacaaaactctatgcattttactcactgaagagctctgcatacgaaccataactgcggctactttgcatgtattctttttgttttgttttgttttgtcttttgagacagagtctcgctctgtggcccaggctggagtgcagtagcatgatctcggctactgcaacctctgcttcccgggttcaagcgttcctcctgtgtcagcctccctagtagctgggattataggcacccaccaccacacccagcttttttttttttttttgagacagagtctggctctgtcacccaggctggcgtgcaatggcgcgatctctgctcactgcaacctctgcctcccgggttcaagcgattcccctgcctcagcctcccaagtagctgggactataggcacgcaccaccacacccagctaatttttttgcgtttttcatagagacggggtttcaccatgttggccaggatgatcttgatctcttgacctcgtgatccacccatctcggcctcccaaagtgctgggattccaggcgtgagccaccatgcccggccttttttgtatttttagtagagagggggtttcacgatccgcccatcttagcttcccaaagtgctaggattacaggcatgagcgactgcacccggcctttgcatgtattcttacaaggatgtacaggcacgtgaatgtgtacatgggtgaatgaggatttaaacatgtatgtctctatacccaaattagaagcagaaaattggccaggtgcagtggctgtgaaatcccatctcttctaaaaatacaaaaaattagcttggcgtggtggcgggcgcctgtaatcccagctacttgggaggctgaggcaagagaatcgctggaactcgggaggcggaggttgcagtgagctgagatcgcaccattgcactccagcctgggcaacaagagggaaacactgtctcaaaaaaaaaaaaaaaaaaaaaaaagcagcaacagcagaaaattaaaaagggttgactggcagaggtaggcacaaggtcagaatcgaggaacaagagctgtcagaaatgacacagacaaagatagttaaaataatagaattctaaggccgggaaggtggcccatgcctgtaatcccagcactttgggaggccgaggtaggcggattacctgaggtccggagttcgagactagcctgaccaacatggagaaaccccatctctactaaaaatacaaaattagccgggcatggtagcacatctgtaatcccagctactcgggaggctgaggcaggagaatcacttgaacctgggaggcagaggttgcggtgagccaagatcacgccattgcattccagcctgggcaacaagagcgaaactccatctcaaaaaaaaaaaaaaaaatagatttctggtattttaaaggaatgcagccatcttagaaatattacttagatgaaatgatccttctctgcacatgatataattaaccatatgcccacatttgagggtgctccaagaccaatagatcctaaaattagttttgccagtaagcaacctaccagatcatctgcaagtaatgcaagagaaatcacagatcatatttaagacctcagtgaaggctgggcacagtggctcatgcctgtaatcccagcactttgggaggccaaggcgggcggatcacctgaggtcgggagttcaagaccagcctgaccaacatggagaaaccctgtctctaataaaaatacaaaaattagccaggcgtggtggcacatgcctgtaatcccagctacttgagaggctgaggcaggagaatcacttgaacccgggaggcagaggttgtggtgagccgagattgtgccattgcactccagcctgggcaacaagagtgaaactccgtctcggaaaaaaaaaacctcagtgaaaacccccttcttgcaacacaaagcagtgccttccacccctccctgactgttgccatgtatgacaaacatcccatatgcagagatgagtccaggccagacacaaggacacacaaaacacagaaggaccccacagaagacagccagttctctacacaacagtaaaatcagagaagctggaaaggaagttgaggagtgaatggggcaatacagaaattgaaagaaaaaaggacacaaactgattggagagcggtgagccaatgagcaattgcacctggtgcaaaattcctgtgccccaactgctagagcagctgcccctcaaattgacagaatgtctgagcttcttcacagttgcagggtggaaggcatctctaaggtcctaggctctcccaggttggaagggcatttttcaagaatagtggcatctgagggatggggctatggagaatcatcatctcagcacctccaatggctttactgaatgtacagatttaaataatgttttatttatgagatggagaaaaagccaaggtggactgaaatgacagtattaaaaatctagcccacagaggccgggtgcagtggctcacgcctgtgatcccaacactttgggaagccaaggcaggtagatcacttgagctcaggagttcgagtccagcctggccaacacagtgaaaccccgtctccaccaaaaatacaaaaaaattagctaggcatggtggcacatgcctgtaatcccagctactagggaggctgaggcaggagaatcacttgaacccagaagatggaggttgcagtgagctgagattgcaccactcaagcctgggcgacagagtgactctatctcaaaaaaaaaaaaaaaaaaaaaggaagaatccagcctacagaaatactcatgcagctgcaaaaagatattcactggagcattatctgtaagactgagaaactgaaaccaacgtacatggccattaacagaggaccagctagataaataaactactatgcatccttaaaattcacatgaaataatatgaagcattttttaaaaagtagatctgtaagtagaaaagaatgtcactgataatgctagaggaaaagcacactgtagaattacatgtagactagtatgacctcatttttgtaaaagaacaaaactacacctcttttttttttatttttatttttttgagatagagtctcactctgttgcccaggctggagtgcagtggtgcgatcttggctcaccgcaacctctgcctcctgggttcaagcgattctcctgcctcagcctcctgagtagctgggattacaggcacctgccaccacacccagctaatttttgtatttttagtagagatggggtttcaccatgttggccaggctagtctcgaactcctgacctcaggtgatctgcccacttcagcctcccaaagtgctgggattacaggcataagccaccacaccctgccaaaactacatctcttgaaggaacaagaaaaaaaaatcagtgtgcctgtggtccctgctactcaggaggctgaggcaggaggatagcttgagcctagaagttcgaggctgaagtaaggtataatcacaccactgcactccagtctgggtgacagagcaaaatacctgtctctttaaaaaaaaaaaaaaaaaatcaggaagaatatgcaaactgctaatagtgcttactgtgagaagctggggaaaaggtgagtgtttttgcgatacactgtggtactgtttgaattttcacacaaagcatactttaactatatatatatatatatatgttgtcagagacattcctctctatctccttcttactcccagactgcactcacatcccagcctctgtccagccctccacccaccacctcctaccccagccccacttacaaatgcaggcagcagccagcaggcggctggcagcataaggggcgaagcagctcgggaagagaggctgtaccatgtagttggcaaaggtgatggcaatgatggcctggctggtgggctcaatgatgagcagggaggtccagagtctgatgaaagcaaggaatcctccaaaggcctccaggatataggcatagctggccccagatttcttaatggtggtgcccagttccgcataacaaagggccccaaagacggagaagaggcccccgacagcccagatgaccagagagagaccaaaggaggcactgtatatgagcacacccttgggggaaacaaagatgcccgagccgatcatgttccccacaatcaggcacacgccgttaagcagtgagatctccttcttcagcttcacctgctccggccctgggctggccccatcacccaaaggggaggtttccacctcaggctgggaggccacttcatactcagtgctgtcaaccatggtggaggagaggaaacccttcaccagcttcctggcattgccctttaaggaagaaagatgatgctatagattaggtggttggcaattacatagaacctctacccgcctccaacacagggtaatacgggcagctcaccaaccaatgcggagacctccaaataaccttttctccagctcactcatcaaaacaaccccaacttgaatatttgtctatctatctatgtatttatttatttattgacagagtctcgctctgtagcccaggctggagtgcagtggtgcaatctcggctcggctcactgcaacctcagcctcccgggttcaagcgcttctcttgcctcagcctcccaagtagctgggattacaggcacctgccaccacgcgtggctaattttttttttttttttttgagatggagttttgctcttgttgcccaggctggagtgcaatggcgcgatctcagctcactgcaacctccgcctcccgggttcaagtgattctcctgcctcagcctcccaagtagctgggattataggcatgcaccaccacacccagctaattttgtatttttagtagagatggggtttctccatgttggtcaggatggtctcaaactcccgacctcaggttatccgcccgcctcggcctcccaaagtgctgggattacaggcgtgagccaccttgcccagcctccaacttgaatttttaagagaaggcactcattcgccagagagaaaggatctgtctctcatcattaggacattgctgcccacccgactcaccaaatagagaactaaatcttgggccgggcgctgtggctcacatctgtaaacccagcactttgggaggccaaggcgggcagatcacctaaagtcgggagttcgagaccagcctgaccaacatttagaaacccagtctctactaaaaatacaaaaattagccatgcgtggtggcacatgcctgtaatcccagctgcttgggaggctgaggcaggagaatcacttgagcccgggaggcagaggttgcggtaagctaagactgggccattgcactccagcctgggcaacaagagcaaaactctgtctcaaaaaaaaaacaaaatcaaaaacaaaacactaaatgttggttctctctgagcctgctataatacaagacaggcatgggggcagtgtggcggctcccagaaaataactataatggcttgaccccgagttttcagccttatccaaaacccgtcttccctccaatttcagcttcagggatcacctgtgctgaggtacaacattaggaactgaccctaccagcagctaatctgtgggagcgtctcatgacactgctcttttccccaaggactctacgtctgccaaaactaaaggcttcagaaacctgctggaaacccacaaccatcctcctgcccaaagagcatcccttaacccttagctggagtcttcagccctggcaaagcccaagtagacccacttcaccctgaaagaagacaggctattatcttttccttgcttttcctttcccattctctggtattctaagcctcctgctatcgatccctcacatcagcatcgttgaatcacccaaaaaagtatgaatgagagaagggcgatccaatgtaccataaaacctagggatgattggaggcagctgatggccactccctaccccagagttgctgctggagagatatcaccccgagccaaggcagggagacagctgcagccaggcagcacatgctggaaaacaccgaacaggagacagctgagaggaaaatgggagaggctagtcaagcaatggagagatgttagggtgagaggcactcgggagaagaagcgattagacactgcacagcagcaaagaggagggttagcaaggtaagtggagatgagaagagggtggaacgcacactcactccttggtcctggatataagcaggttctcacggcagtgtgagcagcagtcagggagagaagtgccttccaggatctgtggtctgatgctcctccttcccagccagcagtaaaagggaaggccagacaaatgcctatggatttaagcaagaagggtggaggaggtgaggcagcccgcaaaggaaggagtgagggagggggaaaggagtattaagcaaccatctgggtccaaggttcactggcccttcacatctgcaaaaggggcagctaggagctcttggctcagcactttctgtgataagaaggtgctctctcaggaatctcctttgtcagctctgctctgggaccaggggcccagaagaaaggacagtcagctgagtgcagtatctgtagccctggggaagctgtcccagagcaagttagctgaggacaggacagtagcggggaaggaatacacagcactctctctctctgtgtcctccatgccccaccctagcctctcttctctctcaccccaagcatttaagaaagggaggaaggttgcacagtgtgacacaaaggcttgttcccatgctgagatt

SEQ ID NO: 2765 - DNA, 46589 bp, Homo sapiens
  source 1..46589: mol_type = genomic DNA
ttaggaacataaacttttattgtcatccagcacctgtgatagtttcatgtctctctaaaggagacaggaaattggagcattgtgggcccttttaaaagaaaagaggagtaggtaggcacacccaggtgcttctaaaacaaccaagcccaaacctgacatgctcctccccacagtcaccttcattgtcccctttaaaagtctggaacagtatgtagcaaaacaaataaattacttttcatttcaaaaagtaagttcaaaggttgaagctgcctaggccaggcttctggacaggtgcctccaaagaagtgagctttccttttcaacttccttagctctagccagtagaccagaaacccctgctttccacatcaggattccagatggtgtttagttagatttgggatcccgttgcttgggcatctctcctccatcttccaaatccatttctgcagcaactgacatacacaggacctggaggtaccttgtggcagaccctacaaagagaactttgagttggaattgagaagaggtcagctgggctgagttcaagtgtcactgaatggaactcagtgtgaggggagtgattccactaagccgaagggttcataagaaggggctaaggcaaagatgtctttggaggctggatttacagaaaaaggcaaaaaccaagctctgcaatagctgagcggacttaaggatgcacggcttacccacgatccttcggaggtaaagcggtcgcttatgttctggcactctgatgatgaggaagtaaaagggcaggcctgagagggcaatggcaatgccgatgagggagttgatagtatcactgtaaagtggaacagccaccaggaagatggtgcagaggcagaagacaatcgggaagaaaacgctgagctaagggcacaggaaacataactggagtggacaactcaggattcttaacagctaaaataaccccacctcccataaggattagcgcactgagccttctttccatacctttaatttcaacacattactaacgaccaagtcccaggcaaaggtttctaaataaagtgctttgtcatagtcccttgtagcaacaactccagctgtttcaggtggagcagaggtaggatggagttgccttaccttgaggggacgaggtcgatcaggctccttccagcgcagataaagctgacccacaatagaaagccccacaaagaaccagtagctgaagctgtagtagttaatgagctggaagatgtcttccacgcacaagtagatcaatgccatgataccctgtaagcgtgagcctaagtcagctcttctcagggcctttgttaatccaaaggcttttcactccctttataccccagaaatccatcccctgtcaatcctcaaagtctcctggtcctcttctggttttaatccctttaacaccctagtttcagtaccttatcccctctcttataagtcagtagtctcaactggcttttcaacccattcttcaagttaaccctgtataaagcaagctcgaaacaatccctcaaaagtcttgcataggaccctttccataatggctccaacctacaataacccgctcttatctcctcctacatgttgagtatccctgttctgaaaatccaaaatgctccaatgagcatttcctttgagtgtcaagtcagcactcaaaaagtttcagatttttagagcatttcagattttggatattcagattagggatactcaacctgtattaaaacccatactgctttatcacaggattttctgatgctatttctcctacctaaagcccatctctaccatttgcaaccctagccatcaagatgcactttttttttctgagaacactttggtggattttaagacacacacacacacttctagatgtaattcttcaccctctactcccatggaagtgatcgtttcttctcttaaacaccgtatcactcactatctgtcatggcaatcaatcattacagtgtattccatgtactttttgccttatcttagagcagaggtgtaccattccttagagcatttggatttcccctgtagcggttagcatagtgccttgcccgtggtgaacattctgatccaccaatagtttttctattggaatctttcagagctttcaggaagctagaacagtcgcttctgctgttactaaagtttcccccgcaatctggctttcagtctcatccttgagttcacttacattgaagagcagagaaggcactggtgtgaaccgctcaacatggatcatgcagatggcatcagggagatggccttctcttgagcccacaaagaaaagcctatgttaggtaagataggagaagctgagaaaattggtggacacggtgcagcctggttcacctgccacatggccctccctctctgccatcccttccttcaaaagtatttggataatatggactggagctcagtattaagattaatgacaactgcaggcttctgctagaaacaagaagaaagaggttgtggtatcggttggagaacacaagtaatcaaaggctgggtcctgtaagttctgtccactgcatagccctttgatgatacacccctcacaaaagttgccactcttacctagaagcagccacaatggaggcattgaggccaccaaaacaggataatgcaactgacagtggaattatccagttaaatattccaaatatctgatctgcaaaagtctaagggaaaagaatggaagagtcattagcaggatctaaaagggatgaaagacatggatgggcatgcccccagattccccttattaggtattccaacctttcttccacagtggggttaacaggaccttcttgcaagcccggtattctaaatgaactcctttcaaggctgtctaccccctttccaggactttcaagagccagaatatacccagtaccccacaagacaccctcaaccttctgctagtgaaaatcctttaccacagcaacagcatcactggccaagatgtctctcatgtctagcacagtataataggccacattggtcaagatatagatgatggtgacaatgggcatggagatgccaatggagaggggcaggttcctacagccaaatagaataaaatgcacattagtcccacagtcatatccctatctctcctttaatccttagactctccctgccacaccggtctttccagggatggagactgttgctacatttcctcaatgcatttgtctttgacggtgccctggatagtggctgaagctctgaacacttaagaactaaagaacattaggggaaaggaatatcatattaggagacaggactgtgcagctgggagcagtggctcatgcctgtagtactaacactttgggaggctgaggcagggagatggctcgagtctaggagttggagaccagcctgggcaacatggcaaaaccctgtctctacaaaaaactagccaagcagctgggcgtggtggctcacgcctgtaatcccagcactttgggaggccgagccgggtggatcacctgaggtcaggagttcaagaccagcctggccaacatggcaaaaccctgttcctactaaaaatataaataattagccaggcatggtggcatgcacctgtagtcccagctactcaggaggctgaggtacgagaatcacttgaactcgagaggcggaggttgtggtaagccaaaattgtgccactgcactccagcatgggcgacagagcgagactctgtctccaaaaacaaaccaaaaaaaaaaaaattagccaagcgtggtggtgcatgcctgtaatcccagctatttgggaggctgaggtgggaggatcacttgagcctggggaggtcaaggctgcagtgaaccatgactgggccactgcactccagcctgggcaaggcagccagaccctgtctaaaaaaaaaaaaaaaaaaaaaaaagcagggcgggggggattaacaaagactgtccccagcatcataacgcacaggaaaatgggaggttgttttgttttataccccaaagatcttttggtgtcaggattccatctctaagattatcaacattggcaattttgcctcaaggttgagaaatataaaaagaaattatggaggcaaattgtgaaatttaacatcttcagagaataagataggccttcagtaggaagagaagtgtatgtatctgactagcagcctggaagatatgtctgcccaccccttcctcagtttgagaacctcaggagccatcctaactggtgggcaaaagaaagatgcaaagagctctcaaggtccctgtagcccaataaagccatgatctttataagcatccttaacagtaaggctgccaaaaaaaaagcacaaagtggggcaaatactctgcaaatagagtcatgcagtttctgtccggtaggtggaagtaccacccaggccttgatcctgcttctgttatctctgttcccatagcgttaccactagttgtgtaccaagagtgctcttctgtttctcaagccaaaaggagtttattggtataagaattgtgattcttttcacttaagcatttacagaaagctgggcacagtggctcatgcctgtaatcccagcactttgggaggctaaggcgggcggatcacctgaggtcaggagttcgagaccagcctggccaacatggtgaaacccatgtctctactaaaaatacaaaaattagccaggcgtggtggcaggcacctgtaattctagctatttgggaggctgaagcaggagaatcacttgaacctgggaggcagaggttgcaatgagccaagatcacgccattgcactccagcctgggaaatacagcaagactctctccaaaaaacaaaaaacattttaccgaaactccactccctggcaaatcttagttcccagaatcatagaattttagagccaggaaaggccatggagatcacagaatttaaccccctcaattacagataaggaaacaggcaaagagatggccgggcaactccctcaaggttagccaacaagtcagtggaaagatcaactctaggtccttgacttcctgtccagttctcttttcactctatatatagactacagagcaataatggtagggtgacttaattgaatgactgaaactataccacaatgtcagtatgaatttaggaaacaaggaaggtatcagagggaaacacaggaaggtttctggaagtctatatcccaaagctatgtatgtggggataagggtggataaaatatctatcaaggaaaatctgttttaaaaacatacataagcatataatacaacctgctttaattaatgcagaaattaatgaacaaatgtaaaaatgcctttaaaaatttacaaagcatacatgagtaagttcatattttagccctgttactgtgatcatagacaagttacttctctgagcctcaggcctcccatctattaaaatgaggctggtaaaattaacctcatagtggttgtggtatgctgtctggcacgtagtaggagctcattaaatgatggctatcactgctatggaaagttggtggtgcagtacctacctctcaggattcttgatctcttcagtgacatagttgagggtgtcccagcctgagtaggagaacagagctgagtacagtgccagggcaatgtcacccactgcaaatgatgaaccctcaaaggaattctcaaaatgagtagaggctcctggaacccaagaacattggaaggcaggggattagtggctcattctcccacttcaagatggtcaagtaaaggactgacagaatatggtaatataatagcaggtaagtggcctacaacacctttggcagcaagagtaccagtaagggaacaggaaacagaagagagacgtctatagagatagaccagaatgccctgcatcctaatgacatagatggggatcttgacaggaagggtccagggtagctttctaggataagaaaccaccatagagcagaaaagctggagaatagaaacaatgcagttctgttctgctctgcaggctgcctgattcctgcctcctatcacaatctgccaaaggcagctcccagggcatggctgtcaaccctttgccaagatcagcctcctctgggaggcagcgtgcatggaagttaaaggacagacttttgggtcagttgtcctggatacaaatttcaactcctctacttaccggtagcaacttgggcaagatatttaattcttttttttttttgggggggggacagagtctcgctctgtcgcccaggctggagtgcagtggcgtgatctcagctcactgcaaccaccgcctcctggattcaagcgattctcctgcctcagcctcccgagtagctgggattacaggcgcctgccaccatgcccggctaatttttgtatttttagtcgagatggggtttcaccatcttggccaggctgatcttgaactcctgacctcatggatccacccgcgatggcctcccaaagtgctgggattacaagcacgagccactgcgcccggcccaaggtacttaattctgcaggctgtttcctcatccataaaatgagaataataatagtgcccaccgaataaggttatagtaagaaatgagataatgcacaaagagcacttagaggagtgcggctcacagaaaatgcttaaaaaagattagttgctactaatattatttcttaccctggccaagtctaacaatgcctgcaacgatgaccgcgatcagtgccaatactttagcataggtgaaaatatcttgtaccagggttccccatttgacataggcacagttaatgaaggttaagagacctgaaagaaaaataatactgattggtgacttacccttaccaccctagggccttagactcccaagcaatttttccagtaccagtcaccaagatatatatacccttcagccaaagacagaccctctgacctgctctgcactggaaccctcggggccccagaatgtcctcaccattatcatacaaaggcctctatactccccacccccagcaccttatatgggagacacaaaacaaagtgactgcagatctgcttacataaaaaatacatccaaatgtccaatcacagcagtgggaggcaactgggaactgtacaggattagtgattgttccggctcttggctctgaaaagtcatggtctctccctcctacctcccattccccatgggctccaggacacagcactctgactctgtggtattactgttaaccttgaggagttctgctgtgacttatccaatgctgagccagcaggtcaggctgtgtggccaaggattaggatgaaggccagacttcctgcccactgcctggcagctcagctgcctgcttttgtgcttggaaagattcttgcagctaagagtggttcctgtagaatggggacagggcatttttcctgatgggacaatagagaagtaagagccacacacattcccccagtccttctactcagaagtacaggttttaaaagtaccttttatcagggttcttaactagggcctccatgaggctcgaaattctctttcaaagtgttatgtccatatgaatacagacatacctaagaaaaagtttcatatcttttcttagaaagggatcatagcttttatcagaatctcaagtccattatccctcccccaacaaaaaagttacaatctacgacttgaatttgaattacttgaagaagttcaacaagggaggctcacgcatgctgtgaggttgaccagtagccccagaatgtggccgagaagaaagttggaaaaaaaaatacagatcttcccactggtagcatagcgaatcgcttcattgctccctccttcccagctcagcaactggaacactataaggagggcttaactttaaagcccttctcccaagggctccaagggcaaggtcaacatcaccctgccttaccagtcaagagaatgaggcctagtacagttcttgcctacttcaggccaccaacacagtcagaaacaccctctgagttctcctggcagtggtgtggccttggtgtcgctagtcctcctattttgtggtgtcctggcctcaccacattctggctacttcatcctgagaagcagggaagtctggcctctcagaacagctgccccatcttctctctctcaccctcccttccaccaccaccctcattctactgactgcccaagttcctttctgctcttcctgagaaggcacattcctgtcctatataaatgcttgcctttctgcctaataaacaacaaaccttatcacagggctgggcaaaaatgtacccacagctccaggccaccccagtgctaagttaataatttaagacacaagtgtgcagcaccccacaaaatgaccaaagtggctgtatcttgccctccacaaatctttcaaatctgtcactcctcctcagccagtcacccatcctttactccccactggactccagcctccagccactcaacagcttagtgccccttctccccagcttgtaacctctgcccttatcctaggctctgcggctggctcataaccacaacatagccaggtttccaagtagaaacaccagacacaaaggatgctgccacattgtcaggaaaatgggatccccaaatacaaatttatgattccctgcagggtaaccatgagtcataacaccaaactggaataagcttacaggactagctctagttcagactcagagtctgagctgtgtgccacaaggttcttctcagttctgtccagggatgtaggcagggaaaaggagggataagcaaccaattcaccacctgctaccacagcagattctgaaatggaaatacatggcttgtttatattttattttatttatttttctttttctttttgagacagagtttcacccttgttgcccaggctggagtgcaatggcgtggtctcggctcatggcaacatctgcctcccgggttcaagccattctcctgcctcaacctcccaagtagctgggattacaggtgtgcgccactatgcccagctaatttttatatttttagtagagatgaggtttcaccatgttggccaggcttgtcgcaaactcctgacctgaggtgatccacccacctcagcctcccaaagtgctgggattacaagcatgagccaccgcgcccggcctatattttattatttttttttatttacttatttattgacttatttatttatttatttatttattttatttattttttgagacacagtcttgctctgtcacccaggctgaagtgcaatggcatgatcttggctcactgcaacccccacttcccaggttcaagcaattctcctgcctcagcctcccgagtagctgggactacaggtgtgtgccaccatgcctggctaatttttgtatttttagtagagatggggtttcaccatactggccaggctaatctcgaactcctgagctcaggtgatccgcccacctcggcctcccaaaatgctgagattacaggcgtgagccaccacacccgtccctttttgttttttttttggagatggggatctcactctttcacccaagccagagtacagtggagaaatcatagctcactgcagcatcgaactcctgagctcaagggatcctcccagctcagccaccctagtagctgggatcaaaggtgtgcaccaccatgcccagctaatttgttttaattttttttttttttgagatggagtcttgctgtcacccagcctggagtgcagtggtgcgatctcagctcactgcaacctctgcctccagggttcaagcagttctcctgcctcagcctcttgagtagctaggactacaagtgcccaccaccacacctggctaatttttgtatttttagtagagacagggtttcaccatgttggtcaggctggtctcgaactcctgaccttgtgatctgccctcctcagcctcccaaagtgctgggattacaggtgtgagccaccgtgcctggctgttttaatttttttagagacggggtcttgctatgtggcccaggctggtctcgaactcctggcctcaggcaatccttccacctcagctatctgaggagtaactgggattatagggaagagccatggcacctgggtggcttgtttacattttaatccctattgcttctctacttctttttttttttttttcgagacagtcttgctccgtcccccaggctggagtacagtggtgcgatctcagctcactgcaacctccgcctcctgggttcaagcggttctcctgcctcagcctcccgagtagctagaattacagacattcaacaccatgcccagctaatttttgtatttttagtagagacagggtttcgccatgttagccagactagtctcaaactcctgacctcaggtgatccgcctgcctcagcctcccaaagtgctgggattacaggtgtgagtcaccggcgtggcgtgcccagtctcttctctacttctctatccatccatttgtatccctctctttgtccaccagtatcccacctcccccactcctgagcctgatttctctgacccaccttctagccctgatctgctctctgtactgagcacagaaggctcagtttgaatgaggaagggaatcctacagaaagaaaccagggagcagagggaactgcctgaagagagctagccctcctcttcctcaaagcctagcttcctccagggcctcttgactgtgggagcaggaaatgggtatggcaggcagcagtgctgacagggctttttgtccccacctcagcggatacagctgaccactggccccagagcccagctaagtgcactgctcttgaagtggagcccaacctcctgcttcagggccaaggacaggaggggaccatggggttaggataatatggaggcaactgcaagttaacctcaagggcagagatgccctccccttctacctctaggggcaattcaatccccacccaacactgggccaagtctataagaggataacctgaaatcacctttgacccttgactcggtgcagcagcactcctgctttgaccccagggggagaaaaaaagaatctgcaaagaagtcactcgtggccgggtgcagtggctcacgcctgtaatcccagcactttgggaggccgaggtggacagatcacgaggtcaagagatcgagaccatcctggccaacatggtgaaaccctgtctctactaaaaatacaaaaattagctgggcatggtggtgtgtgcctgtagtcccatctacttgggaggctgaggcaggagaatcacttgaacccaggaggcggaggatgcagtgagccaagatcacaccactgcactccagcctggtgacagagcaagactccatctcaaaaaaaaaaaagagaagtcactcctataaccatctaaaaagatgttcctgaatggatcatcaaacccagcctacatacggtccccgggagtaggagactagttctagtggtaaggcccagcatcagcgctagaactaaaagccagaaagcaccagaccaggtggatccagaacagaacaaagcttgcaggcccactctggatcagatgctcaggtttagtttagacacctaaatgaaacatttcctgaaaaagaacattaaacccacaattctgtaagcactattacctttaaatacacacaatgtaacacacaaaacttatgattacaggcgtgaaccaccatgcccggcgtcattccattttaaaagtgatctatagagccaggcgcggtggttcgcgcctgtaatcccagcaccttgagagactgaggcgggcagatcacttgaggccaggagtttgagaccagtctggccaccatggcgaaaccccgtctctactaaaaatataaatattagctgagtgtggtggcgcatgcctgtaatcccagctacttggaggcagaggtaggagaatcatttgaacccgggaggcagaaattgcagtgagccaagatcacgccactgcactccagcctgggtgacacagtgagactccatctcaaaaaataaaataaaataaagtgatctatagctcttccttttactaagccaacagcgtcttcctcccagcttctaccagtagtgccagacccctcctctgtctccacacagaatgaagctaaatcctcttccacccaatggcccttcttaacattaaagatgaatatcacggccaggcgctggctcacgcctgtaatcccagcactttgggaggccaaggcgggcagatcatctgaggttgggagttcgagaccagcctgaccaacatggagaaactccgtctctactaaaaatacaaaaattggccaggcgtggtggcacatgcctgtaatcccagctagtcgggaagctgaggcagaagaatcacttgaactcgggaggtggaggttgcggtgaactgagatctcgccattgcaccagcctaggcaacaaaagcaaaactccatctcaaaaaaaaaaaaaaaagccaggcgcggtggctcacgctgtaatcccagcactttgggaagctgaggcaggcggatcatgaggtcaggagatcaagaccatcctggctaacacggtgaaaccccatctctactaaaaatacaaaaaattagccgggtgtggtggcaggcgcctatagtcccagacactcaggaggctgaggcaggagaatgacgtgaacccgggaggcggagcttgcagtgaaccgagattgcgccactgcactccagcctgggccacagagcgagactctgtctcaaaaaaaaaaaaaaaaaagccaggtgcagtggctcacgcctgtaatctcagcactttgaaaggccaaggcgggtggatcacgaggtcaggaaattgagaccagcctgcccaacatggtgaaaacctgtctctactaaaatacaaaaattagccaggcatggtggcacaagcctgtagtcccagctactcgggaggctgaggcaggggaattgcttgaacccgggaggcagaggttgcagtgggccgagatcacggcactgcactccagcctggccacagagcaagactccatctaaaaacaaacaaaaaggatgaacatcctgtccccttgagtctttactccttcaggctaaaacccagattttacaaccccttgtggagcaaatgtggcttccagacccctcaccatcccaggactgtcatttatttcactttgtcatttactgcatatacttcactgtgtcagtatttccccagaaatgcaagaccccacacagaaaactccagaccgtgttgccgactacggagtctcaacctgaaatcattgtttactacaactcctttctttcccacctcaaagtgatgagatctttcctcccctctttctggacctataaaaatgatttttttagctgggtgcgatggctcatgcctataatcccagcattttgggaggccgaggttggaggatcgcttgagtccaggagttcaagaccagcctgggcaacattgtgagaacacatctccacaaaacattttttttagttagccagacatggtggcacacacctgtggtcccagctacttgggaggttgaggcagggggatcgcttgagcccaagtggtcaaggctgcagggagctgtgatcgcaccactgcactgcagcctgggcaacacagtaagatcctttctccaaaacaaaaaaagtgattttttccccccagatacaggacttcatatttagtcttagtgactttcctctgagtttttatgcattattcttatatgatatgggatttttccttcttcattttattagttcaaatcccttctttaattttgtgaaatctgcaaatttgatcagcatacctcctgagtcttcactgaagtcaccctaaaaatgttgactagggccgggcgcagtggctcacgcctgtaataccagtactttgggagaccgaggagggaggatcacctgaggtcaggagtttgagaccaggttggccaacatagtgaaaccccgtctctactaaaagaacaaaaattatccgggtgtggtggtgggcacctgtagtcccagctactcgggaggctgaggcaggagaatcgcttgaacccaggaggcggaggttgcagtgagccaagattacaccactacactccagcctgggcgacagagtgagactccgtctcaaaataaataaataaataaataaatgttgacatgggctggcagcagtggctcacgcctgtaatcccaacactttgggaggctgaggcaggcagatcacttgaggccaggagttcgagaccagcctggcaatatggcaaaaccccatctctactaaaaggaaaatgcaaaaattagcagggtgtgatggcacacgcctgtggtcccagctactcaggaggctgagacatgggaattgtttgagcctaggaggcagaggttgcactgagccaagattgtgccactgcactccagcctaggtgacagagcaacactctgtctcaaaaaaaatttttttaataaaaaaattaaaatgttaggccgggcacggtggctcacgcctgtaatcccagcactttgggaggccgaggcaggcagatcacaaggtcaggagatcgagaccatcctggctaacacaatgaaaccccatctctactaaaaatacaaaaagttagccgggcgtggtggcgggtgcctgtagtcccagctactcgggaggctgaggcaggagaatggcgtgaacccgggaggcggcggttgcagtgagccgagatcgcgccaccgcactccagcctgggtgacagagcgagagttcgtctcaaaaaaaaaaaaattaaaatgttgactaagatcaacagagctgtatagtctatcactgtagacctttctgtatttgtcattattccacaatgttattcagccaactaagaatctaccaaactttatttttatctagtctaccttgtcaacaagaatatcatgagaatttgccacgaacctctccgaaatctgcatacacatgcctctgctctaacaatctaatgatgctatcaaacaattcaaatcaaattagtatatatttatgtagaatattcatagttacacccttgcagtagtcaaaaactagaaacaacccaaatgcccagcaacagtagattgaataaatactaaacagcactaagaataaacaatctgtaatcctagcacgttgggaggccaaggcgggcagatcacaaagtcaggagtttgagatcagcctggccaacatggtgaaacccccgtctctactaaaaatacaaaaattagctgggcgtggtggcgggcacctgtcatcccagctactcaggaggctgaggcaggagaatcgcttgaacccgggaggtggaggttgcagtgagccaagatcctaccactgcactccagcccgggcgacagagtgagactctgtctgggaaaaaaaaaaaaaaaaagtgaacaatctacgactacagacaaaaatacagaagaatctcaaacataataagcaagccagatgcaaaagtgtacatatagattatatccatttacataaaatcagagaaaactaatcaatgctactagaagtcagaatagtgatttccctttgtgtggggtggagaggcagggactgggaagagcataagaagggctcaagggtgctagttacacatgtgctcaactagtgacaattcattaagccataaacttatgagattgcactgttccttctgtatattatatttgaataaaaaaattaaaattgaaccaaaaagtgaggttagcagagtatggcttgttcttagtgaattcatacacgttactaatgatttcccacccttctgctcgtacttcactaaccagatttaacttacaagcctagaatttgggcaagaatccaccttaagttatcacttcagagtgctgctcatccacctccggtggaaagctgggctatcacttgtggtaggtagactaatggccccccaaagatgtccaccccctaatccctggaacctgtgagccatgttatattgcatggcaagggagaattaaagttgcagatagaggccaggcgcagtggctcatgcctgtaatcccagcactttaggaggccaaggcgggcagatcacctgaggtcaggaattctaaccaacatgagtcagcctaaccaacacggtgaaaccccgtctctactaaaaatacaaaaaatagctgggtgtggtggtgggtgcctataatcccagctactcaggaggctgaggcaggagaattgcttgaacccaggaggcggaggttgcagtgagccaagatcacaccactgcacttcagcctgggcaacagagcaagactctggctcaaaaaaaaaaaaaaaaaagaaaaaagttgcagacagaatgaagattgctaatcaagtgacaaaacagggaaatcattctgtattctctgggtgggcccaatgtaatcacaaaagttcttaaagatgaaagagggaggcagaaaggtcaatgtcagagtagtacaatatgagaaagactctcccagttactgctgactttgaaaatggaagggtccatgagactctagaagctgggaaaggcaagaagatggatcctctccttaagcctccagaaagaaacacagtgctacttcatattagcccagtgagacccatttcagacttctgacctccagaattatgagatgataaatttgtgttgttttcagccactcaattggtggtaacttgttagagaagcaatagaaaactcatatgttggctgggcacagtggctcgctcctgtaattccagcactttgggaggccagggtgggctgatcccttgagctcaggagtttgaaaccagcctgggcaacatagagaaaccctgattctacaaaaaatacaaaaattagctgggcctggtggcgtgcacctgtagtctcaactactcaggaggctaaggtgggagaattgcttgagcctggggaggtcaaggctgcagtgatccttgattgcaccactgcattccagcctgggtgacagagcaagactgtctcaaaaaaaaaaaaaaaaaaaaaaaaaaaacctaactgcaggcagaaaactggaagtagcactgggtggtactattcattacatttgttgaaaaatggagaaaggggaagtgaaacccttgacagctcactggatcttggtgtactgaaatttccctctcactgcaatcaaaagaatctaaatgtgaccttatgcaaagaaggcaggcatcccttatgatagcagatcctcaaacaagtatgtacctctctctttaatgtactacatgaatcccagctcttctagcaaatcatcatttttgaacaaagtatactctttcattatcatattctaatcaaatatcgctgatgcctatgaaattgtttcctcctttcagtaaaaggtcaaatacgggccgggcacagtggctcatgcctgtaatcccagcactttgggaggcggaggcagacgaatcacgagttcaagagattgagaccatcctggccaacatggtgaaaccccgtctctactaaaaatacaaaaattagctgggtgtggtggtgtgcgcctgtagtcccagctactggggaggctgaggcaggagaatcacttgagcccaggaggcggaggttgcagtgagctaagatcgcgccactgcactccagcctggtgacagagcgagactccgtctcacaaaaaaaaaaaaaaaaggtcaaatacgtttattagccttacttgtaatatttgtagataagagttcaaaagcatcatttctgatcttccatcccattttctccaaatgcgttactgagcaactcctctctgcctttattctctgctatgtagtctccaaaatacccagatttatacttttatctaggcatttttctccttgcctctaaaatttccattctaaagccttattatacacatctctcccaatccctataaacctcctctatcccttaccaggagtttatctttctggtatcttagaatcttagaatttacggttaggaactctgttctgtgttcttttttctttcacatacacagccttcagctgacaaagagacgaaaattccacctgccactcagtttgctactttaaacttcacgtcaccagtgagacatctcagctatcttctgactggtgacatcattcatcccacagcaattagcagaaggatagcagtccctaggcttaattggtgtgagcaagctcttggtcacatgttgctcagaaaaactgcacatttctaggttaggctgggtctgtgtatagtcagatgcacactattcctgggggaaggccaaaccccacaactggcatactcaggcctgctaataccctggtgtctccaaaatactctaccactgctgtttcctcagaaggtccagatataagctctctggaaacgcctcatatctgttacctaaacccagagatttcaagtctcttcttccttttctttgctgcatccccatttgttttgtctaatgttggtttgggaaaatctctacacctttttttttttttttttaattgagatggagtctcgctctgtcgcccaggctggagtgcagtggcgccatctcggctcactgcaagctccgcctcctgggttcacgccattctcctgcctcagcctcccgagtagctgggactacgggcgtccgccaccacgtccggctaatttttttgtactcttagtacagacggggtttcaccatgttagccaggatggtctcaatttcctgaccccgtgatccacccgccttggcctcccaaagtgctgggattacaggcttgagccaccgcgcccggcctggaaactctctacaccttgaaatcacaatttcaccctggcttctttgatacattatttcttccactctccctaggtgctgttatttctctcagatagcagatggccttcaaattattttacctttcagactacagaaaccttttactccaggtgcagtggctcatgcctataatcccagcactttggaaggccaagacgtgaggatcacttgaggccaggagttggagaccagcctgggcagcatagcaagaccctttctctacaaaaaaattacaaattagctggacttggtggtgcacactgatggtcctagctacttggaaggctgaggtgggaaggtcacttgagtgcaggattgagcccataaccatgctactgcacaccagcctgggcaacaaagcaagacttcgtctcagaaaataaaataacatttttgaccaggcgtggtggtggctcacacctgtaatcccagcattttgggaagccgaagtgggcggatcacctgaggtcaagcgttcatgaccagcctgaccaacatggcaaaaccccgtctctactaaaaatacaaaaattagccagccgtggtggcgcacgcctgtaatcctagctacctgggagtctgagagaggagaatcattttgaacccaggaggcggaggttgcagtgagccgagattgcaccactgcactccagcctggatgatagtgtgaggccccgtctcaaagaaagaaagagagagagagagagagagagagagagaaaggaaaagaaaagaaaaatatcttttttttttttttaaagacagagtctcgctctgtcgcccaggctggagtgcagtggtgcgatcttggctcactgcaacctccgcctcccgggttcatgccgttctcctgcctcagcctcccaagtagctgagactacaggcgcccgccaccaagcccagctaattttttgtattctttagtagagacagggtttcaccgtgttagccaggatggtctcgatctcctgacctcgtaatccgcccgcctcggcttcccaaagtgctgggattacaggcgtaaaccaccacgcccagccaattaaaataaaaattttaaagaaacaaccaattcgcttactcaggtgtcatgggtgagagcctctgtaattgcaaaattttgactgagacagtgaaagagatctaacttaactgactccatcttgcttctaacctccaagctgcctttattcattcccaggcataggctgaactaactttgggagaaacttagtttataatttagacaaagaggataacagccctttcccaaagcagacctccttcttgcctggggactagattgcctttgtaggactaacattagccacaagattagaaattatggtttagggctgggcacggtggctcatgcctgtaatcccagcactttgggagccataggagggcggatcacctgaggtcaggagttcaagaccagcctgggcaacatggtgaaaacctgtctctactaaaaataaaaaataaaattagctgggtgtggtggcgtgcacctgtaaccccagctactagggaggctgaggcaggagaattacttcaactcgggaggtggaggtggcagtgagccaatatcacaccactgcactccagcctgggtgacagagcaagactccatctcgaaaaaaaaaaagaaattatggtttaggagtcacgcagctggaagctacaagattctgaccttccctaaactgctcctaagatcagtgcttgaggtattttgtagaccctgctcttggtggatcagctggcccccacccagatcaataaactggcttagctgatcttgtggcccccacccaggaactgactgagagcaagaagacagctctgattccctgtgatttcatctctaactaatcagcactcctggctcactggcttcccctgacccaccaagttatccttaaaaactctgctcccagaatgttcggggagactgatttgagtaataataaaactccggtctcccgcacagccggctctgtgtgaattactcattattgcaatatccctgtcttgaagaattggctctgtctaggcagtgggcaaggtgaaccccttgggcagttacacctctggcaagaagacacaccaaatgcaatccctgtgggtcactggatcagagtcctcccgctctccttcctggaactcagtcagcactttggtccctgtggctctgaccactctgagggagcaagcaggcagtttgtaccaggagggtcttatagtaacaaccccgtgagtcccttctccaagccgtgtaaatccaatccttattggtttgcttagctaggggtcagttcaagtcctcaggtaccagatctcaagcctgagtgagcatcagtaccacctgaggaatttgtcgacccacaacttcagggccccacaccccagaggttctgatgcaggagacctgagacagtttcgcaggctaatctgaggatctgcttctctgggtgtgtttccttaggtaatcacctacggaaataaccacacacagagcagctgtatcagaacagtcgcaaccctttgctaactcaaggctcctctatcctggctgcaaactagcatcacttgacgagctttaacagtccagtgctcaggccccacccagaccaatgaagtcagaaattctggggtggaacccaggcatcggcatgtttttaaaactccccaggtgactctgaagcatggtgacaattgagaacggcttttcccacctctagtgacacaagaccctcatcaattctcctcaaaagcaatttttctgcttccttaattctcgttctccaagccaattctcatctcattcttctccccagtggttcagatttatgtagtcagggagtgggagtgatgagtattgttttctttctttcttttttttttttttttttttttgagacagcgtctcactctgttgcccatgctggaatgcagtggcacaatcttggctcactgcagcttggaccaaatgggcttaaacaatcctcccacctcagccacctgagtagctgggactacaggcatgcaccaccatgcccaattaattttttttttttttttttgtagagaccaagttctccagactggtctcctgagcttaagccatcctcctacctcagtctcccaaaatgctaggattacaggtgtgagccaccgtgcccaatctgagtattgcttgcttgctttctttctttctttctttctttctttctttctttctttctttctttctttctttcttttctattcttttcttttcttttcttttcttttcttttcttttttaattgagacagagtctcactctgtcgcccaggctggagtgcagtggtgcaatctcggctcactgcaagctccgcctcccgggttcacaccattctcctgcctcagcctcccgagtagctgggaccacaggcgcctgccaccacacccagctaattttttgtatttttagtagagacgggtttcaccatgttagccaggatggtctcaatctcctgaccttgtgatctgcccgcctcggcctcccaaagtgctgggattacaggcgtgagccaccgtgcccggccttgttttcttaattctccagatgattccaatccacagccagagttaggacccactgctgcccagcatcttccgcaacctcctctaggctacctgcccagcttcttctgaggcagagagaaaaagaaaggaacatagaaacatagaacatagaaaggaagagagcaaggatgagcccccaaagggacttgatgatcaaagcagcataaaggtctaccccttcactgctggtcaagagtttgttccaaagttcacaacaaacccacactagaacccaaggctctgatgaaagcctatttcttgaggtgaatatgggccagaaaaggtaagtttcttcacctccaccctcagatggctcttgggaaaagccctctgaaaaaggcaactagcttccaagtagaaggttcaaagggcaaaagtccgttggggggcccagcatctgactgttccacctcattagccacaagtacatgagatcagtcattctggtaccaggagaagctgcacgaggacacctggccaaagctctcagacacacagagatccaaagtccttcacagcccacagcggctctggcagactcagggtaagctgtctgcccccttcccacagcaaccctcagcccccaccagcaccctgaaaggcaaaagcacgaaatacccttctcagccaagttgaacctggaatcatatcttctgttcattcatccagccaacatttattgaagaacccactacatgcaattcactgtggccacatgtgtatgacacgaagaatctttgcctgatccctgaagaacagtactctgtaaacaaagagccctgaactgccaggtactgctgactcactggtacaggggacatactgaaggcatagatggtaaaaatgtcctggtagtgtcctgaatggcaaaacaactaggtctcagtgtgggcaagtgtaggtaaggcaagaacagtcatgtccacctgtgaacagtgggccaaaacaccttggctctgaggaaaggacagtcgggtggagctggacttctggacacctatcctcttgctgagaggaaagttccacctctcttgcaaaacagaaagaaaaggctcagccctcctttctgatccctgagctattgtgaagtaaaatgtaaactgcttttaagtcatccaaagacagcatgcggaaggtaaagcttttagaaatcaataagatgcatatgatatgaatataacttgcagtaatagatactatttttaactgacaactgtgtgccaggtcactatgtacttacacctatcttctaatttaatctgacagagagtaagttttattatctttattttacacttgagaaaactgaggtcaggcagtgactagctccaaagcctacatccattccaccacaccacatacctccctaactgtatgcaagaatgtgagacggggagtgggattatctccccctgtggtaatggagatgcctagaacttcagagcactggggcagtccacgaatttctccaagaagtcagaataagcagcttcaggaggtgccatctgcacacctctctgtttgggaaaagcaaccatttctactaccctagacaggacagtgaggctccttcaaaactcagaattccttcactcactcactcattcattcattcattaagcttatattgagtacccactgtgttccaggccctgtgcaggctctgagattaagatccagtctccagccttcactcaaaagtggacattgacaattacaagaatcagttgctatgaaagtcactgagaggcaacctatctacccacacgtcactggaggagtgaatggggtgcaggcaagcaccaggatcactgttatctggactgagtgcatggaggctgctgctggggtgggggaggggaagcaatattcctgacagagagggcaaaacgttattaccctgacaatgaaatcagcaatgaatgaagtcaaccacccgtataaaaaaacctacttaagcaataaccagtaaatgatttcaaggtctattagtaataccagactatctagggctgtagttcaacagctctaaaggtagactatgcctgccaaaagactgcaaacaactggcaggagcagagactctgtgtttgctctttggaaactgtcatgatttgaatagaaaaagatgaaaatatggtacaaatatagatcacatttctatgaggtagggaccccattttatagaagagagaactgagggctgggcacggtggctcatgcctgtaatcccagcaatttgagaggccgaggaaggtagatcacctgaggtcaggagtttcagactagcctggccaacatggtgaaaccccatctctactaaaaatacaaaaaattagccgggcatagtggtgggcacctgtaatcccagctactcgggaggctgaggcaggagaatcgcttgaacccaggaggcggaggttgcagtaaactgagattacgccactgcactccagactgggcaacaagagtgaaactctgtcaaaaaaaaagaagaagaagaaggagaaggaggaaaaggagaaggagaaggagaacaagaggaaactgaggctaataaatttgacctagcattgattgaatcctgcctgattccacgctgttcaccaccatgcaccagtgccttccaaagggataagggtatcccctacactgttcaagaaaaagaagtctgactcagggcacccaatcattacagccatggagaaggcatcattgtagggtagagatatttcatccaacttttccagaaacatacctcaaccaacctaaggcaggcttaactctttttcataaaatcgtccctcaaccttggtcctttcctctaacaatcaccctccatgctttcagaatcattcatctgaagagcatgtctacattccttcccgttcctgggtctctacaatgcagtctgagatgttgcaactccttcctctttcaccctgcaaaagttttcctttgaccctctgagttgccaattccaaatgacattttattccttattttaaacttaatagctcctccagaaaggctatttttgagtgtaaacctgccacctctggtatgctgcccttgctctgtgctctcacctccccaattaactacactgcattagaacagtgtacatatgtctctcccacccacgagagctgtgtgagggcagagagtggataacagttatccttgtacccatgggcatagtcctgaactagacacacagtaacacttaatacattttgctgggtgaataaatgatatttctgaaacctgatttcaccctcactgccctgaaatttcattgccttaggagaaagcccacatgaaaagccaccagtgaccttcatatcaataaatccaatcaactatactcaatctttacctagcttgacctcttagcagattggacacaggtagtcattcattccttctcaattcactcccttccactcaccatcttccaggtttccacctatctctctagatgctccttctccatcttttcacaaaatacctatccctcaaatgtgggtattcctcagaatgcttctaagcccctttgtcctccctttctacatcttgtcccaaggtcatctcatctgttcctgtggtttctttttctttttatttttttctttcttttttttttttttttttttttttgagacagaatcttgctctgtcacccaagatggagtgcagtggagctgtctcggctcactgcaacctcttcctccagggttcaagcgattctcctgcctcagcctccagagtagctgggactacaggtgcacaccaccatgcccggctagtttttgtatttttagtagagacagggtttcgccatgttggccaggctggtctcgaactcctggcctcaagtgatcagcccacctcagcctcccaaagtgttgggattacaggtgtgagccaccgccctggcctgttcctatggtttcaataaccatatatacaatgatgactcccaaaagtatatcatcagcccaactgtcatgattctagatatatatgaatattcaaccacctactggacattaccaggcacatcaaactcaacatgtccaaaactgattccatcaatttctcccaaacctactgcaccttcggtgttccccatacaagtaactggcgtcaccatccacccatttatgcaagccaaagacctgggcatgttattgtcatcaacaacttccactcatatctactcatagtccaagtcttaagtctccctgtccccaaaacatgactctagtccaagccaccatcatttctcactaggatcatagcagcagcttcccacctgtctcccagctttcaatcctacatagaaaaactaatctttcttaaactcacaaattctaaaatctaaatcacaaatgccactcttctgcttttaaaggccttaagagttttctcattgccttagaagacagcccaccaaactccttaatatagttggtgcaatagattggagttttccaatatgcctcaacgtctcccatcccatattcctttcttacaatgtgactttgacactctacccatcaagaggcagggtctgtacccctcttctcgaaactggatggtcttctgtgaatgcctctacctatagagtatgacagaattgacaccatgcaacttcagagactaggtcataaaaggcaatgcaacttccactttgggtgctacaacactcattctggacgctttcagctgcctgcataagcagtctgactgcccacgagtcaccacgctgtgagaaagctcaacacagtccatacggaaagaccacatggaaagactgacacaatttgataaagaaggccgggtgcggtggctcacacccgtaatcctaacactttgtttgggaggccgaggcgggtagatcacctgaggtcaggagttcaagactaacctggccaacacggtgaaaccccgtctctactaaaaatataaaaattagccgggcgtggtggggcacgcctgtaatcccagctactcaggaggctgaggaaggagaattgcttgaatctgagaggtggaggttgcagtgagccgagatcgcgccactgcactccaacctgcacaaccggagcaagactccacctcaaaaaaagaaaaaaaagaagcccagattgtctgcaacttcctcagcaaccgtttttccagctcctgtcaccatctgctgcaaccacatgagggaccctgacctagaactgtcccactaagcccttcccaaatttctaagccacagaaatcataaaaaaaatgactactgttttaagacactacgttttagactatttgttatagcacaataataactagcacagcttataaagctttgaacaacctatgccttgactctatttacctctgcaagccaactctcaaccttttcttcctgaaattcaacactgcagcccaccctgaactcctttcagtgcctgaaaggagcacttctggcatttaggttttcatacattctgttcttgctgcttggaacactcctcttctactcttgattaattcttcttcgccattcaggtatcagctcaaacttctacaggaatggtttctaaatgcctaggttaggactggtctcctcctgtgccttgttctaccttgcaaatcacaacaccatcacaatccattaaaaccctgtatcagaggccaggcacggtggctcacgcctgtaatcccagcactttgggaggccgaggcaggcggatcatgaggtcaagagatcaagaccatcctggccaacatggtgaaaccccgtctaaaaaatacaaaaattagctgagcatggtggtgcatgcctgtagtcccagctactcaggaggagacaggagaatctcttgaacctgggaagcagaggttgcagtgagctgagattgcgccactgcactccagcctggtgacagagcgagactccgtctcaaaaaaacaaaacaaaacaaaaatccctgtattgggttgcccatcctgaccccggcatgcacccatgcatgcggtcacacacacccacgcacacacataaagtgctccaaaaagacaatgacagtgcagggaacgtggcaacctcttcgcaaatacttgttgaatgtttaatctccaaccctatctctttcctaaattccaaagagcatatctgcctactatgctaaaaataaattccaaattcaacatgcccccatcctcctcctcacagtaaatgatatcactgcctacaaattgtctaaaccagaaacatcatctcttcattcaaagactatttattgagggccgggcacggtaggtggctcacgcctgcaatcccagcactttgggaggccgaggcaggcagatcacttgagttcaggagttcgagaccagcctggccaacatggtgaaaccccatctgtactaaaaatacaaaaattagcagggcggggtgacatgcacctgtagtcccagctactcaggacactgaggcaggagaatcccttgaacccgggaggcagaggttgcagtgagccaagatcctgctactgtactccagcctgggcgacagagcaagactctgtctcaaaacaacaacaacaacaaccaaacaaacaaacaaaaaaaatatttatcaagcttctctgtttccttgctggggatacagtggattatagataggcacagctcttctggcacaaaacttacaagatggtagatgttttccttgacacttccctctcccttatacttgacatcttaataggtctcattggttgtattgattataccttctaaattgtgctcagatctatccttccttgtccaccccaactgccatcaccgtagttcaggtttttgtcatttcctgcctggattgctacaagagcttcctaatagtgtctctgcctccagccttgtcccctaagttccaccccagctatatcactcccctgtttaaagtcctttaatggttcctcatatgctttgaataaattctaaaaccctacaaagatataccttgtgttctagccccttgcccatcttggtcccctcatatcccacaatcccccatgcacccccacaccccatacatttttttcatcttgtgcctttacattggctttccctgtgcctaaaacgtcctgcccccttcttcattcaacatacaattattgagcacctagcagataccaggcactgttctatgtgctggtgattcagcagtgagtaaaacaaagtccttattcacatatgtttatattctagagggaaagagagacaagtaaatgatgtgttgaacactgttataaagaaaaagaggccaggcacggtggctcatgcctgtaatcccagcaccttgggagaccaaggcgggcagatcgcctgaggtcaggagtttgagaccagcctgactaacatggtgaaaccctatttctgctaaaataccaaaattagccaggcacagtggcagcgcctgtaatcccatctacacaggaggctgaggaaggagaatcgcttgaacccggaaggcggaggttgcagtgagctgagatcgtgccattgcactccagcctgggcaacagagcgagacaccatctcaaaaaaaaagaaaaagaaaacaggatggggaactgagagtgaccattttagatacgataggtctctagtaaggtactatttttgcaaagaggtgaatggagtaagggaataagctctgcaggcatctggagacgtgccttccttgcagaagaaacaaatacaaaatccctgagacatgtatgtgccaggaaaatgcaggagaggcaagaaggccagtgtagctggagcagacaaagtgagggcaagaagtccaaggtgaatcaaagaagtcaggtggagtagggccacataggccacggtagaaatgtgggtgcttcagcccagcctgactcctttcatccttcagtgctgatgcagacatcatcccctgaacaagccactctccacccctgcaagcacctgccacatatacatgtttaagtgactatgtctacctcgcttcccaccacactgtgcgttccctacaggcaggggctccacctttcagttccatgctttatagagcccaacatgttcagaaaaaatttctcaaattattcaaactttcttcttttgttccaattccacaccctgcaagcaacttcctgattactagattggtttcccagttactagggtatcagggaggggatgccttgatagtgaacacacaccttctggtcattagaaattactcatgtgggaaaggattccgtatttaataaatggtgctgtgagaactgcctagccatatgcagaaaattgaaactggagcccttccttatatcttatacaaaaattaactcacgatggattcaagacttaaatgtaaaacccaaaactataaaaaccctagaaaaaaatctagggttttatagcaataccattcaggacataggcacgggcaaagatttcatggcaaaaataccaaaagcaattgccaaaaaagcaaaaattgacaaatgggatcttattaaactaaagagcttctgcacagcaaaataaattatcatcagagggaagagacaacctctacagaatgggagaaaatttttgcaatctatccatctgaaaaaggtctaataaccagagtctacaaggaatttaaacaaatttacaagaaagaaacaaacaatcccattaaaaagtgagaaaaggacatgaacaaacacttctcaaaagaggacattcatgcggccaacaaacatgaaaaaaagctcaacagcactgatcattagagaaatgcaaatcaaaaccacaatgagaaatcatctcacgtcagtcagaatgtcaataattaaaaagtcaagaaacagtcaggcatggtggttcacatctgtaatcccagcacttcgggaggctgaggcaggtggatcacctgaggtcagtagttcaagaccagcctgaccaacatggagaaaccccgtctctaacaatacaaaattagccaaatacaaaattagctgggcatgggggtgtgtacgcctgttatcccagctactcaggaggctaaggcaggagaattccttgaacttgggaggcggaggttgcattgagccgagattgtgccattgcactccagcctgggcaacaagagtgaaacttcgtctcaaaaaacaaaaaacaaacaaacaaaaaaaggcaagaaacaacagatgctgacaagtttgcagagaaaaaggaacacctggccaggtgcagtggctcatgcctgtaatcccagcactttgggaggccaaggcaggtggaccacaaggtcaggagttcaagaccagcctggccaagatggggaaactccatatctactaaaaatacaaaaattagccaggtgtggtggtgggctcctgtaatcctagctactcagaaggctgaggcagagaaccactcaaaacaaggaggcagaggttgcagttagccaagatcatgccactgcattccagcctaggtgacagagcaagactcagtctcaaaagaaaaagaaaggtacggcaagtaagaaaatgtggtacatatataccatgaaatagtatgcagccataaaaaggaatgagatcatgtcctttgcagggacatggatgaaactggaagccattatcctcagcaaactaatgtaggaacagaaaaccaaacaccaaatgttctcacttataagtgggagctgaacggtgagaacacatagacaaatgcgggggaagaacaacacacactggggcctgtcggtagaggttggtagagggagggcatcaggaatcatagctaatggatgctaggcttaatacccaggtgatgggttgatctgtacagcaaacaatcatggcacatgtttacctatgtaacaaagctgcacatcctgcacatgtgccctggaacttaaaataaaagtggaagaaaaattaaataaataaaaattttaaaaaaagaaattacccatgtatgctcatcaataaactgtacatacatcaaaggccgagggcggtggctcacgcctgtaatcccagcactttgggaggctgaggcgggcagatcacgaggtcaggagattgagaccatcctggccaacatggtgaaacctcgtctctactaaaaatacaaaaattagctgggtgtggtggcaggagcctgtaatcccagccactcgggaggctgaggcaggagaatcgcttgaagctgggatctcggctcactgcaacctccgcctactgacatagcgagactctgtctcaaaaaaaaaaaaaaaaaaaaaactgtacatacatcagtaaactgacattatcattcacacatcaatctcttttttttttttttttttttttttttgagacagagtcttgctctgtcgcccaggctagagtgcaatggtgcaatctcggctcactgcaacctccacctcccaggttcaagcgattctcctgcctcagcctcccaagtagctgggattacaggtgcccgccatcatgcccggctaatttttttgtgttttagtagagacagggtttcaccatatcgacctctttttttaggtaagcgtgactcaactgctgggaaaatgacccaaatctgtgtcatgacacccaaagaaggcgctgctcatggaagggccacataagcagcctggcagaagacttggatgccctgtctacctcacactcagcccaccttccctattttagatggcagccccatcacccacacctgtccaagctcaaatctctagcttcatgaactctgagagcttccatattccccatacctagaatatatgggtaatggggtgtgcatgaaggattatgggatatgagaaggccaaagcggcaaaagcacaaggcacaccttcctagggatttagattttatcctaaagcatatgaggagccactggaggattttaaacagggagcaacatactggggtggaaacctatgggcaaggctggaggcagggctttacctgtgagagctccccgacccccggcaaaaagtccttgaaagtccactgttaacttttttttttttttttttttgagacggagtctcgctctgtcgcccaggctagagtgcagtggcgcgatctgggctcactgcaagctccgcttcccgggttcatgccattctcctgcctcagcctcccaagtagctgggactacaggctcctgccaccatgcccggctaattttttctgtatttttagtaaagacgggatttcactgtgttagccaggatggtctcaatctcctgacctcgagatccaccagcctcggcctcccaaagtgctgggattacaggcgtgagccaccgcgccgggccaactatttctttattcataccctcatctctgttcctaaggccactccacagtgcagatattcatcacccttcacatggattcaggtttcagctccctaaaccagtctccccaccttctgtctcttgctctttccaaaaacattctccatgtggccaccagagttctccttttaactaagtctcattatttcactagtccccatacccctgcttaataatcagtagctgtgtagctttgtagctcccacctgtaatcctagctactcaggaggtaggaggattacttgaggccaggagttggaggctgcagtgagctatgactgcaccactgcactcctgcctgggcgacagagcaagaacccccatctctaaaaatataaaaataaacaatagcttccccttatcttttagataaagtccaacctgattataaaacccatctcacccagggctgtctcctcgcccttctcccaccccacattccaaccataccaaaccaacgacctggaattctctgaacattctgtaccttgcacctccacacctttgcacatgcagtctcctgtgtgaaaggtcacaggagacagctatatttattttcaaaattcagctcagacaccatgttctctgcgataccttcctaagctatcctcccctacaaaaataaagttgtcccatttaggtcgggcgtggtagctcatgcctgtagtcccagcaatttgggaagctgaggcgggcagttcgcctgaggttaggagttcgagaccagcctggccaacgtggtgaaaccccgtctctactaaaaacacaaaaattagccgggtgtggtggtgcacagctgtaatcccagctgctcaggaggctggggcaggagaatcgcttaacttgggacatggaggttgcgtgagtgaggcgagatcacaccactgcactccagcctgggcaacaagagtgaaacttcatctcaaaaaaaaaaaaagaagttgccccatttgctcttatggtgcctctatcagtgtacaaattatattgcatgacaattatttgttaacatgtcagtctcctttctggactataaattattgaatggcaagggccagacatcattcttctttgtttttcagcactaagtaaaatatctagcacacacatagcatgccctaattaaattttttctaagggagggaatgtatgaaagctctaaattaaagcccttctcttgctaaatctgaagattctgcctaagttctcacttaggctaatcagaatgtcttcataggtcccagcatctgacttgtgtcaggtgcttattcaacagtgcctgaagaccaggcacaatggctcacgcccgtaatcctagcactttgggaggccaaggcaggcagatagcttgagcccaggagtttgagaccagcctgggcaacatagcgagaccccatctctattaaagaaaattaaaaaacaaaaccaaaacagtggctgaaggaataaacccatgaatcatatgtcactaaattcttagtcttggttgcccttctgaaccttctttagatctctatgctcctctgaagttatcaaagatagaacaaagtccagatattatctatgcagtaatatttcatttatctaaccataactactcagatgaagccaagaagcaggaagaggaacaggactataagtgaccaagaaagacagtaatttgaaacataattcataattcatggttttcactgaatctcattccattctcacaacagcctggaattaaacagtcagtgcacctggctcaaggtcacatagctattgagcccaacctcaaacacaagtgtgtgcacaagtgctgtgcacctttcactctatcagagaaatctcaaatgtgtgtcacacatgtgtgtacaaaactctatgcattttactcactgaagagctctgcatacgaaccataactgcggctactttgcatgtattctttttgttttgttttgttttgtcttttgagacagagtctcgctctgtggcccaggctggagtgcagtagcatgatctcggctactgcaacctctgcttcccgggttcaagcgttcctcctgtgtcagcctccctagtagctgggattataggcacccaccaccacacccagcttttttttttttttttgagacagagtctggctctgtcacccaggctggcgtgcaatggcgcgatctctgctcactgcaacctctgcctcccgggttcaagcgattcccctgcctcagcctcccaagtagctgggactataggcacgcaccaccacacccagctaatttttttgcgtttttcatagagacggggtttcaccatgttggccaggatgatcttgatctcttgacctcgtgatccacccatctcggcctcccaaagtgctgggattccaggcgtgagccaccatgcccggccttttttgtatttttagtagagagggggtttcacgatccgcccatcttagcttcccaaagtgctaggattacaggcatgagcgactgcacccggcctttgcatgtattcttacaaggatgtacaggcacgtgaatgtgtacatgggtgaatgaggatttaaacatgtatgtctctatacccaaattagaagcagaaaattggccaggtgcagtggctgtgaaatcccatctcttctaaaaatacaaaaaattagcttggcgtggtggcgggcgcctgtaatcccagctacttgggaggctgaggcaagagaatcgctggaactcgggaggcggaggttgcagtgagctgagatcgcaccattgcactccagcctgggcaacaagagggaaacactgtctcaaaaaaaaaaaaaaaaaaaaaaaagcagcaacagcagaaaattaaaaagggttgactggcagaggtaggcacaaggtcagaatcgaggaacaagagctgtcagaaatgacacagacaaagatagttaaaataatagaattctaaggccgggaaggtggcccatgcctgtaatcccagcactttgggaggccgaggtaggcggattacctgaggtccggagttcgagactagcctgaccaacatggagaaaccccatctctactaaaaatacaaaattagccgggcatggtagcacatctgtaatcccagctactcgggaggctgaggcaggagaatcacttgaacctgggaggcagaggttgcggtgagccaagatcacgccattgcattccagcctgggcaacaagagcgaaactccatctcaaaaaaaaaaaaaaaaatagatttctggtattttaaaggaatgcagccatcttagaaatattacttagatgaaatgatccttctctgcacatgatataattaaccatatgcccacatttgagggtgctccaagaccaatagatcctaaaattagttttgccagtaagcaacctaccagatcatctgcaagtaatgcaagagaaatcacagatcatatttaagacctcagtgaaggctgggcacagtggctcatgcctgtaatcccagcactttgggaggccaaggcgggcggatcacctgaggtcgggagttcaagaccagcctgaccaacatggagaaaccctgtctctaataaaaatacaaaaattagccaggcgtggtggcacatgcctgtaatcccagctacttgagaggctgaggcaggagaatcacttgaacccgggaggcagaggttgtggtgagccgagattgtgccattgcactccagcctgggcaacaagagtgaaactccgtctcggaaaaaaaaaacctcagtgaaaacccccttcttgcaacacaaagcagtgccttccacccctccctgactgttgccatgtatgacaaacatcccatatgcagagatgagtccaggccagacacaaggacacacaaaacacagaaggaccccacagaagacagccagttctctacacaacagtaaaatcagagaagctggaaaggaagttgaggagtgaatggggcaatacagaaattgaaagaaaaaaggacacaaactgattggagagcggtgagccaatgagcaattgcacctggtgcaaaattcctgtgccccaactgctagagcagctgcccctcaaattgacagaatgtctgagcttcttcacagttgcagggtggaaggcatctctaaggtcctaggctctcccaggttggaagggcatttttcaagaatagtggcatctgagggatggggctatggagaatcatcatctcagcacctccaatggctttactgaatgtacagatttaaataatgttttatttatgagatggagaaaaagccaaggtggactgaaatgacagtattaaaaatctagcccacagaggccgggtgcagtggctcacgcctgtgatcccaacactttgggaagccaaggcaggtagatcacttgagctcaggagttcgagtccagcctggccaacacagtgaaaccccgtctccaccaaaaatacaaaaaaattagctaggcatggtggcacatgcctgtaatcccagctactagggaggctgaggcaggagaatcacttgaacccagaagatggaggttgcagtgagctgagattgcaccactcaagcctgggcgacagagtgactctatctcaaaaaaaaaaaaaaaaaaaaaggaagaatccagcctacagaaatactcatgcagctgcaaaaagatattcactggagcattatctgtaagactgagaaactgaaaccaacgtacatggccattaacagaggaccagctagataaataaactactatgcatccttaaaattcacatgaaataatatgaagcattttttaaaaagtagatctgtaagtagaaaagaatgtcactgataatgctagaggaaaagcacactgtagaattacatgtagactagtatgacctcatttttgtaaaagaacaaaactacacctcttttttttttatttttatttttttgagatagagtctcactctgttgcccaggctggagtgcagtggtgcgatcttggctcaccgcaacctctgcctcctgggttcaagcgattctcctgcctcagcctcctgagtagctgggattacaggcacctgccaccacacccagctaatttttgtatttttagtagagatggggtttcaccatgttggccaggctagtctcgaactcctgacctcaggtgatctgcccacttcagcctcccaaagtgctgggattacaggcataagccaccacaccctgccaaaactacatctcttgaaggaacaagaaaaaaaaatcagtgtgcctgtggtccctgctactcaggaggctgaggcaggaggatagcttgagcctagaagttcgaggctgaagtaaggtataatcacaccactgcactccagtctgggtgacagagcaaaatacctgtctctttaaaaaaaaaaaaaaaaaatcaggaagaatatgcaaactgctaatagtgcttactgtgagaagctggggaaaaggtgagtgtttttgcgatacactgtggtactgtttgaattttcacacaaagcatactttaactatatatatatatatatatgttgtcagagacattcctctctatctccttcttactcccagactgcactcacatcccagcctctgtccagccctccacccaccacctcctaccccagccccacttacaaatgcaggcagcagccagcaggcggctggcagcataaggggcgaagcagctcgggaagagaggctgtaccatgtagttggcaaaggtgatggcaatgatggcctggctggtgggctcaatgatgagcagggaggtccagagtctgatgaaagcaaggaatcctccaaaggcctccaggatataggcatagctggccccagatttcttaatggtggtgcccagttccgcataacaaagggccccaaagacggagaagaggcccccgacagcccagatgaccagagagagaccaaaggaggcactgtatatgagcacacccttgggggaaacaaagatgcccgagccgatcatgttccccacaatcaggcacacgccgttaagcagtgagatctccttcttcagcttcacctgctccggccctgggctggccccatcacccaaaggggaggtttccacctcaggctgggaggccacttcatactcagtgctgtcaaccatggtggaggagaggaaacccttcaccagcttcctggcattgccctttaaggaagaaagatgatgctatagattaggtggttggcaattacatagaacctctacccgcctccaacacagggtaatacgggcagctcaccaaccaatgcggagacctccaaataaccttttctccagctcactcatcaaaacaaccccaacttgaatatttgtctatctatctatgtatttatttatttattgacagagtctcgctctgtagcccaggctggagtgcagtggtgcaatctcggctcggctcactgcaacctcagcctcccgggttcaagcgcttctcttgcctcagcctcccaagtagctgggattacaggcacctgccaccacgcgtggctaattttttttttttttttttgagatggagttttgctcttgttgcccaggctggagtgcaatggcgcgatctcagctcactgcaacctccgcctcccgggttcaagtgattctcctgcctcagcctcccaagtagctgggattataggcatgcaccaccacacccagctaattttgtatttttagtagagatggggtttctccatgttggtcaggatggtctcaaactcccgacctcaggttatccgcccgcctcggcctcccaaagtgctgggattacaggcgtgagccaccttgcccagcctccaacttgaatttttaagagaaggcactcattcgccagagagaaaggatctgtctctcatcattaggacattgctgcccacccgactcaccaaatagagaactaaatcttgggccgggcgctgtggctcacatctgtaaacccagcactttgggaggccaaggcgggcagatcacctaaagtcgggagttcgagaccagcctgaccaacatttagaaacccagtctctactaaaaatacaaaaattagccatgcgtggtggcacatgcctgtaatcccagctgcttgggaggctgaggcaggagaatcacttgagcccgggaggcagaggttgcggtaagctaagactgggccattgcactccagcctgggcaacaagagcaaaactctgtctcaaaaaaaaaacaaaatcaaaaacaaaacactaaatgttggttctctctgagcctgctataatacaagacaggcatgggggcagtgtggcggctcccagaaaataactataatggcttgaccccgagttttcagccttatccaaaacccgtcttccctccaatttcagcttcagggatcacctgtgctgaggtacaacattaggaactgaccctaccagcagctaatctgtgggagcgtctcatgacactgctcttttccccaaggactctacgtctgccaaaactaaaggcttcagaaacctgctggaaacccacaaccatcctcctgcccaaagagcatcccttaacccttagctggagtcttcagccctggcaaagcccaagtagacccacttcaccctgaaagaagacaggctattatcttttccttgcttttcctttcccattctctggtattctaagcctcctgctatcgatccctcacatcagcatcgttgaatcacccaaaaaagtatgaatgagagaagggcgatccaatgtaccataaaacctagggatgattggaggcagctgatggccactccctaccccagagttgctgctggagagatatcaccccgagccaaggcagggagacagctgcagccaggcagcacatgctggaaaacaccgaacaggagacagctgagaggaaaatgggagaggctagtcaagcaatggagagatgttagggtgagaggcactcgggagaagaagcgattagacactgcacagcagcaaagaggagggttagcaaggtaagtggagatgagaagagggtggaacgcacactcactccttggtcctggatataagcaggttctcacggcagtgtgagcagcagtcagggagagaagtgccttccaggatctgtggtctgatgctcctccttcccagccagcagtaaaagggaaggccagacaaatgcctatggatttaagcaagaagggtggaggaggtgaggcagcccgcaaaggaaggagtgagggagggggaaaggagtattaagcaaccatctgggtccaaggttcactggcccttcacatctgcaaaaggggcagctaggagctcttggctcagcactttctgtgataagaaggtgctctctcaggaatctcctttgtcagctctgctctgggaccaggggcccagaagaaaggacagtcagctgagtgcagtatctgtagccctggggaagctgtcccagagcaagttagctgaggacaggacagtagcggggaaggaatacacagcactctctctctctgtgtcctccatgccccaccctagcctctcttctctctcaccccaagcatttaagaaagggaggaaggttgcacagtgtgacacaaaggcttgttcccatgctgagattacaggaagtgtaagagcagtctctacaccatgtgactgggtgttctaagagaactctgcacacttccccatgcaaagagagactggggggttgcctccaagcctgggccactgccccaaagtctgagcctcagactacttcaaaagaaacacagtcaagagatcaaatatctgactgcatccccaccagacccacgtgccttttcattcttgacaaaacataccaagatctctgggataagcataaattcctataaacgccttcctcaaatataagttgactccactttcctaaaaaatatgaggaaatcaggccagacgcggtggctcacgcctgtaatcccagcactttgggaggctgaggcaggcggatcacaaggtcaggagatcaagaccatcctggctaacacggtgaaaccccgtctctactaaaaacacaaaaaaataaaaattagccgggcgtggtggcgggcacctgtagtcccagctattcgggaggctgaggcaggagaatgaggagaatggcatgaacccgggaggcggagcttgcagtgaacccacattaggccactgcactccagcctgggcaacacagcaagactccatctcaaaaaaaaaaaattaaaaaagaatatgaggaaatcagatttcactgaattctgttggacagacaggcccagaacaggcagaggaagctgagcactttttggaaatcacatagtttatgctatctttattatttactttaaatctggtattctgagtctcttttaccaacagaaatagaccctatccattctgaaatccaactgtctgtttcttctcctatctgttctaaccctctttggttattctacaaccagagaatagagatctaaatatctctgggagacatctctaccatacatcctcccattctagctctttaaacttttaatttaatctaggaggaggattctggtgtgagcgttcccagagatcatgcttctcccaagacaggctcacaatgatctgaaatccttctggaggagactctccttttctccaaaatgctcctgtaataataattgctatcacttattgagcacttactgggccagacacactgctaaggacttaagcacattatctcatggaacctccagagctcatatactcttaatcacacaagtatactatctctccatctccccatccccctggcctgccttagtctctaggccttccttttatttttttttttttttatttattttctttttttgagacagagtctcactctgtcccccaggctggagtgcagtggcacgatcttgactcactgcaacctccaccacctcctggttcaagcaattctcatgcatcagcctcctgagtaactaggattacacctggctaatttttgtgtttttatttcggtatttttattttattttattttattttattttatttattttgagacagacacttactctgtcgcccaggctggagtgcagtggtgcaatctcggctcactgcaacctccacctactgggttcaagcaattctcctgcctcagcctcccgagtagctgggattacaggtgcacaccaccacgcccagctaatcttttttgtttttagtagagtcggggtttcaccacattgaccaggatggtcttaaactcctaaactcaggcaatccgcccacctcggcctcccaaagtgctaggattacaggcatgagccattgtgcccagcctaatttttgtatttctagtagagacgaggttttgccatgttggccaggccggtcttgaactcctggcctcaactgatccacctgcttctgcctcccaaagtgatgggattacaggcgtgagccaccgatgccaccttagaccttgcttttggacaggaattatctacatgaattacctgggggaagatgtaagcagactagattaaaaagaaagaaagcctctgtcatccttcagtctatagcctagacgaaaggctccaacaaagtttgttaatctccttcctggctgcccctcccctttctcattctttgcagggataagaggtgattacaagtcctcttggcagtgctgctattgctagggtgcccacttctaaagcaaacaaaaaaaaaaacacaaacacatcatcacgcctgcccttttaagaccaaattcactggcaccaaggggtgggcatgtgtcctaatatgacgtaaaagaaaggaaggaaggagggacaaaggaagggaaaactgtgagggggaatggagagagaagtgtacagggtttcattcctgactggtagcatctgaaaagtgaagtcctatccgtggaattttgagacagaaatctgctgggggtaaaacccacactccagcaaacagcacgccctagtggtagcaccaggaagtgctagtggactctaacctacttcagtctgcccgtgcgcactaggcaagggaggctgccatgcattgagaacatgaagaccccctcttttctcaaccactacctagcaccctggacaagaaggcaccatctttggcagctcacatttctccctgagaccctgggtcttagggtaatgcttccaccattcaggcagccccaccattcaggcagcctgggaccagcaacacccctaggctctcccaaaggggctcttctaccccaggtttttggtttttttttttttttggtttttgggttttttttacccgagatggagttttgctttgtcccccaggctggagtgcagtggcacaatctctgctcactgcaacctctgcctcccgggttctcctgcctcagcctcccaagtagctgggattacaggtgcccgccaccgcgcccagctaatttttgtatttttagtagagatggggtttcaccatgttgtccaggctggtctcgaactcctgacctcgtgatcctcccacctcagcctcccaaagtgctgggattaaaggtgtgagccaccgtgcctgacccaccccaggttttacatgagaaaccccataagataacagcagcccttgttgcctttccctgtctgagatgcattcatctctgaacacccagtgaagattacaggacaacacactcatcctacagcttgtggaagaaatttgattcagaaactggcagcagggcctccagtatgcagtgctgggcaggacagccaatggagcccctcaccctaacctcaccctcgaatgacaacaccaaaacacaatttctccaggaactagtacataattcggggtcttggctcctcagccaagctcagggaactactataagaacacactttctctcccagagaccccatgtcctgccttcctggctccaatcagtctgtgctgcctcccctaacaacagaaacagaaaacagatacactctggtatgactagatttccccatcactccaagctagaagctcagctcctccctccccagttctctgtttgtttttctatattccactgtggctaagacagtctctttaaaaaaaaaaaaaaaaagtgaaacaaaaaagaaattgtttactcctgtggccagggcttccattaaggaagggctgaagtctctgggcagaaggttcagcccagggagggacagggctgggatcaagaaacaggaggctcttgggtctccattcagccaatttttaggactccatcctcctcctgcacttcccctctcgcccattgtccctcctctcccacctcttacctgtccagtgacctttgggcaggtgcggggaggaggggctaccagctgagtcaggggagaggggaaggtgctagttaggagaaccaagcgtatcgctcatgctgcaacagctgttgactctgaggagcagaaaaagcagagggtaacggggactgaaatggaaaacaggaaaac

SEQ ID NO: 2766 - DNA, 42670 bp, Homo sapiens
  source 1..42670: mol_type = genomic DNA
ttaggaacataaacttttattgtcatccagcacctgtgatagtttcatgtctctctaaaggagacaggaaattggagcattgtgggcccttttaaaagaaaagaggagtaggtaggcacacccaggtgcttctaaaacaaccaagcccaaacctgacatgctcctccccacagtcaccttcattgtcccctttaaaagtctggaacagtatgtagcaaaacaaataaattacttttcatttcaaaaagtaagttcaaaggttgaagctgcctaggccaggcttctggacaggtgcctccaaagaagtgagctttccttttcaacttccttagctctagccagtagaccagaaacccctgctttccacatcaggattccagatggtgtttagttagatttgggatcccgttgcttgggcatctctcctccatcttccaaatccatttctgcagcaactgacatacacaggacctggaggtaccttgtggcagaccctacaaagagaactttgagttggaattgagaagaggtcagctgggctgagttcaagtgtcactgaatggaactcagtgtgaggggagtgattccactaagccgaagggttcataagaaggggctaaggcaaagatgtctttggaggctggatttacagaaaaaggcaaaaaccaagctctgcaatagctgagcggacttaaggatgcacggcttacccacgatccttcggaggtaaagcggtcgcttatgttctggcactctgatgatgaggaagtaaaagggcaggcctgagagggcaatggcaatgccgatgagggagttgatagtatcactgtaaagtggaacagccaccaggaagatggtgcagaggcagaagacaatcgggaagaaaacgctgagctaagggcacaggaaacataactggagtggacaactcaggattcttaacagctaaaataaccccacctcccataaggattagcgcactgagccttctttccatacctttaatttcaacacattactaacgaccaagtcccaggcaaaggtttctaaataaagtgctttgtcatagtcccttgtagcaacaactccagctgtttcaggtggagcagaggtaggatggagttgccttaccttgaggggacgaggtcgatcaggctccttccagcgcagataaagctgacccacaatagaaagccccacaaagaaccagtagctgaagctgtagtagttaatgagctggaagatgtcttccacgcacaagtagatcaatgccatgataccctgtaagcgtgagcctaagtcagctcttctcagggcctttgttaatccaaaggcttttcactccctttataccccagaaatccatcccctgtcaatcctcaaagtctcctggtcctcttctggttttaatccctttaacaccctagtttcagtaccttatcccctctcttataagtcagtagtctcaactggcttttcaacccattcttcaagttaaccctgtataaagcaagctcgaaacaatccctcaaaagtcttgcataggaccctttccataatggctccaacctacaataacccgctcttatctcctcctacatgttgagtatccctgttctgaaaatccaaaatgctccaatgagcatttcctttgagtgtcaagtcagcactcaaaaagtttcagatttttagagcatttcagattttggatattcagattagggatactcaacctgtattaaaacccatactgctttatcacaggattttctgatgctatttctcctacctaaagcccatctctaccatttgcaaccctagccatcaagatgcactttttttttctgagaacactttggtggattttaagacacacacacacacttctagatgtaattcttcaccctctactcccatggaagtgatcgtttcttctcttaaacaccgtatcactcactatctgtcatggcaatcaatcattacagtgtattccatgtactttttgccttatcttagagcagaggtgtaccattccttagagcatttggatttcccctgtagcggttagcatagtgccttgcccgtggtgaacattctgatccaccaatagtttttctattggaatctttcagagctttcaggaagctagaacagtcgcttctgctgttactaaagtttcccccgcaatctggctttcagtctcatccttgagttcacttacattgaagagcagagaaggcactggtgtgaaccgctcaacatggatcatgcagatggcatcagggagatggccttctcttgagcccacaaagaaaagcctatgttaggtaagataggagaagctgagaaaattggtggacacggtgcagcctggttcacctgccacatggccctccctctctgccatcccttccttcaaaagtatttggataatatggactggagctcagtattaagattaatgacaactgcaggcttctgctagaaacaagaagaaagaggttgtggtatcggttggagaacacaagtaatcaaaggctgggtcctgtaagttctgtccactgcatagccctttgatgatacacccctcacaaaagttgccactcttacctagaagcagccacaatggaggcattgaggccaccaaaacaggataatgcaactgacagtggaattatccagttaaatattccaaatatctgatctgcaaaagtctaagggaaaagaatggaagagtcattagcaggatctaaaagggatgaaagacatggatgggcatgcccccagattccccttattaggtattccaacctttcttccacagtggggttaacaggaccttcttgcaagcccggtattctaaatgaactcctttcaaggctgtctaccccctttccaggactttcaagagccagaatatacccagtaccccacaagacaccctcaaccttctgctagtgaaaatcctttaccacagcaacagcatcactggccaagatgtctctcatgtctagcacagtataataggccacattggtcaagatatagatgatggtgacaatgggcatggagatgccaatggagaggggcaggttcctacagccaaatagaataaaatgcacattagtcccacagtcatatccctatctctcctttaatccttagactctccctgccacaccggtctttccagggatggagactgttgctacatttcctcaatgcatttgtctttgacggtgccctggatagtggctgaagctctgaacacttaagaactaaagaacattaggggaaaggaatatcatattaggagacaggactgtgcagctgggagcagtggctcatgcctgtagtactaacactttgggaggctgaggcagggagatggctcgagtctaggagttggagaccagcctgggcaacatggcaaaaccctgtctctacaaaaaactagccaagcagctgggcgtggtggctcacgcctgtaatcccagcactttgggaggccgagccgggtggatcacctgaggtcaggagttcaagaccagcctggccaacatggcaaaaccctgttcctactaaaaatataaataattagccaggcatggtggcatgcacctgtagtcccagctactcaggaggctgaggtacgagaatcacttgaactcgagaggcggaggttgtggtaagccaaaattgtgccactgcactccagcatgggcgacagagcgagactctgtctccaaaaacaaaccaaaaaaaaaaaaattagccaagcgtggtggtgcatgcctgtaatcccagctatttgggaggctgaggtgggaggatcacttgagcctggggaggtcaaggctgcagtgaaccatgactgggccactgcactccagcctgggcaaggcagccagaccctgtctaaaaaaaaaaaaaaaaaaaaaaaagcagggcgggggggattaacaaagactgtccccagcatcataacgcacaggaaaatgggaggttgttttgttttataccccaaagatcttttggtgtcaggattccatctctaagattatcaacattggcaattttgcctcaaggttgagaaatataaaaagaaattatggaggcaaattgtgaaatttaacatcttcagagaataagataggccttcagtaggaagagaagtgtatgtatctgactagcagcctggaagatatgtctgcccaccccttcctcagtttgagaacctcaggagccatcctaactggtgggcaaaagaaagatgcaaagagctctcaaggtccctgtagcccaataaagccatgatctttataagcatccttaacagtaaggctgccaaaaaaaaagcacaaagtggggcaaatactctgcaaatagagtcatgcagtttctgtccggtaggtggaagtaccacccaggccttgatcctgcttctgttatctctgttcccatagcgttaccactagttgtgtaccaagagtgctcttctgtttctcaagccaaaaggagtttattggtataagaattgtgattcttttcacttaagcatttacagaaagctgggcacagtggctcatgcctgtaatcccagcactttgggaggctaaggcgggcggatcacctgaggtcaggagttcgagaccagcctggccaacatggtgaaacccatgtctctactaaaaatacaaaaattagccaggcgtggtggcaggcacctgtaattctagctatttgggaggctgaagcaggagaatcacttgaacctgggaggcagaggttgcaatgagccaagatcacgccattgcactccagcctgggaaatacagcaagactctctccaaaaaacaaaaaacattttaccgaaactccactccctggcaaatcttagttcccagaatcatagaattttagagccaggaaaggccatggagatcacagaatttaaccccctcaattacagataaggaaacaggcaaagagatggccgggcaactccctcaaggttagccaacaagtcagtggaaagatcaactctaggtccttgacttcctgtccagttctcttttcactctatatatagactacagagcaataatggtagggtgacttaattgaatgactgaaactataccacaatgtcagtatgaatttaggaaacaaggaaggtatcagagggaaacacaggaaggtttctggaagtctatatcccaaagctatgtatgtggggataagggtggataaaatatctatcaaggaaaatctgttttaaaaacatacataagcatataatacaacctgctttaattaatgcagaaattaatgaacaaatgtaaaaatgcctttaaaaatttacaaagcatacatgagtaagttcatattttagccctgttactgtgatcatagacaagttacttctctgagcctcaggcctcccatctattaaaatgaggctggtaaaattaacctcatagtggttgtggtatgctgtctggcacgtagtaggagctcattaaatgatggctatcactgctatggaaagttggtggtgcagtacctacctctcaggattcttgatctcttcagtgacatagttgagggtgtcccagcctgagtaggagaacagagctgagtacagtgccagggcaatgtcacccactgcaaatgatgaaccctcaaaggaattctcaaaatgagtagaggctcctggaacccaagaacattggaaggcaggggattagtggctcattctcccacttcaagatggtcaagtaaaggactgacagaatatggtaatataatagcaggtaagtggcctacaacacctttggcagcaagagtaccagtaagggaacaggaaacagaagagagacgtctatagagatagaccagaatgccctgcatcctaatgacatagatggggatcttgacaggaagggtccagggtagctttctaggataagaaaccaccatagagcagaaaagctggagaatagaaacaatgcagttctgttctgctctgcaggctgcctgattcctgcctcctatcacaatctgccaaaggcagctcccagggcatggctgtcaaccctttgccaagatcagcctcctctgggaggcagcgtgcatggaagttaaaggacagacttttgggtcagttgtcctggatacaaatttcaactcctctacttaccggtagcaacttgggcaagatatttaattcttttttttttttgggggggggacagagtctcgctctgtcgcccaggctggagtgcagtggcgtgatctcagctcactgcaaccaccgcctcctggattcaagcgattctcctgcctcagcctcccgagtagctgggattacaggcgcctgccaccatgcccggctaatttttgtatttttagtcgagatggggtttcaccatcttggccaggctgatcttgaactcctgacctcatggatccacccgcgatggcctcccaaagtgctgggattacaagcacgagccactgcgcccggcccaaggtacttaattctgcaggctgtttcctcatccataaaatgagaataataatagtgcccaccgaataaggttatagtaagaaatgagataatgcacaaagagcacttagaggagtgcggctcacagaaaatgcttaaaaaagattagttgctactaatattatttcttaccctggccaagtctaacaatgcctgcaacgatgaccgcgatcagtgccaatactttagcataggtgaaaatatcttgtaccagggttccccatttgacataggcacagttaatgaaggttaagagacctgaaagaaaaataatactgattggtgacttacccttaccaccctagggccttagactcccaagcaatttttccagtaccagtcaccaagatatatatacccttcagccaaagacagaccctctgacctgctctgcactggaaccctcggggccccagaatgtcctcaccattatcatacaaaggcctctatactccccacccccagcaccttatatgggagacacaaaacaaagtgactgcagatctgcttacataaaaaatacatccaaatgtccaatcacagcagtgggaggcaactgggaactgtacaggattagtgattgttccggctcttggctctgaaaagtcatggtctctccctcctacctcccattccccatgggctccaggacacagcactctgactctgtggtattactgttaaccttgaggagttctgctgtgacttatccaatgctgagccagcaggtcaggctgtgtggccaaggattaggatgaaggccagacttcctgcccactgcctggcagctcagctgcctgcttttgtgcttggaaagattcttgcagctaagagtggttcctgtagaatggggacagggcatttttcctgatgggacaatagagaagtaagagccacacacattcccccagtccttctactcagaagtacaggttttaaaagtaccttttatcagggttcttaactagggcctccatgaggctcgaaattctctttcaaagtgttatgtccatatgaatacagacatacctaagaaaaagtttcatatcttttcttagaaagggatcatagcttttatcagaatctcaagtccattatccctcccccaacaaaaaagttacaatctacgacttgaatttgaattacttgaagaagttcaacaagggaggctcacgcatgctgtgaggttgaccagtagccccagaatgtggccgagaagaaagttggaaaaaaaaatacagatcttcccactggtagcatagcgaatcgcttcattgctccctccttcccagctcagcaactggaacactataaggagggcttaactttaaagcccttctcccaagggctccaagggcaaggtcaacatcaccctgccttaccagtcaagagaatgaggcctagtacagttcttgcctacttcaggccaccaacacagtcagaaacaccctctgagttctcctggcagtggtgtggccttggtgtcgctagtcctcctattttgtggtgtcctggcctcaccacattctggctacttcatcctgagaagcagggaagtctggcctctcagaacagctgccccatcttctctctctcaccctcccttccaccaccaccctcattctactgactgcccaagttcctttctgctcttcctgagaaggcacattcctgtcctatataaatgcttgcctttctgcctaataaacaacaaaccttatcacagggctgggcaaaaatgtacccacagctccaggccaccccagtgctaagttaataatttaagacacaagtgtgcagcaccccacaaaatgaccaaagtggctgtatcttgccctccacaaatctttcaaatctgtcactcctcctcagccagtcacccatcctttactccccactggactccagcctccagccactcaacagcttagtgccccttctccccagcttgtaacctctgcccttatcctaggctctgcggctggctcataaccacaacatagccaggtttccaagtagaaacaccagacacaaaggatgctgccacattgtcaggaaaatgggatccccaaatacaaatttatgattccctgcagggtaaccatgagtcataacaccaaactggaataagcttacaggactagctctagttcagactcagagtctgagctgtgtgccacaaggttcttctcagttctgtccagggatgtaggcagggaaaaggagggataagcaaccaattcaccacctgctaccacagcagattctgaaatggaaatacatggcttgtttatattttattttatttatttttctttttctttttgagacagagtttcacccttgttgcccaggctggagtgcaatggcgtggtctcggctcatggcaacatctgcctcccgggttcaagccattctcctgcctcaacctcccaagtagctgggattacaggtgtgcgccactatgcccagctaatttttatatttttagtagagatgaggtttcaccatgttggccaggcttgtcgcaaactcctgacctgaggtgatccacccacctcagcctcccaaagtgctgggattacaagcatgagccaccgcgcccggcctatattttattatttttttttatttacttatttattgacttatttatttatttatttatttattttatttattttttgagacacagtcttgctctgtcacccaggctgaagtgcaatggcatgatcttggctcactgcaacccccacttcccaggttcaagcaattctcctgcctcagcctcccgagtagctgggactacaggtgtgtgccaccatgcctggctaatttttgtatttttagtagagatggggtttcaccatactggccaggctaatctcgaactcctgagctcaggtgatccgcccacctcggcctcccaaaatgctgagattacaggcgtgagccaccacacccgtccctttttgttttttttttggagatggggatctcactctttcacccaagccagagtacagtggagaaatcatagctcactgcagcatcgaactcctgagctcaagggatcctcccagctcagccaccctagtagctgggatcaaaggtgtgcaccaccatgcccagctaatttgttttaattttttttttttttgagatggagtcttgctgtcacccagcctggagtgcagtggtgcgatctcagctcactgcaacctctgcctccagggttcaagcagttctcctgcctcagcctcttgagtagctaggactacaagtgcccaccaccacacctggctaatttttgtatttttagtagagacagggtttcaccatgttggtcaggctggtctcgaactcctgaccttgtgatctgccctcctcagcctcccaaagtgctgggattacaggtgtgagccaccgtgcctggctgttttaatttttttagagacggggtcttgctatgtggcccaggctggtctcgaactcctggcctcaggcaatccttccacctcagctatctgaggagtaactgggattatagggaagagccatggcacctgggtggcttgtttacattttaatccctattgcttctctacttctttttttttttttttcgagacagtcttgctccgtcccccaggctggagtacagtggtgcgatctcagctcactgcaacctccgcctcctgggttcaagcggttctcctgcctcagcctcccgagtagctagaattacagacattcaacaccatgcccagctaatttttgtatttttagtagagacagggtttcgccatgttagccagactagtctcaaactcctgacctcaggtgatccgcctgcctcagcctcccaaagtgctgggattacaggtgtgagtcaccggcgtggcgtgcccagtctcttctctacttctctatccatccatttgtatccctctctttgtccaccagtatcccacctcccccactcctgagcctgatttctctgacccaccttctagccctgatctgctctctgtactgagcacagaaggctcagtttgaatgaggaagggaatcctacagaaagaaaccagggagcagagggaactgcctgaagagagctagccctcctcttcctcaaagcctagcttcctccagggcctcttgactgtgggagcaggaaatgggtatggcaggcagcagtgctgacagggctttttgtccccacctcagcggatacagctgaccactggccccagagcccagctaagtgcactgctcttgaagtggagcccaacctcctgcttcagggccaaggacaggaggggaccatggggttaggataatatggaggcaactgcaagttaacctcaagggcagagatgccctccccttctacctctaggggcaattcaatccccacccaacactgggccaagtctataagaggataacctgaaatcacctttgacccttgactcggtgcagcagcactcctgctttgaccccagggggagaaaaaaagaatctgcaaagaagtcactcgtggccgggtgcagtggctcacgcctgtaatcccagcactttgggaggccgaggtggacagatcacgaggtcaagagatcgagaccatcctggccaacatggtgaaaccctgtctctactaaaaatacaaaaattagctgggcatggtggtgtgtgcctgtagtcccatctacttgggaggctgaggcaggagaatcacttgaacccaggaggcggaggatgcagtgagccaagatcacaccactgcactccagcctggtgacagagcaagactccatctcaaaaaaaaaaaagagaagtcactcctataaccatctaaaaagatgttcctgaatggatcatcaaacccagcctacatacggtccccgggagtaggagactagttctagtggtaaggcccagcatcagcgctagaactaaaagccagaaagcaccagaccaggtggatccagaacagaacaaagcttgcaggcccactctggatcagatgctcaggtttagtttagacacctaaatgaaacatttcctgaaaaagaacattaaacccacaattctgtaagcactattacctttaaatacacacaatgtaacacacaaaacttatgattacaggcgtgaaccaccatgcccggcgtcattccattttaaaagtgatctatagagccaggcgcggtggttcgcgcctgtaatcccagcaccttgagagactgaggcgggcagatcacttgaggccaggagtttgagaccagtctggccaccatggcgaaaccccgtctctactaaaaatataaatattagctgagtgtggtggcgcatgcctgtaatcccagctacttggaggcagaggtaggagaatcatttgaacccgggaggcagaaattgcagtgagccaagatcacgccactgcactccagcctgggtgacacagtgagactccatctcaaaaaataaaataaaataaagtgatctatagctcttccttttactaagccaacagcgtcttcctcccagcttctaccagtagtgccagacccctcctctgtctccacacagaatgaagctaaatcctcttccacccaatggcccttcttaacattaaagatgaatatcacggccaggcgctggctcacgcctgtaatcccagcactttgggaggccaaggcgggcagatcatctgaggttgggagttcgagaccagcctgaccaacatggagaaactccgtctctactaaaaatacaaaaattggccaggcgtggtggcacatgcctgtaatcccagctagtcgggaagctgaggcagaagaatcacttgaactcgggaggtggaggttgcggtgaactgagatctcgccattgcaccagcctaggcaacaaaagcaaaactccatctcaaaaaaaaaaaaaaaagccaggcgcggtggctcacgctgtaatcccagcactttgggaagctgaggcaggcggatcatgaggtcaggagatcaagaccatcctggctaacacggtgaaaccccatctctactaaaaatacaaaaaattagccgggtgtggtggcaggcgcctatagtcccagacactcaggaggctgaggcaggagaatgacgtgaacccgggaggcggagcttgcagtgaaccgagattgcgccactgcactccagcctgggccacagagcgagactctgtctcaaaaaaaaaaaaaaaaaagccaggtgcagtggctcacgcctgtaatctcagcactttgaaaggccaaggcgggtggatcacgaggtcaggaaattgagaccagcctgcccaacatggtgaaaacctgtctctactaaaatacaaaaattagccaggcatggtggcacaagcctgtagtcccagctactcgggaggctgaggcaggggaattgcttgaacccgggaggcagaggttgcagtgggccgagatcacggcactgcactccagcctggccacagagcaagactccatctaaaaacaaacaaaaaggatgaacatcctgtccccttgagtctttactccttcaggctaaaacccagattttacaaccccttgtggagcaaatgtggcttccagacccctcaccatcccaggactgtcatttatttcactttgtcatttactgcatatacttcactgtgtcagtatttccccagaaatgcaagaccccacacagaaaactccagaccgtgttgccgactacggagtctcaacctgaaatcattgtttactacaactcctttctttcccacctcaaagtgatgagatctttcctcccctctttctggacctataaaaatgatttttttagctgggtgcgatggctcatgcctataatcccagcattttgggaggccgaggttggaggatcgcttgagtccaggagttcaagaccagcctgggcaacattgtgagaacacatctccacaaaacattttttttagttagccagacatggtggcacacacctgtggtcccagctacttgggaggttgaggcagggggatcgcttgagcccaagtggtcaaggctgcagggagctgtgatcgcaccactgcactgcagcctgggcaacacagtaagatcctttctccaaaacaaaaaaagtgattttttccccccagatacaggacttcatatttagtcttagtgactttcctctgagtttttatgcattattcttatatgatatgggatttttccttcttcattttattagttcaaatcccttctttaattttgtgaaatctgcaaatttgatcagcatacctcctgagtcttcactgaagtcaccctaaaaatgttgactagggccgggcgcagtggctcacgcctgtaataccagtactttgggagaccgaggagggaggatcacctgaggtcaggagtttgagaccaggttggccaacatagtgaaaccccgtctctactaaaagaacaaaaattatccgggtgtggtggtgggcacctgtagtcccagctactcgggaggctgaggcaggagaatcgcttgaacccaggaggcggaggttgcagtgagccaagattacaccactacactccagcctgggcgacagagtgagactccgtctcaaaataaataaataaataaataaatgttgacatgggctggcagcagtggctcacgcctgtaatcccaacactttgggaggctgaggcaggcagatcacttgaggccaggagttcgagaccagcctggcaatatggcaaaaccccatctctactaaaaggaaaatgcaaaaattagcagggtgtgatggcacacgcctgtggtcccagctactcaggaggctgagacatgggaattgtttgagcctaggaggcagaggttgcactgagccaagattgtgccactgcactccagcctaggtgacagagcaacactctgtctcaaaaaaaatttttttaataaaaaaattaaaatgttaggccgggcacggtggctcacgcctgtaatcccagcactttgggaggccgaggcaggcagatcacaaggtcaggagatcgagaccatcctggctaacacaatgaaaccccatctctactaaaaatacaaaaagttagccgggcgtggtggcgggtgcctgtagtcccagctactcgggaggctgaggcaggagaatggcgtgaacccgggaggcggcggttgcagtgagccgagatcgcgccaccgcactccagcctgggtgacagagcgagagttcgtctcaaaaaaaaaaaaattaaaatgttgactaagatcaacagagctgtatagtctatcactgtagacctttctgtatttgtcattattccacaatgttattcagccaactaagaatctaccaaactttatttttatctagtctaccttgtcaacaagaatatcatgagaatttgccacgaacctctccgaaatctgcatacacatgcctctgctctaacaatctaatgatgctatcaaacaattcaaatcaaattagtatatatttatgtagaatattcatagttacacccttgcagtagtcaaaaactagaaacaacccaaatgcccagcaacagtagattgaataaatactaaacagcactaagaataaacaatctgtaatcctagcacgttgggaggccaaggcgggcagatcacaaagtcaggagtttgagatcagcctggccaacatggtgaaacccccgtctctactaaaaatacaaaaattagctgggcgtggtggcgggcacctgtcatcccagctactcaggaggctgaggcaggagaatcgcttgaacccgggaggtggaggttgcagtgagccaagatcctaccactgcactccagcccgggcgacagagtgagactctgtctgggaaaaaaaaaaaaaaaaagtgaacaatctacgactacagacaaaaatacagaagaatctcaaacataataagcaagccagatgcaaaagtgtacatatagattatatccatttacataaaatcagagaaaactaatcaatgctactagaagtcagaatagtgatttccctttgtgtggggtggagaggcagggactgggaagagcataagaagggctcaagggtgctagttacacatgtgctcaactagtgacaattcattaagccataaacttatgagattgcactgttccttctgtatattatatttgaataaaaaaattaaaattgaaccaaaaagtgaggttagcagagtatggcttgttcttagtgaattcatacacgttactaatgatttcccacccttctgctcgtacttcactaaccagatttaacttacaagcctagaatttgggcaagaatccaccttaagttatcacttcagagtgctgctcatccacctccggtggaaagctgggctatcacttgtggtaggtagactaatggccccccaaagatgtccaccccctaatccctggaacctgtgagccatgttatattgcatggcaagggagaattaaagttgcagatagaggccaggcgcagtggctcatgcctgtaatcccagcactttaggaggccaaggcgggcagatcacctgaggtcaggaattctaaccaacatgagtcagcctaaccaacacggtgaaaccccgtctctactaaaaatacaaaaaatagctgggtgtggtggtgggtgcctataatcccagctactcaggaggctgaggcaggagaattgcttgaacccaggaggcggaggttgcagtgagccaagatcacaccactgcacttcagcctgggcaacagagcaagactctggctcaaaaaaaaaaaaaaaaaagaaaaaagttgcagacagaatgaagattgctaatcaagtgacaaaacagggaaatcattctgtattctctgggtgggcccaatgtaatcacaaaagttcttaaagatgaaagagggaggcagaaaggtcaatgtcagagtagtacaatatgagaaagactctcccagttactgctgactttgaaaatggaagggtccatgagactctagaagctgggaaaggcaagaagatggatcctctccttaagcctccagaaagaaacacagtgctacttcatattagcccagtgagacccatttcagacttctgacctccagaattatgagatgataaatttgtgttgttttcagccactcaattggtggtaacttgttagagaagcaatagaaaactcatatgttggctgggcacagtggctcgctcctgtaattccagcactttgggaggccagggtgggctgatcccttgagctcaggagtttgaaaccagcctgggcaacatagagaaaccctgattctacaaaaaatacaaaaattagctgggcctggtggcgtgcacctgtagtctcaactactcaggaggctaaggtgggagaattgcttgagcctggggaggtcaaggctgcagtgatccttgattgcaccactgcattccagcctgggtgacagagcaagactgtctcaaaaaaaaaaaaaaaaaaaaaaaaaaaacctaactgcaggcagaaaactggaagtagcactgggtggtactattcattacatttgttgaaaaatggagaaaggggaagtgaaacccttgacagctcactggatcttggtgtactgaaatttccctctcactgcaatcaaaagaatctaaatgtgaccttatgcaaagaaggcaggcatcccttatgatagcagatcctcaaacaagtatgtacctctctctttaatgtactacatgaatcccagctcttctagcaaatcatcatttttgaacaaagtatactctttcattatcatattctaatcaaatatcgctgatgcctatgaaattgtttcctcctttcagtaaaaggtcaaatacgggccgggcacagtggctcatgcctgtaatcccagcactttgggaggcggaggcagacgaatcacgagttcaagagattgagaccatcctggccaacatggtgaaaccccgtctctactaaaaatacaaaaattagctgggtgtggtggtgtgcgcctgtagtcccagctactggggaggctgaggcaggagaatcacttgagcccaggaggcggaggttgcagtgagctaagatcgcgccactgcactccagcctggtgacagagcgagactccgtctcacaaaaaaaaaaaaaaaaggtcaaatacgtttattagccttacttgtaatatttgtagataagagttcaaaagcatcatttctgatcttccatcccattttctccaaatgcgttactgagcaactcctctctgcctttattctctgctatgtagtctccaaaatacccagatttatacttttatctaggcatttttctccttgcctctaaaatttccattctaaagccttattatacacatctctcccaatccctataaacctcctctatcccttaccaggagtttatctttctggtatcttagaatcttagaatttacggttaggaactctgttctgtgttcttttttctttcacatacacagccttcagctgacaaagagacgaaaattccacctgccactcagtttgctactttaaacttcacgtcaccagtgagacatctcagctatcttctgactggtgacatcattcatcccacagcaattagcagaaggatagcagtccctaggcttaattggtgtgagcaagctcttggtcacatgttgctcagaaaaactgcacatttctaggttaggctgggtctgtgtatagtcagatgcacactattcctgggggaaggccaaaccccacaactggcatactcaggcctgctaataccctggtgtctccaaaatactctaccactgctgtttcctcagaaggtccagatataagctctctggaaacgcctcatatctgttacctaaacccagagatttcaagtctcttcttccttttctttgctgcatccccatttgttttgtctaatgttggtttgggaaaatctctacacctttttttttttttttttaattgagatggagtctcgctctgtcgcccaggctggagtgcagtggcgccatctcggctcactgcaagctccgcctcctgggttcacgccattctcctgcctcagcctcccgagtagctgggactacgggcgtccgccaccacgtccggctaatttttttgtactcttagtacagacggggtttcaccatgttagccaggatggtctcaatttcctgaccccgtgatccacccgccttggcctcccaaagtgctgggattacaggcttgagccaccgcgcccggcctggaaactctctacaccttgaaatcacaatttcaccctggcttctttgatacattatttcttccactctccctaggtgctgttatttctctcagatagcagatggccttcaaattattttacctttcagactacagaaaccttttactccaggtgcagtggctcatgcctataatcccagcactttggaaggccaagacgtgaggatcacttgaggccaggagttggagaccagcctgggcagcatagcaagaccctttctctacaaaaaaattacaaattagctggacttggtggtgcacactgatggtcctagctacttggaaggctgaggtgggaaggtcacttgagtgcaggattgagcccataaccatgctactgcacaccagcctgggcaacaaagcaagacttcgtctcagaaaataaaataacatttttgaccaggcgtggtggtggctcacacctgtaatcccagcattttgggaagccgaagtgggcggatcacctgaggtcaagcgttcatgaccagcctgaccaacatggcaaaaccccgtctctactaaaaatacaaaaattagccagccgtggtggcgcacgcctgtaatcctagctacctgggagtctgagagaggagaatcattttgaacccaggaggcggaggttgcagtgagccgagattgcaccactgcactccagcctggatgatagtgtgaggccccgtctcaaagaaagaaagagagagagagagagagagagagagagaaaggaaaagaaaagaaaaatatcttttttttttttttaaagacagagtctcgctctgtcgcccaggctggagtgcagtggtgcgatcttggctcactgcaacctccgcctcccgggttcatgccgttctcctgcctcagcctcccaagtagctgagactacaggcgcccgccaccaagcccagctaattttttgtattctttagtagagacagggtttcaccgtgttagccaggatggtctcgatctcctgacctcgtaatccgcccgcctcggcttcccaaagtgctgggattacaggcgtaaaccaccacgcccagccaattaaaataaaaattttaaagaaacaaccaattcgcttactcaggtgtcatgggtgagagcctctgtaattgcaaaattttgactgagacagtgaaagagatctaacttaactgactccatcttgcttctaacctccaagctgcctttattcattcccaggcataggctgaactaactttgggagaaacttagtttataatttagacaaagaggataacagccctttcccaaagcagacctccttcttgcctggggactagattgcctttgtaggactaacattagccacaagattagaaattatggtttagggctgggcacggtggctcatgcctgtaatcccagcactttgggagccataggagggcggatcacctgaggtcaggagttcaagaccagcctgggcaacatggtgaaaacctgtctctactaaaaataaaaaataaaattagctgggtgtggtggcgtgcacctgtaaccccagctactagggaggctgaggcaggagaattacttcaactcgggaggtggaggtggcagtgagccaatatcacaccactgcactccagcctgggtgacagagcaagactccatctcgaaaaaaaaaaagaaattatggtttaggagtcacgcagctggaagctacaagattctgaccttccctaaactgctcctaagatcagtgcttgaggtattttgtagaccctgctcttggtggatcagctggcccccacccagatcaataaactggcttagctgatcttgtggcccccacccaggaactgactgagagcaagaagacagctctgattccctgtgatttcatctctaactaatcagcactcctggctcactggcttcccctgacccaccaagttatccttaaaaactctgctcccagaatgttcggggagactgatttgagtaataataaaactccggtctcccgcacagccggctctgtgtgaattactcattattgcaatatccctgtcttgaagaattggctctgtctaggcagtgggcaaggtgaaccccttgggcagttacacctctggcaagaagacacaccaaatgcaatccctgtgggtcactggatcagagtcctcccgctctccttcctggaactcagtcagcactttggtccctgtggctctgaccactctgagggagcaagcaggcagtttgtaccaggagggtcttatagtaacaaccccgtgagtcccttctccaagccgtgtaaatccaatccttattggtttgcttagctaggggtcagttcaagtcctcaggtaccagatctcaagcctgagtgagcatcagtaccacctgaggaatttgtcgacccacaacttcagggccccacaccccagaggttctgatgcaggagacctgagacagtttcgcaggctaatctgaggatctgcttctctgggtgtgtttccttaggtaatcacctacggaaataaccacacacagagcagctgtatcagaacagtcgcaaccctttgctaactcaaggctcctctatcctggctgcaaactagcatcacttgacgagctttaacagtccagtgctcaggccccacccagaccaatgaagtcagaaattctggggtggaacccaggcatcggcatgtttttaaaactccccaggtgactctgaagcatggtgacaattgagaacggcttttcccacctctagtgacacaagaccctcatcaattctcctcaaaagcaatttttctgcttccttaattctcgttctccaagccaattctcatctcattcttctccccagtggttcagatttatgtagtcagggagtgggagtgatgagtattgttttctttctttcttttttttttttttttttttttgagacagcgtctcactctgttgcccatgctggaatgcagtggcacaatcttggctcactgcagcttggaccaaatgggcttaaacaatcctcccacctcagccacctgagtagctgggactacaggcatgcaccaccatgcccaattaattttttttttttttttttgtagagaccaagttctccagactggtctcctgagcttaagccatcctcctacctcagtctcccaaaatgctaggattacaggtgtgagccaccgtgcccaatctgagtattgcttgcttgctttctttctttctttctttctttctttctttctttctttctttctttctttctttcttttctattcttttcttttcttttcttttcttttcttttcttttttaattgagacagagtctcactctgtcgcccaggctggagtgcagtggtgcaatctcggctcactgcaagctccgcctcccgggttcacaccattctcctgcctcagcctcccgagtagctgggaccacaggcgcctgccaccacacccagctaattttttgtatttttagtagagacgggtttcaccatgttagccaggatggtctcaatctcctgaccttgtgatctgcccgcctcggcctcccaaagtgctgggattacaggcgtgagccaccgtgcccggccttgttttcttaattctccagatgattccaatccacagccagagttaggacccactgctgcccagcatcttccgcaacctcctctaggctacctgcccagcttcttctgaggcagagagaaaaagaaaggaacatagaaacatagaacatagaaaggaagagagcaaggatgagcccccaaagggacttgatgatcaaagcagcataaaggtctaccccttcactgctggtcaagagtttgttccaaagttcacaacaaacccacactagaacccaaggctctgatgaaagcctatttcttgaggtgaatatgggccagaaaaggtaagtttcttcacctccaccctcagatggctcttgggaaaagccctctgaaaaaggcaactagcttccaagtagaaggttcaaagggcaaaagtccgttggggggcccagcatctgactgttccacctcattagccacaagtacatgagatcagtcattctggtaccaggagaagctgcacgaggacacctggccaaagctctcagacacacagagatccaaagtccttcacagcccacagcggctctggcagactcagggtaagctgtctgcccccttcccacagcaaccctcagcccccaccagcaccctgaaaggcaaaagcacgaaatacccttctcagccaagttgaacctggaatcatatcttctgttcattcatccagccaacatttattgaagaacccactacatgcaattcactgtggccacatgtgtatgacacgaagaatctttgcctgatccctgaagaacagtactctgtaaacaaagagccctgaactgccaggtactgctgactcactggtacaggggacatactgaaggcatagatggtaaaaatgtcctggtagtgtcctgaatggcaaaacaactaggtctcagtgtgggcaagtgtaggtaaggcaagaacagtcatgtccacctgtgaacagtgggccaaaacaccttggctctgaggaaaggacagtcgggtggagctggacttctggacacctatcctcttgctgagaggaaagttccacctctcttgcaaaacagaaagaaaaggctcagccctcctttctgatccctgagctattgtgaagtaaaatgtaaactgcttttaagtcatccaaagacagcatgcggaaggtaaagcttttagaaatcaataagatgcatatgatatgaatataacttgcagtaatagatactatttttaactgacaactgtgtgccaggtcactatgtacttacacctatcttctaatttaatctgacagagagtaagttttattatctttattttacacttgagaaaactgaggtcaggcagtgactagctccaaagcctacatccattccaccacaccacatacctccctaactgtatgcaagaatgtgagacggggagtgggattatctccccctgtggtaatggagatgcctagaacttcagagcactggggcagtccacgaatttctccaagaagtcagaataagcagcttcaggaggtgccatctgcacacctctctgtttgggaaaagcaaccatttctactaccctagacaggacagtgaggctccttcaaaactcagaattccttcactcactcactcattcattcattcattaagcttatattgagtacccactgtgttccaggccctgtgcaggctctgagattaagatccagtctccagccttcactcaaaagtggacattgacaattacaagaatcagttgctatgaaagtcactgagaggcaacctatctacccacacgtcactggaggagtgaatggggtgcaggcaagcaccaggatcactgttatctggactgagtgcatggaggctgctgctggggtgggggaggggaagcaatattcctgacagagagggcaaaacgttattaccctgacaatgaaatcagcaatgaatgaagtcaaccacccgtataaaaaaacctacttaagcaataaccagtaaatgatttcaaggtctattagtaataccagactatctagggctgtagttcaacagctctaaaggtagactatgcctgccaaaagactgcaaacaactggcaggagcagagactctgtgtttgctctttggaaactgtcatgatttgaatagaaaaagatgaaaatatggtacaaatatagatcacatttctatgaggtagggaccccattttatagaagagagaactgagggctgggcacggtggctcatgcctgtaatcccagcaatttgagaggccgaggaaggtagatcacctgaggtcaggagtttcagactagcctggccaacatggtgaaaccccatctctactaaaaatacaaaaaattagccgggcatagtggtgggcacctgtaatcccagctactcgggaggctgaggcaggagaatcgcttgaacccaggaggcggaggttgcagtaaactgagattacgccactgcactccagactgggcaacaagagtgaaactctgtcaaaaaaaaagaagaagaagaaggagaaggaggaaaaggagaaggagaaggagaacaagaggaaactgaggctaataaatttgacctagcattgattgaatcctgcctgattccacgctgttcaccaccatgcaccagtgccttccaaagggataagggtatcccctacactgttcaagaaaaagaagtctgactcagggcacccaatcattacagccatggagaaggcatcattgtagggtagagatatttcatccaacttttccagaaacatacctcaaccaacctaaggcaggcttaactctttttcataaaatcgtccctcaaccttggtcctttcctctaacaatcaccctccatgctttcagaatcattcatctgaagagcatgtctacattccttcccgttcctgggtctctacaatgcagtctgagatgttgcaactccttcctctttcaccctgcaaaagttttcctttgaccctctgagttgccaattccaaatgacattttattccttattttaaacttaatagctcctccagaaaggctatttttgagtgtaaacctgccacctctggtatgctgcccttgctctgtgctctcacctccccaattaactacactgcattagaacagtgtacatatgtctctcccacccacgagagctgtgtgagggcagagagtggataacagttatccttgtacccatgggcatagtcctgaactagacacacagtaacacttaatacattttgctgggtgaataaatgatatttctgaaacctgatttcaccctcactgccctgaaatttcattgccttaggagaaagcccacatgaaaagccaccagtgaccttcatatcaataaatccaatcaactatactcaatctttacctagcttgacctcttagcagattggacacaggtagtcattcattccttctcaattcactcccttccactcaccatcttccaggtttccacctatctctctagatgctccttctccatcttttcacaaaatacctatccctcaaatgtgggtattcctcagaatgcttctaagcccctttgtcctccctttctacatcttgtcccaaggtcatctcatctgttcctgtggtttctttttctttttatttttttctttcttttttttttttttttttttttttgagacagaatcttgctctgtcacccaagatggagtgcagtggagctgtctcggctcactgcaacctcttcctccagggttcaagcgattctcctgcctcagcctccagagtagctgggactacaggtgcacaccaccatgcccggctagtttttgtatttttagtagagacagggtttcgccatgttggccaggctggtctcgaactcctggcctcaagtgatcagcccacctcagcctcccaaagtgttgggattacaggtgtgagccaccgccctggcctgttcctatggtttcaataaccatatatacaatgatgactcccaaaagtatatcatcagcccaactgtcatgattctagatatatatgaatattcaaccacctactggacattaccaggcacatcaaactcaacatgtccaaaactgattccatcaatttctcccaaacctactgcaccttcggtgttccccatacaagtaactggcgtcaccatccacccatttatgcaagccaaagacctgggcatgttattgtcatcaacaacttccactcatatctactcatagtccaagtcttaagtctccctgtccccaaaacatgactctagtccaagccaccatcatttctcactaggatcatagcagcagcttcccacctgtctcccagctttcaatcctacatagaaaaactaatctttcttaaactcacaaattctaaaatctaaatcacaaatgccactcttctgcttttaaaggccttaagagttttctcattgccttagaagacagcccaccaaactccttaatatagttggtgcaatagattggagttttccaatatgcctcaacgtctcccatcccatattcctttcttacaatgtgactttgacactctacccatcaagaggcagggtctgtacccctcttctcgaaactggatggtcttctgtgaatgcctctacctatagagtatgacagaattgacaccatgcaacttcagagactaggtcataaaaggcaatgcaacttccactttgggtgctacaacactcattctggacgctttcagctgcctgcataagcagtctgactgcccacgagtcaccacgctgtgagaaagctcaacacagtccatacggaaagaccacatggaaagactgacacaatttgataaagaaggccgggtgcggtggctcacacccgtaatcctaacactttgtttgggaggccgaggcgggtagatcacctgaggtcaggagttcaagactaacctggccaacacggtgaaaccccgtctctactaaaaatataaaaattagccgggcgtggtggggcacgcctgtaatcccagctactcaggaggctgaggaaggagaattgcttgaatctgagaggtggaggttgcagtgagccgagatcgcgccactgcactccaacctgcacaaccggagcaagactccacctcaaaaaaagaaaaaaaagaagcccagattgtctgcaacttcctcagcaaccgtttttccagctcctgtcaccatctgctgcaaccacatgagggaccctgacctagaactgtcccactaagcccttcccaaatttctaagccacagaaatcataaaaaaaatgactactgttttaagacactacgttttagactatttgttatagcacaataataactagcacagcttataaagctttgaacaacctatgccttgactctatttacctctgcaagccaactctcaaccttttcttcctgaaattcaacactgcagcccaccctgaactcctttcagtgcctgaaaggagcacttctggcatttaggttttcatacattctgttcttgctgcttggaacactcctcttctactcttgattaattcttcttcgccattcaggtatcagctcaaacttctacaggaatggtttctaaatgcctaggttaggactggtctcctcctgtgccttgttctaccttgcaaatcacaacaccatcacaatccattaaaaccctgtatcagaggccaggcacggtggctcacgcctgtaatcccagcactttgggaggccgaggcaggcggatcatgaggtcaagagatcaagaccatcctggccaacatggtgaaaccccgtctaaaaaatacaaaaattagctgagcatggtggtgcatgcctgtagtcccagctactcaggaggagacaggagaatctcttgaacctgggaagcagaggttgcagtgagctgagattgcgccactgcactccagcctggtgacagagcgagactccgtctcaaaaaaacaaaacaaaacaaaaatccctgtattgggttgcccatcctgaccccggcatgcacccatgcatgcggtcacacacacccacgcacacacataaagtgctccaaaaagacaatgacagtgcagggaacgtggcaacctcttcgcaaatacttgttgaatgtttaatctccaaccctatctctttcctaaattccaaagagcatatctgcctactatgctaaaaataaattccaaattcaacatgcccccatcctcctcctcacagtaaatgatatcactgcctacaaattgtctaaaccagaaacatcatctcttcattcaaagactatttattgagggccgggcacggtaggtggctcacgcctgcaatcccagcactttgggaggccgaggcaggcagatcacttgagttcaggagttcgagaccagcctggccaacatggtgaaaccccatctgtactaaaaatacaaaaattagcagggcggggtgacatgcacctgtagtcccagctactcaggacactgaggcaggagaatcccttgaacccgggaggcagaggttgcagtgagccaagatcctgctactgtactccagcctgggcgacagagcaagactctgtctcaaaacaacaacaacaacaaccaaacaaacaaacaaaaaaaatatttatcaagcttctctgtttccttgctggggatacagtggattatagataggcacagctcttctggcacaaaacttacaagatggtagatgttttccttgacacttccctctcccttatacttgacatcttaataggtctcattggttgtattgattataccttctaaattgtgctcagatctatccttccttgtccaccccaactgccatcaccgtagttcaggtttttgtcatttcctgcctggattgctacaagagcttcctaatagtgtctctgcctccagccttgtcccctaagttccaccccagctatatcactcccctgtttaaagtcctttaatggttcctcatatgctttgaataaattctaaaaccctacaaagatataccttgtgttctagccccttgcccatcttggtcccctcatatcccacaatcccccatgcacccccacaccccatacatttttttcatcttgtgcctttacattggctttccctgtgcctaaaacgtcctgcccccttcttcattcaacatacaattattgagcacctagcagataccaggcactgttctatgtgctggtgattcagcagtgagtaaaacaaagtccttattcacatatgtttatattctagagggaaagagagacaagtaaatgatgtgttgaacactgttataaagaaaaagaggccaggcacggtggctcatgcctgtaatcccagcaccttgggagaccaaggcgggcagatcgcctgaggtcaggagtttgagaccagcctgactaacatggtgaaaccctatttctgctaaaataccaaaattagccaggcacagtggcagcgcctgtaatcccatctacacaggaggctgaggaaggagaatcgcttgaacccggaaggcggaggttgcagtgagctgagatcgtgccattgcactccagcctgggcaacagagcgagacaccatctcaaaaaaaaagaaaaagaaaacaggatggggaactgagagtgaccattttagatacgataggtctctagtaaggtactatttttgcaaagaggtgaatggagtaagggaataagctctgcaggcatctggagacgtgccttccttgcagaagaaacaaatacaaaatccctgagacatgtatgtgccaggaaaatgcaggagaggcaagaaggccagtgtagctggagcagacaaagtgagggcaagaagtccaaggtgaatcaaagaagtcaggtggagtagggccacataggccacggtagaaatgtgggtgcttcagcccagcctgactcctttcatccttcagtgctgatgcagacatcatcccctgaacaagccactctccacccctgcaagcacctgccacatatacatgtttaagtgactatgtctacctcgcttcccaccacactgtgcgttccctacaggcaggggctccacctttcagttccatgctttatagagcccaacatgttcagaaaaaatttctcaaattattcaaactttcttcttttgttccaattccacaccctgcaagcaacttcctgattactagattggtttcccagttactagggtatcagggaggggatgccttgatagtgaacacacaccttctggtcattagaaattactcatgtgggaaaggattccgtatttaataaatggtgctgtgagaactgcctagccatatgcagaaaattgaaactggagcccttccttatatcttatacaaaaattaactcacgatggattcaagacttaaatgtaaaacccaaaactataaaaaccctagaaaaaaatctagggttttatagcaataccattcaggacataggcacgggcaaagatttcatggcaaaaataccaaaagcaattgccaaaaaagcaaaaattgacaaatgggatcttattaaactaaagagcttctgcacagcaaaataaattatcatcagagggaagagacaacctctacagaatgggagaaaatttttgcaatctatccatctgaaaaaggtctaataaccagagtctacaaggaatttaaacaaatttacaagaaagaaacaaacaatcccattaaaaagtgagaaaaggacatgaacaaacacttctcaaaagaggacattcatgcggccaacaaacatgaaaaaaagctcaacagcactgatcattagagaaatgcaaatcaaaaccacaatgagaaatcatctcacgtcagtcagaatgtcaataattaaaaagtcaagaaacagtcaggcatggtggttcacatctgtaatcccagcacttcgggaggctgaggcaggtggatcacctgaggtcagtagttcaagaccagcctgaccaacatggagaaaccccgtctctaacaatacaaaattagccaaatacaaaattagctgggcatgggggtgtgtacgcctgttatcccagctactcaggaggctaaggcaggagaattccttgaacttgggaggcggaggttgcattgagccgagattgtgccattgcactccagcctgggcaacaagagtgaaacttcgtctcaaaaaacaaaaaacaaacaaacaaaaaaaggcaagaaacaacagatgctgacaagtttgcagagaaaaaggaacacctggccaggtgcagtggctcatgcctgtaatcccagcactttgggaggccaaggcaggtggaccacaaggtcaggagttcaagaccagcctggccaagatggggaaactccatatctactaaaaatacaaaaattagccaggtgtggtggtgggctcctgtaatcctagctactcagaaggctgaggcagagaaccactcaaaacaaggaggcagaggttgcagttagccaagatcatgccactgcattccagcctaggtgacagagcaagactcagtctcaaaagaaaaagaaaggtacggcaagtaagaaaatgtggtacatatataccatgaaatagtatgcagccataaaaaggaatgagatcatgtcctttgcagggacatggatgaaactggaagccattatcctcagcaaactaatgtaggaacagaaaaccaaacaccaaatgttctcacttataagtgggagctgaacggtgagaacacatagacaaatgcgggggaagaacaacacacactggggcctgtcggtagaggttggtagagggagggcatcaggaatcatagctaatggatgctaggcttaatacccaggtgatgggttgatctgtacagcaaacaatcatggcacatgtttacctatgtaacaaagctgcacatcctgcacatgtgccctggaacttaaaataaaagtggaagaaaaattaaataaataaaaattttaaaaaaagaaattacccatgtatgctcatcaataaactgtacatacatcaaaggccgagggcggtggctcacgcctgtaatcccagcactttgggaggctgaggcgggcagatcacgaggtcaggagattgagaccatcctggccaacatggtgaaacctcgtctctactaaaaatacaaaaattagctgggtgtggtggcaggagcctgtaatcccagccactcgggaggctgaggcaggagaatcgcttgaagctgggatctcggctcactgcaacctccgcctactgacatagcgagactctgtctcaaaaaaaaaaaaaaaaaaaaaactgtacatacatcagtaaactgacattatcattcacacatcaatctcttttttttttttttttttttttttttgagacagagtcttgctctgtcgcccaggctagagtgcaatggtgcaatctcggctcactgcaacctccacctcccaggttcaagcgattctcctgcctcagcctcccaagtagctgggattacaggtgcccgccatcatgcccggctaatttttttgtgttttagtagagacagggtttcaccatatcgacctctttttttaggtaagcgtgactcaactgctgggaaaatgacccaaatctgtgtcatgacacccaaagaaggcgctgctcatggaagggccacataagcagcctggcagaagacttggatgccctgtctacctcacactcagcccaccttccctattttagatggcagccccatcacccacacctgtccaagctcaaatctctagcttcatgaactctgagagcttccatattccccatacctagaatatatgggtaatggggtgtgcatgaaggattatgggatatgagaaggccaaagcggcaaaagcacaaggcacaccttcctagggatttagattttatcctaaagcatatgaggagccactggaggattttaaacagggagcaacatactggggtggaaacctatgggcaaggctggaggcagggctttacctgtgagagctccccgacccccggcaaaaagtccttgaaagtccactgttaacttttttttttttttttttttgagacggagtctcgctctgtcgcccaggctagagtgcagtggcgcgatctgggctcactgcaagctccgcttcccgggttcatgccattctcctgcctcagcctcccaagtagctgggactacaggctcctgccaccatgcccggctaattttttctgtatttttagtaaagacgggatttcactgtgttagccaggatggtctcaatctcctgacctcgagatccaccagcctcggcctcccaaagtgctgggattacaggcgtgagccaccgcgccgggccaactatttctttattcataccctcatctctgttcctaaggccactccacagtgcagatattcatcacccttcacatggattcaggtttcagctccctaaaccagtctccccaccttctgtctcttgctctttccaaaaacattctccatgtggccaccagagttctccttttaactaagtctcattatttcactagtccccatacccctgcttaataatcagtagctgtgtagctttgtagctcccacctgtaatcctagctactcaggaggtaggaggattacttgaggccaggagttggaggctgcagtgagctatgactgcaccactgcactcctgcctgggcgacagagcaagaacccccatctctaaaaatataaaaataaacaatagcttccccttatcttttagataaagtccaacctgattataaaacccatctcacccagggctgtctcctcgcccttctcccaccccacattccaaccataccaaaccaacgacctggaattctctgaacattctgtaccttgcacctccacacctttgcacatgcagtctcctgtgtgaaaggtcacaggagacagctatatttattttcaaaattcagctcagacaccatgttctctgcgataccttcctaagctatcctcccctacaaaaataaagttgtcccatttaggtcgggcgtggtagctcatgcctgtagtcccagcaatttgggaagctgaggcgggcagttcgcctgaggttaggagttcgagaccagcctggccaacgtggtgaaaccccgtctctactaaaaacacaaaaattagccgggtgtggtggtgcacagctgtaatcccagctgctcaggaggctggggcaggagaatcgcttaacttgggacatggaggttgcgtgagtgaggcgagatcacaccactgcactccagcctgggcaacaagagtgaaacttcatctcaaaaaaaaaaaaagaagttgccccatttgctcttatggtgcctctatcagtgtacaaattatattgcatgacaattatttgttaacatgtcagtctcctttctggactataaattattgaatggcaagggccagacatcattcttctttgtttttcagcactaagtaaaatatctagcacacacatagcatgccctaattaaattttttctaagggagggaatgtatgaaagctctaaattaaagcccttctcttgctaaatctgaagattctgcctaagttctcacttaggctaatcagaatgtcttcataggtcccagcatctgacttgtgtcaggtgcttattcaacagtgcctgaagaccaggcacaatggctcacgcccgtaatcctagcactttgggaggccaaggcaggcagatagcttgagcccaggagtttgagaccagcctgggcaacatagcgagaccccatctctattaaagaaaattaaaaaacaaaaccaaaacagtggctgaaggaataaacccatgaatcatatgtcactaaattcttagtcttggttgcccttctgaaccttctttagatctctatgctcctctgaagttatcaaagatagaacaaagtccagatattatctatgcagtaatatttcatttatctaaccataactactcagatgaagccaagaagcaggaagaggaacaggactataagtgaccaagaaagacagtaatttgaaacataattcataattcatggttttcactgaatctcattccattctcacaacagcctggaattaaacagtcagtgcacctggctcaaggtcacatagctattgagcccaacctcaaacacaagtgtgtgcacaagtgctgtgcacctttcactctatcagagaaatctcaaatgtgtgtcacacatgtgtgtacaaaactctatgcattttactcactgaagagctctgcatacgaaccataactgcggctactttgcatgtattctttttgttttgttttgttttgtcttttgagacagagtctcgctctgtggcccaggctggagtgcagtagcatgatctcggctactgcaacctctgcttcccgggttcaagcgttcctcctgtgtcagcctccctagtagctgggattataggcacccaccaccacacccagcttttttttttttttttgagacagagtctggctctgtcacccaggctggcgtgcaatggcgcgatctctgctcactgcaacctctgcctcccgggttcaagcgattcccctgcctcagcctcccaagtagctgggactataggcacgcaccaccacacccagctaatttttttgcgtttttcatagagacggggtttcaccatgttggccaggatgatcttgatctcttgacctcgtgatccacccatctcggcctcccaaagtgctgggattccaggcgtgagccaccatgcccggccttttttgtatttttagtagagagggggtttcacgatccgcccatcttagcttcccaaagtgctaggattacaggcatgagcgactgcacccggcctttgcatgtattcttacaaggatgtacaggcacgtgaatgtgtacatgggtgaatgaggatttaaacatgtatgtctctatacccaaattagaagcagaaaattggccaggtgcagtggctgtgaaatcccatctcttctaaaaatacaaaaaattagcttggcgtggtggcgggcgcctgtaatcccagctacttgggaggctgaggcaagagaatcgctggaactcgggaggcggaggttgcagtgagctgagatcgcaccattgcactccagcctgggcaacaagagggaaacactgtctcaaaaaaaaaaaaaaaaaaaaaaaagcagcaacagcagaaaattaaaaagggttgactggcagaggtaggcacaaggtcagaatcgaggaacaagagctgtcagaaatgacacagacaaagatagttaaaataatagaattctaaggccgggaaggtggcccatgcctgtaatcccagcactttgggaggccgaggtaggcggattacctgaggtccggagttcgagactagcctgaccaacatggagaaaccccatctctactaaaaatacaaaattagccgggcatggtagcacatctgtaatcccagctactcgggaggctgaggcaggagaatcacttgaacctgggaggcagaggttgcggtgagccaagatcacgccattgcattccagcctgggcaacaagagcgaaactccatctcaaaaaaaaaaaaaaaaatagatttctggtattttaaaggaatgcagccatcttagaaatattacttagatgaaatgatccttctctgcacatgatataattaaccatatgcccacatttgagggtgctccaagaccaatagatcctaaaattagttttgccagtaagcaacctaccagatcatctgcaagtaatgcaagagaaatcacagatcatatttaagacctcagtgaaggctgggcacagtggctcatgcctgtaatcccagcactttgggaggccaaggcgggcggatcacctgaggtcgggagttcaagaccagcctgaccaacatggagaaaccctgtctctaataaaaatacaaaaattagccaggcgtggtggcacatgcctgtaatcccagctacttgagaggctgaggcaggagaatcacttgaacccgggaggcagaggttgtggtgagccgagattgtgccattgcactccagcctgggcaacaagagtgaaactccgtctcggaaaaaaaaaacctcagtgaaaacccccttcttgcaacacaaagcagtgccttccacccctccctgactgttgccatgtatgacaaacatcccatatgcagagatgagtccaggccagacacaaggacacacaaaacacagaaggaccccacagaagacagccagttctctacacaacagtaaaatcagagaagctggaaaggaagttgaggagtgaatggggcaatacagaaattgaaagaaaaaaggacacaaactgattggagagcggtgagccaatgagcaattgcacctggtgcaaaattcctgtgccccaactgctagagcagctgcccctcaaattgacagaatgtctgagcttcttcacagttgcagggtggaaggcatctctaaggtcctaggctctcccaggttggaagggcatttttcaagaatagtggcatctgagggatggggctatggagaatcatcatctcagcacctccaatggctttactgaatgtacagatttaaataatgttttatttatgagatggagaaaaagccaaggtggactgaaatgacagtattaaaaatctagcccacagaggccgggtgcagtggctcacgcctgtgatcccaacactttgggaagccaaggcaggtagatcacttgagctcaggagttcgagtccagcctggccaacacagtgaaaccccgtctccaccaaaaatacaaaaaaattagctaggcatggtggcacatgcctgtaatcccagctactagggaggctgaggcaggagaatcacttgaacccagaagatggaggttgcagtgagctgagattgcaccactcaagcctgggcgacagagtgactctatctcaaaaaaaaaaaaaaaaaaaaaggaagaatccagcctacagaaatactcatgcagctgcaaaaagatattcactggagcattatctgtaagactgagaaactgaaaccaacgtacatggccattaacagaggaccagctagataaataaactactatgcatccttaaaattcacatgaaataatatgaagcattttttaaaaagtagatctgtaagtagaaaagaatgtcactgataatgctagaggaaaagcacactgtagaattacatgtagactagtatgacctcatttttgtaaaagaacaaaactacacctcttttttttttatttttatttttttgagatagagtctcactctgttgcccaggctggagtgcagtggtgcgatcttggctcaccgcaacctctgcctcctgggttcaagcgattctcctgcctcagcctcctgagtagctgggattacaggcacctgccaccacacccagctaatttttgtatttttagtagagatggggtttcaccatgttggccaggctagtctcgaactcctgacctcaggtgatctgcccacttcagcctcccaaagtgctgggattacaggcataagccaccacaccctgccaaaactacatctcttgaaggaacaagaaaaaaaaatcagtgtgcctgtggtccctgctactcaggaggctgaggcaggaggatagcttgagcctagaagttcgaggctgaagtaaggtataatcacaccactgcactccagtctgggtgacagagcaaaatacctgtctctttaaaaaaaaaaaaaaaaaatcaggaagaatatgcaaactgctaatagtgcttactgtgagaagctggggaaaaggtgagtgtttttgcgatacactgtggtactgtttgaattttcacacaaagcatactttaactatatatatatatatatatgttgtcagagacattcctctctatctccttcttactcccagactgcactcacatcccagcctctgtccagccctccacccaccacctcctaccccagccccacttacaaatgcaggcagcagccagcaggcggctggcagcataaggggcgaagcagctcgggaagagaggctgtaccatgtagttggcaaaggtgatggcaatgatggcctggctggtgggctcaatgatgagcagggaggtccagagtctgatgaaagcaaggaatcctccaaaggcctccaggatataggcatagctggccccagatttcttaatggtggtgcccagttccgcataacaaagggccccaaagacggagaagaggcccccgacagcccagatgaccagagagagaccaaaggaggcactgtatatgagcacacccttgggggaaacaaagatgcccgagccgatcatgttccccacaatcaggcacacgccgttaagcagtgagatctccttcttcagcttcacctgctccggccctgggctggccccatcacccaaaggggaggtttccacctcaggctgggaggccacttcatactcagtgctgtcaaccatggtggaggagaggaaacccttcaccagcttcctggcattgccctttaaggaagaaagatgatgctatagattaggtggttggcaattacatagaacctctacccgcctccaacacagggtaatacgggcagctcaccaaccaatgcggagacctccaaataaccttttctccagctcactcatcaaaacaaccccaacttgaatatttgtctatctatctatgtatttatttatttattgacagagtctcgctctgtagcccaggctggagtgcagtggtgcaatctcggctcggctcactgcaacctcagcctcccgggttcaagcgcttctcttgcctcagcctcccaagtagctgggattacaggcacctgccaccacgcgtggctaattttttttttttttttttgagatggagttttgctcttgttgcccaggctggagtgcaatggcgcgatctcagctcactgcaacctccgcctcccgggttcaagtgattctcctgcctcagcctcccaagtagctgggattataggcatgcaccaccacacccagctaattttgtatttttagtagagatggggtttctccatgttggtcaggatggtctcaaactcccgacctcaggttatccgcccgcctcggcctcccaaagtgctgggattacaggcgtgagccaccttgcccagcctccaacttgaatttttaagagaaggcactcattcgccagagagaaaggatctgtctctcatcattaggacattgctgcccacccgactcaccaaatagagaactaaatcttgggccgggcgctgtggctcacatctgtaaacccagcactttgggaggccaaggcgggcagatcacctaaagtcgggagttcgagaccagcctgaccaacatttagaaacccagtctctactaaaaatacaaaaattagccatgcgtggtggcacatgcctgtaatcccagctgcttgggaggctgaggcaggagaatcacttgagcccgggaggcagaggttgcggtaagctaagactgggccattgcactccagcctgggcaacaagagcaaaactctgtctcaaaaaaaaaacaaaatcaaaaacaaaacactaaatgttggttctctctgagcctgctataatacaagacaggcatgggggcagtgtggcggctcccagaaaataactataatggcttgaccccgagttttcagccttatccaaaacccgtcttccctccaatttcagcttcagggatcacctgtgctgaggtacaacattaggaactgaccctaccagcagctaatctgtgggagcgtctcatgacactgctcttttccccaaggactctacgtctgccaaaactaaaggcttcagaaacctgctggaaacccacaaccatcctcctgcccaaagagcatcccttaacccttagctggagtcttcagccctggcaaagcccaagtagacccacttcaccctgaaagaagacaggctattatcttttccttgcttttcctttcccattctctggtattctaagcctcctgctatcgatccctcacatcagcatcgttgaatcacccaaaaaagtatgaatgagagaagggcgatccaatgtaccataaaacctagggatgattggaggcagctgatggccactccctaccccagagttgctgctggagagatatcaccccgagccaaggcagggagacagctgcagccaggcagcacatgctggaaaacaccgaacaggagacagctgagaggaaaatgggagaggctagtcaagcaatggagagatgttagggtgagaggcactcgggagaagaagcgattagacactgcacagcagcaaagaggagggttagcaaggtaagtggagatgagaagagggtggaacgcacactcactccttggtcctggatataagcaggttctcacggcagtgtgagcagcagtcagggagagaagtgccttccaggatctgtggtctgatgctcctccttcccagccagcagtaaaagggaaggccagacaaatgcctatggatttaagcaagaagggtggaggaggtgaggcagcccgcaaaggaaggagtgagggagggggaaaggagtattaagcaaccatctgggtccaaggttcactggcccttcacatctgcaaaaggggcagctaggagctcttggctcagcactttctgtgataagaaggtgctctctcaggaatctcctttgtcagctctgctctgggaccaggggcccagaagaaaggacagtcagctgagtgcagtatctgtagccctggggaagctgtcccagagcaagttagctgaggacaggacagtagcggggaaggaatacacagcactctctctctctgtgtcctccatgccccaccctagcctctcttctctctcaccccaagcatttaagaaagggaggaaggttgcacagtgtgacacaaaggcttgttcccatgct
